United States Patent 11,001,841 (CCCTC-BINDING FACTOR (CTCF) RNA INTERACTOME) - sequence listing, part 43

SEQ ID NO: 102333 - DNA, 1024 bp, Homo sapiens
tagaaggaaaacaaagggactttgttttgagtggctctaaattacgtttaagttaaaacagttccagagttgtcttccttagtagtttgcagttgccttttattcattcttcagaaattcttcagtttaggaaagtgagtaaatagagaaaagcacaacattgtggcagttttcaaagagaaaaatgcctgtttactgattttcaggagcaaatcatctatctatatgaaattttgtcttaatctgctccatcaaatattgcccagctaagcagggaaacacagctgaaatactccataaggagctgaaggcttctttattcactgtttgtgccccagtgtctggtcaggtgcagaatgtctagtttggcttagtaaaagaaatatattaataataaatttactattatggcatctaactggaattacttaaaagtctgattaattacttgaaataacagtccaaccctgtggaaaataagataaaaatgttggaacaacttaattttagtatacattagtattattaaattttgtttgttttctattataaatcgtagcacttgggctgatacactgtagtgttatttttgttaaacattttatgtacatttaacttatggctagtctgtaaaaactcatatggtttctttatgttgagcttcataatgctgttatttgagtgttcactgatttttccccccattttttagtttagttcaaccaaggtgaaaaacaaaagcaagaaaaagaagccaaaggattcaaaggtatggagtattttctgtattaattcttgtctaaactctccaaaatagttagttggacatatacattagaattgagcaattcttgggatattttgaaacatttgtagagaaagactttctaggacttaaagatgttttggcagtcttctacattttgaagaaattccaggttcatattatataatagcaagtcttgacactcgtattctttattgtcttttttatttttctaggtatttctgagtaaaaaaaaaa

SEQ ID NO: 102334 - DNA, 1035 bp, Homo sapiens
tttctctttttatttaaaattcttattggcattattatctttcctgaataaattttttgttgttgtttttagaataaattatgtaattacatagttgaaagttatgaaataactttttgatttccttttgctttcccctgctcccagaaaagttttaaatgatcattttctaggaggtagacaaaattttctttatagtatcattgattgcagttaaccttatgtttgttatatttgttgttgaggaaaggttgagatcagtgaaaagtgaaacagtgttttcctttgggagaataaaagtttttttcaaatagacatattcaagtacttccttatagtaactcatgtaaatgtaaattttttccaagttacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagca

SEQ ID NO: 102335 - DNA, 1038 bp, Homo sapiens
cacctaaaagtaaagccaaagttaaaatgttctgtttatatctaaaatatgtataatatgtgcagctttttaaacctaataaataatcgttggtgttaattgtggagagtgacatttaaatcaaactgttgatctggtattgaacccttctaaagcaaatattcagaactaattatagtatagattggagaatttatgaatttcaataatatgaatgattatatttataaaagtgctggttttgctaagcagtgtttaggggtttttaattcctgaatgattgtgacatttcccttgtaaattttcatctgctttttactctcctttgtttattttaagaaacagtaaagaacaagatcataagtaggcattttaaatgatttttaatagattgttttgtaattcacttttagggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaaggtaatcctgtctgaaacctgtctttaattgcatgtagcatagttaggagaatgtgagtgtagctgtgcttgtgcggcctcagctgaacttctgcattggtggctaaacaaaagattctttctcagaatcgcctgcttcagatttcttcatgacatattaaagtggctgttgccatgctttagaacttctgcaaactgccttatgagaaaggggctgtaagtctgggttttcgtttagctatagttcagtttccctggttaactaaaactctattttatggtgactgagctctgaggtaaattcttgtttatattgagaggcagcataggaatagaggttcagaatgagagccctggagacagactggctgggttcagatctaggcatggttctatactagttctaatcttgggcaatttacttaacttctctgtgctttagttccttacctggaaaatgtgagtaataataactc

SEQ ID NO: 102336 - DNA, 1158 bp, Homo sapiens
atcttcatcttactcctaaggaagtataagaataacacatggagccttagacatactagaactgtaaagtcacccagagtattttgttgagatctgctgaccttgaattctgttagtcaagactgatcatcagatacatggctagtggagggatagcaattagtggcaaagccagattgaattagtgagaaaatggaatcacagatgtgaggaaatcatggtgcatttgtttttaaaagctaccatcatctgtttagaaaggtaacaaaagaatagtaattcatttaagaaaggaggaatttgttccagaagtctggatcaatagctgggataacatattaaatagaagaaaactagcttagtgggaccttaatcaggaaacctatttactaagattttagtagaaatcttagggtcagtttgtaaaggtaactgtcataacattccccaggacctgtttatactcaagatgaggctggggagagtctaaggacaagaagaattagatagatcctgagactttactcagtttcctggctgggagaagtaaagaagaacaaaatcctacacagcatagtgacacatggaacacaagtttctataagctacttgtgggtttaacaaaacaaaatagttttataaactttatattgcctcaggaaacttcagttttaattcccatgtgggaattcctgtagctgcctgtttgagtgatgaggcagattggagacatagtcttaaaggtagcattcagccggtgagatatctttctttctggccgaggctttcctggctttataaattgctggtctgactgtgtgttctgtgtgcacagttcatcaaggctctttctttgtacagtcagtccagaagagtctcggaaataaagcacccagtgggagggccccagctctcaggcttttttttaacttgttaaggctttgagtctgctgttgcgtggccctactcaagagtgccttaaaagggcaattactaagccccccagatcacaggcctgataagttattagacttgccacgtaaaatgtatacctattccctaccaggataagtcgctaatctgagttccttgggttggtgtccacataagagtagatgagatttagccacagtcatttctttattaatggtggttacg

SEQ ID NO: 102337 - DNA, 1929 bp, Homo sapiens
gatgtgggaagaactggttcctatgttaaagggaacattactgagctgttgttcaatttttgccacctaagaacagttgtcctgtgccaaaatcaaccttatccctgctgtaggattcagaaatcttaaaggaccttgactggttagcaaatctgcctttaaaaaacatgaaaaccttggtgtctaaggctgaagagggagtagtggtctcttaagttgatagagcttttgacctgagggccatgatttcctatggaatccatgtaggttgactttagtgtcctttcttacagagaagacctcgagtttctatagctgaaatgacctacgtgtgctctaagcctaagcaggaagttcaggctgtagggaacctgataggaagtaaaaaattaaaagtttccctaaagcaaatgtgaagttaggatttcattaagccgtcattgataatagtgagattttaaactagaaaatatttgtttcctttaaatattgctttgattcacgtttaaattaattattagaaatattaacatagggaatgttttacttataagtgactggtatttataagcatgtgccccacccaaaccccttgctacaattaaatagatgatacttcaaaaaagacatcaaacctttagagaatgtgtagattcagaagtttcaaaccagcaactacataggaagttgacaaagagggttaggtgtcaagtggtgctgtaccaaaccctccaggggaacggtaactagcattgtctccaaagaggttttcatttctctttgtcacactgcctgaaattctggcaggtatctcaacccaaatgcctttaatgaccagcaagaggattacatttatatttataaaagcaaacaaaaactattggccttgccaactaaaacatgcatacactccctgtagattagagaatcatttaggctggagagtaagtgtgaacacttctgggcacgtcggagtggttcttcggggtgtcttactgtaatcaggtacacgtagcgggtaggatgtggctgtctggtgtgacttggtgtcccaggcttggctggggggcatagtctgccacagggcgccagcttgggagtgtgttccactgaacttaggtcattgtttaagctatggcaccgtcacaattctagcctttcagtctcttttgttaaaaagtatattttgccatttatttaagtactttctaaatgtttttagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtaagtaatgattgaaaggcagtaatttttatttaaaaaaaaatattgtggcttttggttattttcacatttttgatatttaatattaaactacatcaagtaaagtaaaaatgaatactgttttcattgttttgtctcatttaaaaaagtattcattgagtaattatctcacctgaatttttttctaaacttaacattttttcagataaattatataaaagtgagagtagcatggaactgagaatccccaaggaactgacttccttccagtttgaacaccatccctttctctggccctcttttttcttatcagcaaaacatgggggctggtctaaaatctaaggttcttttcaaaagtaagattctgtgatgattatttataattacttttatcctgaatctataaattattaaaatttgtcttgtagtgtgaacgatttgataacatatacagatcctaggaatgattgtcaggtgggccaagagtgtgttttaagattctctgtgatccatccctaacctccctctgctcttaacagtgataggtcaaattcttcagcttgtttt

SEQ ID NO: 102338 - DNA, 1018 bp, Homo sapiens
ctcagggtagcatgaaagaagaggcagaacccgccttgtgcagggcatggctcaagaatcggagattcacacacttgttttgaaggattatcagagaatgtgagtgtgtgtgtgcgtgcgcacccgcgtgtgtgcatgaatgcttgttttgactttaagttctgttttaaagagtagaaggctgttttcattttgaatgagaatccacatcttctcattttgaataagatctctggttacactgatgatgatgccgcagtacctgtgttctctgcttgagctgcacatcttagactgagatagggtgatttacctgtaagcatatgccttagagtgaagaaaaaggtgatctggaaggaaaatttcccaaaagggaaatgacctcaaattattttcctatttagaagatactaaaaatgaaacaaaatgtaaaaatatatatattaaaaaatcaagaaatgtttttaaggatatgggtgcaatttactgtgtgggggtcctgttaaaaatttttcaaaattaattaatatttggtgattatgcttttataggtatacccagaaaaatgatggaaaggaaaaggaacatgaattacatctggatcagtcccttgaaatcaggcaaattaagcttaaatttatttttaatatattttaatacttttaatgccaggagtacaagcacagtagactttgaaatatattgttgcttgtctatttcttttaaataattatgtttctgttttctttatttctatttctgttgcattttaaaaattaatttataaatatattctttgaatatttaaatatttttattttacaagatttctgcatttatttcccattgtcaatataaaaatactgaatttattgttgtcaactttttttggattaacttgaaactataaacatgttgtaaaaacttttcttttgtgttacttggaatattcgtctccactgtaggctggtagtttgttgctgttattgctttataattataggttcattaaattttt

SEQ ID NO: 102339 - DNA, 1054 bp, Homo sapiens
cagcctctcgagtagctgggactacaggcacgcaccaccattgtattttttgtagatatagggttttgccatgctgtctaggctggtcttgaacttctgggcccaagcgatccgcctgccttggcctcccaaagtactgggattacaggcctaagccactgtgcccggcctatacagtttattaatgtcaccagattgtactccacctgccctcataaaaatggtgaactggaacagtaccctcaccttgattctcagcatgcccacctaatgtgcacttccatttcatatctgcctttgatcacttataaagcacaaagagcacacttgagcctgtgtattgtgtagtaaaatatgagatgagaaactgctctggaagatgtagctgaggctatcgtggtgtggtttcaaagctcatccagcctgaaacctttgtcatctcactgtgaaattttgttcaagaaagttttttttttccttcaatatttgtagcaacacacttacaaatgagaaaatgaaaatagaagagtatataaagaaagggaaagaggattatgaagagagtcatcagagagctgtggctgcagaggtgagtccatgacacttagtgaccactatggcatttgtcatttgtttttgtgtttctttaatgacatatgaggcataacagacattactgaaaagtgtggtgcataaaggatatcctgtaacccataatatatcctccctaaaacgaccactctttttccttgcctatagccttgtaatgttttaccggtattatgttgttacttaaatgcactcatagtgtacaccaaattttgtaacctgccttccttatttaccattataattcagccatttcctatattatacactttgaatactttcatcatatttaatcaagtgatgtaccatgaagtagccaaccatatttgccaatacttggaaaggaacttgaaaataatccacatattaagaatacgctccttctgcccctagaagaatatatagcaatgtcagtacactgtttcagaaactactgagacaaaaa

SEQ ID NO: 102340 - DNA, 1050 bp, Homo sapiens
attttacatttcctgcagtgattctcacaaaaatggccagttggtttgtggggaagccacagagagtctaaaatcttaaaagcataccccgaagcttttgatgcccttgccgagaacagcttctctgaggcttttctaaacttgcagaggatgcagcctttattaagggttattctgctgcaggaccataggtaatgcacactcgtgtacacatgcagttaacctggctctgtgcttatatatagcttaagcagaaagccatgtacagttattcatatctgcaaaaaggatcatggaaggtatgcatttgtgatgtcattttgttctgttttcaaatctcaaagtctaattcatgttcacctatgatacaatcaagttctgatgattctgtcatgcttcatttaaggagaaatgggaaagtggtttgaatgtttaagttttaacctttaaaatagtttcaggctgtcatttgtaaaatactcatatgtcttctgatctactggcaggtatccgtacttgaaaactggaaggagagtgaagtgtataagctacagatcatggagtcacaagcagaagcctttctgaagaagctggggctgattagccggtattgcagtttcgtgggtgttctcagcacgtcatttagaagataaagctaggaccatttgagaaaaacattattttgtattaggaccattttatttttaatagttatataattgatacatgttcaattgtagaaaagttaagacatacaaacaaaaatgataaaaatcattcctaattctaaatggatagataacatttgtattttggaataaattcatgaagtgtttgaaaaaatgaaaatttatgaattatttttactaaatagtatataggaaatttattttcatattggtaattacatatctccaacctaattttgaaaagttggatagtaattgagcatagaaacatgtcatgatttaccaaacactgctgtgctggaacagtggagttgtttgtgaatttgtgttaatataagccaccctgcagtgagcatcctta

SEQ ID NO: 102341 - DNA, 1189 bp, Homo sapiens
agaggaggcggccccctgggatggagacagctctggggagtgtggtggccatgatgttccatctgtcagctacatggtttagctcagaaggggaaaagtgtaaccaggtagaggctgaaggagggccagtaggcaggcaaaatggtctcatcttacagagaaaatagtgacttatagagataattatttagaagtctgagccctcctactcttgttctaataactaacaagttattgtcaagaattcttttaaaacgaaaatatttaattcatggtattcaggtttcctgtgcacggagcctctgcgctgcgttactgtatttattcatcggcctttgtccttgggcgtttcatccttcaagggaagccctaagtgatccatggtgtggtgtgttcctcacaggttcatcccgagttactccctgagtcttcaggcgacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacaggtatgaacagaaaatgtctgtgactgtgtttaatactttatcgaactgaggtttcctgattagataaaatcatggctagttaggtgttaacatgaaaagggttgcataattgttttgctcagaaagacagttgctacatttctttctttttgtaaatatagagataagtattttcaaataaattggtgggttttttctttctttttttttttttttttgagacagagtctcactctgttgcctaggctggagtgctgtggcacagtctcggctccctgcaacctctccctcccgagttcaagcgattctcctgcctcagcctcctgagaagctgggattataggcatgcatgactaagcctggctaatttttgtatttttagtacaggtggggtttcaccatgttggccaggctggtctcgaac

SEQ ID NO: 102342 - DNA, 1049 bp, Homo sapiens
aattacaggcttcaaaattgaaatttgtaaacaatggggcagttaaaatatgattagccagcaggcatggtggctcacgccaggccgaggcaggtggatcacctgaggtcaggagttcgggaccagcctgaccaacatggtgaaaccccatctcttcttaaaaaaaaatggcaaaactcgcttgaacctgagaggcagaggttgcagtgagcagggatcgcgccactgccctccagcctgggcaacagagtgagacactgtctcaaaaaaaaaaaaaaagttatgctttttagatagttattgttgttatcagtggtcttcagattaattttatgtgcatttgtctttgtttctttgggttgggctgttggattaatattggcatgtaatatttcttagcagtagagaactttctgttgtcattcatcactcactctccctttcagcactgagcttgctggttttattaaaaaagtgcgaagcaaaaacaagaactcactctcaggattgagtattgatgaaattgtccaaagagtgacagaacacattctagatgaacagaaaaagaaaaaggtattttatctagatgttccagtttatccttatttatttataaaatatgagaattgttaaaaaaaaaaaaaagcttcaaaccaaaacctagagagcaatgtactaaagacagaagatggtcaagttgttggataactggttgcttccctcttgtcccctccccgccacccctgttattttcgcagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgtatgtataactgtatagttttgttttttaatgaaaaacaagaagcaaacaaaatttttaatccatgatttagccccattcatttctagacctaatttatttgatcccaacattagaaactgaatttcaatgtacttgaatgtgtcc

SEQ ID NO: 102343 - DNA, 1803 bp, Homo sapiens
ttctgattttgttttctccttttcagtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgagaagttcactgtcactcttgtccattctttcttagagaagtttaaaaatgcattcttctggaaaacttaggacatgtatgtcatgctaacattttaagagtgctttcgtcag

SEQ ID NO: 102344 - DNA, 1107 bp, Homo sapiens
cagttgtgctgtcattttagtcagcgctattgagaaagagcctaacgaacagagttttattttcttctgttccttttgaagggacctcatccatgcccatgtgtgatatcactgggaacttacatttgccctggcccttctccttgcactcttgaattcagacatctgttgagattccccaaccaggaatgaagacatgtctgagaggcagtgacgggacgaggtttctcatccccacacccgggtgctccccgtcaggtgtgtccaggctgccacgtcattatcagtgggcatctgtcccctaccaggacctgggccttctccaccctggtatccaggtgtctcagtgaatgtctggatctttaaacaaattgatgatgaaggagacctacgtttgctaataaacaaggtagaatggaggaagcatgctaatttgattggtggctgtcttttctctcccaggaagtgctctctggcgtggtggtcatatcgagtaaggattcagtccaacaccagggagtgtctttgaccatggaaggaactgtaaacctccagctcagtgccaaaagtgtgggtgtgtttgaagctttttataattctgttaaggtaagaaagaatgcttagattgcaagtttttagttcaatattgaaatgttgggctgggcgcagtggctcagggccaggcgcagtggctcaggcctgtaatctcagtaatttgggaggccaaggcgggaggatcgcttgagcccaggagtttgagagtagcctgggcaacatagcaagaccccatctctataaataaactttaaaaattagccgggtgtggtggtgcgtgcctgtagtcccagctactcaggaggctgaggcaggaggatcccttgagcccaggaattcaaggctgcagtgagctatgatcacagcactctactccagcctcagcaacagagcaagataccatgtctcttaaaaaaagacatgtttatggtgggtttcacttgctgtgtgcctttattgttatctgttgttattttgcaagggatggtggtagttacacttctgatatttactaatcaacctgcgaaaatggagatactttgtttctaagta

SEQ ID NO: 102345 - DNA, 1013 bp, Homo sapiens
gcccactgtctatgtctgcttggaggaaggagagtcagtgaccaaggagaacatacggaggtgacggcgattttggccgtgagagccaagtgtgattttggtgttgctgcaactcctttgcttagtgcagcagatgtgttcttgatcaaaaagttggactcaaatgcactgtaaattactttgtgtcttggaacgctgtaggggagcttattggttagaaaaatcctgcagtaaatctttctgtagtgtaaatataattcatttgtttttataaatccagaatgttttacattcttaaattctggcacatgtactcatgaaaatgacattgttaaatattatggttgtgaaaaacataaataagagatttactccccagcatagccaggttacagtgagaagaaatttatacactgtggactgagtactgttaccttaagaacctcaatactaccttaattgggcatgcccgtaatttcttatgaaaaaaaaaggagaaaccctatacataacagttcattattatgaagaaaaattgcaaagctaaaatgctagtttttttgtttttttttttaagcttaaatattctactttaacctgctggattcttagtaaatgaatgatcagttgtaacagtgaatgcttgttgtaaggacttagggtataaaaatttaaatctctgagccagaagagatcttaaggtaattttgagaggtatgaaccttttaggaatacagtcatccaaactttaagtaggtctcttcttctgccaataacctaatactcctgaaaaagcttgtctgttaaatcataacctaaactcttatataatgcataagaagcattttcagaattatccgagattgtctgaaaactgggatgcgatcaaaagtgttcatgtagttctccacttggtgtttgttgctgcaaatcttgtaccagcctgcgcctgagcatggtaaagcctgcttgaccaccgcggcgtgtttcgatactggacaggtctcagcctg

SEQ ID NO: 102346 - DNA, 1017 bp, Homo sapiens
tcgctggaacccgggaggcggaggctgcagtgagacgagattgtgccactgcactccagcctgggcaacagagtgagaccccgtctcaaaaaaaaaaaaaaaaaaaaaaaaagagaaaaagctacctttataatggagaaatctggtagtcacactcctctagccaagcacaacaatgaacaccacttcaccatcacaactaatgagacgactgacattcggtaccccttggcatgatgcacagagaaggccacaactcacctatgtagtattcctgccaaaaatgtttaatccgtatcagttcataaggaaacaataaggaatatccaaattgaagggcattctgtgaaacaagtagcgtggattcttcggaaatatcagtgtcaaaaaataaaggcgagataatttttctagactataagactaaagggacatgagaaccaaatagaatgcttaatttctgataaaatataaattcgactatggactataattgttgtatattggtgttgaatttctccagtgtaatatttatattttggttatgtagaatactccacatgctgaagtatttaggatcaaagtgtcaagccgtagactgtgcacatatgtttatgcacatatgtgtataggagaaagaaagtgaatgtggcaaaatactaacaattgctgaatgaagttaaaagctacatgggtctactttgtattctttttaaaaacagctttataaagataatttaaaatacgaaatttaccctttgaaagtatacaattcagtagttttttagtgtatttgcagagttgcacacccatcaccacgatctaattctagaacattttcaccccaaaaagaaaccctgaacccattagctgtcactcctcattccccctccctcctgacccctggcagtcacaaattgactttgtctctggagttgcctattcttgacatttcatataaatggaatcgtacactatgtggcccttttgactgacaggcttcttttacttcgagta

SEQ ID NO: 102347 - DNA, 1014 bp, Homo sapiens
gaggagggcaggcattaccaagttaaaacctcctgaaagacaactccattgggcgaccgtctgcgccgcacagcctgacgggagcgtcatccttcctgcgcaggctgcaaccgacagacaggctcggctccgcctccagccgcggggcacgcggggagagccgttcctccctccctccgctaacccggacagcaaaggagcatttccggcgtaagactgtccctacggaaggggtggggctagcttggccccgtctttcacgcccagagggggcggggtgaaccgtgacagcgcttcggcccgcactaaggccggctcttgtgccggaaggaggaaggcgtgggcattcgcccctcggagctagggagtgtgtgcgacgccgctgcgaggtcacgtgagccactgccggcagagagggaaaggggcggggcccagaacgaagcggggaggcgccccttgtttccctggggtcacgcgcagccggaagtggcggctgctgcggagaattggagatggggaccgccctggacatcaagattaaaagagcgaataaagtttatcacgccggggtaagtgggggctgggggtggggatggaggtggggttgggcgggtctgcaggttccgctgtctccatcgctctgcgcacgtcccgcgtccctaggcggggcagggctgtcccgccaggtgcgtctccgccaaggtgggtgcgttcccgccaggtgcgtccccgccaggtgcttcccgcgcgaggctggctgccctgcgaggaggccccagggcaggcgccgccgccgcatctgcgggacgtgcagggcaggcgcccagctccggggctgcgctcttcccatctggccccttgaacacccggcggtgttgggttctcaggcttgagctccctcagtgagcgctgagggcggaggagttgacgaccaaactcccctttccctctctcctaaggtgaccgcaaaggtctaatgaacgaaagctaaaacaaaccttggaagcagaaatg

SEQ ID NO: 102348 - DNA, 1152 bp, Homo sapiens
tcgctcctctcggagccgcgggcgctgggtcacccgccagccgggctccgcgggccgcgagggattgtgggtgttccccaggcgcgtgtcctggaaccgggtgttaaatattcagatccgtgcgccccgcgtgaagggtggaaaggcacggcccccaggctctggggcttggagattggttgcaaatgaaagactgaaagctggagtgaatctgcctattatttttattcccagcaacagctgaccccagatacagtttgtgggggtggggggcgttactgcagggcagggcagtgcactgttaacgtacttcgtttattgagttaaaatctcttgtaaatgttataaatgaggattttgccaataagcagaaggtcaaatttcattttgacaaatgatttaattaaataatgcggtgaaaagtgctttttgtttaaattctttgctttttgtttaaattctttgattctgatcattattttttaaagtgcattgcttttgggataacatcagaaactatctgtaaaaagaattagtatcacgaatgcctccctcttaagaatataaaatgttttacaggccagcagtgatggtgctgcagctacaattgcatttgaaggttaataaatggtattttcaaatattcaggtcttggtttgcagctcctctctgccctcagggctttggtctctgtcttcaatgttttcctggcaattcaaaactcagcgattttagaacaattcattagggacttgaaaatcacagtctagtctatttgaattcaagaagtggatccctttccgctagactcacccatcattttcaagtggtaaaaaatcaatctcagtagacactgcagagaaacaggaaaagaaacacatgtatcaacattgtatacttggtttttttgttttgttttgttgttgagacggagtctcgctctgtcgcccaggctggagtgcagtggtgctatcttggttcactgcaacctccgcctcccaggttcaagcgattctcctgcctcagcctcccgagcagttgggactacaggcatgcgccaccattcccagctaatttttgtattagtagagatggggtttcaccatgttggccatgctggtctcgaactcctgacctcatgatccacccgtc

SEQ ID NO: 102349 - DNA, 2619 bp, Homo sapiens
ttaagggttcctctgtgacccttttatagtttatgtgtccaaagtattaatgaatatatttagcattttgattttgaggtgttttaataactcaggggaattacctttagcttttgtgttgtttaatttctcatgtcttgatcagttactttaggataatattgttttcaagtagacttttaaaaatgtgagaccagaactaaagtttcatgtgttaaggttttaagctgcagaagatcatttcaaagaaactggttatgaaaaaagcttacttgattatagtcaagattttttacgcatacttcaggtatcccagtactttggaggattttccctggtatagcagtggtgtttatggtagctgtccaaatttatttatacttcaaaccatgccagaaagttaaggatttctgtcaatgtctacacctagttctcttgttaagactagtaaaaagttctcttgtaaaaagttcatttttacctcgagaggcataagctcagagattattgcaggaggaagggtcaccccttgtgtttgcgccatgaaggcacactcctttttacctggtgggtgttgaaaaaatatttgaaggaatagacctgaatgaatggtaattattggtaggggtgggaaatggactaaatgacctagtgagatctttgttttgagatctaagtataagatcatctcttaaaccttttaacaatattttggtggaacctattagaaacttaacacattattgtgtgcaagatatctaaaaataagtccagttttttagaggcagtaacatttaagataatttaaaacattccatattagtgtaatgtcttgttagggaatgtggacagtaaaaacgaccatttgttaaattttttttcccctccaaaatattgtctgatgtttgctccttcgtgttacttatggagagttactgtttatgacttaaagatatgggggtggagaggcctaggtaactgcaacaatgtatttaggtaatttacattaggtttttagagggctatgactatctgcaaaaggaaaattcaagataccttgttataaacatggtatacagtgacctttggcatgcattttgttttgtaactacacgaagtgttaatttggattgaatctttgttttcacttgaaaaccttttttttttttttaagaaatagcttggaaatttaggctgccctgaggtgttttcgtgtgtctgtttatggttgacaagtatctagttatgagaagaaaatgtggatagaattaactgtattataggcgagaagggaattgccttataatcttgtgccactgaacacaagattagtagaagagtgggcttcacttgtgactttcttggtatttgtgattaggcgtgtgccagtttgtctttgctttggcattagctttcctcatatttgagaaggctttcacgtttcctgtacacacacaggaagcagtttcacccctccccaagaaaaaacttatctaaacccagcaaaacccaaaaacttccagaaagtctttatcaagaatttagttcctcatccccaaagttgtgttagtcttattttgtagtaatcataagcagttatttaaactgaaccaagaatctttactttctgttgagtgttttggtgattttacctccatatatgttcgtctattttcgatttagaagtaaagatattacgtgaaactattagtaatgtttcctgaaacttgatactaacagtttgctctgtgaaagtgaattgtgtgaccagtgtaatagcaccttatgtatatatggtggttttgccttttaaaagactttttaccagatgttatcttgactgttgggcaattttctgatggctagagaggtggtaatttatgacccaaagcttgctcaactttggattaaaaagtttggagagttaaaatttgtgtttaattacttggaaaaatcagcaaattatattaaattacctaaaatttctcctcagttgctcccaaatgaagaaagctttttgaaatcttgccttatgtcagtgctacaattttaagctagagttgtaaagtttaccatagagtgtttgaaagtgaaatgtagacttcatgtgactaaaataatcattgaaggttcgttcatattgggtaattgaagaaagatcttatttgttaatactggctaccagcagccttagtttgattattatttttttatatggaaacaaaatgatttggaaatattgcactgcgtaagccagctaggtatttaaaaagttaagcttttgctttgaaatcctacttccagagtactaaaacgagtgagaattgtttattggtgataataccctacgttgaacacgtgaaatggtgtggtttcttttgggcatatatgttttgctaatgtagaaccattttggtgtcttggcaattggttcttataccagagctatgtatcttctcttctagaaagcgatatttaaaagtttgtattactgttaaaactaggttttgacaagttacataatttttttttggtttggggcagatgctcatatctgatacatagtgagtaatagcttaaaatgtgtctttgttcttgtcagtgaatattcttgtttta

SEQ ID NO: 102350 - DNA, 1206 bp, Homo sapiens
cttgaattcctgtggatttgaaaaaagagaaatataaatatctaagattcccttaaactatgaaatattattagctctagtacagacttgggaaaactaatggttcccaaacagtcttctggagaacttgtcaaagttaagagatttccaagctcagatgcctctctttctgtaggtttagagtgatgctctggaatctgctttctttttttttgagacagagtctcgctctgtcgcccaggctggagtacagtggtgcgatctcggtttactgcaagctccgcctcctgggttcacgccattcttgtgcctcagcctcccaagtagctgggaccacaggcgcctgtcaccacgcctggctaatttttttgtatttttagtagagacggggtttcactgtgttagccaggatggtctcaatctcctgacctcgtgatccgcctgccttggcctcccaaagtgctgggattacaggcttgagccactgggcctagctggaatctgttttcttaaggactccaggtaatcctgatgcagtaggaacattttgagaaacaccaataaagttcatttctcacatattagagaaggaagtgggtgcagagaagctgagtgactaatcagtgcctcagaataagcaggcctgggactagcattgtttttcctgactcttcgttctttgttctttctacagaagagggaataaaggacaaggtgtacagagtgcagtgggattttataggaatagttatcatcttaaagtaagtatgtggcttttaatgtgggagcttatgtctagtgaatggttggcccagttgtcctttttgccctatagaaaaataatgtgaatatttaaatactcaagtgaatgtttaaaggttaagtgaatatttaaaggtgaaaagctgaaggttttaagtaaggttttgttagtatcagcactattgtgggcaatgtatatacagcattagaatagatgtataggcagctacttacttgacatgattagaaggaacaaaggtagttcttgtcctcaaattactactttccttttaggttgcttgtaattttcactgttggaattcatttcattagattaagataaaatctggaattctctagtttaaaattttaaaattagaatattcctagaggaatattactttttttttttttttttttttttgagatggagtttcacttttg

SEQ ID NO: 102351 - DNA, 2509 bp, Homo sapiens
gatggggtttcaccatgttagtcagggtggtctccatctcctgacctcgtgatccgcttacctcggcctcccaaagtgctgggattacaggcttgagccaccgtgccccgcatttttttttacttgacctatgttagaaatatttccatgtcagctcacagagctcccattttttaaaatttgggacagagtctcgctgtcactgaggctgaagtgcagtggcatgatcatagttcactgcagccttgacctcctgggttcaagcgatcctctcaccttagcctcctgagtagctgagattataggtgtacaccaccacacccagctaatttttaaattttttgttgagacatagtcttgctatgttgcctaggctggtcttgaactcctggcctcagtgatcctcctgtcttgtcctctcacagtgcagctgtgagacactgcccagcctctattgttcttaatggtcggaaagtattctgttctatggttgtacctctgtttagtcagactgcattaaaggacatttaagttcatatttttgctcttttaaacaatgctggtgcgtacttccttgcatgtatagttgtgttctgtgagtattggccataggatgtctatttataaggaaagtggctggttcaccaggtatatggatatttgaatatatgttgccatattgtcttccagaaaagtagcagtagtttatgctttcaccagcagtgtctgagagtgtatagtttctcaaatctcaccaacactgttgttaccttagatttttgtgaatgtaataggtgaataatgatgtctagttgtttggatttgcatttctttaattatgactgagtttgaacaccttaagttgtactataagatttttattttaaataacaaaataattcattcttcatcagatgtatgttatagttaaagtatttcctgggggccaggcatggtttctcacacctgtaatcccagcaatttgggaggccgaggtgggctgatcacctgaggttgggagtttgagacgaccctgaccgacatggagaaaccctgtctctactaaaaatacaaaatcagccgggtgtggtggtacatgcctgtaatcccagctactggggaggctgaggcaggagaattgcttgaacctgggaggcggacgtggtggtgagccggagatcacgccattgcactccagcctgggcaacaagagcgaaactccatctcgaaaaacaaaacaaaagtattttttgggttccctttatttcgttactctgttgattgaataactgatgttttgataaattgtaaatgcctacagaaaagggggctcttgttcttcttcaattgagtgaacatttgcatgtcctctgtatgagatatgagtcgtggtagaagcttttgattataaaagtgaataaggtttggttacatctgcttttaatgttgagataggtgtgtcaatacaggaaaacttgaacacagataagaccatggccgttaacagttagaggggttgacatgtggagagctagaagagcacaggaagtaagacaattatggggattcgagtgtgcattgtggagatgggactgggtctcgatcttgaagagtggatggatgggctttttatggtggaacctgaggacttgacagtctattggaggaagtcatgtgggcaatgggtggtggtgggaaatgaaggtgactttgaagaatgacagagtcatatccctggagcatcagatgagggagagagggagggagagtgagtttggtatgctcagggagtgaaggggacacttgtggacatgagagtggggttgagtcttaatattataaagatatgaatttggggcgattgagggtttttcagcagggattaggacagatctgtgggttggagggaggtgacactgtaagaaggagggtttggaaggcaggaccattctagatgtaatgtataggcatgagggaatacgaagaggtgaaaagtggaagacagatgggaaaaccttaaaaatattcttaattatactttaatttccaacagaccaaagtgagtatttctggattcaaacagcaacatggccaagtttttggagataggaaaaagagtattaagctttgttggcagtatactaaaaggttctaggaatgcagtgattaggttttagtgggacatggagaatatgtcctactgaggacctgaaggaactgttgaggaactgaagatagaattattattgtagttcagaccttacattagggacaggtggaaataatttgcagcaccattaaatatgagctaaaaaatagggcagtgggagagggcaatgtttgaagctgtgaatctgtaaaggaaaaggttgtatcataattcatggtttggaaaatggagagtagctgagcatgtgagcagtttcattttttctgagcatcttagtatttgcctgaaaaaaatctcatattctctttattttttcatgtatcctaattggaagactgg

SEQ ID NO: 102352 - DNA, 1022 bp, Homo sapiens
cgttttaagattcacgggagacagtttgtaggaaggctgtttgctgaataagacaaagatacagacatgcaaagtaaaggatgtgggcctatagggaaggtcaaagaataaggaaagttcacttgagtgagcagaaatggaagagggatttaagcaaatagatgaacaagaattgtctctcctaaaaaaaaaaaacctacacaattatttgatgatttattatgacttttggggtagagaccacgctagtcacaggatctgcaagccctgccacctggatgatctggctccagctggctcactgcctcttctcaccagtctctggatcatgtgactgtaccggctcctagtctttgcatatgctgcttccttggcttgggatcatcacttctatcagctcttctatcccttctatgcgctcttcgttttaaaaatctcatgtgtccttgtactcttccttcataacgcttattacagttgataattttttagtgcttatttgattaatgccctccagagatgaggaccagtagtgttttgctctctcttgcaatctcagtggttggcagggtgcttggcacatagtaaacactaaataaacatttgttgaatgaatcagtgaactacatgctttggtctttactagttggtctcaaggaccaaaaacctacagtaggaagatgtttgttggactaagagattagcaggaaatatgagagctttgaggaaaaaggaaaagatgaagttttttaaagataggattagaaagttctatgtagtcaggagaaagaaaattattcgtggaataattcaacaaatgcacatgaaatgcctactatgtattgagaattagatactggaaatgtggagtggaaagattctgtcttctgtattaaaggagtgtataattgtagtagtttactgaaatggggacagtccttagtggttgtttggagcaggtgtaagttgtggagagggatcagcctggatcaggatattcttcactcttctagccgacacag

SEQ ID NO: 102353 - DNA, 1037 bp, Homo sapiens
ctgacagaatagttcatttggattctttttggctttaacttcaagtttggacaacagaacaagaatgaggaaaagtttgtagtatggacaagttttcaaaagaatgagtcgtgtagttagaaaattgaagctgttgatcttgtcagctgaatgagctttcttaaagcttataaagggatatgtttgaatatagttttataacctttttcagtgactaatttctgtagtaaatatttggaaaagcaaatcatcacataattcctgcaggtctctttgtgcctggctccatgctaagctcttgggacataatagtgaatcagatggatattcatggttcctgccctcatgaagcttgctttctttttttttttaaaaaaaaaaattaaatttttttttatagtgatctcacttttacggggatctcactttgttgcccaggctggtccaaactcctgggctcaagtgatcctcctgcctcagcctcatgaagcgtaagccactgtgcctagcagttgaagctttcagttagtcagaactccctggagtgagtgtaaaggaaaacctggcttgtggattgggtgagcagttgtattgatttacttatttatttataatttcttgaacttagttttggtagcaccgttttaaactactttaaactacttgttgctttatttctggtaacatagggagtgtgggatcacacttactttaccaaggtaaaataaaaacttggatcttcaaccttttggcagattattttctaaaaaaggtattcttgtaaatctgagtttctcctcttaaaaagcaagctactatttagtaacagtaacaatagctactattaatcagttacctgcagcagaccagccactggcctactgaatgaataactatttattattagttattttaatatacctagaaagtgattggtattatccgtgtttacctccagataataaaaagcctaaacagttaagtgccgtaaagttgaacatttagagaaaaagaagagtttctgtaacccattaact

SEQ ID NO: 102354 - DNA, 2341 bp, Homo sapiens
tggaaagaatagctccatcttttgttctcattagttccttcctttcttattgtattatcatatatagcatttataaaattattatttgtatttgaggcatgtcttggtctgtttgtgctgctctaacaaaataccttggactgaataatttataaaaaatagaatttatttttcacagttctggaggctgagaagtccatatcaaggcaccagcggattcggtgtttgccgaaggcctgctttctgcttcatagatgatgcctcttgccgtgtcctcacatgatggaagggcagggcaacttcctttaacctcttttacaaggacatgaatcccacagttccccaaaggctccacctcttaatactgttagggcctaatgtagaaattctgtggggaacaccagtattcagactggtcatagtctgtgctgctgtaacaaaacacaggttaggtagtttacagaaaacaaaataatttcttacagttctggaggatgggaagtccaagataaaagtgttggcaggattgatgtctcgtgaggatccagtctttctgcttccaagatggcgtttcaaacgctgcaccctcttgaggggagaaatgctgtgtcctcacaaggcagaacgtgaaagagcagaagagaccaaacttcctctgttaagcccttttataatggcattaaccaatctgtgagggcaaagcccttatgacctgaacatcttccaaaatcctcatctcccagcactgttatgttgtggatgaagttttcaacaaatgaattttgggggacacattcagaccatagtagggcctttgatagattgagctgttttggtggggagctgtctctttctggtatccaggatgcttgccacatgatgtgtagtctcagtaagtgagtgcattgataaagaagtatccatgatgtgctttaccgacagcaggtagcagtactctctgttactcaagactgcctctttgtaagggtacaagtagtttcagaaactccactctctgtttagttgggaggatgtgctctcaaagaggttacctacaggcacatttttaccggagtttaataaactgtcttttttctgggtacatataggtctctggtctggaagatggggtcttgactccccaaccaccaatagtaaccatctggtaggagttttgaattatttgttaaagaagtatgctgatatgagatgtcacaatgtacaagcctcttttcaaatcaggagataaattatttcagaagaggtagaatgtttattttgaaacattttacaaacaggtttgttgtaattctttccttgtatttgttgtcatataacatgttgaggttatctgttgctgcttaacaaaccatggcgaaattcagtggcttaaaacaatattcatttctttgctcactgtgttccaatttgggcagggcctgtctccatcccacgtggcatctgctggcactgggcagtccaaggtgatggattcccttccatgcctggtgccctgggcatcttcctccaggtggcctttccacctggcacacttgggctttctcacagctgtgactggtttccccacaagtgcgcaaagttgaggctgccaggccttcttaagacttacaccttgaactggcagtgtcatctccactggattctgtaggccagaagcaagccacaggccagcccagattcagggggttcggggtggggtggggattgtacaaggtgtgaacactggcaagagtggtttattgggccaccaaggaacactaccacatgaaccaagtctctttctgaaagggaaaaagaaagataacttttttattctgtttgttttttattgtctaatcctactgaccgattcattttgtaatgcagtggtgtatttctttttttttaaacccttttttttttttctaatttttttaaattttattattattatgctttaagttttagggtacatgtgcacaacatgcaggtttgttacctgcagtggtgtatttctaacttttgctataactccattcaaatagcagtataaaattaatataatttttcaaattcagttgaactgtactcatcttgatacggatcataaatacagatttgggagtgaagaaagtagaacaatgaatactttatggcaggggtctccagccactgggccgtggaccggtactggtctgtggcctgttaggaattggactgcaccccatgaggtgagctttgggcaagcgatcatttctgcctgagctctgcctcctgtcagatcagtggcggcatttgattctcataggagcgcgaaccctgttgtgaactgcacatgtga

SEQ ID NO: 102355 - DNA, 5457 bp, Homo sapiens
tctgccttccagcctgggtgacagagtgagatcctgtctcttaaaaaaaaaaaaataaaagtgccgtaaaaatttttaggtggtattacaagttgtttggcaagattttgtgtacaacagccctgaaaggtaagtgctattatctccatttaggaataaactgggaaataataggtaaaaccctaggcttcttgattttgcgtaattaaacagactcagaaaaagttatctgtcctgtgtaactgccaatagcagaacaaactgaataatttatagatacttttgtttttacatagtttataaaataccaaatgacaacttgatgcctttggtgtcctatgtggaagactctgctttgtactttggcgatgtcaagttgaatgagacacattgtctgcccgtatggaagttacagtccagtagaggagagaagacttaaaaactattcattataatgtccttaagaatcattttctttttatgaatgagccctacaaccataacaggacaggttgtgaatatattgtacaagttcagaggaacggagaggccacgtgaggtgatccttttgtaaaaagcacagcttgagacaggaggagaaactttttttttttttttttttaaaccgcagagagaacagtgtcggttgctcagaggactcttctttctaccctggtgcatttactaggaccttgtaggcaaataaaatgatagagaaacttgcatagatgaaggatgtgtcccattccctgaagtcaagggaagcagagctaagattggttatgcagaccatgggctaggcactccctacaaagtcactttaatcattcccaacagtcttgtgagtagagagagcagagccctttagtggaaagagcatgagatttttaaaacctagaagtggttggcaatggtggggccaaatctggattgtgtgtggatattcaaataagtggattttccttttttataagacccataagactcttcctcctttttcagcacatttggtttgccttgattttgacaagagtgtgattgctgctaccccattatgaaattggggatagagatctgtggattcattgtcaaggtggaggatgcaggcagggaaagagtgcgggaaccattcctgcagagtttgtggtaggggacctttacaggaaatgtaaaggttaatttatttggcaaagattgtaccagatgtttggggtaaagtagtgaaaaaaagacaaatacagtttgtactttcatgttgttgacagttttggtgtggcattttaacatttactgttcttaatagaatatgtgacaactttctagacaggtactactgtttaggattgggtagctcagtgttgggtttcactgagcatgagaggcgtggagagtttacattacatgtcttccagtggttctgtctttctaaagcttgaaggtactcacgagaaagcagtgagactgtacatcattccaaatgagatgttgatgtagattaagcacagtttttcatcccagaatgcaaattaagaatacaaacacaggttgaagcatttttcataggtgacatttgtagaatgtatatattttaagaacatttggaaaactttttttaacctacttgtattagttccctgtggctcctgtaacaaatcacagatttagtgacttaaaacaacagaaatttattctcttacagttctggaggctagaagtccaaaatcagaatcattgagcctaaaccaaggtgttggcagggccagggctgtgctttaggaggctgtaggagagagccacttgctagtggctgccagtacttcttgacttgtggatgccagcattacttgacttgtggccacattacctcaatctctcctgcgatggttgtgttgtcttctttttgtgtcagattgccccctccctctctcaacatttgtgatggcatttagggcccaccttgatgatgaaggataatcccctcatctcaagattctcaacttaatcacacctgcaaagacctgtttttcccccaaatcataaaacatttataggtttcacagtgtaggatgtagatatcttttggtggaccattttccagcttatcacactcctataaattatttggaaaagtaggaaggttgcttttgaagtagcaacttgtagatatatcataagtatacttccagctataataagaattagtcatagttttataactttttagtgttaacttgatgatccaaatttgagatccaacctgggagacagctcccaaaattttaccacctaatctgttttttataacaatggttttgagcgacttttctctaaataatggaagttattgttcttttagggtcagtgtaagctgacagtggtaatttttatcaagtattaaaaatgagtctgagtttagggaaatgatatgaatgattggaatttattttagcatctaggaattttattgactgagaaagtgcagattgcagaagagtagccaaaaatatactatgattgtaccctttctaaagttgcttggttaaatcaaggttgaaaataggggccaggtgcagtggctcacgcctgtaatcccagcactttgggaggctgaggtgggcggatcacttgaggtcaggagttcaagacagcctggccaacatgatgagaccctgtctctactaaaaatacaaaaattgtccaggtgtggtggtgcacacttgtagtcccagctacttgggaggctgaggcgggagaattgcttgaagccgagaggtggaggttgtagtgagctgagatcgtgccactgcactccagcttgggcgacagaacgagattctgtctcaaaaaaaaaggaaagaaaataggttataattggactatatttttcttattgtgctatattaggtagttaattttggactggtctaatatagcccattgtgaataaaatataagcatatgtagtgtttaaaaaaaagatgttcacacttagaaaggtgccagtggaaagttttcatggtcatgagccaatcatgaacataaacgtgtgtattaattttaatatttgattttttttcttgaacctgcctgttttttaccttttacaaaatactttttatttctctacaccttaagatacgtattttgaagtttttcagatagtcttgttatttctagttcctttttttttttttttgggagacagagtttcgctcttgttgcccaggctggagtgcaatggtaccatctcggctcactgcaacctgcgcctcctgggttcaagcaattctcctttctcaccctcctgtgtagctggaattacaggcgtgccccaccacacctggctaatttttgtattattagtagagacagggtttcaccatgttggccaggctggtctcgaactcctgacctcaggtgatccacccaccttagcctcccaaagcactgggattacagatgtgagtcaccacgcccagccaattctagttcttttggtgtgaaatttggtttctcttttgtaatgaaaggttctttgtatctttcgcaattactgtgtataagctcttcttcacatgaactttggaaggtgttctacattttgagggatatacacattacatattttcaaatatttagagttaatattgttgcaactcctacttcacactgacaatttccacttcccacttcccattccccagttgccaaatgtagtagccataaagagcatcagattgatttatctgccatccctttgtgcaattgctgccatgtttttactcctacttatattatacattatgtacaattttattatttttgctttaagctgtattttaaacaactaaaatttatttttgtttaaaactctcagtttttaaatataagtatccaaaggaaaaatatttatgaaaactttgtttccatttggtatcagttttctgtcttaacactcttcggcatttcttgtgcagctctgctggcaaggacttctctcactttttttcccttcttacaaattttaatctctaaatgtctgtattcagtcttgagtttgaaggttttttcactgaatgtagaattctagattgatactttttgtcttttagcactttaatggtgttccattgtcttctggcttccattgtttgtgatgagatgtaagtggtaatgactatctttattccctcgatataccagtcttttcttctggctgctttcaagattttctatttctctgctttaagctgttttactctgctgtgcctgggtatggttatcatttgaaagattttaagctatggtttcttcagatatttatccctttttttttctgtgactttatttacttgcattatacaacttgatattgttccacaggtcactaagggtctgttcagttttctttagtcttttttctctctcttctttagacaattttctttccctttctctttccctttccttttcttttttgagacagagtcttactctgttgcccaggctggagtgcaatggtgccatctcggctcactgcaacctctgcctcccaggttcaagtgattctcatgccttagcctcccaagtagctgggatttacaggtatgcaccactatgcctgcctaatttttgtatttttagtagagatgggttttcaccatgttggacaggctggtcttgaactcttgacctcaggtgatctgccccccctcagcctcccaaagtgctgggattacaagcgtgagccactgtccctggcctagattagatagtttctattgatctgtcttccaagtttgctgattttttttccctaccatcttcaatatgctgtttaatttcatctagtaaattttgccctttggttattatgttattcatttttagagttttctttttgttcttttttttataatttttatttttctgctgagatcccctatctgttcacacattaaagaccatgtgttcctttaagattttgaaaataattctaattctttgaatgtataaaatagctgctttaaaatctttgctgctaaatttaacatctgttctaacatggggttggtgttttactgactcctttttcccccttattggatcacatttttctgtttctttgctgcctactaattatttttgtattaaaaaacaacaacagaggcaaggtcttgttctgtcacccagtctggagtgcagtggtgcagtggtgcagtggtgcagtcatagttcactgctacctcacactgctgggctcaagtggtcctcccacttcagcctcctgaataactgggactacaggtgtgccccactatgctcagctaattaaaaaaaaaaaaaaatatatatatatatatgtgtgtgtgtgtgtgtgtgtgtgtgtgtgtgtgtgttcaccaggctggtgttgaactccttgcctcaagccatcctgccttagcctcccaaacc

SEQ ID NO: 102356 - DNA, 1440 bp, Homo sapiens
aaaaaacaagctgagtggtggagacagttttcttttacattttagctgttcctctgattatatttcatggggtaggtagatacttaaatgattttttagtgatgtcggcctttgggtgaagatgaggcccactgagaggactctagagcagttgaaccccgcttcccacctagggttggaatcatggcccaggcagatgctgtgggtcccaagctctgcaggaatgactgggggctgccattcataaagcagctgtcccattattggatgtttttgttcttttatctattttctgcctagtctcctgcatccttttcctaattcttggctttagttctgttttcttcaactatagggagcgagtcaagtcatcccacctctgtgagacttgcttgattatttgcaggcatctatgcatgactccttccgtctttcattgtcttgactgcacagccttagtacctccagatccccacccacctattactttctcaggagttttgaactttctcactaacttttttaatgtggatctaggattgaaaagaatcgtgagcttaggaagcgttacagatacaaagactacaaattcaggtctcacttgtcaaatatcagaaaggttatttctgacagtcctccttccccaaatctaaatgtttccctcttttagcaatctttccctccctcataactttagcatggtgtatggtgtgtgcgtagtcatacattagtgtgatttttgtctgttttgaacactatactgtgaagtccacgaggtagaggcacagtgacagcaagcctcactctacatcttcagtgctggacgtcatccagtgtcatggcatcatgtgatttttagggtactattcatgtgtgttcagttatgtaaacttgtttctcagttgtatcaataggcgtaaataagttctcattgttgatgttattgaagtgtatccataagtatgtatggtcattcctctttttttttttaaggatgatacatatatttatttcttaaaaatttcaggggacgtcccagtgttagccacttcttgtcccttctgtggctacatccagttgtaattgttcagtacaacacatcaggtgtttgaaatgcctcaaatgtcaagaaacactaacttatctctggcataccgtactttttaaagcagaagtattttctgtaatggttactacagagtgtttactggttaatttttagttaaccagaagcatacattccatagctattccagttaactgaggtttatatccataaagacattaccagagatagaaaaatttcccttttcttcagctagagaccccaggcaccaacacaccctcaccaccttcttgaaaatataaagtgatgggacagggtgcggtggctcaagtctgtaatcctagtgctttgggaggctgaggcagatggatcac

SEQ ID NO: 102357 - DNA, 2264 bp, Homo sapiens
acccatcatatgagttcaggtgtggagtttttcactggtggcatcatgtctgtgctcaatagatttaaaattttggagcattttggagttttgtattacagatgctcaacctgcacttctgtaacagagtagtttgaatgcttaattaaaatggcagttgaatattatgttaactttggttttatgattaaaccttttcaaagtttttgttactttcagatactcataagtaaggcatataacctctctagacctcactttccacatttgataaaggaacgatttgaattaaatgaaattgaaaatctcttagctctaagtataacaaattatgtgttaaattgtataattcatctcttagatatcatgaagaatgtgttgtttataatatgaaaaagtatgaagataaaaatcaaatatgactttgggtagcaagaagagattttgggggaagttgctaatgtgtacagttttttcccctaagagcggcgagagaatggcagctgatcagactggtggtggaatctgtctctattgcccagcttggcactatgaagtttgacctgtgtcgatcactcaaaactagctgatgacatctgaaagggagttttaccccggctccctgaagtttcacattacagctctacatttgtgttaacacaatgaatgcttcaaaaaaaaaaagttatagaaatcaaagcttacataggcaaatctttgttagtgacttagttaaaaacatttcatgaataatagttgctcaagctattttaacccttttccctttcccagaagagaaacaagaaaatcccacacattttgctcagtcatggtatgtttgtaagctctcttgtcagaaagtgtcactgattctttaaatttcttttagttagctgcttttgtccagtagctcacttattttgtggtttgaagatgactgtacttctgacacttttctcacatactcctgctttaatttttcgaaaaactcaatggcaagaaactgaaaacatatacagaagtggagagaatactagaatgagctctcacgtccctagcctcttggcttcagcagtactcagtgttttgcccatcagattttctaatgcttttagtgtaagtaatgccacatttaaaaatactccttttagaaaagagacttagtatttaaaaggaaataaaccagagtcattcccaagatttatctgattaaactgtagagtttataattatataaattttttttagcacatagaacagtcattctctatagcaaaagtactagcttttgtgccctttgcattggattgagttatagagctaaaccacagcaaactcatttgttccactcttaggttgcaagtatcacttaactgtgcttacttatctcatcttcaatatttacaaattttaactcacatttgtttcagtaaagcaacccaaagtagatgttttaggagatgagttggtttgatggttatgattttcttttactcctgtattgacagtcagctgtagttgagactattagccttctggagggtgaggtgaacagggctttttccacttcaggggctagaggctgacatgcatgcagttacctgcagttcagggcagagtggggttagggtggtaatggtggcataaatactgttgtgccagggtcatgtctataggtgtgtggtgggaagctctgggggagacagcactggcattgggtttggacgtggcatttacgggcagaggtggataaagaagacccatggagtagccttagcaaaagagtggtatttgggtagtaggactttgttcatgtggctggagtgtagatgtgtactaggagatagagtgaaaaggtggaggtaatagtaatttaaaatataacagtaaaaagaagcagctgtgtattgatcacttactgtgcactgttttaaatggtttacaggtgccacatctttgataatacagcaattctgtgggtgcaataagtgatggagccaggagttcacctggggcaggctggctccggagcatcactggtgccttagggcctcaaataccagattcagcaacgctaagcacttttttgggtcttatttttggatggtgatagttagcaggatattaactgatttttaaaaacaaatatatttgtccattgtcatgaactttttaactctgttggagtttaaaaaattggaagtacttagtggttactcattgtggcccctagttacagttcatgaaagggattttttaatgtt

SEQ ID NO: 102358 - DNA, 1016 bp, Homo sapiens
aaatgctttcttcgagtgttttctatgtatttattctactcttctaaaactgtgctttgggaagggctttgagtcctttctaatataatggtataacttcccccctcatgcagtgaagctttcagaagaattcaagtgatcacacaacatcatatctgtgttaccttttgtgttgaacatttattatttataacatttaatttttaatgataaacttttgtatatacattttgtatattctgttatgaaacggatttctaaaattagagattgaacatgaagcagaatggcctacaaaaggaacatgaatctgtgctacagatataaaaactattttgaaggctataggaacaaccacatttgccaggactcatgcttaaatagactgtgtacggctgtggagatcataaattgagaaagcatgatatttgagcaagaaaaatttactgaggtttgttaagatttgagaagagagatggaaaatcttcctgttcagttggagaagaagctgaggaataagtctttgtgcatatgaagagtgttttgtaggctgtgtataggtattttctgtttcttcagaatgtagcaaaaaacagtgtgaacttaagttggtatagaggaatttaggagataatttatgactagggattggaagctattgaaatagtttatcatgacaattctttgaaatggatgagttttcattatatttaggattttattctccttaaggagaggaggggttaagatggtgtcttacaggtatttctagaactttattcccaagatttatttatttacttagagacactttcactttgtcacccaggctgaagtgcagtggcacgatcataggtggtcactacagtctcagattcctgggcttaagcagtcttcccacctcagcctccccagtagctgggattacaggtaagtgccaccatactcggctcattttgatgttaattccagttttctcacctattgcacgtctcctggacttacacagaaaatag

SEQ ID NO: 102359 - DNA, 1970 bp, Homo sapiens
gagaggaatggaaaggcatgaggcacttcgaaaatggataggatttagtaagaccatttagataaagtcagcagcttctaatgaaattactgaaagaatggtggtgcgggaatagagatgggaagttcaagtggataacatgtggtgcaggaatgtgatgaggagttgtaggcatagagaatggaggcagggatgtggcactgtaggcagccacccaacagcttgttagactagatattgagtgaaaagtttgagtggagaagagagtttgaagtattagtttggagtaaaccattgaaaatacttcttttgcagggaaagatgtatagagaaatgagtgaagcggtcaggggatagaaccagaggtcacatctgaggttagggctaaatgtgaaagagacatggattatttggaggatagctagtgttgtgaaatacaagaacatacattttaagaatttttaagggggtagcatttctctgtaaactccacagaagtgtgggaggggaagtaagtaaaactgaactcactttactgcttttagtaatagactcattggaagaaaatgtaagctattcatgcagtgtgtgtttttgattatttctgggccttgttatttttctgtgtttctgagatgcaaggattatttaaaggcaatggtttataaaatgatatataattacatacgtataaaagtacatataaccaactaagtatatgtatgcatgcactcatgcaaatcaattatatatttacattttatatataaattatatatgtgtgtatatattgtattatagaacatcctgtgtggaaaagttggtgctgtcagaagggagagagagcaaggcagttttccagtgcatttcttataagctagttatgagaagggcttgcaggttactgattgaacatattctttctaaatgtcttctgtctgatagatactcctttgttagggaatatatacataaatgagattaccctagatgttcaggttagtgagggaaacgttacaatagatagcactaagcgctggatctcagctttgattcccagagcacctagagcgtcattgggccacctcttctaagttcctcttaagatctagaattgatttgaataatagaaattttgagtacattttgtgtaggtgacataaaagaacatccttaagcaagcatatcagttaaaggacttgtcttcatggctcttggtgttttcttcataccactttgctcttagttcctgttagcagaggggaagaagcaggctctaagatttaaaattcatgctagtgaaaattagaaacaagccacataccctcaataggtgtttgcttaaaatgcatttacgtctttgcagtggagtactgtgcacctggtaaaatgatgatgcaaatataaattgttgatataaagatatatatgtatatatacatatatttaaggagcagagattccaacaccaaattttgggtggtggaattttattaggttggtgcaaaggtaatacagtttttgcccttgggagattgggctgatggtgacacccgttacccaagactgagaatacagaaaggagaagtggattttttctctgtttttcctccctttttgagtaggggaaatggtagattcagtttaatatggccaaaagcagtggcttagtagtcagtttgcttggatttgaatatctctctaccattagtcgtgtgtgatttgggatggtttcacttcacctctctgtgccttagttttctcacctggacaatgggaatgatagtggtacttactttttgtaattatggggtttagtggtttaaagtagaaaatttataccagggcccattaaagataagtcatctcatgcagtgaaacataactgggactttcgagctcagttcactgaggtcttctgggcctggaacaagcccgccttataaaagttggctttacatactacatac

SEQ ID NO: 102360 - DNA, 1448 bp, Homo sapiens
atgcttctagcctctttaacacaaatttcagctattccacttccaaaatgccattggagtagtataatccagcacccatgtttataatcccacatgttctttgaccttgaccaaggttttaatgcaaaattgactcatctgctattggtttttaccttcctttcagtttgtctcctttaatatatatatgttttttttctttttgagacaggatctcaccctgttgcccaggctggagtgcagtggcatgatcagggctcactgcagccttgacttcctggaatcaggtgatcctcccacgttagcctccttattagctgggactacaggctgcaccaccacacccaaccaagttttttattttttggggtagagatggggttttgccatgttgcccaggctggtctccaactcctggtctcaagcgatctacctccctctgcctcccaaagttctgggattacaggcatgagctgctgtgcctggcctaaaatgtttttggtaaagggaaaatatagcaatctgttatatgctggaatcaaaatttttctactagatgaacttttggggaaatttagtattctgttctaaattaaatgcctttttcaagtaattactgctaatgagctcttgttttttcatgtttagggtggttgatgcagagtagtgcatataggggctaaaatcagacttagacacttgggggttcttgcatctctgtattttctcacaactatttcagtgattcttaatgagtggcatcttggcatagtgaactttaatgtgggaccatagttcacaaactgtgaccttaggccagttaatccttctgacccttgctttccctgttgatgaaatggaagtaacactacctactcgtagggctgtcaggaggtcaaatgtgtcaacgtctataaaatgccttagccaagtggttggcacatagatagtaagtgttccacaaatgttcatttccctgtagttttactaaccattttggtgcaatattatattctttataaagtcttgtgttttggccttttttttttttttttttttaaagactgtgactgttttctagggttttgaggggagtgataaatgttctgggtttttaggatttcacttgaaatcctcctatataactgctttttctctgtaatgctgcttgatcatcttattggaaataagagattttttttcttgtgtgttaggcatcaaaactgtgatacttctattttccctttgactcctttggctattataattctagaaaattatttctaaaattgctatatggaaaaagtactttcttctgtcacttctttaattcgttagtgtaaatgagccaaagtttataagagaatgttagttaactgtataaattttagataatgacataagtttaatttatgtaatctaattttagatctagtttttcttgattt

SEQ ID NO: 102361 - DNA, 4584 bp, Homo sapiens
ttattgtcatataaaaactctgaccttgtattaacatttttgtttttgaaaagtggctagcctgaaggaaggatatatggaataatcactagagtccttatttaaagtaatccaaggtgaagatttctggagtttattgttacttagcatatgatggtttggttgctgtataagtcagcagaaaattatgtaactcagagatactttaggtggcctttcatatgagtaatgattaatggataatgtttcaaaaaggtgtcagaaattttgatgtgtcttacctttagatttttaaaatagtaatgaaatctaatttctaacaatttttaataaagaatactgataattgattctactgtcttacaaagaacttttgtgtcagtaatatctacttctatcgaaactggcgaggtgtaagtagcattgtaacattttctgggtgaagaatatgatgttgagagcctaaaggatttgattatatagttcatagctagagattgaatttatgttttctttccccatagttcatgtcataattttaaagactgaccattttaggggaaaaattattagaaaatgatgtcctttgagtaaagataatcttgattcaattatttttacaaataaaactattctgatgcagcactctagtgttcatccatctagtcatacaccccccacaatatgataccagctagttgtaggtctagtgtttaatgtaataccgtaacaggcatttgaattggaatggtagttcttcaggaatggaatctggaatataggcaaagatttcagagacaattcctaatttaaaaataactcatattgtctctgaggttcttttccagtgaagtgtttagtattgctgctatttggagtacaaagttggagcttttaaagaacctgggagttcaaaagtataaggagaaataaatgaaaagcagaaatattttgaggcaataagtatagactcaaatctatattatgacccacttgtagcaccacttggaattctaccaataagagatttatttgggcaaactataatggttgttggaaattgcaaatcttagtgtgaattattttagtccagttggtttctttctttctcttacctgaaatgaactatactgaggcaataggagctttgtatagtaatttaggagtgtaaaacaacttagggaaaaggattattaagcaggatgattgggatgacatcatgtgaaatttaggaattggaggcattgggaattgagagggtgctaacaaaggaaaacagcttattttagaatttgtctggaggatgtagaattgaagaagttttggtatttcttctgcagcggccccagtgcccttgaccaggaacatctcttggagtcagtagttttcatgaggctgacctaggaacttggccaacatatgcaacattgttctatttaaaatattccttgaattaaattcgatagtatcaatttaaaacataaagttttcactcaactcctttagaagttagattttagcttgtacttgtctttacctcttctgctgattatcagttgacaacactgagattactttcattttcctgtaagtcattatgaatttttctggtcaaccatgagttatcagtggaagcaataagtaggaagtactgtaaaagaattacaataaaataagagaaaccacttggagagcaagagggcttgtggacttgggggagcggttgtgagaaatgtctcagaacttaatttacaaataacattggtagattgacatgttgtctttcctataaagtaactttacctctgtcttaatagtaaactactatgaaagtgaattcgtgttcctcttgatttgtgaactgatgaaaattacaaaatgtggagttttttccccagataaagtaaatggtggaatattcaggtttatttgatacctagaaaatacctgaaattttccgtggtaataggcacattttgaaactgttttttttttctctgacaattgaatatattttatatatagttgattttgattattgaagactaaggaaaatttaagtttgaatgttagaaaatgaattttgcaaatttgaagtaattttattctttatgttttgggattgtagttatgttagatattcctcagttggggtaattgtcttgcatcattatctcttatcataatctgtttttcttcacacagtgttatagttttgccgctggactcttccctcccttcccccaccccatcaggatgatatgagacttgaaagaagacgatgcatacaggtgactcaagttttgaaatacagtaaaactctggctaagagaatgtgggaatcgatggtctattttgaatgggggaggtttctgataaatagcagttagtggggggaattgtagatcagtaaatgcaaaggtagttgggctatttgttaaacttacttttgaactcagattgataatcagtgatttatagtggtgttattacaaatacagcatagtaaatgctagcacttaggcttttcaagagctaatattttggtgggaattggaataattctgttaatgtaaataacacagtcacctttatggttgaatgcatgtctcccccagaactctattagaatatggcagatcttttatgggagtagatgttagtaggatatcatcaaaaagactgacaagttaaggatattatacccatacatacggtttcttaaaaagatatgctctgggattttgtttattttttccttgttcccaatatccctgcctcccatttcctttcttcccaccctccccctcttatccttttgtcatttgtatttttatacagaagaagcagtgtgaaggcatttttgaaagaatattttttgattgctctataattaattgaggtgatcttttacatgggaaactggaggctattccacacatggctatgttcaaatttctgaaaatgtagtgcagctaatgtataaagtgttaataacttttgaacttaaatgttcttaaattaggcatattataaggcattttgttgaactaagtgacttaacatttgaaactctgtcagagagccttatttgattatatttataaactgtttgaaaatgtgattgctaactggaaaagaaatatttatataaattttgaattgatacctaacagatgcctaattatatcattggtgtagtttttgtgattggtttttatttttggcgatctgggttttgtctaggggaaaaatcatcattttatgattttaagattttaaaaaattgtttcggtgtactattttgtatgaagaaatgtgcttgaatatatttataaattaaattagagagtatataatacttcacgttcatgtagaagtcaccattttaagaccgatgttaattcttgtttacgtcaaaggtgattgagcaatcatctctgttacgcatctatcatgcatgcacacaggcttgcacatgtatgtttgcctgtacatattagaagtatgccaggtacacattctggctgagttgctcgctgattgttaaaagcaacgtgatgctgaagctgaatatcaccatcatagaaaaacaaataggcatatttacagaaacatttttagaattttatgcacatttttttgttgtcagattttataagtttgaccttttggtgcaggaactatttctcagcattgtcagctcctggattgctccttgggcgctatactgcacattggctataccaagtagatgctcactttcgactgaggtcagtagaggaacaaagtatttttggggtatctcatagatttatctatgaatattactgattttggagattttctctcgtgaaattttggagttacaaagtttctatttatcctcacaagacatggagggtttccaaatagctctttttcttgaaaggcttatggtctcaatggaatgaaataactaatgagtaaatacagtttatagttatctagttaattttatgaatgctagaacacaagaaaattctacagattagatttatgataaaatccaatctcttattcagccttgtattctttaaaaattgtcagcatttattggcttacagaggaaaaaacccaggaaagaagatctagctgtctaataaatatattagctgttggtgtattccctttctaatagtttgaaagttaacaattgtttttgaacataaaattaacagctttcagaatcatcattaattaatgtagcagtttggtcttgtattactatgcacacatttattcgactgatagaatttcaacacattaaaactaatgagtagatgttcaccgaaagttgtttctagagaatgcttcctgacatttgaaagcaagtggtctgctttctctgggccttgtttttaccctctggcattgttcatggtactggctttgttctgttggttagatgtggtaacttactctcatcttttccttgatgaggcacaggttcagggatgctggaaaggacactgaagtaggccttggctgatgggcctttcagaagtgaacacttaagagtaggttttcagagtaactttgtga

SEQ ID NO: 102362 - DNA, 1058 bp, Homo sapiens
tttaagactcacctattgaattcaaggcatgcagagagaaagtagagagcactgtctgggtaatgacattgacagtaatggctttacctgtaggcagaggttaccaaaatctctgcatcccattcttctcttccgagctccacactcaggtaactgctttctggatgcctctcccgcatattccctcctcctcccccattcagtcctcttagtaatgagtgacaccattctaccctaacacaacatcatttggggaacctagcaaccactctttgcccttttgaatcacaagtaaccaaattcagtttatttaaggtgtagaatgacttctcagattagatttggaaaaagtactgcctcagagattaccatgtatatgaacataaagacttttatataaagaaacctgtgtaaaccagcatttcttcagtttatttgattaagggacctcccctcccttttatttttgatttatacctattaataacatcctgtggaccatgatttgggaaaatcatgttggaaatagaaggggctgccattctttgttttgttgaaatgaacttctttaacaactaaaattttttaaacaatagtgatatactagtcacttttaaatgtggaatagttccaaagcatacagagctatcactttttgaggatgaataaacatggaaatttatttttaaatgtgctgatttgttcatattgtctatgtcataattcttatgcatacactatatatatactcatatatatgaatttaagtacttaaaaccgtttgtggcagagttttaattttggattctcttaactcattttaaaatgtgaattttgtaggacaaaattttcatatttccagtgatcacaaatggggtgtattcattatacaagagttagaaatcagatctgtaaattacaaaaccccaacttttaaaatcccatcatatgtggggtacactaggagaatgaaagggcatgtagattgtaatatttaggaagctgtcaccagtttgcctccccttggaattgttgtcgtggtcgtgtgtgtctgatct

SEQ ID NO: 102363 - DNA, 1047 bp, Homo sapiens
gaacatgtgttcttaaacaagcaaataggagttgtgaagaatgtatttattgataatgatttgaattgtagattcaaagtgaaatgaaataatttcactctaggaataatttgatgggatttgttttttgtatttttagaaaattatagatttggccattgtttaaaaagttttgaataaattttggcttagtgtaagaagattctttgataggaaaactaaaactatttgatataaaaagttatcattgcttaagatttggatagtgtagatcatctcctcaaaaggtgaaatttaagattttacttttctcgaattcctgacctcaggttatcctgctgccttgggctcccaaagtgctgggattacaggtatgagccaccgtgcccgaccaagattttacttttctttaagcactctttctcctcttctctctggtggtgaataccaggctacttaatggtgccttcttagtttggcctctgtattccttagtcttttaaaaaagtgtagagatccatattgctaatggatatacattagagagaaacacaaataagttaattttaatttttataaaccatccacaaaatatactccatggaatcagatactcaaaaagataccgagatgtaaatatttatgttgttaacgcaaatccaggtctgctttgtagaaggttaccaaagcttaaaaaccattgttgagtgcttgctgtttttgtaacctactggttgcagccagctctttcctctcctactggtggtagtagtattcttcaggccatttgtattagtctgttcttgcactgctataaaggaaacctaagactgggtcatttatgaagaaaagagttttaattggtacacggttccacaggttatacatgaagcatggctagggaggcctcaggaaacttagagtcatggtagagagtgaaggggaagcaggcatgtcttacatagccccagcaggaggaaaagagagaagtgggagtgctacacacttctagacaaccagatctcgcgagaacgtactcaccatcgt

SEQ ID NO: 102364 - DNA, 1120 bp, Homo sapiens
tctgccacttctgctctggttcctagatctttttgacattccttaaattattggtattatcccagttgccttttcttgcagaaaactgacaaaatctttggttcactggtatgtctccatcccatgctttattttatttagtgatctttcactgcttgtttctatggatgatatagaggaatatagaggataagaacaatatgtttactctatccagtgttctagattttcttgttagaagcaccctccttcccagcttgggaaaactgagctgctggggtggctgttggctccttcgcttgctgttagttttaaaggattgttttcagtcacacttgaattgtagctatccttggttctctttttaccaatgaattctggtagtatgttttaagagctgggtggccttcctggcctttgtaaacatttcctgcaatgcctagctttagtgagctgcgaagttgcccattggagatgaggctctattgaaagtcagcacctgtacttcactccctgccttttgtgactttgggtttcgaccgggtgtttggaagcactgtttcttctgtccttgaccttgttccacatgttttacccattacctcctgtgagcaggcacagggcctttccttgtcacctgggcttcagctgctttgaggatgactacttaccccttgcagtagcttcccaccaaggttcttgaaagggaagttttcataatgttcatttttttaaaaagttagaccagctataccccctaaacttaagtctgcttgttttcatatgacgtagaaattgatacaaaaatactttatgtagtttgtatagatgtagttgcttaagaaagatgacacttactgtactattttgttgtcttgataagtacagtacaaaaaccagtttttaaaccctaaagttaatttgcaagaaattgatacaaaaatactttatgtagtttgtatagatgaagttgctaagaaaggtgacacttactgtactattttgttgtctggataagtacagtacaaaaaccagtttttaaaccctaaagttaatttgcaagaatctttttgttttgacaatatactattataacttttagctgaataaaatcttaagt

SEQ ID NO: 102365 - DNA, 2927 bp, Homo sapiens
tttcatgatacctaaatgagggagcaaaagtatatttagtatatgacagtatactgtcatatactactgaattttcataaggttctaggagcctttttttttgttctgggaaagggagggaggaagaggatggcactgttacccaaatgtgagttagttgattcagaagagtaaagaatagtccaatagtccagtagttaaaaatttatgtctgtaatccagatttaaataccagtttatcttctagctttataaacagtcttaatgagaagtaggggacaaaaaagaagcaggattgcccttaggttagagaatagaaatatctacttggcttaacgtttttatgaaagatgtccagcaaaactgtggtggcagcctcactttagagaatgaggtattaaaaacttgaccaaggtagtcatgccagacttttgaatatttttccaaataagatggcttcaaattgaaaaattttatccacttgatatttttcaaaactataaagctgtgttctatttctacctaaaatataaaattgttagtatggtatgatttgtcatttgagatgatcttggctaatacattactgggcataataatggctattacacattgagaggatagaggctgtttccgtgtctcaagcatcattaactgcagataaaaaaaagttaacagttattctaaaaatatttcttataggggagaaaatgtaatcagtatattgtatgttttagtctggtgtggtggtgcaagcttgtaatcccagctactcaggaggctgaggcaggagaatagcttgaacccaggaggcggaagttgcagtgagccgagatcgcgccattgcactccagcctgggcaaaagagcaaaactccatctaaaaaaaaaaaaaaaagttaatgattaattgtatacttagaaaacttactttctttactaggaattctaaatatatatatatatatatatatgtaatgaagattttagtttagtaagttaactattttaaaacatgtttaatgtttaatttctgattctaaaagtagtactttttggtactttcctaaactccataatttaagtaactttaaaaagaactgatgctaagctaaacatttaaattgaggattatcccagagcatctgtcactaggcagatgatgtttccttatgtctctagtccccaaaggaaagtaggagtgccaagtttttaatatttgtccctttcaagaaggggaaagttttgtgatacaaaaaatgtttaagaggtggaccaggaaacagtcccttgacatggaaaatgcccaggctgagttaggattgctttatctatatggagggaataagaacctgggagaacaaaccaaaatattaaagattcatgagtaagagtatgaatgaaattggctttaaaatctttcccttttatttctctcttacctttatccttcggaattaaaggaggctaatgcaggttccaagtagttcaaaaatgtaccaaaagttgtgaagtttaaagggctgagattgagtctttcagggaatggattaaatactttggtttcgacagtgattttcaaacctgtcttaagccttgactcgtagtgtgtagatgatagtatcgtgaatgatcctgagctaatctcatgaaagcttacatttaaacaaattttcatatggacaagaaaccaagagacattgatgtgtgactaaaatattgattattcatggattctgcgagagctttgctttttatctgtgggatcttacgcattatgtttctaaaaatatagtttctttgtttctaggatgggggggttaatattagattatttttaagtttccttctagttttagagttattgatcctttttctgacttttagaacctgacttttccagtcttggtttcattggactttaacgggttccagaattcctgagtagagagaacatgggaagaaattaagggacaggtgtgggtgatgggtgcttagagatggtggaaaagtggcttcaggagaagagaaattgtagtgttagggataggaccagcatgctcttctcttggaatctgatgcttgaaatctactctgtcttaatgaaatatactttacaaatgctagacgtctttctggagacgtttatagacactctatggaaaaatatctaaaaatcatgaaatttttcatgatgtggaatgaatctgtactctatttaggaggagataattgctaggctaggtgggacaagttgatctattttaaaataaaattgtatcttttataaggcacaaatgggaactgtgtctccttgacatgtttcaaagcatttctctgaatatgtgagattaaagaaactctcaaccactcagaattgtcagaacactgatgttctttaaaactatctttgtagctgttagtatgtactgacacagttgaagtttttaatgttttattcattattagacattttgcatatgaatgtaatgtcttttatttacagttacatcttaactgaacttggttcccagatatgagtattatttacttggtctcagtcttcatattttaagctctataggttaatacttaattgggttttattttaaaattatttttgaagctatatattaaagtttgtcgtaataaaccaaatgttagttttcctccacctgggaatacttgagacttcagtgagccacgctttctgttatgcccacctctttagtctttccattatagaataaacatgctttgtgtgatttctctaaaatgtaatgtttgagaatctattttaatgtatagaaagacatttacataatgcttttgagtaggtggggaaaaaagttgaaatgttgatggcagcatctgttagaaaaactcacatgtctatatagtaaaaagttaaaattacaacaaatgcac

SEQ ID NO: 102366 - DNA, 1693 bp, Homo sapiens
acagcaagttgaaaatgtgacaaagctcaatttcatttcttgtttattgcttgttttcctattggacaattggaagtagctttgccctggcaactaaaataggctatttgcataacctagtttgattggctagcatcctgactaacagttccaatcatatggtgtcggtttagtggtaggctatgctaattagccgctgttgctggggttcagggatggtttctgtgtgctgttctgctgcattgtgttgcctggtgagagacattgataaatgagcgtttaatgatctgcagcagttcccactcactgcgggcaggcggattttagaacagaagtggaaataaggctttaattgctctgttaaataactgtaaccaaaatatgtgtattacattttagaaattaagttgtatgaaatcttaaatacttcataacacaaaaggaaaatactttagctttgtctcttaaaatataactcaggtagcagcactatgcacaggtttcctaaaactgtgaaactgatcatttttttcagatcagaaacagtacccttgtagtaagtagcatgcttgatttttcttatgactttgaccttttataaagatacacgtttgtatttaataaaatgttgcaagcttttgggcagaatttatcttgtactgcctgtgtagtctagcaaataagagcataaacttgaattccctgttcttcttctgttgaatttgaagatcaggttgttattcactacctcctgctattacttttctaattgaagtcagatgttttaactgttgcttgtaccgttatgttggtgtatgtgaagtctttattggtactgtcagatggtaggttctgcagaaaaaaaaatcagttctttgtttaaggaacatgaggtgaagaataaatacatgtgacgttagattaaaaattcaagatgaccatatggaaaagtgctgtaaggatttatctggaagggtataggggaaaaaattctaggcctttttatgatagggacatgggaaatggattgagagtctgggaaagggttaaagaggaagcccatagaatttgtgttaaggttttaaatatcacttaggtttcaaacagctagagagtaataagaagaaagagcattttagggtgaggaataggtgagcaaaagtaatgtttctggtattcagttgtcaaatgtaagtggtcacagtgatcaaggactccggggccttaggtgtgtcagtgccccagcttccaggcaggcttgtgtcattcccttgaaataagacctggtgtcttactgttccagctagcaccatttctggctttttgtcacttggttttgttggaagcagggctgtccactttttgtgtctgatggttaaagcataggactcttttgccttcttttgtccctcccattggccctaaagcattgaaacacggatgccaaaaataattcatgtgaatttagatgtttgtattaaattttctgtaaagtgtatccctttaattgttctggcctttatttaagagcatagtaaaattagacaagctaactggacaatcttacagactagtaaagaatgaaaaccaacattaaaccataacatttgattcttaatcacacgtccccaggcatatatactgaacatgtattctaaaataaatttacagaaatgctttattcaaccagtca

SEQ ID NO: 102367 - DNA, 1864 bp, Homo sapiens
tatgaaaatgtggtattgagtaatttcaaggggtttttgagttgccatcatctaaaacgagatatgttgtaggagaagcagatttttttgtggagtggagggaagggattgattgtacttagagtcaggttttgaatgggttaaaagtttttaaaacagctttattgtgttataattggcctacagtaaacttcacataattgaaagtatacaatttgatggattttgacaagtattacttgtgaaacttttaccacaagtcagataatgaagatttattacttcacttgttccagaattttatataaacaggattatatgtgttctttttgcctggttttagttcttttgagagtcatatgtgttgtgatacctatcagtagttcactgtttttattgctgagtagtatttcattgtgtgtatatactttggtttatccacttacctgttgaagcacatttgggttgtttccagtttttgtctattacaaataaagatgctatgaatattgttgtacaactttttgtatggacatatgtttttatttctctttatttcctaacattggagtgactcaatcatgtggtgggtatatgcctaacttttaaagaaactgctaaatggttttacaaagtagttgtaccgttttacattttcaccagcagttcaggagagtttcagttgcttcacattttgccatatttggtggtcagcctttttaattttagccattctaatacttgggtagtgatatctcattgtgtttctctgtgattaatgttgttgagcatctttgtatgtacttttttgccccctgtatgtcgtgtttggtgaagtgtttgttcaaatcttttgtcattcttttttcggttattgagcttttagagtttcttatacatttgatacaaatcctttatcaaatacatgatttgctaagcttttctcctagtccatggcttgtctttttattctctttaaaagtgtcttgaagatctgatgttttcaatttttatgaagcctaatttattcatttgttcttttatgaaagctgcttttggaaagtttttgcataattgtcccatgatcaaaaacgtttttgcctatgtttgttgttgtttttttccccactagattttacagttttaggttttatatttaagtctgtggtccatttggagttaatgtttgttaatagtgtgctgcaaagtatagatcaaagatcacttttttttgcaaatggatattcatttattgtagaaccatttgtcaaaaggactgtcctttctccactgaattgcctttgcacctttgtcaaaaatcagtcttccatatatgtgtgggtctgtttgtggattttccattctgttccattaatctatttgtcctgataccaataccatattgtgttgaccttctgtggccttaataataattaatgcaatcaggtagtcttaattctacaactttcctcttattcaaagtttttataactactctaggtcttttgcattttcatatgaattttcaaatcagttcgctaatttcttcaataaagtttgctaggatgttgattggggttgtgttgaatatatagataatttcagaagaattgatactttaactgtattgatttttggacccgtgcacatatatctatttagccctttctctcatttttctaattttcagtatgcagttttttcatgtattttgtcaggtttatgcctaagtatttcatatttttgtcactattttaaatggcttttaaatttcagtttctgatatatagttacagtactagcacatagaaatacaattgatataaatatatccttgtattctgtgaccttgctaaaatcactt

SEQ ID NO: 102368 - DNA, 1159 bp, Homo sapiens
tttggtttaaatctgtcatcctgctatttatttcctatttgtgttgtctgtttttcccctttcctctttttctcctaccgtcttttattctgcttttggattgattgaaatttttaaatgatttgattttcttccttttattggtttattcattttaaccttgttttttaaatttagtggtttctctttatcttatcacagtctacttccaaaggatattagatcacttcacgtatagtgtattgaccataccatagtattcttctatttctctactactgtcctttttactgactttaaaatagattttgtttgtgcatatgttattaaccttacactacattactattattgtttaaacacttagatttaaataagaattcctgtattcttatccatttcgttatcttttctggtcttcattcctttgtataggtccatatttccatctagtttcattttccttcatcctgagtatttctattaacattttttgtagtgcgtatttactaatgatgtattctttcaccttttaggtatctgaaaatgcctttattttgctgttttttttttttttgacagatattttcagtgggtatggaactctaaatgacacttttttctttcagtaatttaaaaatgttgctgcaccatctgctctctcgcattgtttcttacagaaaatcttctttattcatttgtatataatatgtctctttttctggccgtttttaagatttttctgtttatcattggtttttagcagtttgataattacgtaccttagtttagttttctttgtgtttcttgtgcttgtggtttgttgaacttttagatctatgggtttgtagtttttatcagatttggaagatttttgaccattagtttttcaaaatttttgggttctcctctctgtcaggaactttagttacatgtatattattagggtgcttgagattgtcccagaactcagtgaatgtctgttaactttttaaaatctcttctgttttgacatccaatttcagttgttgagtactcatttggaattctgaggtagtttttattgctgtgtcttcaaggtcactagtccttttttctgtactatctaaccttttattagttttaccctttgtgttttttatcattcacattgtagttt

SEQ ID NO: 102369 - DNA, 1026 bp, Homo sapiens
atatattttatgatactaatatataagtgtacatatatatacacatttttatatgtgaacatacattaaaaaaacataatttcagaatgcctcacacgaatcttgctgccactcaagcctttaagacctaaagtctgcttacctctttttgtaaataaagttttattggaatatagccctactcattggtttatgtattatatctgtggctgcttttgtgctacatgggaagagttttgattaattgcaacagaagcttcatcttccgcaaagcctaaaacattcacactctggccccttaagagaaagcttgctgacccctgctcaggatgtagcaagcattgtactcacggcattatactcacggccatggtgcagctgcagacttagaaaagaaggcttgagttggcgagctgatggacatggcaggtgggtggaacttagcagtggagtgggtagtttctagcctctaggtgtgggatcactgtgctaagtcaggaagtgtggctaatctttgcttagaggtggggaacttgtgcttttaagaaagcacttggtgttttctagtaaatgtgaattgtggcgattaaaaaaattgtatattaaaattcggaattaacaagtttatgtaaattagaaagtgagagttgccgctgtcccctcaattcccactcttcaaggtgttaagagctgttaagagatggagtttttccccctctgagtattaacttctacttagtaatttaaaaatctgctatattttagaccatctttttttacattgtgaccctgaggttcacttgattcccaaaatgtagtcgggattgttcagttgagtgtttgttacatagaagattaacgtgtaaaatatttcagaagagattttaatagacatctccctgtcagttgatgagttgacattgtttttctaaatagttttagaattaggctttttatgacaagtattaaagcactttgtactgtattactggtattttaaatttttacaattttttttaaaaactc

SEQ ID NO: 102370 - DNA, 1004 bp, Homo sapiens
aaatatatataaaacaagtatttaaaattttttttgtttgtttttgaggcagagtcttactctgttgccaggctgtcaggctggagtgcagtggcacaattacggagcactgcagcctcaacctcctgggcctaagtgatcctcccatctcagcctcctaagtagctgggactataggcacatgccaccatgcctggctaatttaaaaatttttttgtggagatgaggtttcgctatgttgtccaggctggtcttgaactcctgagccgaagcaatctgcctgccttagcctcccaaaatgttgggattacaggtgtgagccaccatgcgtggacctaggaattacgtaatttgatttgaagagtcatatcatttttcccctgctttacttttgtacctcttctccaagaaaaaagtctactctctcaaaaaccgaaaacacatttcttaacttctgggaggtagttttgtttgtattagttcaagtccatactggaatacgtttgaccagtgttttcaagctgagaaatgacatttaattatttgttatcatttctaggtagatagtaatttctgtatttactaaggtaagctaactggtttaacgaacacacctaatatttcagtggtttaaatcagtagaatttcttgccatataatagtccaatgactgttagtacaatgggataacagctctgctctgcagttattcaggctctgaactatgggcatttttcctattttaaatttaatagtgtccaaaggtcatcctaggttttggcatttgttgaatgggggaagagcatggaggttttcacacgcaatttttatgggtcagacgtggtagtggcacacatcacttctgttgacatttcattggcttggtcttagtcacgtggccatgctaactgcaagggaggctggaaatgtagtctagttgactcagggaaaaaaatgcctttggttatcaattagcagtctctttcgtgtggtcaaggtaaaca

SEQ ID NO: 102371 - DNA, 1203 bp, Homo sapiens
aaagctggaaactatgctggaaaaataagtaggggccaaagcaggtggcagcagaggacacagccagggtcgcagcagaagaccagtctgcttcggatcccacacctggcacttgtgcaatgcattgctatgtgagcctcaactttcctgcctccactgtggatagtctcttactgtccctacatcttgcaggagtgacccatcaagactccagagtctgaacaggagcatgtgattgtcaaaactttggtcactagcaaagccctggttaccagggaggtaaggtaggagatttgttagtttggtttttatacttggtggcatggcttttttgccttccatgattctcatgaactgtgaagagtgttcagataccaaatggcctaaaaatgacaaatacctatgtgggaacctttttcatcaggagaaataagttgtggtataagatgggaggctgtgttccaatcttgatttttatcacgttgttaagcctctgggttgcagccgccccctctgtaaagtgaggtgggggaactagatgtctgacagtgtctgttcatttactcactcattgaataaatatttagtaagtgccttttatgtgccaacacaaaagaattatcacacccttgccttcctatatttgggtgagtcagcagagaagtcattctgatacagttagggtgaagtgctcagatactctagccttgggcaggggtttaggagctcgtgagagttcccaggccagcctgggcagagagtgttggagtaggggattcagggaccacactccgcttctttcactcattcgtttagtgtttcctttaagcctttgccttgttgttatgagaatacaaaaataaataagaccagtacttccctccaaagcactaattgtgagagcatgctgatggctttagcaggcagcatgcttgctgtgttgagataagagcagaatacagtcatgcaccaaataacatttcagtgttggactgcatatacgacagtattcccctaagactgtaatgaagctacaaaaatcctatcacctagtgatgtcttgcgatccttacccaaggaggtcttggcttacgtgtatgtgtatcttaatttttgagaaaaatgtttaaaaagtaaaaagttaaaaaaatgaaagcttacagaataagaatgtaaagaaagaaaacatttttgtacagttgt

SEQ ID NO: 102372 - DNA, 2199 bp, Homo sapiens
gtgtatatattttgaagaggtcttaactacacagtgattctacccctgtgtgtgagggcctgggctctttggacagatgacatgttttttccagtgttatggagttaaccttagagctgggaccagaaccctggacttgctccttgtgccagttttaattttctcagccacacccttttctttccttttattttgtacccttttttcttactattttcaatagaattttaaatgtcatatgtttaataagatggaaactgctgatataaatcaagaagcagtctttaaattttaaataatggtacatttatggagacattatcaactaatttaatttctttttctgactttttaagtcacctcttttttccaagtcaccatggcttggaaccgctgagtcattcttgaatccagctgtctcttatctgtcgtccgtattgaaacaggttttgaagtcctgtcagtctgctctcagagtgtctcttcatgcatctccttcctttcttttgctgacaattccctccttaagggctctcaccgtcccgtgcttgggctggtgcagtaagcaactgatagatctctatttgtggttcctcctggttccagtccaccttacacattcgttctatcatttagcatttgccatttgccaggtaccattttaaacattaactctttactgttcttagtaccttgaggtttaagtactgttataaacccattctgcagatggaaagggaggtatggatttaattgatttgcccaaagcgacacagaagttggtagctagctagtaaatggcaaaattgaatccagactccttatggtgttaattgctatagctaaagatgaaactggagttgtgccactccttgcacacttttatctgtcaccctcttaggctgttttagaaaatcccatgttttagcttgccattctgttgacccagcctgcctttctagccttaacttacccctctgtctatattctattttccagccaaatatgaggtgacgtttaagctgctacttgaaagagaagtgggagttaggcagagcagtaggggaatcatgtttggggaagagtgaagagtgtacttgagagagtgtggaggtgccttggaggagctggagcccagaggtgccccatgagaacaacacaggaggctgcaggtggaggtgggtgcctgattgtagaatgctttctagttgtcttccacaggacatttttgggagctattcacaagattcatggctaccgtgctctaaaatttgatgtgaagttcatttttcctggacttcttacttaattcctctgtcttttggcccagccacccctttgccagtttacacgggtgatgagcaggctgtttggaaagaacgtcctcgagcagggtgctgtttcctaaccctgcgtctttttcccctctgagatcagtttatctttattcacttgcaggtgttcaacaatcttgtcttttatggggaatttctaatgtgtcttgagcactttcccaccctcctatcttggaggcatggttcagagtggaaaagggcgcgggcccacctacctctggccttcccacctcagccaccatgcttagggccgtggtggagtgcttgacctctttgtgtgtacaatgcaatacatgctggaataatgccaccttatgcatagggcttttgtgggtgtaagggcataccggaacaagttggcatagaataagagttcagtgaatgttgtcactactttttattactttttaattgtgaaaaactcacagattctgtaataaagggtcatagaaacctgctttatccatactatcattactgagaatactttctggtttggaaaatttgcttgagaggtaaaaagaaaatttacttacttacttacttacttacttatttatttatttatttatttatttatttatttatttatttatttagtagagacagaatctcgctctgttgctcaggctggagtgcagtagcacgatcctggctcactgcaaactgactcctgggttcaggtgactcttgtctcagactccggagtagctgggactacaaatgcatgccaccacacctggctaatttttgtatcccccccgcaagacagagtctcactctgttgcccagactggagtgcaggggcacggactcggctcactgcaacctccacctcccgggt

SEQ ID NO: 102373 - DNA, 1083 bp, Homo sapiens
atacagaatgaatgaaaagcacacatctgcatattagtcttaaagttttaagatgattatttttgattttcaaatataggtagtatttcattttatttaagttatacatttatttaaattatctaagttataataaaatggcaaaaccacaactacttttacaccaaccgaatacttacatttatttctcctgtcctttgtgctgtgattgttttatttatatgtaataaactccacaatgttatttttgctttgaacagtcagttggctttcaaaaatattaagaaaaaatgtcttttatatttatctacatacatatttacatttctggtgctctttattcctttgtgtgaatctcagtttctgtctggaatcattttccttctgtgaacttgtgtgaacattttttgagggcggatctactgttgacaaattctttcactttcatgggtctgaaaaagtattttgccttcgtttttgaagggtgttctcaccggatatagatttgtaggttaaaggtcttttttattttcatcatttaaagatgttttattttcttctggcggtgcacatggtttctggtgagaaagtggtgactcccctatatggaaacaggtgtttttgtctctggctgcttttacaatttttttcttcatcattggttttcagcagtttggttgagttgcctcagtgtgatttttgtgtgactttttccttttttttttttttttaaacttgttttcagtttggttaatttatattgctttgtttttccattcacttatcttttcttctgcggtgtctgaactgctattaggtccgttcagtgaatttttcatttgagttattttgtttctcatttttagaatttccatttagttccttttcgtagattctatttctctattaagattcactattcccttattttgtccatgttttcctttatattttaaaacattcataatagtggttttggtctgctaacttcactctttctgtcatttctgagtcttaaatggattttttcctcccgaatacagaccacattttcttgcttcttgctgtgcctagtgaattggg

SEQ ID NO: 102374 - DNA, 1034 bp, Homo sapiens
cgtcctggcaggctgttaattcacttgcagaccatcttgatcctttgaggtttgtttcagtctctgttagaacaggggccagcctttactgtagggctggattagccctagccctaaatgtggattttctggggtctctgttgaatgtctgtgggtttctccactgtagcctgtttgaacactcaatgtcttacagtcttgtgtgaattttagtagttattcagttcacagttccctggtagttgttctgtgcctggcttcatggtccttctcccagtgcttgtgcagcttagcatttggccaaagagtcaaggagaaccctatgtacggattgatggagctccttctctttttgttacctgctgcacaaattccagccaattcagtggccttgaactcttccttctgtctctgcagcacagtgagattgctgtgttctgtttgggctcccccttcctatattgtaccctggaaagtgcctctagataggaaaccagggggattgtagggctcaccaagagtgatttcttttttcagtcatcacgattctgcactgcctgttgtccagtgtttgaaaacggttatttcgtatgttttgactagttctttagttgtttatgatgaatgagggagtctggtaccaggtactctacaaaggtcataagtggaaatctgataatacaaattcctaagggtaacatgtttttatccataacccattgttactaacaattttaatatatagattcagttaatctttcatgctgaaaaacctgagattttatttacgtcttatatgagcaatttcattgtgtttctagataattgagtatgctcttttggctagtgggttgacaagcttgtgtgtgcatgtgtgtgtgtgtgtgtttaatgttggcacgtgtgtgtgtgtgtgtgtgtgtgtgtgtgtatcctgtagtaacacatattggccactagagggtaataagaaagcagttcatttgttcttattggctcactgttactaaatagtccttatcattagacttttt

SEQ ID NO: 102375 - DNA, 1526 bp, Homo sapiens
tccttacctcccgtgcagtcccctccctccctctctcaatgatttcttcacagtctaaatattcctgatggattcagttcattcctttattgcacagatatttattgaatgcaggccatgtgccaggcactgttcttggtgctgatgataaaatcgtgaacaaagcttactcatggactttcgttcacttaccctcttaatcatgtgcctttatttccggccatcattagaggtgcaattcattttggatgtgccttgttgctagggacctcgtgggtttttgcccacataagcttggttgccctcctcatttcttagtggattctgtcttagaacctcagcctcataagtttccacatttagatgctatagttttaattaaattattttcatttactttttgttctttaatattgttctttgatttaactgtttctctttaaaatctactatcaattaatactgtcacaggaatggtcccctgttaacacattactaacaaagaaattcaggttaggtaagaataacattcagatctacaagtagagctacgtgtgggttatgtatcagagatgatggcttctgatacttgttatttttacttttttgtttttaaacttagggtcttttctcatgctttttgtatttgctgtttcctctgtgtttaccactatctttttgaatcttatgtcccagtctttgagatgtgttgtttatgaaatatttctctgtagaatcagtgctgatccatactggtaatatggtctctagttattatagttccttgctagaacatagtaacgtggctgaagtaagaaagctgcttcatttttcttttagtaaaatattgaatttttcccaagtttagcaaagttacagaaacatgctcatggtaaaaatgatccatacagttcagaagcacgtaaagacagaactccacatgcatgattttctccaacatgctttccatactgtttgacagcagttgaaaatactttggaactgcactccaaatgatgattttagatagctttgaattatttgttaagttcatcattaaattataacattatctgatgttaaaacatgtattgtgatacattcttaagctaagatattattatactgagttgaataaagattatataatacggtagatagtaggttgaaccatatgaaattactgtttttgtaagccaagggtagtcagaaatctatcagcagtttcatatggttccgcataatactttatatgatcatccctgttacaggatgaactgagtcattttttccattaacatttgcattaaaattttaggaagatagaaacttaagagtaaaaacatgggtaatttgcttaattatgaaatcaggttaactagaaatacgcatattagttttgtccccttggaatcttatcataggaaaggaatgaatgaatggataacttaaatactttttggtgttgcaggaggaaattaaacttaggtttattctgaatttcatacacagcagtcgagttaaga

SEQ ID NO: 102376 - DNA, 1766 bp, Homo sapiens
atatccaacctttgattgcctgtgtcagtggagagcaccataaggtttcacctggtttggggaatgctggcgatgttgtttgccgtaaacctggcagcaggtgcaaaatagcatctcagaaatgttcctttgagttggtttgtgaggagctggtctgttggagaagtccctcaataattaaaagattacttatttaacttgtattatggttcttaatttatgaaaatctcgtaggtgaaagtaagtcttaaaggttgttgctgttgctttacaaaaagattttctgaagattttctcaatacaagtttatattcattttaatcactatggatcttctataccattaaaaacataactgttgtgttgagtaacatatacctgtttgtagttagaaaagttttttaatattgaatatcctaaagttcttatttaaggaaccattagatatgtcaaatgatacaaacattaggatatgaatatttcctttaaacctcacttatcttcttgtaggaggagagacttcagcatgcaaaccttcatctgttcggcttgcaccgtcattttcattccatgctgctggccttcagatggctggacagatgccccattcacatcagtacagtgaccgtcgccagccaaacataagtgaccaacaggtttctgccttatcatattctgaccagattcagcaacctctaactaaccaggtaagttcatggagtatcagaaatgactattggaatggcagtttattccttaaaaatgttggaatactaagtaggcaaaatgctttaatggctttcagttttacatgcaacgtgggattatggattgggaaaacatgttaagaagtttgcattaaattttttttttttaatttttacttgtatttcacttaaacactcataaacataaccacagtctctcattctgtaatagaaaggggaaaagttatttctgaagaatattaaaggatcttgaagaaaaagcttatttttatggaaaggtggctaagttaaaaccgttacaggaaagcaagtcagattccattacagcaaacttacagaaccaattttgtgttattttaaactacctttctacacatttgtaaaaataaatacaaaactccctaaaattcaaaagagatgtatgcaaattaaccgtgctatttattctaatattcagacaggctattcaccatttttctatgaagtgaatggtgtaaatagaatacatgctgaactcttggtactcacacacacatacacatgcatatatatgtatgtgtatgtatttttaatatctttctaaattaactgcaccgtctacgttgagttttggtttgggagacttaacagctgtagttgtgtgaaagtttcttgccccacggatatttgatgtgtgatgagcactgaaaatggctgcttttccatggacttagaaatttggtttgccattcttttgtttaggtcttttaatatattgtgtgaggataaaagagttgggagatttaaaagtatgtcttttcctggtgtcttgtttatattaaaacgtgtttgtaataaaattttgctagtaggctgacataatgtttaaaatatacaacatgttaacattcacagttaaatcgttacaataagatgaatttggcaggacttaagattttatgtagtgaattgatttcagtttagttgcgtgtttgagaattgggacagttgttcagaatgtccaagtttaggaagtgtttaattgtgtaccagaagaaa

SEQ ID NO: 102377 - DNA, 1061 bp, Homo sapiens
ttcccacttgttcaaaagcagcctgtcaggcagagtgctgtttttaatgtgtttcacagctgaaaggactgcgctcccatttgtgacttttccgtgtgtgagcaggagactgtggggtccagcctgggcttccttcttcttagatacagtgctctttcaggtctaacctctggtgtctacagcgggctaggaaaacttccagtcctttaaagtcatttttatcattatattattttagtaaataatttaattaacaaagcacctatttttatatccaactaacgtcttatgtgtatttggatcatataaaataagagatatttcacttactatttctgttttaagctatgaaatacttttaaagatttgtgtgatgtaaaaagactatctttaaagtaataatactcagccaaatatttctgccaaaatccaaaaatttctgggcctaataagggagtcatattagaggatccctttcctgtaactaaagtgtaggctgcgtattaagtggcatagtctagtcataggacctggcttcaaggtcttggccggctcatgatctggttgtaggatttgagttaggttatttgtacccttcatatctgttccttgggtgtcaaattggcacctccgactagaacccccaacacatacaaagtaccttttagctgtaaacttactgtaatttcattatttaattttcattgtttcttgttaatcatcctatcagatgtcttttaaaagagaaatagagcgaaagtaggtgtagaagaggaagactgatgtttggaatgctggctctctgggctattctagttttcacaatatcttccatagttcttaaattctagtaccctggatatgtgttatagatgctattcagctttattaatgctctcaaaataacaagaaaggcagaatacagtgtttctgattcttcattatataggaaaacaggaggtaaatataaataaaatgaaataggtattataatggaaaacagtttttgaaaggagtcctagagcttatactaaagaatcttttcaggacaaaagttaatt

SEQ ID NO: 102378 - DNA, 1043 bp, Homo sapiens
cccttttttggtgccagctgggtcctgaaatcctatgttaaggaagctgaaagttgcctctgagggctgggtttatctttgtctgctagttgtgaacctggtcaggttttaggaataattcagaaaaaaattttctttgggctaattgtgtggtagagaagccctcgtgggcaacatcctgtgtgtctcctagattggcgtatgtctgcatttctaccactttaaatttggcggaataggatcaaagcctcaggcagctgggcatattatcctctaatttcattgatttgttctagtggttgtctttattggaatccacatgaaagggaactttgagagagaatgtataatcatctaatgtgtagctgtctttaaaaaagtagatacatgcaggttacagaagagggaatttatatcttatagttaaagtgctagtcttttctgtctatttaaggtgatgcctgatattgtcatgttacagaggcggatgccccaaaccttccgtgacccagcaactgctcccctgagaaaactttctgttgacttgatcaaaacatacaagcatattaatgaggtaagacttgatttgttataataacatctatcttgcagtatgtcattgagaaaaaaagtgtgacctatttaccctaaacttttttttcattcctagtagttgtcatattgatgattattatgaagactaatgatttagaaataatattacaattatgtaaaagatatattaacaaggactgcagagtataaagataattgtggataacttgatttttttaaggttgtatttaatatactgttatttctttttttaatttttattttttgttttttatttcatttgagttctgtaataacttattcaaaacaagaaaggggaataaggactctaaaagtatatatgtgttagaatttttgctagaatttttatatatttgtttctgcttttgccatgggtgtcaggaagctctgaaatatgtttaatacctagttacaggcatttggcctagtttatttgatctatctat

SEQ ID NO: 102379 - DNA, 1071 bp, Homo sapiens
acagaagagggaatttatatcaataaattccctttatatcccaaatataaagttgggattgactggaagggggcatgagagaacttgaacttgagggacatgaaaatgttacttggctgtttggcatttggtaacttttgtcaaaattcctcatgttgaactcttaagatctgtgccacctcactgtatataaattatacttcaatttaacaaataaatataaaccaggtccttttacttttcttgaatggcatactttggacaagtcacttaacattttttgtttacaaagtctataaacagtataactataatgaatttcactgtataaattttttcattggttagatcagtattattttctaactcaaatgtcaactgtagaaaataggtgtgtgtcaatatactctgataatgcccttcctcacagtgatttaaattttacagttaacactatgtattctcatttcaggtttactatgcaaaaaagaagcgaagacaccaacagggccagggagacgattctagtcataagaaggaacggaaggtttacaatgatggttatgatgatgataactatgattatattgtaaaaaacggagaaaagtggatggatcgttacgaaattgactccttgataggcaaaggttcctttggacaggtaatttaatggaaaatgctgaatttcattagttagaaagaacttcttagtgaatcttgttgttaacagcccttcctcaagagtgtacttttaatatttgcaaatagagctcagcaatggatatgcaagtatttggatgaccataattctttaaaggtagtgatactgcatcagtaatataaactccttagacttctaaaaacttttatggctaccaagtgctcattttactaatgactggtgaattttaatcacttaatagatagtattgcctctttgttatgggccttgtatagtctgtagatgattgttaattacatatgctagaggtatttaccttcttgtccgatagaccacttcaaagagaaaagaattaccatgttcaggtggtgcagtgggagtccactcac

SEQ ID NO: 102380 - DNA, 1074 bp, Homo sapiens
tcatgaacgctgtgctttccttagcagtaattctcattttaaaactatcataatcccccaattatggcgtttgtggcattgtggaactttactggtaatttgtgtttgatttttttttagtctaaaccaatttttcttttatatacttaggtttttatgtatgaaaatctaattgaaagttagaaagttatctgaagccttctgctgataaacttttaaatatttcatacatattcttagggttcaggtatctctcattaaaagaatagttcgatgagttgttttatagtgttatttagtaagaaagataaaaaaacctaagcatttgtcaagagtcataatttatttctgaaggaggaaaatagttaatttaattttattaagaaaattatctattttgtggatatttagaaatattgtacaaatgcaaaaagaaattcaatttaaaagattgatttaaagttactgtgtaataagtggatatatattgaatagaaatagatggcatctcttctacttaggaaggtcagaaaaataattataaaaacatataattgagaattaggtaaatgttataattaaggtgaattataaattattgtgaaatttttgcaattaatgaaatagagaattattcatcttctcttttaggttgtaaaggcatatgatcgtgtggagcaagaatgggttgccattaaaataataaagaacaagaaggcttttctgaatcaagcacagatagaagtgcgacttcttgagctcatgaacaaacatgacactgaaatgaaatactacataggtaaacaaacaggcaaacagcgcagtgtgccccaacccacaccaaaactttgagttaatggttcttttctatcaaaatattttgattttattttaaagtggctgattaaaaatttgtttatttctgttggacagcaagatttatataagtgacttgatctggtagtaatagtctaaatcttggggaatgtgccttccatgtagcataccatgtagaaacaaatgagaatagtgtgtgtgtgttttttatttgcaacttactggtaccatttgttt

SEQ ID NO: 102381 - DNA, 1149 bp, Homo sapiens
ttacgtattatgcatttcacagtcagattaaccaatccctcaaaatgtttagttctttaagccgtattcgtagtctaatgttgaagttaatcaatggaaccctaattcaggaattagccaattcttttctgttaatatcagatcaatgtttttaatccaatgctgactgcagttttaagcaattgaagtaatactattttgaaatatatttcagatataccagtatattcagagtcgcttttatcggtctccagaggtgctactgggaatgccttatgaccttgccattgatatgtggtccctcgggtgtattttggttgaaatgcacactggagaacctctgttcagtggtgccaatgaggtaaatgatgtattgctttacaaattctgttttcataatttctttttgtctttcatctgtgacagtgtaatttaaaagttgtttttaggcaaagatgtctacttaatcattcaaatgtgaggtcagtttgaatatacctatttttcatatttgtcagttgtcatgtaagtttagaattatgagataggagtaggatattttaatctactcatgaaggagaacagttagaaagtgttaagtattttggcatacattttacaggttttaaatacaatacagaaagcttaaagatgataaagaatgaaggccatcctgaagagtgatacaaacatcactctaaattttgagattatgatttggagttgaagagtaatgatcagtaggactgatggatactcagtctgaataatgtagagtaaacgagattatagacttgtagggctacagagactgtgtgcagttctgaagtctacaggttttcagtctgtgttctggaagatttttcaaggtcagaggcagtgaatgggagggcagggacaggccttaacttccctgcagtcagagaaattagactttcattgttttaaaaactacacctgtggggttttgtttgttttttaaaagaaaaattgacaatttgcacgtcttgatcagtctatttataaatgagaagagaaaggccaaaggcattaatgacttgtaccggattacacagctgttaataggtggtgtcagaaacttgtttcttccatccttccttttaattcttctttttttttttttttttt

SEQ ID NO: 102382 - DNA, 1113 bp, Homo sapiens
agacggagtctcgctctgttgccaggctggagtgcagtggtgtgatctcggctcactgcaacttccgcctcccagggtcaagcaactctcctgcctcaacctcccaagtagctgggactacaggcacccaccaccacacccagctaatttttgtatttttagtagagacggggtttcaccatatgaccaggatggtcttgatctcttaacctcgtgacccacctgccttgtcctcccaaagtgctggggttacaggcatgagccaccacacccggccactttttatatgttttaacagtcattctgaaatgtttctaacttgtgatttcttctttaacctgtcattagaattttgttacataatttcaaaatatttgaggattttctagatgtcttattgagttctagtttagtagcagtttggtcacagaacgtgattttagtcctttaaaatcgagacttgttttatggcctagcatctaatgtgtctttgtgaatgttttatgtgtgcttgataagaattgtattttgtgtttgtttggcgtagtggtctccagctatcaatgtagatcaaattgtttgatatttttcttcatatcttttatatctttgtgtgtatttgtgtatattctgtcagtaattgagagaagagtcttcattgataagtttggatttgtcttagactccctttgtaacattgctttatggtttttgaagctttgttaataggtatatgcatgtttgatattgttacgacttattgataaattgacccttttatcatcctgaaatgtccctctttgtctctagtcatgtttgtctttaagtctgctttgtccgatatcactatagtcttaccagtgttcttattcttgatattttcatggtgtgtgtgtgtagatatgaaagatatgaagaaaaatatgcaacatgtgtagacacacacacacacacttttacccttttactgtaaacctgtgcctacctttatatttaaagaattatttttgtgttgtgtgcaacatatgatcaagtcgtttttttaatctagtctgttagtggttaacccattattcagagttttgggtttaagacttgtcttatttgtgttct

SEQ ID NO: 102383 - DNA, 1019 bp, Homo sapiens
tatccttatatttgctcttttctggtgttattcattcctttttgcaattcctagcttccatctggtattatttcttcagcctcaagaccttcctttaacttttattttgtaatgaataagctatcccgataaattctctcagcaggtgttgatctgaaaatacttgtttacctttattttttggaagatattttcagtgaatatagaattatagattaacttctttctttcagtgaaagaaaaagatgttacgatatagcttaaagatgtattgactttttttctggattacactgtttcggtagagaagtcagtggttattcttagcattgttcccctgcatataatattttccccctcttccctctggctgattttaatattttctctttgtttgatttccgcagtttgactatttacctaggtatgattttctttgtattttttctcctgggagttcactgagtttcttggatctgtgggttgatctctatcatcagtttttgaaaatcctcagatacagtcttgccaaatatttgttctgctttcgtctttcttctagttctccagtgatgtgtatgttacagtgctgaatattatcccagaggtctctgtctggtttattcattctgttttctgtttgtgtttttaatttggataatttctttttctgtcttcttgttcactgatttcttttttttccttgtgctgagtccagtctgttgttgaatccattaaatggattcatgtgatgttattgttatttttgagacaggttctcactctgtcacccaggctagagtgcaatggtgtgatcatggctgattacagccttgacttccttggctcaagcagttcttctacctcagcctcccaagaagctcggactacaggagtggtgcaaccaccatacccagctattaaaattttttgtaggaacggggtctggctatgttgccttggctggtcttgaactcctggactcaagcagtcttcccacctcaacctgggtgtagaga

SEQ ID NO: 102384 - DNA, 1040 bp, Homo sapiens
ttttctcttctgaaattctacatctattcatatgttgtccacttttgaactaaattgtttatcataatttatcagaagtaatttatcataattattttaaagttccagtctgctattttcaacatctgcaccatttatttatgtgtatcttctattgggtttttttctttcatgtgattgtggacgtcatttttaaaaaatgtttgtaatttttaaatgtgtgacaaattttctttgcttaagaacagttaaagatggaagtgagtcatattttccctcagaaagaggcctctcaactctgtcaggcccctcatgtggggctgagttgatctcttttgtagcttagctgactctgggctttgcttgtttgacttagattctactccccactgttttcatatgttttgagctgggatcaggacattcccttcagcagtgtttgtgtctttagaatcagggaaaatctagtggtctctatacattactgcccagtcagcagccccactcctaactctctgtgcctgggagatcgccttcctcctgctgtactgccccatccttctgtctgtccactcctggccgtcagaagttggttcagacttgggctggagtcttctcgctcatctgtggcttacttgcgccttctcccactgcaggtctcttccaggagaggcttttcattttgtagaattcaggagatttttgttccaactttggatcctcatacagctctctgatgggtctttaaaaggcagtgattttatgacttattagaggaggaacaatcatctcacacatttctgcattgtaacagaagtcaaagtctggtgatgctattcttaaattcaatatttatagagatcttgagggttatagtattatctgtcaaaaatgagttttcaggaaatctcaacacacgttagtttattattacatagattttctaaagggaagcatacataattttctctttttctaccatgagcaggtagggttaggccagtgcctttttatgtagaacatccttggtgtcattgcca

SEQ ID NO: 102385 - DNA, 1040 bp, Homo sapiens
tgggctgctgttgctgaaggaagtgtaacaggtgctgcgggtgcacagttaggtaggaaagaggctcccagccagggtgagcaggggcatgcatgttctctgtaaaagatgagagaaaatgcttttagccttgtggacctctgttgcatattttttgtttttggttgcttgtttttacaacctttgaaaacagaaaaaccatttgtagctggagctgtagaaaaccaggctctggatcaggccatagtttactgacccctgggctaaatgatctttatagccatttttggtctcagaattaatgttgaactgtaactaccatgcatttgggatagtaatgtgtgaaaaggcagaggatttaactatgaagtgtcctttttaataaaggcctcaacatatatatttaaacatatttgaaattcaattatgtgagtgtttacgtattccaccaaatttagagaaagcctttcatcttctctcttacaggagtacaaaccaccaggaacccgtaaacttcataacattcttggagtggaaacaggaggacctggtgggcgacgtgctggggagtcaggtcatacggtcgctgactacttgaagttcaaagacctcattttaaggatgcttgattatgaccccaaaactcgaattcaaccttattatgctctgcagcacagtttcttcaagaaaacagctgatgaaggtacaaatacaagtaatagtgtatctacaagccccgccatggagcagtctcagtcttcgggcaccacctccagtacatcgtcaagctcaggtctgtgctgctgcggttagattaggcttgggaatgttttgtgttttctttatgaagtgggattattttaaagtgttgattaaatttgttaatagagtggggagcagttactttacttaaatctgttctttgtagttagtagtaaattcatctcccccaaagctccaatatttagttacgcatgtaataaaatctgcttggcagttggaaatctgtttactaaccagcattttaaattacttcttaa

SEQ ID NO: 102386 - DNA, 1070 bp, Homo sapiens
gttgattaagagtgctctccattcttgtgactagggcagctgaatggtgctggagaaaatcccacatgcagctgtttgtcagcactgttaatactcaccaacctctgctgggcagtcttacatgttttccaagttgtcccatcctctcctattctctttaataatagtttcaaacttttctactcttagaaacctttgccctccccttctctgttcttacccactctttgctttgtaaggaaaagagtcttcagacaggaactctctccactttgtaacattgaatacatgatcctgcctatgtgtgcactgtccacttctcctctaccccttttttgttagaagcagtgtgtttctttctgcctaaggccaagcccactcattgccctgatcccctctctcctgccatcatgggggctttgccctttggtctccctcagctccggtgtcttcactctctcctcttttggctttttctgttgatcagcatttcctcatcctcaggcctctcccatcttaagcagcacctttgcgtgtccccctttctttccctatacttctgctacctgtggtctttgtctctttaccctgaagacctctttgcttgttccacttaggtcctgccctccaactctcctgccggtgtcagcggtgacctttattcatgggtccagtggacaccctaatgctgtctttctgcattctacaacttcatttggcagtgttgacttttccccactctttgaaacactcactgctggtttccttggcaggatgttcttctttccctccccccaccccttttctttgccctttccttcactgtctgtttcgttttttttcttctacccagcactgaaacctgggtgttcctcgaggcatgacctgtgtcccttccctactccgcttaatgtttcctggatgatttcagccacacctgccagggcctgcagtcaccatcctcatgctagttgctcctaagtcttgacttctgacttagacttcacttctgaacccctggggcctttctaattgtttactataaatgtcaccttgaaagtctcaacaat

SEQ ID NO: 102387 - DNA, 4547 bp, Homo sapiens
ttggaatctgtttcacaggtagactcataagttcttgctcatgggttggacagaggcattgttgagcagctaggtagatagtagtcctttattgaaagaagaaagatggagagaggaaggacatgagggaaaagtaaagacttccttttggacctgcccagaatactgtccagcccttttcaggaaatatttgctgacccctggcataaacagggctcccaaggaaggacagtggctagtgaaatagatgaacctatttaaggatataacttcctaaaaattgcagctttcatgatgaaattttttgcccttgaatgtatttgggattttgtgttataaaactgtcttaacacattaaaagtttcaaaaaccgtttccccctgattaatatgatgctagtttgttagtgtcatggcttttgatggaagattaaagcttggaaacagtcctctgaaaaatccttttaaaaatctgttctttcaggtgcgtcagcaatttcctgctcctcttggttggtcaggcactgaagctcctacacaggtcactgttgaaactcatcctgttcaagaaacaacctttcatgtagcccctcaacagaatgcattgcatcatcaccatggtaacagttcccatcaccatcaccaccaccaccaccatcaccaccaccatggacaacaagccttgggtaaccggaccaggccaagggtctacaattctccaacgaatagctcctctacccaagattctatggaggttggccacagtcaccactccatgacatccctgtcttcctcaacgacttcttcctcgacatcttcctcctctactggtaaccaaggcaatcaggcctaccagaatcgcccagtggctgctaataccttggactttggacagaatggagctatggacgttaatttgaccgtctactccaatccccgccaagagactggcatagctggacatccaacataccaattttctgctaatacaggtcctgcacattacatgactgaaggacatctgacaatgaggcaaggggctgatagagaagagtcccccatgacaggagtttgtgtgcaacagagtcctgtagctagctcgtgactacattgaaacttgagtttgtttcttgtgtgtttttatagaagtggtgttttttttccaaaaacaaagtgcaaagctgcttgaatcaggaggagattaacacactgaaccgctacaagagggcaaagctgattttttttttaacttgaaaagattgcaaagggacattgaagtgtttaaaagagccatgtccaaacccatcttcatggatagctcagaggtatcctctttttgctcccccattttaacttgccacatcccagtcacagtggggtttttttgtctttctattcagcaaaagttaatattcagatgttggtcttggtcatttgccaactaattttaaagtaaaaggcactgcacataatttgcataaagggccccatgagggtgttttttttttttctttttgtcccccccatccccctttttttttgttttgttctgttttgttttgggtgggagggtgggaaatttgggtttttaagtcctctaaacacacttgggcacggaaatgcagtactgtaaggaagagggacctccagcttccacaaacaccatcttcagctgtatgaaagggacggttgtggtgaagtttgtcaggcacagtaagcatgctgagtggcggggatcagaactctcctatctgaacctactgaggagcaaagcagcaattacatgggatcctgtggctctcccgttgcagaggccacaggaagataggatggaacgtgactggtctcctaaccaaggtgcactgagaagcaatcaacgggtcggtcgtggccagtcctggggaggtctgagtggtggtctttgggataacctttggccttatggatttggactcgaaattagaagagcctaccatttcagatgcaatcacttttggacatgcttttgcagacagtccttaatgctgaaaacacagagaatgggtaattcaagaggcctttcttttaaaatagacttttgtgacccactaattgtaaggtattgcaaggtcactttgcgtgtgtcataaagttgacttccttattggttgaaggtcacagaagtagtggtttgctttgatggaaatagctacagctgtgtcccttcctgctttttactttttcttttgctttttctcggcacgtggtatctccaccatttcttctgcacaaagatgtcttctgttcatcctgaacatttttaaaaaatgcagaattttatgtgactgcttttttgcctcacaattatgctgtgaattttacaaaaatttattttcttttttgataatttattgtaccaaagctgtttttatagcacatagatgtctgtaaccaataatgtagcagttctgcactttgacacaaggtgtaactagaccatttttaaatgtcagttgaaaattatggctgtactattgcttaaacaaaactggaactgttgttgaatccatagccaatacatttacagcaatctgtgtactgaacatagtagattgacatctaattcaagattacaacatctgttacattctaagtgtgttcaggcttctgaaggtaaagggacactggatccagaagctatggaaccagcagttgattcttgtattcctgattaacctacttgtaaacttgaaagcaagaccttgattgcaccaacaggtccagagtatgagtgcaagcaaagcagaactctcatgcgtgacctgagcagacaggctggtatttaacaggtgcctcgtgttgagattacgctgccttaatgtaacacagtctggcagttgctaaatttgtgttcccattttaaattgaccaattttggggtgtgacacttttgagcggttgaattgggagaatgaagataagtaatttacctgtccaggatcaaaagaagcctagaaaagaagcagtaatctacctctgccgataacctgtttaagatgactcagcagaacaccgcgtttcattctattggtcaattccatgtggctgactaggtcaattttttttctgaacaaaagcaggtttttatatgtaaacagtgagaaaagaaaggctaaacactatgtaaatgtgaatggaaacttggaaatactcgtttttataaactacaaaaactttttgttgtttatcaggaaatccatatttattttgtaattaactgtcaagcctgtggatgatttttttgaacttggtagttcataaaggtttacagtgaataaaaggatatcatcttgagtatagcaatatcaaaaggaattcagtagttactgctgtttaggaatataaggttaagatatcatatgggtcaggtcattttttttttctgtgctggttgccacatcttagcaagcaccaaaaaactaaagcagtttttaaaccgatatttacgtaaagaaaatcataaaatccaatgcttctgcatactgtgttatgttacagtccagttttgtgtgctttactacacagtttggttacaggacttctgtgcattgtaaacataaacagcatggaaaaggttaaatacctgtgttcagattgtaagatctagtccggacttgctgtgtatattgtaacgttaaatgaaaaaagaacccccctttgtattatagtcatgcggtcttatgtatgataaacagttgaataatttgtcctcagactctttactatgcttttttaaaaattaatttaagaaaaatgtaaacatagtaaaaatcttcctatgcaattaaactggtccaggtctggtaggtatagtatcaaagttgagttaaatgtgtaaaaaggaaactatttgagatacattgacataggcatcagcaatctctgaaagtaaaaattggaggtttaacagatcattttgatttttcacattgatttttttatttgaatgtttacataattttgtgattcaaaatgctcatattttagttggtagcatttcgactggatgtgagggtctgatggttttctctgatatgctttgacgtgcttggatgaaggaaggaatacgaatactcattcttccttccctaactcctcgtacggggccatatcagaattctagaattcttgccactgtgattcaattgctaacctaaagtcttctctttttacaaattcacctgcttcagtatatattaaggtggctttcgagaggcaagatgcttatttaaaagttaagcgtgaatctgtaaaattaaggttggttgcgtaaagttgaagttaaccacatgtaagaaaggaaaacttccattagttttcttcttagggtgtgagaattttacctaggcacatggatattgggctgaaaaaaaaaaaccgacatttttatttaaaactacatgtaaaaaatcatgaaagattcagtaattatgttaggctcacaagtgaccattgagtttgcccctgtactgcttcccagcttttgtggtgttgaacttttctgttctt

SEQ ID NO: 102388 - DNA, 1033 bp, Homo sapiens
accatgccctgctaatttttgtatttttggtagagatggggtttcaccatgttggccaggctggtcttgaacttccgacctcaggtgagccacccttcttagcctcccaaagtgctaggattacaggtgtgagccaccgctcccagccataaattttgatctttataactgctatagtgtcttacacctaaagattgataacatattttacaaaataaaatggagtgcaaatgaatgatcatagccaaaggcattctgcacaccagcacctggccaccatttgtcccaaattgccactcccttctgcctaccatttccaccctccgctagctttccttttaagcctgtccattcttacctcatcttccacacaaatggtgtttattctctgcccaaatctggggtcctggctaccatcttcagaaaattgcttgcagacaccaggcaaccttcatttacttttaagaaatcacgagatagccccaaatcaaatctcaaactgcaggaaacttcttcaaattctcccattctatatttgtatcttcctcctccaacagtaagaatctgaattctcaacaacctgtatatgtaggctctctcctacaaaacatacaaaacactttcggaacggtcacatccttaactctactgaggaattgcttatgcaagactcagacctcacagctaaggaccagcaattcctccagttgaaaaagaaaatcccatgtcaccttatttagcctgagggctcccaataatgtaccagtaggtgatggaccaatcacaaactgcccaatgcacttgaaagccaatcagaaagcttccctacttccaaaaattctacctaatagaacactcaccaagcaaagattatttgtcttaagacttccttcttttactctataaaacccaccctcctttgatttttcactaggaggaaagtgatggtagcagtcttccttgtatgatctcaataaatagccttttgttaattctacagatgcactttgcccttttgataccaacaactaca

SEQ ID NO: 102389 - DNA, 1118 bp, Homo sapiens
caatgtgcatatttatatataataaacacacctatgcatgcacactttttgatgggagacactaattttaggcagtataggtcaatttctaacttctgagctggggcatggggtcattttcaggtgacaggtggggtaacagccacaggtatgcaaacttccttctagctggtctcgagggcatctttgctcagagggggcagaaggaagtagcactggcatcacttcgaggaagccgggtgtttgcccgtagcacagcctgaagcaactgtgcttgggacataggtgagtagagaataaagtacgcgtgggcaaggccaggcaagcaccagcacagcctgaagacacaccctccgctcgtggacagaatggggcaccatgcagggagccccatagggactgctcaatgaatccacctggactggatttgtcactagatggtgtgagatgcaacttgtattgcacccatacctggagcccggctgtcattctctgccatggagacaaagtgcctatgttgtggctgtcccagaccctttccaagaggatttagactgcagtgtaaagggggcttcatgttgaggcacattatccatttgtggttaaaaattttagcaaggagctaggaaagttatgtttggggtcatgatccaaaggaacttctaccctattagcttaaggattgaatctaaaagatattggaggttgaaaaacggtctcaggaaagtcctctaacttaacacagggacataatctattgaggctgaatggaaagaaggacaaggtgttgcttttggagccaaagtgccagggttcaagacattcgtcaaagggcagtaatcatacctatgcagcctgccttgcaccgtcgccaagaaagctccaagccagtgcaaaccaactatctgcaaaacatctaatgagaggtcagagctgggctaaaaagtcacagacctgaacctttatctgcaggataaaacatttggattaaaggcatttaaaaaaaaatgcttgctgcttttttggtagcagagcataaagccacatcaaaagaagacatttatgcagccaacaaacatatgaaaaaaagctcatcatcactggtcattagagaaatg

SEQ ID NO: 102390 - DNA, 1087 bp, Homo sapiens
atttttgttgttgttgtgatctgtaattagcaccttcctgatatgtgtggcttactcttatttccatataaatatatataaatataccagtagttttctaaggaaaagaagtttcctcttattcttactcattttaaaataaataaataaaattgaacataaatgagaaaaaagaatttttaaaatcttatgcctacaggaaactttagattgagcaaaaacaagggcatgtgatgtgaataatcccaagattccagaactattcactttaaagacaatgatctatggatgtgaggcagcttttgtctttcccccaaaatgttctcctgggtagccagggaggctggctggaggctgtgcttgtggaaggcagctggtcagaaatcccacgtggatggggatctaccccaagatgaagatccctggcttcaggaattgactgaatgtgttcccacccctttcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagagtaagctcccccttcctccaaggatagatggctgtggctatggttcttatgacctgagcttcagagggttcaaccaggtgtgtcgacagcatcctcctgccctcgcccagttcccactggggatccgagggagccacatgcttggtatgtgatgacttaggggagcaacaccctggccacatcacctgatgagaagtagtcagcgctctcaggagaagccaaaattcacttcaacactcagctgcctcctccagggtcctgcgaccaagaagatggaatgtcaaaggggaaaggaagcgttaactggtcacacattagttaagtctccatgataccccgaatcgaaatagaatcattaaggcttctctttcgtaggaattagggggattattctccctaaagctacatgaagccccact

SEQ ID NO: 102391 - DNA, 1061 bp, Homo sapiens
acgaggagaagaagtgagccaagggtgaagcccttgtgttgggtctgagcccctggaagggattacctctgtgttccaccttctgccagtcctgctggtttgtggatagcagggattgcttccctccaaggcagttatggtgagagcacatgggaagtgatgagggctcttttaatctaaaacttcttttctcctctgtgtgaaacactttcttcctctttttcaatctcccctcaagcctattcttgttgtccttggccagtgcggtgaagcagttccttgcattgtgtgtaggacctcgccaaggacagagagagacacagcgtgggttggtgttgcattgcattagaggtggccaagatgcacagtccagcccatgtggtcacaggaaggaggggtattactccgtaggtttcctttctcacaccacagcacagaatgattgctcagatcaaacattcattgtctttaagcactggtacaattgcagttcaatctcccctgcttcagtctacactgagttttcattgagactttgaggaattcaagcccctcttgctaaacacacacacacacacacacacacgcgcgtgcgcgcacgtggactactagtatcaggtttactaatgaaagagctgaatgcagagaagtggatggatttgggcccagttgatctgtggaagagggagactgagtctgggctctttactttcttggatggtgaatgttgccgtttgcatagaagcccgcatggcagtgaactaacagtaaccttgaagatgtgtttcatccaccacccttgaacccattatggctcaagcttgggtattgcttttaggaatctagcattgtttcaggaaaacattttagttcttattgttttctgggaagccttactttgcacaagggcagtggaagaaaccgaagtgcatattaagtgccatccattacttgctgtgtgtttgaatagtgatcgcagcgttgctatgttaaattgcaaagaacctgtgaacctgaatctccctccatccttcccttgtggcctctcatctctcgccact

SEQ ID NO: 102392 - DNA, 1146 bp, Homo sapiens
ttctcaaaggagcgagcatgtcgtggacacacacagactatttttagattttcttttgccttttgcaaccaggaacagcaaatgcaaaaactctttgagagggtaggagggtgggaaggaaacaaccatgtcatttcagaagttagtttgtatatattattataatcttataattgttctcagaatcccttaacagttgtatttaacagaaattgtatattgtaatttaaaataattatataactgtatttgaaataagaattcagacatctgaggttttatttcatttttcaatagcacatatggaattttgcaaagatttaatctgccaagggccgactaagagaagttgtaaagtatgtattatttacatttaatagacttacagggataaggcctgtggggggtaatccctgctttttgtgtttttttgtttgtttgtttgtttgtttttggggggttttcttgccttggttgtctggcaaggactttgtacatttgggagtttttatgagaaacttaaatgttattatctgggcttatatctggcctctgctttctcctttaattgtaaagtaaaagctataaagcagtatttttcttgacaaatggcatatgttttccacttctttgcatgcgtttaagtcagtttatacacaaaatggattttattttttagtttaactgtgtttctccgacagctcacctctctctgaccacccagccatttccttcctgtgctccacgttcttctgtgtgattaaaataagaatattatttttggaaatatgcaactccttttcagagatcaggagggatttatgtagcagctatttttactgcaaaagtaattcactggaaaaaaaatgtaatttgtaagaaagctttatttttatctcagctctatgtaaagttaaagttactgtacagagctgaaggacggggggcggtaggggtcttgatgaaacctcttgaacgaagcacagtttgtcccatctttgttcactcgtgtgtctcaaccatcttaatagcatgctgctcctttttgctcagtgtccacagcaagatgacgtgattcttattttcttggacacagactattctgaggcacagagcggggacttaagatgggaaagagaaagcatc

SEQ ID NO: 102393 - DNA, 2059 bp, Homo sapiens
aacagggtggtgctaggccattcatgagggatctacccccatatccagtcacctcccaccaagtccggcctccaacattgggaatcacattttaacatgagatttggaggggacaggcatctaaactatatcaccttagttcactaatgaggagagtgacttggaaaaattgcccacctagaaagcagaaccaagatcaaacccaggttgtgacagcaggtgtgttctgtttctccaaggcacactcccacccctgctaggcatgctattattgtctgtggtgttaggtgaatacctagaggaatgtttccattctgtaacaaaattatatgttttttttaatttgaaataaattttatgttaggtttttggctcttgtccaaggaagaacatgcagataactattctcacatgtcgacatgttaccgattataaaacctcagaatccaccggcagccttccttctcctttcctgagagccctaaaaacacagaatttcaaagactcggcgtgttgtccattgctagaacaaccgaatatagtacacgaccttcctgcagcaggtggtattaaaatttgtaacatttacattctatcttattgctttattgatactacttttcaccattagaggtctttttgaggtagtttattaatgatgattgataccaatatattgctgttagtcctcaatatctgtagttacaagtgcagtatatttagtttgagttttcagattttccagacacagttatttgaggagctcatgtttcttaactgttgggcttcagacatgctgtgtttctttttggtctttgattattcagaatgcaagccagtgttaaatataaattattggtgcatcaaaagttgataaagtacattttaattatcaaaacagaagttttgaatattgaatcttgatagttgctttaatttttttattaccatcacacacatctgccatcatatgacaaagagactgccatttacttttcagtgggtaatatattacataattgttatttattatatgaactgtattaaaatagggtttggttggggtttctttttgctttcaatgtttactagaatgagaagtggctaaatatttcactttatgcattttgtacttatttgttatttatatgctttattatagtcagtagaattttaatctttcagctacttaaatcatctcagctgtattttcaggaaatataaaattaatatttgcaaaagaagagattattaggaaaataaattgactttgaaagaaaatcttcattataattggttcaaaattgcagtaaataccttgattgaaagaggcagctgagataactacttttaacaacagcctttattatttaaaggtgtttaatttaaaagtaacataatagaaaacttacatcgtttttttttcttgtgtattcatagttctaagctactgtcaagtatggaaaatcccagcaattctgtacttgtgttatactgatgtgatgaaattagacctaatcacagtggaagcttttaagcctatactttctaccagaagcttgaagggtttggttaaggtaaggttttaactcatttaaattaatagctgcattgttataatcagcttagtaacaaacataaatgtatactgtcattttaaaccctaagcaatgcttggagatccattcttctcaaagcgaagctttctagtctggcagtttgaatttgattgtcatcatctcttctgtatacgtctgtaacttgacgaatgctttgttcttgtatgatagattaatgcagtgcaattaaatcccaaatgtctatgtggacagatggttttactgttcaataagcttctataactactttgcaaggttttttaaaaaatttttatttaatttttgagacggttatttttgagtatagtgtggatcaaattattataatatttatttacccaattttacagagaactgtatatgtgaagatgagagaattacataatgaacctcttccttacccttggtttatacctttggtctcattttctaaaaaaatt

SEQ ID NO: 102394 - DNA, 1069 bp, Homo sapiens
acccctacacaaccgggtaaattcaacaggaagattttgccacgtttattttctctcccgccactcctaagcgaattccagtcatcatggcctttcacctctacatttttcagaatacatctcaaacgttttagggattttcttacatatgctattatcacccctaacaacactaatactaattttccagtatcattttgtagtccatgctcactcacgtttacctagttttttcaaacatgacattttacagtggtctgcgtgaatgagaatcctaacagggtccacaggttacatttagacgtgtcacttcatttagagcaacctcctcttacccctcctaagagacaggactgattgtcttgtccagtgcccccacactctgaatttgtctgatagcttcgttgtggtgtcacttaacgtttgtatcacctgcatgtcctgtaaaatgaatgttcatttggaggcttggtcagattctcattcaaagttttgtcggcaagaatgcttctactaagtggtgctttctgtttcttattgcaggctatccccagctgtctcacttttagggatgctaagattggttcttgggtcaggtggacagcctgatcactattttagagttctccgtaaacacgtatgcaatagttttatctgttggttatcattgtccgagtccatcgttttctgaggatattagttatattctttataaaactaacgtgcattttatttattgtaaatcatacatatagtgcccttttgccatgatactgtttatattgaagttgctttagtttcatcttgtttcttgtgttagggaagtgcggctccttcgaagacaaacaaaaacatctttggaagtttctttgctagaaaaatatccgtgctccaagtttataattgctataggaaataatgcagtaggtaagtgaaaatgcagaagacttagtcattttgttgaaagaatgaaatatacttattttcttccatcataaaagatttaaaatgtttagtactttaaaaagccacagtagagtgattgtatttctgagtaaaatctctctcc

SEQ ID NO: 102395 - DNA, 1017 bp, Homo sapiens
ctggcgcccgcagggctcaagctgcgaatgaaagcctttgggggccggacgcggtggctgaggcctgtaatccaagcactttgggaggtctaaggaggacgatcgctagagtcctggagttcgagaccagtctgggcaacatagcgagaccccctcccccaatctgtaatttaaaaacaaaaaagctgcggggactgctggcccagggcatgacagcgcgggcgggcggtgtagagggcgtggccgcgagctcagggtgtgcctgggagcgagccctgtgcggggcgggacgtagcgcccgcgcggtgggggtgtggccgcgagcttgggctgtgcgcggagggcgtggcctgtgcggggcgggacttattgcccgcgcggtgagggagcgtggtctcgcgcaagccggcgtgcggtcccgcggcgctgcagttgtgtccagccggtcacggggcggctatggcggccacgttcttcggagaggtggtgaaggcgccgtgccgagctgggactgaggacgaagaggaggaggaggaggggcggagggagacgcccgaggacagggaggtgcgtctgcagctggcgcggaagaggtgaggcaccgggataagggcagcgcgctcaccgcagctggaaggtgcgcgggcctggcagccgcgacggcgcctaaggccggggctccgcggtcttccgagtggcccccgcggttgccgccgctccttggctctgcttgggccctgggtctccgtgaagccgcggcgtccagcggcgccagccccaggtgtgtgtggttctcgcgtggatctgctggcgtttcgtggagtccagggtgaagccgctgtgggagggctgggttcaaatccgttctttaaaggctttctggagcgtttctggagcatttctggaggcttggtgtcttgcggactcgtgatcttcccgcttgtcacactgtcttgggccgcagcgctcccgcgggccccaccacgtttgtcgtggattgttcacggacacaccaat

SEQ ID NO: 102396 - DNA, 1026 bp, Homo sapiens
caaagtttttttttttttttttttttttttttagcaatttcagtgtaatgaaagaatttaagctttgaatttataatttgctgtggtggggttaatttctgtcagtatttgagattgtattatcagtcttgcataatgaaatccttttttggctaagtatttaattcgaacatatttgcctttttaaaaagtgcttggcctaaacttattgtaactgcatgaaataagcatttgcttaaaacttaacattgtaaaattgttctctctgaaatgtgtgcagaatttaaatcatggccaaatgtattactattaccctatttacagtaatttgctttgcagaaaatatttcttcatcatggaactgtgaaatcaaattgaagatcttactggtaaaaatgacaaattaacaaaaggactaagacaagtggtgcccaaacaacctttttattctgcagttccatcatcataatagaccagttaacccaggagtcctaatgttttaaaacatcattgtggtgatcttgtttattctatctcactaaggatatccagtttcctaagctcttactggctagcaatttcgtcttaattttattgctaaatgttcaaattttgcttccaaactcactttatttttgcagatgtgtacatctgctaagtactaattttatgtaaatgattttgttgattatctttccacatcttaaaatgtttctaacagctttgagattttatctcaacaggctctctctgaccccaaagtagtacttaccttcgtgactactgacaaagtcacaaaatgcaggcgatgtcatgtatttcggtacaactaaatctaggaaacggttttttcattgcattactgcatattttcattttcatttaaattatgtcccctttttctcttgcttgaaacagtgctcctcgaactttgtcttccagcacattttaaagagaaccaattaaagaacaatcacacattctgcttattaaaggctatttaaaaagaaacattttgtattagaa

SEQ ID NO: 102397 - DNA, 1040 bp, Homo sapiens
ccattgatgtcattttgtttataatattgcagttcatactgaatgaccacttgatatgactaattcagggaatatatatttttctatgaaagctatgaatgttactatcacggcttttccttatttttacttgtatgtagcagcatttacagaaatgccaaaaatgtgcctcattaagaggcaggtcttaatcagttagataaaaataaaatgtatagcttaagatcaaaacagtcatatttttagatacagtgaaatcttttatgtttctctacagcaccttaaaaattagaacttgaatactttgagtaaacttactacaatctcatcccaacaaactttaatggtagcatgtttggcctatttcattgtggcctgtactaggattagaaaatttggtcgtggtataacaaagaagtgtatttacaataggatttaatttgttgttaatatgtatttgttgaaattaaaattgccagattaaatgaatatactgtcgcatctttttaacatagtaacgtgttactggaaaaattaagttgttgaaagtaagttgttttcccatttaaaaatatctgaatatatgatttgcatgtgtaaatctgaaaaactaaactacagaaacctagggttttctatttcttttttaagtcaaatgcatttttttttttttgttatacagatgaaccaagtgtctaaaatacttgagaaatttgtggttgcatgtctgttttaaaaaaaaggctttttgttttttagcataagccagaatattctaacctactaagtctgtgtcctttgctccttttgtagtatactttcatctaaattactgatccccaatatgttgatacacaggtgagaaagggaagaattcctaataaactgctattacttttaggtgcatggggtttgatttttgagctctaatgaaatgcttaaacttctttccagttcaaattttacacttaatttataatatttattgagtatattatgtcctcaacaagtaactataaaatgaaatacttaactcggtg

SEQ ID NO: 102398 - DNA, 4939 bp, Homo sapiens
gaggattactcgaagatgtgcagctacggctgccaataagatcaagctcatgagtgatgtagaagatgtcagtttagaaaatgtgcacactagaagcaaaaatggaaggaaaaaacctctccatcttgcttgtactacagctaagaagaaattgagtgattgtgaaggaagtgtacattgtgaagtaccaagtgaacagtatgcctgtgaaggcaagccacctgatcctgactccgaaggtagtacaaaagtgcttagtcaggctctaaatggagactcagactctgaagatatgttgaattcagaacacaagcacaggcataccaatattcacaaaatagatgcaccttctaaaagaaaaagttcctctgttacatcttcaggagaagattcaaaaagtcatattccagggagtgagactgataggacattttcttcagagtcaaccttggcacaaaaagctactgcagagaataattttgaagtggaactgaattatgggctgcgcaggtggaatggcagaagactcaggacctatggaaaggctccttttagtaagacaaaagtgattcatgattcacaggaaacagcagagaaggaagtaaaaaggaagagatcgcatcctgaattggaaaatgtgaaaatctctgaaacaactgggaattcaaagtttagacctgatactagttccaaatcatcagatttgggatctgtaactgaatcagatattgactgtactgataatacaaaaaccaaaaggaggaaaacgaaaggaaaagcaaaagtagttagaaaaggtaaaacttttacagctaacatatctaaaactgtgagacgtcaaagacaaagcaaacgccctaggttaagtgtggatgataatgactgggaggatttggactatgcaaaatctaaaagagttcttcgacgttcaaaaataaaaacgagaaatcagggtagaaggactgtgagataccatgatggggatgatgacagaagtttagaaaatgtgttagatttcaatggttgcaccttatgaccttgagggaaagccagttcatttaagaggaaatggactggcatttatggtgaaagctggctgttaaaattatttttttgtcttacaattcagggaatatatttatatttttctatgaaaagttatgaatgtgactaaatcatgactgttatttttatttgcacttgctggtctttgtagcagcattcagcacaggtgccaaaatatgcttcattttgggggcagatctattttgacagtatttgactacatatagcaagagtttgaaatatgttaaacactagacatcctggttatcaaaaccaatgagcattactttcatggcagcaagtgtcatgcagttattttctgaatttgtcaaagaggcagtagtttctaacccctgttctatagtagttacaacaatttcacaacctatgtttacagattcttcataaatacatgcatactgacactataatcatgggaggtgtaaccatgattagtaggcgaggtacctaccacttttttttttttcttcccctggctacttgagtagaatgcattataccagatctggtcactttcattgaaatggtttctaattttcttcccaagtgctgttgggtttttttcttcttaaggaaaacgttgtcacttttatgttataaacttgaatttataaagtgctggtaaattatttttaatgatttgagtgcatgttttaaacctctaggaccagagcatagtcagagcattttcttttaaattgtgcactaacaaaatgctatataatctgtcttctgtccaagatctcctggtttccattgtaagggatttaaccaaaatcttgctcttccataatcttactctgtgaaatagaggaattcgtgtgccttagatttagaagtgtgttctttaatagagtgtacagggctaaaagagtatttaagttaatatgtaggtttcccccatctgtattccaattgtagaggtgagttttgttaagagtacaattgcaaatcttatctatataggaaaatagctaaatgtcattctccatctctttgttttagtttactgcttccatgtgcaatcctaagcattctttgctggggcaactaaatgtatctttattagtgacttctagtccaaatataagaaactgtcatgttttgtgggaaaataattttataatccatttaaagtgaaagtttatcacacaaatagtacacttattttctaaccaaatacttgataggttatgctactccagtgtagatggccattcctaacttgtttgtgcctgaagatggacttgattcaaatggtttacatatttagtgggtaagggatatgttacagtaccccacctgtaagttatttattagccctaattgtgtttgatttcagacaaaattaacccttttctcctgtgtatctttgaagtggcagataaggtgaagcatcagactggtatcaatattagacaatgttatttattagccctaattgtgtttggtttcagacaaaaccttttctcctgtgtatctttgaagtggcagacaaggcgaagcatcagactggtattaatgttagagaatgttctgaagtgttcctattttgtagttatctattccatttgacatagtagaaggtacattttctttctactctgatgcatggggaaggatgtttttggacattatcaactgagataggtgggaaacctcctctcatttgtggcttagagagctatcaccatttcagaactatgatgcttttcttctcagaacttgtgttaagtagatagtaaacagattgattcatgataattgtccttgactaagactgaaaagactaatgggatgccttttactttgctaattttaaaaactggtgatagatgtcaaatccattaatttatttaaactcttcttaaccttctcttttataatctgttctcaggttttaactccatgtttaccatcatttgcaaaaaggtaccaaaaaaatccataaataaatatggaatacattcataagtacatacattcttttggtataaaacaatattttgacagtttaggcttcattaatagaactattctgattatttggactgcattaattggtcattgactggccatccaattaccattttttctttcagtccaaaatagttagacccttgcatacagaagtggtattttggtttttaatcagatttggtttcatcagaagcagcaagaatggacctgatgtctttaaaagcatagccgacaatggtagcttctcaagttatgaaataaaactgagagataatggagaaaataatttttatgggtttttttggttatggtgctattcctaaggttaactttgaatatgtgacacacacactcctaagtacctttaaggaaaattaataaatcattaatagttaaaatgtttacattgagcactagaacatgtttggccttttttttctacgttatgcaaaatgcccagggatttaatgcacaggtgtactttaatgtttagggtcagtttgtagtattcttgagaaaaagataaagggttataatttgaatgtgaactgatccagaaataagtgctgtacctttccactgcacttgaagttcaacttaatggtgtatgtgaaaaacaaaaactactttggttgtgtatgtccaaagtcctatggttttattcatttatggttttacaggctttgaagtactcagatttgatttttgctttcttggaaagactcactttaccaagcatataaaggaaaaatgatttcaaacattgacaagatagatgagtgttaacaaagctttcttttttcgtgtcctccttatttaaaaaggtatacttacaatgtgaagtaacttatgaataaaaggaaaagtttatcccatattcaaataattcctaaggtcagcctccctttttgtaagtggcaaatatctgattaaatcatttctcagtttattaatccttggaaacaatgatatagcagttactcacagcttgtaaattacaacagaaaggttcctttcaaatagtagagctgcacctaaagaggaaattgggtttataagaaaatggaggcaaagaacttaagttttaagaaaaagcacttcaaaacagaagggcaaatggaaaaggggaatataaaacaaaccaataaaaataccatctgagggtgttactgtccaaaagtaaagaataagatgcatcactaagccctttgcactcgttatgacctcgtaagtaaaaattatcacttagaataaggggtgcacactacattccctctgtcttctagacttttttttttgtagaagaatcagaaaacaatttactaacctccctgtttgatattaaaaataggaagaattttaatattttctgttagtacaagttgaacttgattgtgccaactgaaaccccagaggtttgtatatcagtagaatgcaagaacattgttaaaggtgcttacgatcttttttgttttcctttccactccattgtatcaattttttgagtaacttttaaatggctagaaaatggtctttttgctttgcccttttaaagctgaaataaccagctccattcttttcatgaatagtaagttgatatatttatttatcaggtatcttgcagttgtcaccaaatactgtagttttcttatgttgtatggaaattatagttcaattattttaatgtgatagagtgcaacaagtcattgtagaacttttcacctgttaatgttgaagttatacctctgaatttctgctgtggatatcaaggaaataataaagcagaaaccccaagaaatttgcaacttaacagtttgagactgtctcttatcctagtatttgggaagagaaggaataaatttgtcaaaactag

SEQ ID NO: 102399 - DNA, 1212 bp, Homo sapiens
attcctggcctagtggccaaccatggtgaatgggtgcagttagatgtaaatagtctggtcttgggacaaaaatcattttgttctgatgcctttttttaacttttcctgtttaggttttgttgatttctcctcttaaccatattctgtctttagggacatagaaataagagaggagaaagttgggtcctattgaggcttacattggtagtatgaatgaatacctatattacgtaaatgttggttcctcttagcatttaatccaaagaatgtaaggtattcaaataattttctgtaactcttacttggaacattgattcattactccaaatttgaataacagtacgttaaatttagagttaggaaatactactactaatcagtgccagaataaaatgttaatagtgaatattttaatgttttgatgataaaattactctcagtttaagaaatatgatatacttctatttagtcattctctgtgaaccaattatctttgtattttgttaaatactgtttcctttgttcatatgtttggccagaaacctcaagccgaagaggttaaaatctcagacaaaaataattcctgagttggtaggttctcctacccagtctacctcaagtaggacagcttatcttggaacccacaagacaagtgctggtatctcttcaggtgttacttctggtgactcttcagattcagcagaatcatcagaaaggaggaaaagaaatagacctataacaaatggttctacattatctggtgagaagtgaaatactatgttatttctttgctgagcacccaaatgtgtaacactggccgttactagagatttagaggaaaatataaagatgtggccttgacactgaaagaacttacagtttaatggaagagataaacataataaacatggaacaattcggttatcttctgtaagtgccatgctttgtgaatggtacatttatattgaattgtcaattacatgatacatagattcttcacacttggtgtgcagcatttgaagtttttgtatctttttaatttaaaaattaagaagtactaagaatcaatgaagttcaaagctgatgacgtagtaaattctaaactgttcatgttgttgccatctggtagcataactgtagctgatgctaactttgttaacattgtacaaatgaggctgtggtgtgtatctatttctgtactgctctgagtgg

SEQ ID NO: 102400 - DNA, 1090 bp, Homo sapiens
gtaagaaattcgtatatctcacatactttttaaaaaagttttctggtattggagtgtcttcgccatccactgccatgcacaagaattatatttaagttttgagcattagacttttgcacttattttcaggaaaagtcgtggaggaggatagagtagttctgtacatacatagctgtatccaaaagtatttaagatttgatgttatttaattgtaaacattgttaaaacaaatctttcatatgcattaacgttctaggttatactttctgctactggatgcaaggtatttttgtttcatttttagaattaggtggcattgaaaacagattgcagacagagatgggtatataaaagtgcttttgttcccttgccccaaagaaagacagcgcttttgtagcctaaatagcagccttaaaaccattcaacttcccatctaactttgggagaagggtatattttggggtttgtacatacagatgttagaataggcaaaaacagttgagattcactgacatatagacacaagtcctgaatatagatgcttgacttcaaactactttcttatcatctgagaggtatgtatttgatacttcttacttccagatgtcattaagggaagggggttggaaacagaagaagtgggtgacagccattacctataagcagtgatataatacattgcaagggatctcaatgattacaattatttcttaagtacttttaaggctattttgtaattctactttgtttttatatccttgcagatttatagtatgaccttgagattatctgccttatttgaagaaaaaatgaagaaaatctcttctgattttaaaattggtcaaaaattcaatgaaaaacttcgaagaagccagaggttcaagcaacggcaaaattgtaaaggtgacagtcagcctaacaaaagtatcaggtaaactggttatggcaagcttgctttatttatttatttaattttggagagagtctcactgtgtcacccaggctggagtgcagtggcatgatctctgcctcccgggttcaagtgattttcctgcctcagcctcccaagtagctgggactacaggcgcac

SEQ ID NO: 102401 - DNA, 4609 bp, Homo sapiens
agtaactgattcttgtcagctttcttggtttgattctgtcctaagtcttggagactcatacgtaagttacctcctccccagaatcaccttcttgttcttacttcaggaaaattatctacccatttttgtctcctttatgcttagatatccatatttcagcattctttttttctcctgtgtgtacagtaagatactatttgctttaatttcaattcctttttcccttatatatatatgtatatatatatattttttttaccttaaatcaactgttttcctggtacttattgtgtgaatactgctattgatgatacttagaaaaactcatccatgtattcatccaattgaggccatacatatattatttttggattacctgcttaatttggatacatacttaacggaaaacaagaaaaaccttcaagattctaaattaggatttaagatggctagttacgtttacaaagggttgggggaaaacctgatattcctctgtttgaaattaggcacgtataggttggtgaactgtttatattttaatgtataatttgaatccttgccaacaagtcactacatctgcatactattaaagtgaaaatttgttttttaggaatcaacactgtacaaatatctcagaactttctaacacatctgaaaatgatgagcaaaatgctgaggatttggtatgaagtttgttgattttataatggtttttgttaatttcaaatggtatttttaaagtgaagaaaatgttggctttgtagtaccaactcttgtagtagtccaatgaacaaatagggcatttgataaaattatatttttgaattttctagatgatttatgaggtaatttgttttagctaatatcaaaatatatctaagtgaataactttaggtgtggaatatattctctttctatattttagctagtgaaaggtgtattatataaagtaccttggaggctgggcacagtggctcacacctgtaattccagtgctttagcaggctgagatgggaagattgcttgagccaggagtttgagaccctgtctctacaataaataaaaaagttagatgggggtggtagtgcatgcctgtactatagaacacaaaatgcagaaactataggaatctgtatgtttctggggatttgtggatagaggtaaaacacaagttttctatttaggaaatgcatgaagcgtctttttatagctgtaatttcaaattttagaattagttcatgttcttagggaatgaaaaaggattattaagaatgatttttttttttcaagcctgggtgccacaaagatcatctggtagtctttctttggagattttgataataacatgttataactctggtaataccaaatgtctttgatatgttatttattaagattatgttattattttctaatgagactctaaatacttaaggtgctctgattttattcctaggatgatagtgatcttcctaaaacatcttctggaaggaggagagtaagttactctgcatggttgacttttgtagtttctttttctttgttttaaaatcaattcaggattttagtttttgtctttgaaaagttatatcagtgtagatactgaatattttattagcaaaatgggagaaattactggaaagatttagtgggagagttggaatttgtactgtattatcagagtgagatggagtaagaagaggccattcaaaaaatagaggctaccacaggaaagacaaaaaaagtagagaaatatggcatggcatgtccatagactgttaagggaactacacctgactggtgtagaggttggatgttgaagtgatcaaagtggctgtgtctggctgttatgattggggtagattatggtgatattgaaatccaaggatttcatttaaagtagagaatcaattgaacagccaaaatagataatacaatttgaaggataagaagatgtgtattaaaggagatgaattaggagtttattccaagaatatagggtgaaggacgggtacctagtcaaggatatttgcttggaatggagaggaaaggaaaattatgacacctttttagggaaaactaactaggatttggtgactgaactttttttaacaatggagatatgttgggatgatgaggttgaggggtaaggagaagggtctatggaactaagtttatgaaagtgggtaatcataatggagtatcggcaggctttgaagttcaaatatagagtaattaaaattaaaggttattaatatgaaaatgcttaagacattttagcccagatcattttaaatttcctccaaatgctccttaaatttaagctttttatgaaatattaatttataccatgtgcttgccttccagaacactgaaaagttatacctaaaatactctaatttgattagtcattttcgtttaattttatttctagactcccaagtgtttagtatttgtatttatttgctatgtctgctgcagcaaatgacaaatttagttgcttaaataataaaaatgtattacctgatagttctgtagattagaagttttcatgggtctctaggtcagaatcatggtcttggtgtggccagaagctccagggagagttatgtgcattttccagcttctagtgggtgtcctcaccttggctccaggtcaccttgttccatctttcaagccaacaatgtagcatttttcagtctctctctgactctgacctttctgcctccctcttataataacttttgtggctatactgggtccaagcaatcaattcaagataatctttcatctcaaggtctatacccttaatgcaaaataccttttctcatgtaaggcaacatagtcataggttatgaggattatgatgtggacatctttggtggggccattattctgcctatcatattatcagatgtgcttcatattctgcgaaaacaaatattataaacctgggaggtgagaggtcatggaatagcctttcactagataatgtgctcttgttagagtatgcttttcatagctaactttgtaatatttctgaaattggttaagttatatgaaaataacttacgtttcatgcatagtttaaaaatttcatttctggaaaaatgtgttgagagcaacatatatgacattattgtatttttatagaagacagtagatcagttacatttttaccacagtcttacaccaatagtgtgatttttcttaagactgtgaatgtatttttaggtccatgatgggaaaaaaagcatcagagctacgaactatgttgaaagcaactggaagaaacagtgtaaggaactagtgaacttaatttttcagtgtgaagattctgaaccatttagacaacctgttgatttggttgaatatccagtaagtttccattgtttaaatgtttggggcttttcttgttttgcagtgaggaaactggggtagagttattaaactttaaagagaaagatacccaggctttatgttaacttttttgctcctatcactaagttagtggtagaagtattgtttttacatagttttcttcaatttatagacacccttgtgagctcatttaagaatttagacttagataatcagtattacataacagtgggatggatctacttagatttctatctaagtaggcccagcactaggagaactgtgaattggataaacgtgtctgtttgcactctttaaaaagggaaattgaaagatgactttataaaaaaagttggattataacagcacagagtgactgtaggatgcttggagtacatacagcaggaaataaaaccatcccatgtgtcactaacaataaatagacattaacattttggtatatttctatcttttctttgtttttatacctctttttaaacattactaatgaattttaagagtcctctaaccttttcctctcttccatcatttcacattttttagagatctgatgcatttacatttctaaaagcaagaaatgaatctatgaattaaatattgtgtttaaaacctaggactacagagatattatagataccccaatggattttggaacagtaagggaaactctagatgcgggaaattatgacagccctttggagttttgcaaagacatccggctgatatttagcaatgcaaaagcgtatacaccaaacaaaagatcaaaggtaattttttatgtggtttattgaaaaaaactgcctgatctgtgtagataattttccaatgtaatagtaattttttccagtgtaattttccactgtgtaatagaggttagaacattaaagataagtgaataaattaagactattataaagaaaagagcttctgctactgctcatatagcttcagtttttgcctttcatcagttgatgtttatcataatctcctcaaattttataagcaagtggggattaatgggagtaggcatcaatagaaagtgaacaaatttgatacacagagtaagagtctctgtgttttgtatgtataaggatcttaagtggattggaaacatagatcgagactgtaagaatattaaaagtaaaaaggaaaatctgattgtgagactgctgacagcataagaacatttggatttgaagaaggaaca

SEQ ID NO: 102402 - DNA, 1067 bp, Homo sapiens
gccctgtcctcccaaagtgctgggattacaggtgtaatcccagcttgctgggccagcttttagggttgatgatatttaacatattttctttattgagattcaacaattttaaaaggtacctatatgcagtatgaaaagggagggtagttttgttggttttctgtatgtgattaagtaatttgttaagatttttgtcctcttcagttcaatataattgcttcggtgtccaatgtattgcctatgactatgatcaagttgagagcattagaaggttattcattataactttgcacttatggtttaattattatttcacagttgtttaattcacatgctgcattttttcacttggtttctatcttctcattttctaagccctaaattgtctactttattttgaaggaggctgtctgcgttagtttgggaagtcagatatatagaacataatgccagaacatttaacgaacctgagagtgtaattgcaagatcagctaaaaagataactgaccaacttttaaaatttatcaagtaagtaatttcatagatgttgtgtaaaagtgactgcatattgtgctattaacaatcatctagttttgccgggcgtggtggctcatgcctgttaatcccagcactttgggaagtgaaggccgtcagatcacttgcggtcaggcatttgagaccagcgtaccaacatggtgaaaccccggctctactaaaaaaaatacaaaaattagccgggcgtggtggcgggtggctgaggtgggagaattgcttgaacccaggaggtggtggttacagtgagcccaatcgtgtgtggatcgtgccattgcactccagcctgagtaacaagagcaaaactctgtctccagaaaaaaaaaaaaaaaggaaaaaaaaatcatctagttttgttttttactcagaactatacttttttaatgctttactttagatgacatttctttacatacataatttaagtaaaagtctgagaaactgaataattcagtttttcaactttttaaaattttgaaataattttatactccagaaagttgccatttgccttt

SEQ ID NO: 102403 - DNA, 1105 bp, Homo sapiens
tgttacactttgttctgtcacacaattaagctagtcggaaacaattttatctttttaagatatggtagatgggtttggagcagtgctcagcctagaactgatttacttttgacttctaaggcaaggcccttttatgcagtgtatccactgctctatgtatcatgcagctttttcagtctggctgagggaacaggcgtgggtgctggcctttttgtgcatcaggcctttgttatcacagaactttcatttggttcttttcctggcttcctgtcatttcttcacacgtgtgggttgatcagtattcaccagaatacctgaggagaccagcccaggcaacatagtgagaccccctttctccccattaaaacagacacacccacacacccacccacccacaccccttgcccaaagtcatagtttttaggtggtatagatgtgatttgaacttagatcccggctttgataaaccagtgttttttaaagcactttatgttgcctgcctgtacagcgtctttcctcttccttttgatgagataaaatactgaaagcataactctgaattacagtataaaaatacacattttggcttattagggcagtgggatgtctctgccctcttcccccacatttcttttatgttcatgcagaaaataaaatggaaatcctttttctttttgcaagaacatgaattataagcttataggaatcatttatcatccatgtttaaaaaattcccatctctcagctaaaagactacatcatatgacttaattctaataggtcaactctactgaagttaagagcattcccaaagaatgctctatataaaacttgtgtgtatgtttgcaggaatcttaatggatatgtttctagaggaaatgctcccatgagcattctctccatcatttagcagctgttaaaatgatgctcttcccaatgcccttgttccctcattgtaaacgtgctctgagttaacctggtagccagtacacagtacacagtaaatgacatttcttatctgtatgttagaactactattcaataagctaaaatattttgagcttcctcagattttctcctttttttttttttgagacagagtctt

SEQ ID NO: 102404 - DNA, 1119 bp, Homo sapiens
gagacctgtctctacaaataataaaaaattagcttggtgtggtggcatgttgtacctgtagtcagtcccaggtactcgggaagctgatgtgggaggattgattgagctcaggagtttgagattgcagtgagccatgattgtgctactgccctccagcctaggcaacatggtgagatcctgtttccaaaacaaagccagaaggaaatatgttagatttttaacagtgattgtcgttagatattgcgctaatccgagatttgtgttttcaatcttacacttttgtaatgtattttctaaaggatgttctttgtattagaaactgtattaaatatgtggagattaactttagcaaaattgaatgtaattaatggtattaattaaacttgtctgcgggtttggaagcctaaattatgagtttacttaatataacagtatgtggagaattatagtattaaggaattgcttttattttaaccattaaaaaatatgtctgttaaaggatcaagaattggttaaaatagttggaatacgatatgaagttgggccccctacactctgttgcctaaaactagcatttatagatccagcaactggaaaacttatggacaaatctttctctattaggtatgtattattttttaaaatggaattacttaaatttaaatttgccattttgctgattgaatgattagcatgcccttcccatttaactccagggtaactggtagagcactgtggatagcctaagatgtggctcgagcttctgatggctaggaaacccatccctgaccctgaagtcatagtaggcatgtcacagttatagttaagtgtgggcagtctgttttatatggttttcatgctgcttatgtgggtggggaattctgacatacgggccaaattttttctgccctttgtttttgaaaaaattcagaataaataatttcctacacctgtgctgtctaataaggttaccactagtcacatgtggctactgctcacttgaaatatggatggtttgattgaatgtcttaatatgtgacttggcagagtatgaggcataaacatttttttttaaagaaatgaatgtgttgtgaatgtacacactgcattttgaagagt

SEQ ID NO: 102405 - DNA, 1920 bp, Homo sapiens
ttgaccagggtggtctcgaacttctgacctcaagtgatccacctgcctcagcctcccagagtgctgggattacaggcgtgagccatggcgcccggccaagctactttattattaacacttctccatctccactgttctgagtagtgggcttgacagttaaacctttccaaatctgaaacttaaagagaaagctctattttgctcagaatctcacggcaacacttattttctcctgtcaatttcaacactagtagtagacttcaaggaattttaaggtgctttttttttgtgtgtgtgtgttattgctacgtttaccattttcattttacatgtctgtcttcatacttgtctcttcatttaataacatccctatttatttgtgtacactgtgctgatttcaagcaggtagtcattgtttaaagatgttaagtctttgtatttatctattgctgtatataacaaaccaccctaaaatttaggtgtttacatggcaaacgttgcatatttcatgtattggttgatcaggaactgggagctgatttgactgggtgattttggctcatgaggttacaacatgttgactggggctgcagtcatctgaggacttgatgagggttggatgatattctttccgagcttattcatatggcttttggcctcagttccttgccacacaggtctctccttagctggctgcttgagtgttgattttcaactcaagctggctgcttgagttatgattttcctcagagtgaatgatttaacagtagccagggataagcccccatttatgacctagtcttagaagttgcacatagtctcatcggctttattatatttggtagaagtgagtcattaagtgtagtccacacttaagaggaggagacttccacttcttgaaaaggagagaactattggggaatttgtaggcatattttgaaatcaccggtcttacaacctaaaatcaagaggagactccttgtgatgattagcctgtggccaaactcagagtggagtcttggcagaacaggctatgggtaaaagaggatttaggctgggtattagccccctaaaatgggatgtaaaatagcatgaagaatctatcagaaatttaggagatgatgctaggaaaatgttaggtagatttacaatgcttttttaagtgatatattcctgtgtaaaggaactaaatatatatgctgtgtgaaaactaatcattagatggacatggcaaaaatagtcattctgaatggtgaaagtttcttttatttttcattcagacagtgcatgctgcccctttctaatctaagaaactttgttctcttccccttggtagaatttgcggaggatgactccagcagagcttgcaaatatggagcatttatatgaatttcaccctccagtttggattactgacaccacacttagaaaatctccttttgttcctcaaatgggtgatgaggtgagagtaatacaaatttaaaaacacgaatatggaacataaagtttatattgctcttaatttttaaatgcatatttcccttttgtaggtaatatattttcgacagggtcatgaagcttatattgaggctgtaagaagaaataatatttatgaactgaaccctaataaggagccatggagaaaaatggatcttagggtaggatgatggcattattaaatcattaaacattttagcacatacatagttaaattacttacaaatctatttaaaaacctgttggaaacatattttattactttctttcctacttgataacatttctgctgtaaccaaaccttaagatcctgtgggaatggcttgtttgtcagtgggcaaaatttgtatgttgctgattggtgtgtaaaatgttaaatgcaacaacctagagtttcagaaaggcagcttggcaatatatata

SEQ ID NO: 102406 - DNA, 1011 bp, Homo sapiens
ccaaagaagataaacagatgacaaataaccatatgaaaagctaccaaaatatgtcacagggaattgaaaactagaacaacaattagatacatctattagaatagctaaagtccaaaatggaaaacatttacattgactttttattaactttactcagaatggcctgttgtatcactttctttgctaatggtggtagtgttaaatcttacggatgttctctttttgtcttatgctttgataagaaagggatgtagtgaagaagtttgctttttaagtttatctgattatatatttactgattactgttcatttttcttagatgatttaatcttactggggaggattgtgtacagcttttttctggacatgtgttgtttaacttcagggatcaagatttttttccccccttcacaaattaggagacttcctgtgatcagagtgaaggttctggttcttcagaagaggatgaatggagaagtgacagaaaaagtgagagttacagcgaaagttcaaggtatctgtttttattgttgtggtcttttaagcattttagtcatagtcttggatggaatcatacttgaattttattcaagaggcaagaatttgcaactgtggaacagtttttaatacacttaaaaggagaccaaaactagatccaacagctgttcctataggagtatttcaggagtttttttttttttttttttgactttaagcagttgacccagcactgttgaacatgcatactgaaaatataaatttaatcttggttgcacttaaaaagactagtatctaaagtatgtgtggtaaaaccacagtatattcattattattgcatgtgttgaatttttgttagttttgagatccagatttcctgggtccaaaatgtcagcctctggttcttggtgcacgtcaccttcatctcaacagatcctcaatccagaaaactggaccttaatctctcttgtccacctatccgtaacatggctagaaaattctccttcctatcac

SEQ ID NO: 102407 - DNA, 1051 bp, Homo sapiens
tcatttattaatatgcatttacatttcctacatgccttctcatggcttgatttttttgtttgtttgtttgttttttttagcacagaataatatttcattgtctggatataccatagttttatcagtttacctactgaaggatgtgttggttgcttccaagatttggccattataaagttggtataaacatctgggtgtaggtttttgtgcggacataatttttcacctcatttgggtaaacatcaagtgtgattgctggatcttattatgtttagttttataagaaactgctaaactgtcttccaaagtagctgtaccattttgcattcctatcagtaatgaatgagagttcctgctgatccacacccttgttaaaaaattctttccagcatcatctgtagattcacaatcccaaacaaaatcccagcaaattaattttactgacaaactgatttttcgagtttatatagagaggaagaagatccagtatagccagcacaacactgaagaagaataaaactgaaagactgacactctacttggcattaagacttactgtaaatctgcagttttcaagacagtgatgctggtgaaagaacagatcaatggaacaacataaagagcccagaaacagactgacacaaatatattcaaacgatctttggcaaaggagcaaagagaacttggtggacaaatttatcattttcagccagtggtagaataactggacattcacatacaaaataaatcctagacaccagtctttcacaaaaattaactcaaaatgaatcataagcttaatgtaaatgtaaaacaaaaaaaccataaaacttctagaagataacaaagggcaaaatctatgtgtccatgagtgtggcattgacctttttagatacaatatcaaaagcacaatcatgaaagaaaaaatataaaaaatttggactacactgaaatgaaaactgctttgggaaagacactattaaaagaatgaaaagataagccacaaaccaggataaaatattagtaaaacttatatctgataaatgactta

SEQ ID NO: 102408 - DNA, 1028 bp, Homo sapiens
actagtgtgagatggtatctcattgtggttttgatttgcatttctctaatgattagtatgttgaacattttttctttacacctatgtatagagatagtgagaaattccttgagaagttgcttactgcatcataatgtacgaatatgtatttttcatttctgagatgtatacttttaaggtgacatccttttcagattattgttattttccctcattcgtggtaaaccagttaacttacagcatagtttggaaaatgcccatctaatgtgcattttctcatgttttctaaggaccttaaaagtaaaactactaagcttgagttaaaactgtatggcaaaaatgctaccttctttttaagcctttttttctttttgctttaaatccttctggaaacttgacggaatgcccattttgttgatattgtccttatttaggtgttgattttcattcgcatgtttttctgtgtttcagtcggattcagtggttttggtatcacagtctagacaaaggacatgtaggcgtaaatatccaaattatggtagaagaaatcgtagctggcgtgagttatcttctggaaatgagtcttcaagctctgtaagacatgtgagtggaaaactttaaaatgttataagataatcttaaatgaatttggcttaattctttactttgaatgaatataccccaaatttatatgaaaacacagcattctgcagagattaatatgaaatttcacattttgaatgttaacaaaaacttttaatggctaagatagtcacatactgtatacttgtgcaatccagtggttttacatgttgagcatcccaactcagaattttgaaatgcaccaaaatctgaaactttctgtatataaacatgatgttctagtgtgcatttcagattttggatttttggatttggcatgctcaacctgtaagtgcaaatgcaaattttccaaaatctggaaaaatacgaaatctgaaacaattctattccccagcgttctggataaggggtatataacctgtagt

SEQ ID NO: 102409 - DNA, 1009 bp, Homo sapiens
agtctgctttagaaatccccgctggataaaataatgttctactgtaatcttgagtgtgggctgtctggcgtacttagagaaaaatgcagtgttcttaaaaatcagtttttatccttacagcatttactcttacactctgttgagtgtctagttataccttggaacatggccaagatttcagtataaatctttttcctttgagatgttaaagtaaacaaaaacataaaagccacgtgtttttaataatgttccagttggagaaaagggacagtcagtcttttccagagaagaaaaatgatttttagtaccttcttcttggtggcaggtcctttgctttgaaattggtcacaataacataatctttttgttgtatcatgtgagtgaaatataggtgattagaaaaaccagtaacattgctattcttgttttctataaattatcaaacatagcttgaataaatgtggagaaggcagactctgcttattttttctttagagaaaggaattgcaatcttggaaaatcatgaagacgttttgaaaagctattatgggagattctgtttgaattggtcctgatagtaccaatcagaaaacgaatgaatatttttgcctctgatatgaaaaataggtttaactgcctctgagattttatttatattcatataaatttttaacatgttttaacttcagagattttgtgtatttttaaagtacataaacttatgatttatagaatcacactggtttttattctttatatcctttagttatccatcagttcagtagttaatataactgggtatttaaatttgtaggaagctggaagacttccgattagagaaaggtgaagaggaaagaaatctttatataataggaagaaaaagaaagactcttcagctctcacataaggtaacctaaattctgttttcttagcaaattagaaattacattgaaatatagagttttctttttgatttataaaactatcagtaactttcatctgaagtgga

SEQ ID NO: 102410 - DNA, 1048 bp, Homo sapiens
atctcttgagaatcatgagaatcatgattactgttgcaagagctcttgtaaaaccactttgatttcaggtatctgtcttcagtgcaaatttttcaaaaagactttttttagtgtgcaatttttaagaaggcacagtttttaggaatgcatatataatgtaatgtgaaatgtacattttataatttcagaaagtctagtaaaaattgaaattgaggtttaatagttaatgtttgttccgtattctacattttgatcttagtcatgttaagattctgtcaggctgggtgcagtggctcatgcctataatcccagcactttgggaagccgtggttaagaggattgcttgaggccaggcatttgcgactagcccgggcaacatagcaagaccttgtctgtacagaaaataaattttaaaaagatttttctcacaaagttttttcagtagatactatcttctcttagttctttatttttggtgcgcatcttaggtgaacgtgtgcttgttacatgctaaatgtatattagtttaaaagtgtattggaatcacttccccatcatattttcctaggttttagaaggctgagcttagacattcagtcccctccaaatattggtctgcgtcgtagtggacaagttgaaggtgttcgtcagatgcatcaaaacgctccacgcagtcagattgctacagaacgtgacctgcaggcttggaaacgaagagtggttgtaccagaggtaccactaggcatatttaggtttgttttaggatatctatttataatgtttctatctgtgaaaatatatttatatggttatttacacattctgtattccattaattgtgtaaataattgtataaatatattagtaatgagtgggaatcttactatcttaattgtggtaggaaaatgtcagaattattctctaatgtttttactacattaaaggttttcagagccagtcttgcttcttttctttttttttttcgagacggagtttcgctctcgttgcgcaggctggagtgcggtggcatgatctcggctcactgcaa

SEQ ID NO: 102411 - DNA, 1162 bp, Homo sapiens
ggggcagagggagagctaaagtcttgttgaaggcttaaaaaaggtcttacctcccttttttcccctttcttaagacatagagaagaaattaaatctcagggatttttctccacattggaaatgacccatagttgctctgttccagttagagactctggggaataagattttagtgaaatatatcgagtatggtgaggggcattagtgtgaaacagcgtaataaagttttacagaaatatgtttccatgcttccacttgcaggaatttcagaggctgctttcaggtttttgtggtatttagtcctctacaggaagacttttgttggctttgaatcttttctctgacttcttggtgaatatgtagagtatctttttaaactggttatttttcaaaaatgggaaattctgaccattgttaatgtattttaatttgtaccctaacgaaatttttttttgttttctgcttttatatgattatatattaaataattgaatttgtaggtgatggagaggtgattgaacaaattataagcctgcaaaccaatgataatgatgaacgcagcccagaatcgagtattcttgatggaatgataagacagttgcagcagcagcaagatcagagaatgggagcagatcaggatactattccaagaggactttcaaatggtgaagaaacaccccggagaggtaataaatagtgataaatgttttacctgaatatggctgcattgaaattaaagagtaaacgaagtctttgtcaggtacatgtaatgtgagaaacttaagtaaacaatgtatttttacaacttaattagtagtctgaaggtagctttatgaggtgtgagataatgtagtaacaaatgggtctttgaatttcaagtactgctgaagccttttgtactctaaaaatacagtatttacaaaattgtattaaataggagcgaataacagattggtttttaaaataaaaccatagttctagcttttctttgctttaacattggtaatttttgaaaaactgtattgggtagagtatgatttttcttattgaatcagaaagtttgaaaacttagtgagttttcagtgttgagtccttaaaagtacagtgtagaagtaaatacataacaatcaccagtctcccctcagttagttccactatttac

SEQ ID NO: 102412 - DNA, 1362 bp, Homo sapiens
ttatttttttggaatagtgattgatgtatatgcttaatgaaacatttgtttttatttttattttacagagtctcactctgtcacccaggcttgagtgcagtggagtacagtggtgcagtcttggctcactgcaacccctgcctccccggttcaaacgattctcgtgtctcagcttcctgagtagctgggactacagacgcacactgccacgcccggctaattttttgtatttttagtagagacagggtttcaccatgttgcccagggtggtcttgaactcctgtgctcaggcagtccacctgcttccacctcataaagtgctaggattacaggtatgagccaccatgcctggctgaaactttttttttttttttcagaagggatatattgtcacaggttatccacattaaaaaagtttacatagcaaatcacttgcatagaattggtcctaacttttttccttttgtgtttcctagattgaaggacaaggacatggagctgtgtttgactgtaagttttcacaggatggacagcattttgcctgtacagattctcatgggcaccttctgatatttggttttggatgcagcaaaccatatgaaaaggtcatttttaatactttgttgtagcatgcaagtaatagttatcagctgtgttttggaaataagtagttatgagctatgttttggaaacagtttagctgagtgatttgatttccttgtttttctagttttaattaactgtttaatatttgtttcctttaaaatgtgtgaaccttaaaatgtcatcctgtgaacttcatttttctagattcctgatcagatgttcttccatactgactatcgaccacttattagagattctaataattatgtcttagatgagcaaactcagcaggctcctcatcttatgcctccaccattcttggtagatgtagatggaaatcctcatccaaccaagtatcagagattagtaccaggccgagaaaattctgcagatgaacatttgattccacagctgggctatgtggcaacaagtaagtgcagtctttttttttttttttttttaaagttgtacttgaatattttaaagtataatataaataatttccttacctttagatccccaattattaatattttgcaatatttgttttattattttttttctgtgtattgttttgaaccatttaacttctggacctcatgtaccatttacctctaaataagaacgacattctcttacataactatagacacttatgacaattaggacgttttacactcagataatactattatcaaatctatagtgtgtaaccaaaaatttccagttattctagtaatgttcgtttatagcttc

SEQ ID NO: 102413 - DNA, 1012 bp, Homo sapiens
aagttgtatgaagagatgagaatagtcccatttacagttcagattgaacatctgtgtgtcagttatttttctaaacattggggatatgaatatgaattaccttatttttgtgttcctaaaatttttttgtcttctatggagagaaacagttgaaagtaagtgttagcaataggtttgtattcagaagaaggaaataataggaaagaagtagggagaaaaagcattgctttcataagcagtaatggtgtcctaaaatctgcccttattcagtctctgtactgtttctaaattatccctcccttcttcaggttttgccctcacctgtttctagacagtctgttctgggtcagctgtgatgaactcactgtagggttgataagataggcacatgggttggatttctttatttttgtattgatgagagattgtatacattgtatagccagccatctaaataagtttacatgttgtgtatttttttgttagggacttatcttccgaagaggaaaggtttatgaaacctaaagtaacaatgatagcttggaatcaaaatgatagcattgttgtcacagctgtgaatgatcatgtcctcaaagtgtggaattcttacactggacaactgcttcataacttaatggtaggtaatttctggtacagtgtaacaaatgagattttttgaaatatgattgtaattttgaagctataaaaataatatattgaacaagttgtttctctcatgtaaactatgaaatgattagaaatttttataattataaattattgtcgaatacatttctaaaagtatatgctgtaacagtatgtatttttaaattttcaatttgtaacttgtaaaccctccttaatgttatgactttgttaaataaagggacatgctgatgaagtatttgttctggagacacatccctttgattccagaattatgttatctgcaggacatgatggcagcatatttatatgggatattacaaaaggtaccaagatgaaacattat

SEQ ID NO: 102414 - DNA, 1147 bp, Homo sapiens
taggctggagtgcagtggtgcagcctcggctcactgcactgcaacctccccctcctgggttcaagcgattctcctgtcttagcctcctgagtagctgcgattacaggcatgtgccaccacgcctggctaatttttgtatttttagtagagacggggtttcaccatgttggtcagactgatctcgaactcctgaccttgtgatccacccaccttggcctcccaaagtgctgggattacagacatgagccactgcaggttgcctcttctcagcattcttatacattgtattttcaaaacttaatctgtttgaaaagctattgattgagtttgaggtgtgttttatttcatagggccgggcaaatcatagcaaaccaaattttttttcccatccagatacgctctaaataccttgtcttttgaattaacacctgtggattgtcctgttgttaggacagcttcattacattctttttttgcatgtgattttaattgtagcccttgttggaaagtgtgtgaatatagtaagatcctgttctgaatgttttaaggttcctaagtggtagcagagatggaacagcacggatttggagatttgagcagttagaatggaggagcattttattggatatggctaccagaatctcagggtaagttgagattgttagaagtaggtgcatcataggtgttcgatctgtctctctctctctctctctctcgctctctgtgtctctcagtggttattttgttgaggggattatagctaccttctattacgaagagctgtggtataagtgaatagctgcgtactgcatatcaggtgaacagagacatccaggtaaatttatccttacgttgtatagcaaagaataacatgtactttttctatggttcaaagcattgacctccttcttagatgttgcatttaaaagcttctacaagtaaaaaagataaaattaactcaagtacattaagagtggaaattatacttttctgtggataggatttttgaaaaaatttaaaagtagcttagagccaaggctgggaaatagggtaagcaaacatactttattattaaggttaaaaaagaaaattgagctccagcctgggtgacagagcgagactctctaaaaataaaagtcatagattt

SEQ ID NO: 102415 - DNA, 1032 bp, Homo sapiens
ttaaagcagcatcttcttcttttaaagcccacgtcccctgaagttcactgaaaagcctaggccaggcgttcaaatgctttgttcttcttttagtgttggtaagaacttcttcacatttttttcttagttttttttttttaaacatctattaaatgaccacttggttgctaagaacttttattagctacatggtaaatgacttctggtgtttatttcattaggttcaatttatgatgtttattttgttagccttgttcttccagtcctccagtctgcctttctctgatttctggtagtaatcagtgatataagagatggctggtaaaagggaggcttgaggtgtccacacaagtgattcctatgccagtactatgtgtatgataatctaaatttgtgattttctttgaataggctaaactgtgtatgtttgatagtttaaatttatttcccacacataatatcttgatgaaattattctttttcagtttttgtacagtgaacttgtgtggtaacctttctcttttttcggataggtcaaagacttttccctcataaaatctgaaaacttgaacaagctagggttaggtatgtagaattgtttagaaagcagaacttcttttcttaaaaatatttttagagcgctggtgcttaattggcattatattgccacccttaataatacagatggggaggccaggcacagtgactcaatgcctgtaatcccagtcctttgggaggccgagatgggaggattgcttcagcccaggaattcgagcccagccctggcaacatagggagaacccatctctaaaaaaaaacaaaacaaaaattatctgggcatggtgcacacctgtagtcccagctactcaggagactaggtgggagtattgcttgtgtccaggaggttgaggctgcagtgagccatggtcacaccactgcactccagcctgggcgacagactgagaccatgttccccgccccaccagctggctcacgcctgtaatcccaacactttaggaggctgaggcgggt

SEQ ID NO: 102416 - DNA, 1034 bp, Homo sapiens
agattcctttttaaaaaaactgcaacaccattatcacactatttattgatgttcaagtttccagttgtctcataatggtattttatttaggttgtttgaatcaggagcaaaacgaagcctgcatgttacaattggttgctgtagaataaaagaaacttaaaatataaatttcacctatctatgcagtttaaaaaaaattcgcttgcagtttcttcgttgaaggacctaggttatctatagtttccccacagtttggatgttgcccattgtatcctgttggagtagtttaatatgttcctctgtatttctgttaagttggttattggatgtagagcagtggttctctttaatgtgcatgagaatcacctggagggcttgattaaaacattgttaggcactactcccaaagtttctgatttcaaaacgtctggggcgagggtatgagtatttcatcactgatagagaattgatcatcttgggatgtaagttcttccatcagaaggcacaaaatgtctagtgttttttgtattactcactgatgatcattgccttacatccgttagttattagggacagaaaatgttactcttactagtgcacggttcttggctgtcagtgtaacagaaattaataggaggctaggcagacttcccagacaagatttattaagacttatgctgagatttattaagacttgtgcctagcgatggctcatgcctataatcccagcactttagggaggctgaggtgggaggatcacttgagctcacaggtttgagacccggcctgggcaacttagtgagacccccccccccacccccacccaccccccacaaaaaatagtttggcaaggtagcacacgcctgtagtctcggtactcctgaggttgagggaggattgcttgagccaggaggttgaggctgcagtgagccgttatcgcaccagtgcattccagcctgggtgacaaagtgagactgcctcaaaaaataaaaataaaaaaagagacttatgcctgaaacattgggaataagtga

SEQ ID NO: 102417 - DNA, 1055 bp, Homo sapiens
ccttgtgatccgcccacctgggcctcccaaagtgttgggattacaggcgtgagccactgtgcctggcctagactaacatttaaccattgttagttgatataagagagccgtgaactttgagttggacttactactttgcagagaacttgggggaaaatagtattggtaatggagtctgacccgtagaaatgataactcggcagtatctttatgtagactgtctttgccttaaagaaaaatactattattccataggtgttctgaccatagtcataatttattacataaataagagagtattctatagttggaaagagttaaagttaatttggatggcatataaaaggtattcttttaatatttaaaagatttgctgtactaacattaatttttggatatattttttcttagggttcagatgactgtttggtaaagatttggtcaacacataatggccgcttgttatctacattaagaggtcattctgcagaaatttcagatatggcagtaaactatgagaatacaatgattgctgcggggagctgtgataaaattattagagtgtggtgcttgagaacttgtgccccagttgctgtgctccaaggacacacaggatcaattacatctttacaggtaaacttgtagcttagtgggcacattcctatatgtattttcacctttttctttaaaacagtttctttggaattgagaaatagtaagatgtgtattagttatgttttaagtaagagaagtgataatcattcatacaaatcatacaaatcatggaaggctgatgaaatgaagatctaatgcatatttacatgaaggcttattgatattttggggtttatggttgaactggatgagtgtcaattagaaactggtgatagattaattatttttcaactttaaaacttgtggattttgctaagttgatttttttttttttttgagactgagtcttgttctgttgcccaggctggagtgcagtggtgtgatctcagctcgctgcaacctctgcctcctgggttcaagcgattcttgtgcctcagcct

SEQ ID NO: 102418 - DNA, 3649 bp, Homo sapiens
tgaagttttgagtgttacaggtttgaatctgtagctcaaatctgtagatcagcttattgtttatttaagtcgtctttaatttctctcagcatgttttacagttttcagtgtatgtttttcacattttgccagacttatccctaagtatttaatagtttttgatattattaagctgttgtcattaaaacttgctctccaactaggtcttgtccaataagcatgtggctcctgatcatcttttgcaaatctgccagcgcatcggtcctatgttggataaagaaattccacccagtatttcaagagtcacttctttacttggtgcaggaaggcagtctttgctacgtacagcaaaaggtaccttaatttgaagaagtgttctgctttgtattaatagcctaataattattataattgtgaagtaatgtaagcattgtggaagaaaggtgataatgtaactataaatcatgctgtggactataaaattctctgcatttagcatagaacattgaattttattacataagtgtttaatgggtccttctgcattaaaaagttgataaagatatagatgttaagctaaaaagcttgaatttattctgagatgttgtttgaggttttatcaatgtgagttcttaattttccattttgtagctcactcataacttcattgaatgtaattgtatgtgtctaataaactctttaaatgctagaggtatttcatttgatatttagcttctgaaagccctttgttataaagggaagtgattttctaaatttggtagcagcttgaaaacaagcaccacaaatgtaaaactgcatggttctttttttactaatttaatttttttgccaagttatgtgctagcaaaatgtttgaaattgctattctttttctgttagcttggtatatatgacttagactaagtatatgtatgtgatataatatatgtgtacatgtggctaaactgctaatgggcaaagattgttggttcttctgatgctgagtatacatcaagttcatcccatgattattttttattacgagctattgctgatgtgatgctactcttagctgcaccaccagtataaagcttaactgagaaagaacacccctccctcttagttccgtgccagactggtttgttagctttagttgtttcttagtgctctagccatgtcaccctgtggcactaatcaggacactgtttatattcttcctcttctgtgtccctattcactttgtaattattctattttagctggttatatggtagttaattggtagcctgttttcctttgttttctttacttgtgtcaagctccatgtcgttgttttgtgatgagcagtgatttagaactggccagaccttagaagagtcttcagcaagctgccctagggtaggggcgtattctctgtttgttttgtactggtaccccaggaggatgccttgtaactgctctttggtcatgatagtggtaatgaatccattcatgtaaaatgcaatatgtctgttagtttggggcacccgaggctcagtagaggtttagtatgatgccttccctttcttctttgagttatgaagaaactaatttctggcacagtgtgactgcttcaaacctatgttctgctgctatctcctatagaggagggcagacttttttttcttagtgcatttgctggtaggtcaaggagggatggactttgaattagtgttcagagtcacagatcctacgtatgtgctcttcagtagaggattttctgtgatcctacaatgaagggaaagctatataatttattggtacttcctaaagatagagactaaagtcatggtagtattggccaaattaattttaaaactgaacaagtcatgaattttcatataaatcaaagaactttttccttataaaagcttccatttttgaaaagttggatcagttgtaagacctttcatctttagtattgtatgatataattctacattgaaaaataaacacttggcattaaatgggacttggagtcaaaagatctggttttatggtccatcttttaccaatcatttgctgtggatctctttaaaggtcctggaacctttgagcctcagttacctcacttgtaaattggcaaaaatacctacctcacagggttgttgtgaggattcaatgagctaatgtatgttgaaagcactttgtgaattgtaaagtgctacacaaatgttagttgttgttgctgctgtatctgagatgtcttaattttctttttcttcagaaatagtctaataaacctccagggcttttctgttaaagtatactagttggtaaaatgttgaataaacagtttattacaatatacgtaagtattctataaaatctttcttggggttaactttcaagattttatgtgtatctaaaattcattttaaagactgcaggcacacagtttggaagggctctgcctttgctgctcttcatagaggaagacctcctgaaatgccagtgaattatggttccccaccaaatcttggtaagtaaggttggcctttgagatgcctgaaataattgtttttaaatttctcaacaacctttataaatgctgtattaaaatttaaaaggaaatactggttgaaatgttgttttaatagtaataagtatcaaatgtcaaattattgttaaaataattactaaaaataaaattaataaaaaatctttttatagtaagaagtctatgttactgaatacagaagaatagaattgggaagaaattgtgtcattagggcttcttgaacatagatttttgtgaccctctagaaattgttatttgagtttttcttagatttttccttattggctctcccttaaccattttcattgtttttatttcctagtggagatacatcgaggaaaacaactcacagggtgttccacttttagtacagcatttccaggaactatgtatcagcatataaaaatgcacagaaggattctcggacatctatctgctgtttactgtgtagcatttgataggacaggacatagaatctttacagtgagtaaaaattttaaacttgatttgatgtcatctagagtactttagtgtgcttcagaatcatctaggaaatcttagtttctgtttcccatcctcagagattttgactcagtaggtatggtgtgggtctcacgaatttgtatttttaataagtgcttcagctgaagataggactctgtgctgttttgaaagacagtgatttagagtagtcgttcttaaatgtgatatttaaggatgcttaaaaatagacatacctggccgggcgcggtggctcacgcctgtaatcccagcactttgggcggccgagacaggcggatcacgaggtcaggagatcgagaccatcctggctaacacggtgaaaccccatctctactaaaaatacagaaaaattagccgggtgtggtggtgggcgcctgtagtcccagctactcgggaggctgaggtaggagaatggcgtgaacctgggaggtggagcttgcagtgtgcagaaatcgccccactgctctccagcctgggcgacagagcgagattccgtctcaaaaaaaaaaaaaaaaaaaaaaaaaaaaacatagacatacctaacactttccctctagcacattctag

SEQ ID NO: 102419 - DNA, 1173 bp, Homo sapiens
ggcaacgagcacaacaggagctacgaggagttggtgagcattgggcacgtttgctccccgggttttccgtgcaccgccccccgcccccgccccttcccctcgcggggaccccggcccgtggggtgcaaagtgtgacccgcactggggggcggcccggggatagctgcgttcccggctgaagattttgttttgtttttgaggcggccaggtttgttttggcaggaaacagtcattgggggcggcgcggggcggagcggtgggggcgactcgcggaggtcctgcggcaggggtggggctccaggtgcggccgcctctgcgggggtgtggcgtgcgcagccagccattcaactgggcggtttcattcgcttccccgctccaccgcgcttgtaactcgcgctctgattggcctcgctgctcttgccccgcccgggtctgtccccccacttgttccctaggaatagaatcattggtctctgaaggtggagaaatgttcttgtgttgagctttttattttttgttttgtcagcagcgtcataaaaatcttgcagctgtatgaatatgccactgtagtgcttgtgctcctttctactgtacaatatttgttgaacgcagtagttgattgatgagtttcacactgatcttgtagataacacaataaagtgctttaaataggcacttttcttttgagctcggttaatcttgcattacagtctcatttcttttgtgaacttggttaatgtttctatataacttgcttttatctatagttacagcagttgcagggattcgtttgtttttactggagacatttttcaggaatatatttttgccgtttcgttattaggataaaggaattcattaattgccaggccatattcagcatcttgtataaggaaaacaattgagaaagaaaagagcttctgagtgatcttttaccacagttggaagacctgtaacacttgagtggtagagtatggtggcaagtgaaaagaagaaaaaaaagtggtagaagattactggttttgaattagacaacagaagagaccagaggatgtgttatttccatgaacagttaacacttgaagcctggtgcaagtaataaataattttaatatttgctttcttagattttgaagtaaacactttaacagtggatgttttcaagggaatgag

SEQ ID NO: 102420 - DNA, 1053 bp, Homo sapiens
cccctgcggtcccgcgtagaggacccaggtcccacggggggcggcggtgaatcgccccctcttgtggccgcgcttccgcccccggcacccgcccgctgctgggccacccggcgtcgcgctgccgcctcacaaagcccgggcagccgcctcattgcgcgcagggattcggaccacgcgccctcccctcccccactcgctgctgcggcgcccaggtctttgcctccgcgtcactttctcctcatcgagtccccggaggcagagagctgagcgaggttcgcctccccgggcgggacacgagctccggtcctctcttggcgcaaacccccgccccccgcggagggactacttttcgtctcccgcggaggaactacttcctcccccgcggaggcgtcggtccaggcggcgcgcacggtatggcggcggcggcggcggcggcggcgcgcgcctgagaagaggggacgccagcccggtcaggcctcggcgcggcctacacgctccgctcgctcgctcgctcccgcctcccgccccgcgcccggccatggcggagccgtcgtccgcccgacgcccggtgcctctcatcgagtcgggtaagacgcgaggccgtgccacccccgccctggcgctcccggctgcttcggcttccccggctccccgggctcccccggctcccctggccccgtccccctcccctccccgccggggcttgacctgactccttgtcttcccgcagagctgtacttccttatcgcccggtacctatcggcgggcccgtgtcggagagcggcccaggtgagtgcgggcccgcgggcggctgcggacttggcgtccccagtgtccccgccgccgggggtcgcgggtggtgggcgggggtgaaacgggagcgccccgggcccgaccccacccctgaccgcgcgtctctcggccgcaggtgctggtgcaggagctggagcagtaccaggtctgtgcgcgcccgtccccgcgctccctcgggttcctcctgccgaccttgccctgagggatgctcgcccgcgccccccgcccgccgcccgccgc

SEQ ID NO: 102421 - DNA, 1064 bp, Homo sapiens
cccaagcactttgggaggccgaggcaggcggatcacgaggtcaggaaatcaagaccatcctggccaacatagtgaaacccccgtctctactaaaaataaaaaaattagccaggtgtggcagtgcgcgcctctagtcccagctacttgagaggctgaggcaggagaatcgcttgaaccccggaggcggaggctgcagtgaaccgagatcgcgccactgcactccagcctgggcgacaaggcgagactccgtctccaaaaaaaaaaagctatttgtgaggtaacaatctaaatatgtttgagctagtgcaacagtaagttaactccttacatctgttaattcagcaagcactaacaagtgatggagattaaaaaaaaaaaaggaatgagccacagctttgccatcaaagacttcagcgtctcttaggggaaacagatgtaagcaaataatgacacgatttagggcagagatatatcagaagatcagcttgcctgtgcgtgggggaaatgttagggaagtttgggttatccaggctacaatgtgtggaaagggatttcgcacatacaaacaacagagggccaagacatgaatatgatttctagtttaaggaaccagaagtttagtatgactacttggggtgactttggagaggatgggaccatgatgtcagaagttgaaattgggagcaattgaaagattctaagccaggaaggaatcattttctattttaggatggatttgagaaagttaagaccaagaggcacttaacatacccctgaaatagaaaagaaatgatgcatgagggcgttggtcataaggatagagaagagacaagatcagaagtatgtaggacagtaaatctgcaagatgaagttggggtgaaataaaaaccacaaaaatctcgtttggggctttccaaggttgtgccaacaaataaggtagggcatacaggctggtagctagattgttaagatgagtaactgcttgcaacaacttgattatttgaagttacagtgcatagatgactgtgggacagtgatctgatgctgcaagattaccagtgtta

SEQ ID NO: 102422 - DNA, 1506 bp, Homo sapiens
ttagagctgaaacaagaagacagagtgacctcagcttggagtgtacatgtgatgcaactcaacattttttcctgctctgtagatgcatgcacatgaccatggaagggctgcaagtattgatttggggtgagggggtggttaacaaaagttttttaacaagagtaggtaggtgactttacaaataacaaaggttattgacttttttaaagacctgatagttgcatataaataaaacgacaacgtgttaaatgctaaagatctcaatttcctttcttttgcagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatctttgtggtagtcctgttttcctaataactttgttactgtgctgtgaaagattacagatttgaacatgtagtgtacgtgctgttgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaatattttgaagcacatggattaaattctggtttaaattttatttacagaatttccacatttgagcctggccaacatggtgaaaccctgtccctactaaaaatgcaaaaaaaaattagccaggtgtggtggcaggtgcctgtaatcccagctactcgggaggctgagccaggagaatcgcttgaacctgggaggtggaggttgcagcgcacccagatcgcactactgcactccagcctgggcaacagagtgagaccctgtctcaaaaaaaaaaattccatatttgatcttccaaagttgttttttttaagtgaaatgtttgaatttttgtttaatacagtcatgggtcaccactgactggatacagtctaagaaacacattgtt

SEQ ID NO: 102423 - DNA, 1032 bp, Homo sapiens
aaaatttaaaccagaatttaatccatgtgcttcaaaatattttcataactgagattttattggttgaggatcagtacagacatttcaatttgtacacaaatcttaacatacgtaacgaaattctaaaaagccatgtattgtaattcttttttaaagttattccagtgactttccagcttaaaatttggaagcaaattttccttaagaggctatcaagtaccagtatcttcacgttggtcagctgttacatacggcccaccagttcacaactcaacagcacgtacactacatgttcaaatctgtaatctttcacagcacagtaacaaagttattaggaaaacaggactaccacaaagatgttacagagtgcacacaattctggcagagagagccatgatcaaagagtggttttctttaggaaacaattctactaaaaaacaacatggtaatagaagtaatttaaaatgttcaagacattaaatgcaggactgactccatattgccatttaatatgctttgtattataggatataaaaactaaccccccatctgtggaatgttaagctgacacccgagacagtcagagcctcccataattcaatatcccacactattttctggttgtaccaaaaaataaacaaccagcaaatgatttcacctcttaaaaaaaagcatttacacttaaaaaatgggatgaggtgggattccctccttcttaaaaatgtttctagagctactaaaaaacttgcatttacaaaatagttgataaaaatattcctctggattgtacaagaagggagacagggaccactgataagacatggtatatggttattaatcagacttggcttctttctctcctgcttcatcagaggctggactctgcaaaagaaaggaaattgagatctttagcatttaacacgttgtcgttttatttatatgcaactatcaggtctttaaaaaagtcaataacctttgttatttgtaaagtcacctacctactcttgttaaaaaacttttgttaaccacccc

SEQ ID NO: 102424 - DNA, 1088 bp, Homo sapiens
cttctcagtattgatggatggtatctaaaagtatttttatgtttctttaacatggcttaaattttgaacttaatgtatcaagttagtatggtcatattaatacctgtgcttttcagattcttcaaacacctaaatgaaagtgataaattcaaaactgatccttttagttcctcattatatgatatgaagggattaactgtagcaggatagtcaacctgaccgtacggcatggtgctttttttcaggtgattggtcttaatgtgagggttaaggtcttgtgaggacagtattgttgaagttcacaacaaatttggggatgggtgggaatacggtcgacgagactcctccggtattcaacttcatgacattgtcctgtcatgtggaactgtagggaatagtggatgatggcgacagtggtgaaatatagctcgggctttaggatttgtcatatgtctaatgaggcttgacatgcaagtactattaaaatctccttagcatacattgttttcctgattactgggggggaccttaagttgtctcatgtaataggtgtatcaactgatgtgtgatagacattaatatgacagctgttatggatacagtctatacaaaatgagatcctttcataagcttgaagattggggtttcacgctcatgtgtgagatgtccctctctcaaaccttactatgaagtcagcaccactgggcacattacttgtctgacatgaaggggaaaaagtaaaacaaaatgtaaataaggagtaaagcatgtacttaaaatatattcttattctatcataggataaatcttcagacaaaaaagtgcaaacaaaagggaaaaggggagcaaagggaaaacaggccgaagtggctaaccaagaaactaaagaagacttacctgcggaaaacggggaaacgaagactgaggaggtcagaagtgtgtgtgtgtgtgtgtgtgtgtgtgtgattgctttgactctgaacagtagatactaaattgtacattttttgtagcagataacagtattcattataatattgaacaaagttttgtacggtatcccaaagtgattggacaaatggttttct

SEQ ID NO: 102425 - DNA, 1050 bp, Homo sapiens
tacctgctactataaaaacggtagttttctatttatggaagagtttttcttaaacttatctagaattaaaagttaatttaaagaaagtactaattatgacaaaagcagggagtcgttagcacttgaaaccagagtttggtactatgagaaggtttttaattttaaaaagaaggaaaaaaagaaacacggacgtcagaaaactggttcagtagggatgggtgctagaaggctacggaaccgccgaaggcccaggagaaacccggaacgtgttaaccgctccaactggagccggacgaaaaaacggccccgcctcccgcgagggcgacgcagttcgcaggcgcgtcggcgcgcctgttctggggcgcttggcttcaccgcgcaggcgcggtcgccgctgttgttgtggtccccatggagctgccgtagcggacccagcacagccaggagcgtccgggatgagctcagccgcggccgaccactgggcgtggttgctggtgctcagcttcgtgtttggatgcaatgttcttaggatcctcctcccgtccttctcatccttcgtaagtggctgcctggcctcccaagggccggtggggatgccgccccagtcccccggcgggtctggcgtaggtacaggggtctcaactgggcgactgaaggccgtagtagcgtcttggttggtccgtaagcttttttgagatagttgttagcgtctaaaaggtacgacgctttaccccaaaatcagactttctgggttctagggggttgggagaaacaccgggcaaccctggactcttctggctgtgggtggcggcggcgaacctcacactgggagttcctagtgccccgctgtcagcctcgtttccgttaatcctggttcctagaggcattcgagcagccctcggccagggtttcccagaggcctggcgggcgaagtcagctgttccaggtcccggagagatggatcctcgcgtccaggagcccacattcttggggtgggtagggtgggagacaggtgtagagagaatctcagtacagcgtgatgccttcagt

SEQ ID NO: 102426 - DNA, 1028 bp, Homo sapiens
tacaagagctgcggcagtcccgggacagccagtgagagaaagggacatttacctagggctgtctgccacccgggggttggggtatggagtgtatgtgggagtttaaggactttgtcatggtggggctagtttgtaggtgtttctcagcaggatgaatctcccagtgttctccagcaacagcctttgctctttatcagtcctgggaacgttcacggccgcagtttgcattcagtcctgcagggacgcacacaactggctgggtcacagagtggtcagggcatagacagaaagtagcgggggactggggaaccctcctgtgacccgtgttggaaggtgctgatccccgttgtccgccctgccagatgtccagggtgctgcagaaggacgcggagcaggagtcacagatgagagcggagatccaggacatgaagcaggagctctccacagtcaacatgatggacgagtttgccagatatgccaggctggaaagaaagatcaacaagatgacggataagctcaaaacccatggtactgtgtcccttgcagcctggaggcttcatgagagcggatgaatagagaagtctgtatgtgaagattagtagaatacatactttgcttcttggatgttctgaatattgatggaaacttaagttatctggaggaaactcagtaataagtattactttcctcttatttgctggtgaacctttgctttctaagcacagaaatatctaagatcctctcagattttcctcagagccaactctttaaaattttaagctaactcttaaaaattgtaggttttcatttttaaattcatcacttttctgagagaagcccagaaaaaaagtctcacagtggattcccagaggcttttgttccactctctagaaaaatgcccagcagtgtcctcttctgagtgtcacctcccgggtccagtgtcctgtgatgaagagcgctttctcagggcagcccgtgtgctgagggaccccggtcacagtgtgtgcacagtcagagagctgtctctg

SEQ ID NO: 102427 - DNA, 1885 bp, Homo sapiens
agtgagccgagatcgcaccattgcactccagcctgggggacagagcgagactccgtctcaaaaaaaaaaaaaaaaaaagaaagtgacaaatttgaacctatgaaacataaacttcacttcagcccagcactgctcaaaaagaatggaaatactctctttgctgtgagttaaagacagcagagacagatgggggcagcactgctggtatgcgctctcatggtgaatgtctttgttttcaggtggtgttggaattacctgttggattttagtctgtaacaaagttgtcgctattgtgcttcatccgttcagctgaacaggaggatggatacagccgcgaggctaaaaaacggatttcctcttcctagcttaaaatctgatttacactgttttgttttttaagaaacaaaagtgcatagtttagattttttttttgttgaatatgtttgttcttggactttatgagagagtcttataagaatcacgattttctacacctgtcattgagccaagaaagtccagtttatgacacgtatgtactagtgaacaccgtcctcgatctgtacgaaatgtgaaatgtttagggacatctccatgctgtcacttgtgatttgccctcttatgtattttggtcatattgccaactggaaagtcaaaattttctaacaactttaagtaagttctttgaagacttagtgctgtttttaatccagtttagaaagtaacttaattttaataccactactaaaaattcgaaaatttcttctttaatcacattcaatatggttaaaagaacaacactaattgacattgcgtgggctttttctccctttgtttaaaatgtcatttgttgagcaagagttgtatagtattatctacttacttgaggctgttaatttttcattacagtgttttgtaaatgtatccacgagaccatgatgcattgttttgtgctcaacttgtgttttgtatttaaagcattttgaatgaagtgtattttataagcatttaatatttatgctctttagaatggaacacagaaaacaaaccttataagtcctgattaatctgaaccaataacctgtgtggcctacaaagtataattctattaaatgttccttaaaacacttttttctaattaaaatctttgcaaatgcttgtgtaacttcctgccttacagctacttgtttgctgtgagccacccgcaactgacaagtggctgttaactgagtcaccatatcccagtaaagctgaattttctcactagtttctgcaagttcatatttgtactcttttgtttcctaatgatctaataagtagtttgttgttattttagctgattggactgtgagaagacaaagtgctgtggtcctttatttattgtcatgctgaaggccaccacagcagcttttgggttccacttactcaaacacacatgcacgcaggcttacccagcaccaagtttacttagctttaagaaaggacagagcagggaacgcagccacagcctggtggaggaactggacaccagcttccagtgtccgtcaccacacgggatacattttgcccacaaaggatgagaagccaacctggggaggagatgagagtagcacacggaagctgcaggaactagtccttcagacgaaatatagcaccaagggggcacgtgcctaactcccgttttagtaagctgcaggcagaaatgatggtggacagtcaacagtgcaccggccatgtagagcgtgcccagggaactgctgggatcactcatccgcatacagtgtccatgatgatacccgtatctcttaaagatattctcattcagttgttacaagaattttgacaaatctcactgaggctagaggtaaaaatttctggttcacagcta

SEQ ID NO: 102428 - DNA, 1035 bp, Homo sapiens
atgaatacaatattacctaaaaggcccaataatatcactttggtatacaagagtgaaaattgaggttgctcattattttctgtagatcacatattaatttcatgtgaaaaaaatttattggaaaatagggaattttaacaacagaagaaataactgagattaaaacgtggaggaaacgaacctgatatttacttacttcaagatcatagaaaatactcgtgtttcagcatcaaatattacagaattaaatcctaaattaattccatttatgtttatgtctatacagactcaaactagctaatgtaagatatgcaggagaattcttaatatgatatcaatgccttctcccaagtcatcccttataatgtaatccccaggcttttgacaaccaagtgctgttgaggaaaatcaatccagtcatctctttaattattttaattccttttccttccctactacccaggaacattatctgggaaaagctgctattttgaaaataactacaaatgtctgtgtggtaattcctggccaaaatggtgagggagaatacaaaggccctgaacggatgcactgagtaggtttttagggaagtagccttttaatcaacagtttaaggtagagggttgacttcaaagagaggtttcacgtaacacaatgcaatcttttcagcacagggaaaaagtcccttagcactgtagctgtgctctcttagagaatggtcatttccagataaaccagtccagccacagagtgaactcttgtgcactgcaacagatgaacatttctagtttgagctgcttctgtttttccttcaaaccactccctttctgtgccctctattagacaacataattatttagtgcagcacgccaagtgaagcagttagtaatgctttgttacagagggggcgcatccatgattaattcacaccctctctctattaactttggaatcttaaactgtctgggcccctgaaatacagacctgtatttttttgtcatttgcgtccatttttgttgtgataatagataattt

SEQ ID NO: 102429 - DNA, 1051 bp, Homo sapiens
cttttcctgggatttcctaagtagttgccttaaattttttacttcattctgatgtttagccataatttgaggtagattattttgtgaattctcatattttcctatagctttcaaatgcctaagctgaagttgtttcaaaaattggttttctgtaaggatggcttccaatttatgatgcatatcagctaattcattttttagtcctttaattttatgaagccttgctgagagtattcgatgagccatagcatctcttctttgggcaatcatatggatttgagaattaaagagtgatgcattccaggtgtgctttttttcaactgatatttccttctggcctgtgtaagcagaaaatccagtttattactagtaaaatatacagatatgcaaatatgcacatatgcataatctctctcccatgcccccatgcacacacaccacacacatacacacaagcgtaagtgtaactagaaggggacaaaactatcatttaatgaatacccatgctttaggctaggtactttatatataactacctcatttaatacaattctttaagatcagttgtaatatattttatagctggagattttacatcatttgtccaagattacatagccacgaagtgacacagaatggattgaaaaccaggtcttctttgactctaaaatctgtacttagatttctattataacagctagactaaaagctgtgataataggccaggtgcagtggctcatgtctgtaatctctacactttgggaggctgcagtgggaggactgcttgaggacaagagtttgagaccagcctgatcaacagagttaagatcccatctctaaaaaacaatttttttaaatgtttatttttatttttttttgagatggagtctccctccattgcccaggctggagtgtagtggtgcaaccttggctcactgcaacctctgcatcccgggttcaagcgattctcctgcctcagcctcccgagtagctgggattacacgtgtctgccactatgccctgctaatttttgtatttttagtagagacgg

SEQ ID NO: 102430 - DNA, 1082 bp, Homo sapiens
cttacaaaagtatattcatgaagaagagggctttgtttccagaaagtaggtaaaaatgattatttttatttgtatgctcagattttaaaaggagactcaaaaattctgaaggatatgcaggctcaaaataatgttagtctagatagtcaatgtctctttctacatgattaaaatgtatataactattatttaagtggtctccctggcttctgaagattcttggtcagtcatatgccatgcctgatgatggcagcaggtggaaggagaccccagaggcaagcagtagatttcattgggcagtgaggggattggacatcaagggtagtcctcagtgccttcctgcccctgccagtttgaacttctgctactctatgcagagcaaatgaagatattatcctgagagccagggcagacaactgttagattgagaaaggagacaccacactggaagccaggcacagttgaggccaggctccccgcctgacagaggaatgtgaactggaaagagcagacacatctcttgatgacaagttggcatctgtgcattttagcccaggtaagggccggagtgcctgcctgggaccaagatagcctgggcctgactgaacacaaacaaagaagacctagatcgttcagcacagaggtgcccatttagcagaggtatgagtgtctccgggtactcagggctgtaaggaaacacaggatgcaaacccagttagggtggggagagggcttctcaacatatcgatgttactgaacaaactatgttatgttcctaaaatttattctgaaatatgccgtatgtgataagaaatacataatttaaaaaggagtgatacagtgagcaaccattgtatgcactatccagtttaagaaggacagtatactattaccagaaatgtggaagccctctgtgtgcctctctccctgatcccatcccttcccctctgcaccagtgatagtcattggaaagaaagggtcttgctttgtcacccaggctggagtgcagtggcacgatcatggctcactgcagcctcaacctcctgtactcgatcgatcctcttgcctcagcctcctgaata

SEQ ID NO: 102431 - DNA, 1007 bp, Homo sapiens
atgaaacggcatggcaatttctgctgagggctcacttactcaagtttcatttttctggtgcctttcctttattttgctcgagattctcatgcagcagtttcttgaataaatttcattttgaagaaatatctcttgaagcatggtttacctgagtgttttgccagggaaaatcaagaaccctgctttgctgaacaagttgtgtcccttttgctttttcagttcctgcgatgataacatcctatccaaatactaccctggccacgcaggggcagaaaaaggagatgagctgcacggcgcatggtgagaagcccattatagtccgctgggagaaggaggaccgaatcattaaccctgagatggcccgttatcttgtgtccaccaaggaggtgggagaagaggtgatttctactctgcaggtaaaagcatggcaaatacaacacaatggaatgaactttattggaagaataagtctttcctttcacagaagcgggtgcagataagtagcagataatctttcggaatttatttacgaagcactatttctctcccctttcacacagcgagattagtgaagtagccttcaaaaatagtgcttcagcctaagtgttattaagaatagggttattatgaacgcagcagggaacccaaatgtagtaaaaaaaaaaaaaaaaagtgagaaataaggtttttaaatgacagttaatccttcaggaatgatggcctatgctgtgtgcatgttttaacttcctgcaaaaagaaaaatgagatgggctttgggacaaaaatattatcataaaaactatcttgcttctttggaaaaatccacaataaaaaaaaaatctgtcgttaaaagaggatcacaaaagctagagaaaaggactgtgagcagtgaactggtttgtgctgttgtcatgcggttggaggatgatactgtagcacacacagggtggggaggtggggaagccctgtgtttgaaatgcttatattggctctcagacaagggtcca

SEQ ID NO: 102432 - DNA, 1025 bp, Homo sapiens
ggtccatttcactttttctttttcttgcagtttgaaaggcacttgaactagcccactaatgttgctttttactccttttacattttaaaaggagtcgtaccctggtttatttgcttttattgcctgtgaaaatggcctgagtaattagaccaacagagaattgcatcttaagggctaattattgatatattccttgtgtcagctcaaaagtaacctctggggatagaagattaggcagagtatgcctgcccatgaatatacactgttcatgcctctctaggcttcaacacacacaaggtcatgtaaggcaaccttacctaccccattagggtccagaaagatatccacctaggagagagtgtaaatatcacacccatcaactcactcttatgcccagtggctcatcctttcaaacatgcaaaactttctataatggggaatctgaaatactttaacaagtttaaaaatctttattgagcacagattttgatttttaaaaaatatttttgatagacatactatggttcaagtcccatacttgcattaaagggttaaggtggaacaatgcttcatgcacagttagcatttcatattttttgtccagtgaagaaaagaaaacattctcaactttgatctcctttagtttaaaatgagataagataagatacactccagcatcatgctcttacttaaactgagctgattctcttgatttctatttcttgctttcctcgccattggcctgaaatgagtaggcatgacaatttttgtccatatgttgtatgtaattaaactccagcctttacattgccaccatcaaagacagcgaggaagagacattttattattgcaattcactgtcttaaggtggaagcttctgcaacggtgacacagaagcgtgatggagaaggcacaaaaatgatccatcttgctcttttaagagaggagaacataccggacttgtgcagacagaacttttttttttttttctattgaagcatcttctagtgcatttaagctttttt

SEQ ID NO: 102433 - DNA, 1052 bp, Homo sapiens
gatgtggagatacataaaacaccatcctggaaaaaaacaataacaccggctttatatttgggtttcccttcacaagcctgttgtgaatttcctcccgattagggaggccagcagtaagagagcccagccttccgtttctgtttcttctgataaaattgtgagaatctcaccaggggtttagctacattaacatcaaagacacagcccaggggtaaccggatttggaaaatggaaaaagcaaacattttactattcccagagaaactgcctccctctttagcagtggcccaattttctgctgtaatatttcctatctgaatacctctattagtgatgattcaaggagaattttacctcttaggatcattgagttcaggtcgaaggatgattatcttctttctgtattttggctaaacgtgaacaattttctgcccacatgaaatatcaaaggacataaaccaaccactttacatgaaacattggctgtaattcttcactgccacaactgggtctgggcatcatagatcacgcaagacttgggctttaagaagcactccctccccaggcccctgcagagatggtttctgctgttgagatgcttggggagattcctgcactgtccctcttggggtgttaagtgctgcagtaggcgcttagggcctgaggctgtagctacacacacggttttgcctggggaagtagagaaggtttcagaaaggaggttgtgatttaagaaaacctttgcattttagagaggggaaaagagattataggtacagccaaccaaattagacaaggctgcccttaagcacgtttcagcaaaccagaactaagagcagattggatgccgtattctcatgtggggagggagggagagctagcacagctgtcggggggacctgagggtcatgctgtggggggcctctgctttgtgcactcttgactatagaagttaaccttccctttctgtggcacttctattgtgattttattgctcctcactgagcattttccagacatctgctatgctgtggctgctatcttgcggagac

SEQ ID NO: 102434 - DNA, 1071 bp, Homo sapiens
taggcttcattgaatatttgtatagaaatctgggtagaaaaatgtggacctcgaggtgatctaggtatttgttttgggcaaggaactctcatcagtggttggtttatttgtgtcttgggggatctcacatcatcagcctttattaatcacaggcacgaggggccccacactctcccccatacctctaccgccccattgctgaggatgggagagtaagaatatagaatatgctgtaggcttctgtgggattagatgcttggaggcagcggaggcaaatgttcatgggaacactgaatatggaggaagaggctgtgccagccccatagccacacatcccctccacccttacatcaggataagaggtagaccacagtctgttgacacttcaagctgaacattagttagtatccttctatgtgggccttcccaggtaaggatcgaggacactggttctcaacaccccggtgttctgggtcagggagaacagagaaaggagatatggaagtttcctgaaatgcatttcctctcattagcctcctgttggaaattctgatgccagcgttgtggggaatgggctgtagtttggaaagctccccaggtgtttctaatcccatgtgactttgtcttgtttttcccaccaccactggggtctcccaagttatggtttccatgtttgttatgtcgtcttccagctctgataccagagagtctgattctgtagccttggtgtatgcacgacctgtgaatttgcattattaacgcatgcctttgcctgttctgatccacatgaaccataattcacctttgcaaaacacacacttgcaaagaagctacccaaacagtagctaggaagttgatccagtaaagttccaagtacatctcgatgaactgttggagaactctgtattgggtagtaatttattgggaatgtctgtatacagggttaggtcttcactgaccaccataagaatttgggcatctttcgggataattggtgctggggtttagtaacaagaaagattctgagtagaggggtatgtagatcctgccagaggcactcccaatgtggat

SEQ ID NO: 102435 - DNA, 1011 bp, Homo sapiens
ttacatcatctgaaatgttgacaaattaaaaaaaaaaaaacacctgtatagttgtaaaaatgaaatcagtgaatattgtaaatagcatacatttcctcatgcccagccaatattatattttgaaatgatttcttcctgggtatttagaaagctattgctcttgactgagtcagacccaattagtaagtgtgactgcaccttaggctgcctgtcaccgcataaatatgaacttacatgtatgaatggcttcctctcttgtgggaaccagaggaaattgtcatcatttgacatcgcctgggagtagctacggcttaaattcccatttcaaattttggaacacacatctgcataaaatgtataacctactgacagttgaaattaaaccattaagcagaatcccctagccagaagagaggagagagagagagagaaagagaggagggagagagagcgagacagacacagagacagagagagagagagagagagagagagagaggagaagaagagaaggtaaaagaagagaagagaggaaatctggcccttgtgagaaaatacgagaagcaaaggggaggctctaagattttcctggaagacacacagggaagctctgtgtgttggctgcaaggcagtgcattttctttgcctacctagacagtgcctaaagaatcagcataccaacaggccagaagaaatgcatgagcattgtcaattttttaaaaaaacggtgactaagaaaaggtagagttgaaagaaggtactatcaaaatgaacatgaaaatgatactttgctctccagtataacctaaagcaaagtgtttgaaactttcattttgagatttcctagcaggaaagaattgcaacaagttctgacaagacacccatctttcccagagggcaccatacctgtcctgtgtcctcctgggaatttcccttcagggacagatgtgcttagggaacatgcggagatgtgtcggggaagtcagccctttctgctcttctgctaatgcg

SEQ ID NO: 102436 - DNA, 1044 bp, Homo sapiens
ataattttctgacttaaacatggctttcctgctcatccctgtggattatctgatggatatgacaatcctcgccatcagatatagaagcccctaaaagagaaaggaaagaagctgagttacggggcctgaaagcaagcctgtgcaggtccccaggccccgggatgggggtccggcccatctgtggctcaagcctcctgggaagctctgaccctcagccagggctagaaacctgccttagatacaccagggcgcggcccagagggctgttccaggaaacgtgctgtttcactcacgttgggtaacctggtatttacggacttcttacctactttcctgtgactcaggaatttgtgtcttgagggaaactgtatttatttattttttactgtagtccaaaattgaagacattagagcagaacaagagagagaaggtgagaagctgatccgcctccacttccagatggaacagattgtctactgccaggaccaggtatacaggggtgcattgcagaaggtcagagagaaggagctggaagaagaaaagaagaagaaatcctgggattttggggctttccagtccagctcggcaacagactcttccatggaggagatctttcagcacctgatggcctatcaccaggtacgtcttcgcgtggttcaggatgccagcttccattctttccttttcttctgaacgcctctctctttagtcttgctctctctgtaggtgacgttggtcagctctgtcgtttacctccttgttagcctcctgtattagtccattttcatgctgctgataaagacatacctgagactgggcaatttacaaaagaaagaggtttaacggacttacagttccacatggctggggaggccttctaccatcacggcagaaggcaatgggcacttcttacctggcggcggtggcaagagagagaatgagagccaagtgaaaggggtttccccttatcaaaccatcagatctcatgagagttactcactaccatgagaacagtattggagaaactgcccccatgattcagt

SEQ ID NO: 102437 - DNA, 1132 bp, Homo sapiens
gcaggcaaatcacttgagcctaggagttcaagaccaccctggcaaacagcaaaatcccatctttactaaaaatacaaaaaattagctgagtgtggcacacctgtaatcccagctaccctggaggctgaggcatgagactcacttgaacctgggaggtagaggttgcagtgagctaggatcatgccactgcactccagcctgggcaacagagcgagactctgtttcaaaaaagaaaaacaaacaaaaaaacagattttccagccccaacctggaatgcattctcaaggagtgaggcctgggaaccagcattccagccagcttcctgggtgctttctaccatgtctgtgtttggggctgctgatctcgatcctgcatggccagcgtgcgtccgtgggattcagcctcttactctgaacgcattctgagacttttgacccatgatgccaatacagaccattgcactgggattctagtctgtgaaaacacaggctgcaccagggaagtgaccttagaccagaggttggtcagctttctccacgaaggcctagagaggcaacattttaggctttgcaggccgcagggcctctgttgcaaggactcctctcccctttgaagtgcaaaagcagccacagccagtgtttaaatgaatgagtgagactttcttccagtaaaagtttatttatacaaacaaggtggtggcacgctgtgggcaaccatttggcagtttctcaaaatgtgacacatagactgtgaccaagcaattctgctcctaggtatgtatcgaaaagaattgaaagccacgactccaggcgtttgtcccccaatgtgtgcagatgtgcagcattatccacgagagccaaaaggtggaaatggcctgcacccacgaacagatgaacaaaacgcagtacattcgtgcagcagaatattattcagccatgaaaaggaagttttgatatatgttacagtgtgaatagaccctgaaaacatgcttaatgaaataagccagacacagaagggcaaattttatatgcttatgcttatatgaatttgcctagaatgtagaaaagaggttactgaggatggggatgagggaaggagttattggttaatgggtgcagaatttttgttgagg

SEQ ID NO: 102438 - DNA, 1178 bp, Homo sapiens
cccctggcacccaccattctactttctgtctctgtggatttgatgactctagagatgtcttataagtggaatcagacaggatttgtccttatgtgactggcttattctaccccggctcatccatgtgtagcctgtgtcagaatttccttcaacactgagtaatataccatcatgcatatgccccatattttgtgtttccatgcatccattgatggacagttgggttgcttctagctttcgtgacgctgctgtggtaaaatactttgctatttgaatttcagtaaatataacagcttgccctgtgttttagttacgattcttgggtcatttttaccatggagttgagtaagttggtggtcacttctttttggcccttttcggatcacctcttatagttggcaaaagtaatatcagaaatgatgttacctgtttatttatttatactttatcttattgcccagaagagttcaggtggcttaccatcaaaaatacatttaacagggaaaagaagttttgaaaatcaggttcagataatatgtaaaacagagaagagttaagacagagtgacaggagcagaaaacaggtgtggttattctaattgaggcacaaattgacctccaggctttctggtggccagagttagaacagagtcaggtgtgtggctgttgcagctaaagctgcctaatgtcattatatattcaaggtgtccctttcagatgccctggaagctgggagtgacgcccgggcgcattccctcctttctcgcatacaggctcgggattagctgggaagttttggaaggaggccgttttcatgctgcttgtaacctggaacttttttcccacctgtcttttcccaacttattgacgtccctgggcaggttcacccatcatcagaataacaccatcacgctcaagaggagcttaattctctcaagcagacacggcatccggcgcaagctcatcaaacagctcggggagcacaagcgggtttaccagtgcaatatctgcagcaagatcttccagaacagcagcaacctgagcaggcacgtgcgctcgcatggtgagtccgcgaggcccggctggcgcccggggccagggccaggactggggctgggggtgggaggacagcacggagtctcccctccttgggtcgtctcccacgagctgcgccagtga

SEQ ID NO: 102439 - DNA, 1069 bp, Homo sapiens
tgtggctccttctcctggattgctgaacagtgcttggtccatcacctgtgggtgggcactgagttgctcccaggacctgtctagggctcatcctttgattgtgcagtatcctcagttgggtttgaagaggcatttgaccctcttccagggtgtgtggtctctgtaaggctcttgtccctgtggtcctcacacagcccccatccaagccacctgcagcacacgcctcgtgggcctcacagtgaggatgagatctgatgctcagccactggccccttcacatttgttactgacactgggcagtttttctttttactgtctgggatacaccaggatttcttttatgagagtgaaaaggagtccttattgcttctattaattagagacaattgggaagagcagccattgtggaatattctgagcctccccttttctgctgtgggtctgcagcttctaggctgtgcactgttgggcgctgatttaggagcgcctgaaagccccctggccagtttccccaggtctctgtgaataggcagagaagatgggggcgggggaaagcgtgtcaggtagatatttcactaattcttacttgtgttgagaagacatttagtaggcaaagtggtagaaaccagtggttgaatttttttgtgtaatcttcccctatttcatttatcttgggtttctggccagggtctccagtattggcgatgatgtgatctttaactcttatacaaaatggttagctaaaatggttttactaatgttggcacatttaattagaaacattaacatttctaaaactctgtcagaattgatgtagtaagttcgaagtttctgctatatatccaaaatgtttttggttggtatgaagagggattgaagtaatgttatgatgttgtggtttttaaaaagaataacaaattataacttcagtttaggctaagaaaaacattttgcttttctgtttgtactagtaaatgtgtggatcccaaaatattgacagttttttttttcccctctgtaaacctcaacatttgtgcctaccattctggcctggctgtggttcccatgg

SEQ ID NO: 102440 - DNA, 1046 bp, Homo sapiens
ctaggagaagcttaggagaggggagagctctcttcctgcagggaggaagagaccatgacatcagaaaataaggaacaaaaccctcctatagtcatgtggttgatttgaacttcaaaatatgtaagtttttctccctgctgcctgcctgcatttaatccataaagcaatagtgctgtttgatagatggggaggcagctcataaagcctgaggagcccagcaccctgtggcggagctgggagtagaactgtgtcccagttcccagtgggccatctggagagccttaggtgtccccgtgacacgtggactgggagtgaagctcaggtagctcaaagcccacctggaccaggactagaactttggtgtccccatgcccactagaacctgattagaacttgagttccgcacctgggccgtgagtaacactcaggtatcccaatgacacatagaccgctggctgtgtctgctgcttccttttgcctgtgactaacctgacccgtccaaaccacatggtctacctgtgaccctcctcactattgtaaacacctcaacatcccgtacaggagcccttatggcctctgacgtggcactgtctagatgggttcctcagcacctgccccccacacgctgatacacagatgggtaatcagccatttccccggcttctccatgggccgactcaccttcaggtgttccagaaggacgggcaccccgtgtgcttcgacacctccaacgaggatgactgcaactggatgatgctggtgcggccagcggcggaggccgagcaccagaacctgacggcctaccagcacggcagcgacgtgtacttcaccacctccagagacatccccccgggtaccgagctgcgcgtgtggtatgcggccttctatgccaagaagatggacaagcccatgctgaagcaggccggctctggcgtccacggtatgtggcggcccccgatccggagcccaccttcccttgtgcctcgccgaaggggttatggtcccttggctctgtgctgaccccacactgatgagatgggttgggc

SEQ ID NO: 102441 - DNA, 1049 bp, Homo sapiens
tcgttatcccccgccctcgggtacagcccatgcgggtcgcacgggggggtccctggacccccaaccccgcgtttagagaagctgagtcctggtgatggggtctcccagaccccctgcgccttattttcgtaagccttttggtggcagagagaaggtagcgaggtggatggacaggtgacgcgtgcctacccggggtgggtggccgttcggggacggggcgtgcccggccgctcaggtgaggcccgcctcgcgtggacaggtggggacgggggccacgcgcagcgtcctgctagaggggaggtgttcacgcaggggttagccttgagaaaatagaaatgaaaactcatggaaataaacactcctatctggtggttagagttatcacccatttacctttcttaaccccctaatgtagtggatggttttttcccccacaaatgctcagaaattgcccctcacccccaagtccccaaagggagtttaaaacggtagaaacaagtgtgtgatcagagacacgtggacctgtgtgtgtatttaaagctaccaacactcgttttaaaaaaaccacattggcttaagccagactcaagtgaatttggagaacctagcttggttcctgaagggtggtgacatgtgaaggagccactggctttgtgatgtaccttaaaaggtagcagtgacagttctccttggagaatgcaatgatgtcaacactcgataagggtggtgatcccaccccggtgcacacaccactaccgtattttgtttcaagctcggacattttcacgtgttccacgttttcactgcttcactccttccccagatttcctgacatcgctgcctcacggtgaacgattaagaaatagtagctctataatttagactttcaagagcaaaaacaccattttttttatagtttgtttttcttctatctgtgattcatactttttgccgcaaagtagccagcaaagaacaagctaaatgttccattttggaagcaggcgggacggttatttctccagaagacaaataaataaatttaaaaatca

SEQ ID NO: 102442 - DNA, 1025 bp, Homo sapiens
aatcactgggtcctgaaccacttctaactccaaacaagaggcactgccatcaccaccttgtggtgcccaggaaatggagcagaaaacctggaacccagctgggaagcatcgggctccctctaagggtctacacggtgtctagcgagcgggcgggacagctgagaggaggggtgggcagtgtggggacaggaggctgggcctgtccagtagctttctccaggacaccagctctccacgtgctctgctgtctgggcaccgcagggggaatgaagactgagggagaccacgggaactgatgactagaaagaaggcacgatgcctgcatggggcccgcaggacacgtctgtgacccgactcgaccgcctccctcccagaaccaccgtgagccccaggcaagtgccgacgctgttccacctgtggctgagccaggtacctgtcccctctgcatgcacccgggccacccaccggggtggggaatggacagtgaagtccaaggatgacctgatgaaaggggcgctcagagaagaccctgggacttccaggacagaacaggactcgggaaaaacaactcagtgtagtgttctgtgtgcacatttatttctttcaaagattgtttgtgttccagccacatcttctccaaaggaacccacccaagcccgtgtgcaggcttgctgcagggctgtcttcggcgtttaaagtgctactgaggaatacaatcattgtcacgtaagttcatcaccgcactccagcgtcaggccaaacctttccgtggacctggaaaacctgccactttcttctctttttacaatgcagtttcgacataacattggtagagtaaacaacaaaccacaagcctaaatgatgaatggtgcgctgctgcccagctgctaactgagagaacgaggcagtgtattgtgtttcgaatgcaaacggtcatggacccaagttaacctgagtttgctctgcaggattccgcgggggccttgccctgtgcaggctgctttggtcttcgtgtctaggccggt

SEQ ID NO: 102443 - DNA, 1037 bp, Homo sapiens
ttaattactttattcagtaaagttttttaagaatgtttatctcagccagtaggcaaatacttggtgtaaaacaagttggtcttaaattgttgcaactcattagctagtgaagatattcatgtaaatatattttaggattgtaattaattttgaaaatgtagaaagctctttattccatgtaagtatgcaggatgcctgcttttttatgcagttgtggaaagaatgtaaaatgttttaatatattctttgttaatctgagaacttgatactgaatcgtttatgtgggagaaggaaggagtaacataaaacatgtttttatcactcaaagtaagcaatggaggtaacaaatattgtgcattttaacagtaatatttgaagatttgtagaatattcacctttaaaactagttagtatgcatttataattttaccagaatatacaactaacaattcaacagtgatgttctttgcatttgtggggagatgtgtgatgttcttggttttctggtttggaatggaacgtttatagccttgcctgtaaaaatgtgccccagcacttaatgagtgaccgtttgaatccatatgtagtcccattggtgctaatgagagtagctgctgtgaaacaggaataaaatgtgtctgttcacggaggtgcggtgtggatgcacctacaaggccaactctctgatcagggtgagggagagatggaagaattaacagatctaaagttggcctttgttgtctcaaattgggtttgtacacacatgcatgcatgtgtgtatacaactgtaatctggaacttcaggaagtaaaattatttgaagtttcttagtaaaaagtaattaggtataattccaaatagatttctgtataaattgtatctaactggattacaagtcagtttgacaatttacgatgtctcagtgatgtttctgcaataattgtgaaatgcattattgatttaaataatgctgacacgtactctttaaaagtgttctttaacactgactactaaactttaagttttaaaaaataggt

SEQ ID NO: 102444 - DNA, 1597 bp, Homo sapiens
tttgtcacgtgtgcaacaaagcttttcgcactaattttcgactctggagtcacttccaatcgcacatgtctcaggcttcagaggaatcggcacataaggaatctgaggtgtgccctgttcccacaaactctccctctccaccacctctgccaccgccaccaccactgcccaagatccagcctctggagcctgacagccccacaggcctgtccgaaaacccaactccagccacagaaaaactgtttgtgccccaagaatcagacacccttttttaccatgccccacccctttcagcaatcacatttaaaagacagtttatgtgtaaactttgccacaggacattcaagactgcatttagtctttggagtcacgaacaaacacacaattgaaagaccaacactttttacctatgggaggcagtccccagatttcaacctgaattgtgaaatgtgtcataagaaacaaaatattttttaaacaagaataataaaggttggagattgttacgcttgaaattaagttggaggcaaattgataattacttagtaatgtccttaactttagaaatacagcttttaaaatattgtggttctggaccttacaagaacaagatggtttgatttcattaatgttgaaattggattagtcttgattgtgtgcatggttcctcattccatggtgtcagtataatcatttaattgaggtttttggttttttattgattagtggaatactgtcgaagtattccttcttttaattattttagacacttgagttctagttaaatcttaaccatgttcttaagtccaaaataggaagaagtggagtagtttgcagtattgatttatatcttagactactttagcaataaaagataaatctcaactttaataagttatcctgacacttgataaaaataaatatttggtattttgtggtcatgtaaaacttctttttgtatgaaaattgtgagaaatttaaatcagcaatagtaacacttagatttttataaactaacaaaaacttgctctcagtcaatataataaatgatagttaaactctaaggaagacctgggaaatgaaaacaatttatggaagtcccctacagtcagtttataagggcttcagtagtgatagacattgttataaaaacttgtaccatgttacatgtacactgcaccacagtctaaattcagaccagcatttgaaggactgcacatatttcatttcctctgatttatgctgtcacaaattgaaaatctgagtgtagttaggacaaaaaacaaagctaaccatatggcactaattttgattttaacattagtgtaacaaataaggtcgggacatatatttacatagatcccagacactcaagaattagcacagctgatgtaaaattctaaattaccatttacttccagatagagcagaggagaaacacctcactgcagtttcaacatgctttccaagaacaatatatacgacatatacattttcctgcctctctcttgtgacaatttctgttagaatttgttgggggtctgatggttaaaatcatgggcaaggccattctctacatcattgcttaatatttcaa

SEQ ID NO: 102445 - DNA, 1011 bp, Homo sapiens
ggcccacttgttaagagtctcctcagacggtcattgtcgatggatagccaggttcctgtctattcaccttccatagatttgaaatcttcccagggatcatcttcggtgtccagtgatgcaccagggaatgtgttgtgtgctttatctcagaagtcatctttaaaagattgtagtgaaaaaacagccctagatgacaggcctcaagtgctacaaccgcatcgcctcaggtcctttagtgcttctcagtcaacagacagggagggagcttcccctgtgactgaggtgcgcataaagactgagcccagcagcccgctgtcggacccctcggacatcatccgcgtcactgtgggagatgcggcaacaacagcagctgcctcatcttcgtcggtcacaagagacctgtctctgaaaacagaagatgaccaaaaagacatgagcagactcccagcaaaaaggaggttccaagcggaccgaagattgccgtttaagaagttaaaggtgaatgagcacgggtctcctgtgtcagaagataattttgaggaaggctcaagccctactctccttgatgcagattttccagattctgatttgaataaagacgaatttggtgagttggaggggacgagaccaaacaaaaaatttaaatgcaaacattgccttaagatctttagatcaacagcaggtcttcaccgtcatgttaacatgtaccataacccagaaaagccctacgcttgtgacatctgtcacaagaggtttcacaccaacttcaaagtgtggacacactgtcagacccaacacggcatagtgaagaacccatcaccagcctctagttcacatgctgttttggatgaaaaattccaaagaaagctgattgacatagtgagagagagagaaattaagaaggccctgatcattaagttaaggcgcggcaagcctggttttcagggacagagtagctcccaagcacagcaagtcatcaagaggaacttgagatctcgagccaaaggagct

SEQ ID NO: 102446 - DNA, 1001 bp, Homo sapiens
gatatacaaatgcctatattatagttcctgcaattcttctattttaatgaggacctacttaaaccacgagacttattttacattttcaccattatttaaataagattgttcattcatagagcttctgttagcctacggtctgctaaatattggtacctatgcaaagacagctgatgttccctgctcttgaggagccaggggaacttttcactgcaatatctgtagtaattttacattttgtcttttagataaactcaagccatggagggattactgcattacatcaaccctgcacacgccatttctctcctaagtgccctgaatgaggagcgtctcaaaggacagctgtgtgatgtgctgctgattgttggagaccaaaagttccgagctcataaaaacgtcttggctgccagcagcgaatactttcagagtttattcacaaataaggaaaatgagtcacaaactgtatttcagcttgacttctgtgagccagatgcttttgataatgttttaaactacatttattcttcctctctatttgttgagaagagcagccttgctgctgtgcaagaacttggctatagtcttgggatttcctttctgactaacatcgtttctaaaacacctcaagccccctttccaacgtgtcctaatagaaaaaaagtgtttgtagaagatgatgaaaacagttctcaaaagagaagtgtcattgtttgtcaaagtagaaacgaagcgcaaggaaaaactgttagtcaaaatcaacccgatgtaagccatacttcccggccctctcctagcattgcagtcaaggccaataccaataagccacatgtcccaaaaccaatagaaccacttcataatttgtcattaactgaaaagagttggccgaaagatagttctgtggtatatgcaaagtctcttgagcattctggatctttggatgatcctaatagaatcagtttggtgaaaagaaatgcagtgttgccttcaaagcctctgca

SEQ ID NO: 102447 - DNA, 1995 bp, Homo sapiens
ttttcaggcaggtgtgatggctctaaatggaggttataggaaagttaagttttaaatccccaataattttcagggacagtgagtatttctcttacaacttaactttgaatgactttattattgtcccctagtccatagatgttttcatccaaagaagatagaggtctgtgatccaagaaatttgaagcagtgacttagagcagaaatagggatcatgatactttgaataatgcataaagaaggaaacctttctaaacaaaagggacacaaatgttgcttttttggcaacgggatgcatacggtctgtggaataccatttgcttcaggtccagggatgtagaaaactccccttggtttagtcttcacactaaagggccaggacaagcccttggaagggaggttttagtgtgaagtggttagccgttacctgtgcttcgagttctgtttgtgtcttagtttggattcccccaaaagtagaccccaagacaaggattcagaggtagacgtttatttgggaactgatcccaggaagcacaagaaaggaagtagggacagtaaggcggagatggaggctcataaagggtacattgatgaacaggttgctgctcacgtgtaggatatcaaaactgaattctttaaaaaatctgaactcctggtttttctgtcaaaccccatctctcctaaggatgcccttccagttattttggcagaatacttaactccacaccttctgttttctcctgcagtctgtccactagaaattctaatgactctgcctttacctccgttgctaccaccctggtcccagccaccatcctctctcatctgggtcattacagtggactgcaagctggcccgcagcttcccccataacctaccctctgttgtctaatctcaacaacagagccagagcaatcctttggaaatgtaattcaggtctttgtcattcctctgctcagaatcttcaatggctgtccatttcatccatagtaaaaaataaagttcttctggaggtctcccagccctagacggtcttacttcttattgcctctcagatgtcatcttacatggctcccagcacacactgctccatccctcctgttgccttagcttctccctttgttgtgatgttcttcctccatttatctccatggctcatccctcgcctccttcacaccttctttgatcccattttgatgaatgaatgacatgagaagtttctggtatagtttgtagtgtaggttcctgtacagttaggtgctatataaatggtagcgactattattatcttatttaattcccacaatagcattatgtggtagctgctagtattatccttattttatggcgaggtaaactgaggctcaaagaggttggttagcctagaacagtggctctcaaaatattttgactgacccacaggaaggaatacattttacatctcaatccagtccatgcttgcttatgtgggtatgtacatatatataatagaaacaaaagtttctcaagctcataattagccttatgacatttgatgcattctgatattttctactctgtcctagtcatttattttttaattgctagttttaaaccaccaagttgagtttaagaaccccttttgacaaagactatccaagcctttaaatctgtacctttaattctgtgttacagcttttccctgtggcaacatctgaactagctttgtcaaaaattattagtgctaaaaactcctcagtacccagctgagtcaatacgtgtaacattataagcttatgtctttttctgctgatctctgtaaaagatggtaagggtttcttcatacaaatagatgtaaagaaagtatagtaggattaaggaaaatttaaatgactaagagaagaaaaaggaagggaaattatcaagtagtcacaaatagaataattttttaaaaaaatagaggaattaaaatttaccatttactttgaaaggatggtaggcgggagtggacagaaa

SEQ ID NO: 102448 - DNA, 2352 bp, Homo sapiens
ccacatgggaagtgctgaacgtactggggctttcaaacatgttgcctcttctgtccttcataaaaatcctatgtggtgggtagtgttagccatgtttaacaggtaaggaaactagtcagaaaggttgagtcatctttagaaggttccatgcctaataggtggcggagccaggatttgagacaaatagactgattcgaaaggcttttccatggaactgtaaggtcttctgtgaattgttaaccataaagattctctcattttgaaatttcagaagacatgaagtagaaacaatccaggaaggctttgggaagctatttgtgtgcgaggatcaaagtggtaagcaagccggccctattttagaaactggttttcctggggggttttcctcttagttttttctgttgctcgtaaatagaccttttctccaaatttcacccactggtcttttaagagctccaaggtttttccaccatgactgaagtggcagaagttctgccgtgatgagtcaggtggagatgagccgtggaaaggaggggcgtagacggtggtggcagcagtgcgtgtttatgtgtaagatgcactgcttctgtaagtcggaggccctgattactcataatgaaaacctgcatggaaatttggagtgatgtgccagcaaacttatcggtctagatctgaaaaatacactgaggagaaagtacacccggcaacaaagctcgccttatctgacagcagaagagcagagaaatcaaaagtttttgaggattcggtgtacacagccaccagccacaaacagtcttgctggattatctcgtgatcgtcagcagttgtgattttccccctttttacttacattcttgatggatggagcattttatatttttaggtaattgttaaactcaaatatactgactgtcattaaaacacaaaaattcaatatgttaattgtctgtctgcagccagactaggaaagggtacattgttttcaaaacttaataattgaattaaaatgtaaaaaaaacaagggccttaatgtgaaggtgagggatctgcatctcctagctacccctgtctcctatctagacatctagagtctctagatcctggggtactggggagaatggacaatgttgctttcctgtgcaagatcctcagatgacatattttagcccccagggcgctcatgcctccatcttcctccagcctcatgggcatttcctcccctatgtgtacctttacctttcaccaggcaaagccacctgtggttcccttggattcctcctgctctgtcttgtctctgtagtgttgcatgtactgcagcccagccagctgatgtgaatcttgccctgctacttattatctgtctgacattgagcatgttacttaaccctctgtgcctcggttttctcatctgtagaatggagataataatagtacctaactcctagggttgatgtcaatattgagttaatacattaaaagtgttttcttttgtgtgtgtggcagaataagcacccaaattatagctgttattgagtacctagttactgttctactgaaaggaatggaaaataaatactcgtccctcgaaatgtccttcatccttcctatctcttcccagcattccctataaaactttcttcgtagaacgcccttcctggcctccatctcacctggctctgatgcctgtcatctatactgcgtctctacctctgcaaacatcctgtctgctgctcagcatactggactaggctgatgaattgacctgttctcttcctgcacaagaccttaagctccatgaggcagggccatacttgttaaattgatatcttccatgtctagaagggttctagcacacactagacagatgctagccataagtctataattgtctgggtgaccttaggcaaatgacttgacctctcaatgcctcagttttctcatttgtttgtaaaaaggattgatgacactgtctagttcagaagatgatacgagaattggaagaggaaactagaggcagtgtcgtgtaggggttaagagcttagcctctggatccaagccagctgatgtgaatcctgctctgctacttatctctatgacgttgagcatgttacttgaccgtctgtgcctcagttttctcatctgtaaaatggggataataatagtacctacctcctatggttgatgtaaatattgagttaatacataaaaataacttctttatttttgtgtatgtgacagaataaacacccaaattttagctgttattaagtacctagttactgttctactgaatggaatggaaaataaatactctataaagttattctgcacttgtgtatcaggaatttggac

SEQ ID NO: 102449 - DNA, 1015 bp, Homo sapiens
agcggctcctgcttttccatcccagcacaccgctgggggctcgcactctgcccccggttgctatgcggtcccagccacgagggctctgcggttcgggagaattccgcaagagcgcgcgttcggaggcggggtgtttttagacaggtgccccggtgggattgcctgaccgagaggacggggaaagttagacttcacacggcctggggtttttcctttcgtgcaagcgctcacagccctggcaccgagcctccgagggcacgcgtgtgttacaaaatagtccagcgattgttcacacgatgaccctgagtcctcaattaagcagcttacattacggtcctcataccttgtttaagaagacaagaaagtgggttaatccattttagaaagatttctcatggaaaattatcttttaaagctttcctcgtgtacttggagtaaatgatgatctctaaggactagtagtcattaagtttaaatttaagcacccctaaatattgatgttaaaaagaaagtcaaaatttgaagtgctggtttacttaaaagtaactttttgtttatttttcctttttaacactttattgaaagtataatgtgcttcattctgttgaaatagaagttgaagaagatataacccctgccctcgaggaacttacactgttgaatattagatgtgtacactctgaaggaaaaattgtaaataacaaaattggggttaagttaagaaggtctctcgatggaaatgagataattaaagggacaattttttcttttcttttctttttttcttttttttttttttttttttttgacagagtttcactcttgttgccccaggctggagtacaatggcgtgatcttggctcactgcaacctccgcctccctggttttgcaacctccgcctccctggttcaagcgattctcctgcctcagcctcctgagtagccgggattacaggcttccgccacatcgcccagctaattttttttttttttttttttttttttgtagagacgg

SEQ ID NO: 102450 - DNA, 1040 bp, Homo sapiens
ctccggcaggcggcaaagtcccctgagaatcggcgcgctcctcgccgcgacggactccacccggccggggcgctcagcctcctcgccgtggcccccagcccggccgcctcccctaacggccgccgcaggctcccctcatggaccgagagcgcgggcttgcagcgcggcagcgtccgttcggcgcgcggctccgggcaggcccgccctcccccgtccccctgcgccgcgaggccccccccccgccccgccctccggcgcccggcgcccaatcagagtgccgcgcacgtgacgagcgatgcctgcgatgacctcatccctggtgtgggatgacgtcaaattcaagatggatggaatcacagcggcagcggcggctgcggcgcgcgcgagccgagtgtgagcggaaaggggcccggcgtctgcctcgagactgaagaccggtgagtaactgtcacgcccctagctctaggagaactgcggggctccttgggaggctacagcctccccgcaaaacgcggcctttcctgacgtaactctgaggtgatttctctcctcttttttctccaccagcgggttgcgggctccgagcgcttctgcgcgtgcgcgggacctgggcgctcaccgagcatgtcccgggttcccacgtagccgattgtaccttcacactgcgcacgctccctgccagcacttggcctcgccctcgcgaatgcgcatgctccattccctcacgggcttcactcttcaccctggccgagctgcccctggggtaggggacacgcctggcccaggcgcgcgcccctcgcgcggagcggttgaaacgcctcgtggagaagggcgcgttctcctgttccgggcaggggttgggggccggcggcccgggccgcggggtgtgcgcggaagctggccggcggccttggggaccccgcacctgccgcgacccgccgctcccttcacggtccgggacctagccccgccgccccgtcctcggcccggtggccggagcgtgaccgctcggtgcccgctggacgctccctccccgcccc

SEQ ID NO: 102451 - DNA, 1048 bp, Homo sapiens
gtaaactgatgtattttccttttaattggcctgcttggatgtcagcggccattggccatttatagggatttcctgtccctctggagaggctccagcttccctcttctcaccaggaaggggaggctgatgtgcatggcgtgctttctctccaacaggtgaagcgattctcagaaatcaaatttacctcccaagattaccttgaggcgaagttcaggttgagaacaaatgtagtcatatctggggctttagagcgttttctttcctatctgcagtcaggccgtggcctccacatggtgacgctctgatggaatggaatgtcgcctccttctttgaaacccaaccctccaggctcatccttgccaaaaaccaggaaggggttaaatattccgggcagcgccaagtcagattatctgtattggtttgcttctacgctataaaaatgcatttggacacctttctcaaattcggggttgctttctcttaatttctatagccatttcacaaggcctgtaatgacaggccagctaaagtgcatggaaggcatcatgaataaatcctttcaggaattccattaagggaagactggattccaaccaagtgctagtgacttgatccaacctgctagaacagggaggggaggcagcccggttaaaggcagagtgtggagatcctgtggctaggggttttgagaggggcagatgctcaggctgaagggggatggatagttccctagcataagtgagttacttttgtgcttctttgaggctgttgtgctaaagtgggctttcttgtgggcccacaggacatttcttttagtcctttgcctttaatggaggtgacagctgacccctggtgcagtgtcgtggccccaggccacttgcagggatggcttgcttgaggctggggcattgacaaagagtctgccttggagaattcagaggactggagaacccttctcttccccgctggggccagttcctaggttctcagtggcccccaggtgggtgggctaccactcaggccctgaggggtagcactcctttggtga

SEQ ID NO: 102452 - DNA, 1027 bp, Homo sapiens
cgggggcctgggtgcccgaagtgccgcagtactccatggtgcagagagcttgctcctgtggaggaagtgtctatgtggtccccagctcctctgtctgcctgtccactgaggggcacccatggctcagcagaagggctattcttggggttcccggtcctcctccagccccgctaatctgtgtaggcctcaagtgctgtgtgtttgtaagcattgtcatccacagtcctattgtacgagctggttcacccgcagctctgagctgctctccagccccagccctttcttcctgtgcccctacccccgctgggatgactctcctcaccctccctggggcgacaaccgccctgtctgtaatgagtggcagtcccaagcttcctgactggcttccgcagctctctgactcccctaaacaaggcctcagggactccacatccaaattaaggcggcacctggtggcaggttggcattttccggtgtcctatctatgaaagacaggaagacagctgggagcaaactcccctgggccagactcttggaaacataaaggcttgggtgcccagctggggaccgggagaaagtctaaaacacgggactgggccaaggaccccacaggtccctgtctcattaggtcccctgaaacgtgtggaagctaaaatggcattcacgtgattcttgatcatttaacagtggattctgatctgatactacactgagaagtgcccctgggccgggcgcggtggctcacgcctgtaatcccagcactttgggaggccgaggcgggcggatcacaaggagattgagaccatcctggctaacacggtgaaaccctgtctctactaaaaatacaaaaaattagccaggcatggtggcaggcgcctctagtactagctactcgggaggctgaggcaggagaatggtgtgaacccgggaggcggaacttgcagtgagccaagattgtgccactgcactctagcatgggcgacagagcaagactcagtctcaaaaaaaaaaaaaaaaaaaaaagtgc

SEQ ID NO: 102453 - DNA, 1043 bp, Homo sapiens
aaagtccccccgcccagatgagtggggacccccccacctctgtcccgcctggacagttgcgaagtcccccccgcccagatgagtggggacccccccacctctgtcccgcctggacagttgcaaagtccccccgcccagatgagtggggacccccccacctctgtcccgcctggatagttgtgaagtccctccctgcccagatgagtggggacccccccccagtcctggactctggcagcaaggctcgctggggtccctccgttcttaccaggaataaaatgcaacatgcaaagccctgctgtgtgccctgccactgagcagcaaaacaaacagcaagagcagagcccggcctgggacggggcagctgcagctgcagcccctgatgccaagccctctgggacaggaactccctggacccccggaacctggggcagtggctagttcctgccgcccgcaggcgtctcacggtgcctcttgacttgcagcggcctggacagcgcctcctgcttccaggtggtctcgctgatgaaagggctcgctcaagggggtcgctccatcatttgcaccatccaccagcccagcgccaaactcttcgagctgttcgaccaggtacgcgggccccgggccctccccgccagattaccactgcactcaggtcagcctgaatgacaccaaaccctgggtacccactgccttctgttagctcgtggggcgtcttcatgacaccaaaccctgggtacccacagccttctgttagctcatggggcatcttcatgacaccaaaccctgggtacccacagccttctgttacctcgtgggatgtcttcatgacatcaaaccctgggtacccatggccttctgttagctcgtggggtgtcttcatttttgagagcgtttaagtgccaggttttgtgagacttgtggaaccacaggcagcgaagggggctggggagtggaagctggtgagcagagtcctctctctgtcctggtggtcggtcatgggatcctgggtgtcaccagcattgtagaacttcatcacctcc

SEQ ID NO: 102454 - DNA, 1088 bp, Homo sapiens
gccccatctccaacattggggattacaatttgacatgagatttgggcggggacacagacccaaaccatatcactaaactttcaaattacttttcttctatttgcaatagtcagcgttcactgtaatgctgcagtaacaaacactcccataatgtacgtgtctccctccatcaatatttgtgtcctgcttgtgttaggggtggcaacggtgggttgtatcatggctctgtcccataagtcttctcatcccgggacagctcctatctggacatgcctttcttcaccatgtcaaaggaaaagtgcaagagagaaaccaaatgacagcccttaaaacttccagttggaagtggcaaatcatcacttgcactcacatgccattggcctaaacaagtcacatggccgagcctgaaaccagggctgtaggcgagtccatttctccttcaggaaagcactgtgaatcatgaggattgggacggggggttggacaattccttatagggaaggaggtggtgaatacgcgggaaccataattctaccagagaagttgacaatctggccacctacttaggagcggctgaatgcctggcatggcttctgggacctaatttgaaagacagaggggctcaccgccgtccacagcagagttcttagagcctctgatatagccacttttccctcaccattgtttttacctttcctctcttctgagggtagacttcctttgttctccatttttaaatcttttacaaaggatagtaattatgttggttttaacacaacaaaagcctgacatgtgtgcatatatgtgtgtgagcaggcgtgtatgtgtgtgtgtgagtgtgtgtgtgtatgtgagtcgctttagggtttggcttgtttctctggaggagaagacaggataaagtctaagacgtgctgtcacagagttcagggtcccatgcttccaaaggccgcatccgggttgttctctgagccgaggacggctttgcgaacgcactgggtaagatgcgggtctgtccccaggtcctgacacacctgcgcatcacctcgcacattgggatcggcctcctcattggcctgctgtacttg

SEQ ID NO: 102455 - DNA, 1036 bp, Homo sapiens
ggtgaacgacattgaccttcagccaacggcgtggctggctgggagaacgtcctccctcatgcctggcctttcctcctaggtatgggttcgaaggggtcatcctctccatctatggcttagaccgggaagatctgcactgtgacatcgacgagacgtgccacttccagaagtcggaggccatcctgcgggagctggacgtggaaaatgccaagctgtacctggacttcatcgtactcgggattttcttcatctccctccgcctcattgcctattttgtcctcaggtacaaaatccgggcagagaggtaaaacacctgaatgccaggaaacaggaagattagacactgtggccgagggcacgtctagaatcgaggaggcaagcctgtgcccgaccgacgacacagagactcttctgatccaacccctagaaccgcgttgggtttgtgggtgtctcgtgctcagccactctgcccagctgggttggatcttctctccattcccctttctagctttaactaggaagatgtaggcagattggtggtttttttttttttaacatacagaattttaaataccacaactggggcagaatttaaagctgcaacacagctggtgatgagaggcttcctcagtccagtcgctccttagcaccaggcaccgtgggtcctggatggggaactgcaagcagcctctcagctgatggctgcacagtcagatgtctggtggcagagagtccgagcatggagcgattccattttatgactgttgtttttcacattttcatctttctaaggtgtgtctcttttccaatgagaagtcatttttgcaagccaaaagtcgatcaatcgcattcattttaagaaattatacctttttagtacttgctgaagaatgattcagggtaaatcacatactttgtttagagaggcgaggggtttaaccgagtcacccagctggtctcatacatagacagcacttgtgaaggattgaatgcaggttccaggtggagggaagacgtggacaccatctccactgag

SEQ ID NO: 102456 - DNA, 1034 bp, Homo sapiens
atctggaggtcaagtggtctttgaattcacaacaaggctgcctgtgagtttgtcagctctcagaagcagtttgactacatgcagagaaggtgattctggccaaagaagtccacctttaggaaaatgccattgtttactccctctagaatatcattctcctagaatcagggcttccgatggaaaggctgtgtttttgcgggaaaatcagtgaacctttctaagctacatttttcctcatctgtaaatagttacagtacatcatgcccaaggccatgccagctcaaaggtggtgggattccttggcgatgtccctgaagctcttatttcccacttcgaaagaacgaaaagggtctgaattttatttacacatggatttagtttgctaattcttagagattccttttttactgctagatcttttttagtaaacacaattgagatagatattaaagtgtaattttaagtgtgcttgttctatacaaatatggcattgccttccagattaagtttttaaccagagtcaaacttagcctttataaaaagtcctcatttaatttcaaaatagatcttcttgtaagacattgcacatagggaagacctacctaggaatagcctggtgaaatgcagaattggaaaaaggcaaaagtccttgctcatgactcagaactacatcgagtgaggtcagtgttgaaaacgcccattccctccaggtgagccttccccattgtggattagtgttgtggcttcatggccctaataggggtgtgtctgccaggaactgcactgcatggggcccacagccctgcctcagaagcagctttggtctcgtttgctgagaccgcttgctgtgcctcatcaatttcaggaggaaacagtgagatgcctctagattttaaatctggtttcggagagcacctaagccctctgatggaatgactctcgtaggaacttgatgggggtaattctaagggggaagagcttgggaaccatgagggctgttaggctgcaagaagggaatggatatgtgagaccat

SEQ ID NO: 102457 - DNA, 1075 bp, Homo sapiens
accaaggaacctgcccggttaggagtggccaaaggcagctgatgaaatagaatcctgcaggtgggagggaggcactgaccggggcagcggggagaagacaaagagacctattcatgcaatgcaggcgcaccagctgtttttacaataaggtgcatgtggcttttgagaaagtgggtcatttggatggagggtctctaatagggaacaatttttctttcaaatacctgaatcacaggtcagttcaattcgccacctgccccactgtgtggtccacacttcgttcactttctgccttcggtaagagaaaccaggaaggccgagcagttctcagtcaggactccttgctcggctggctcagcaggtcggccccccgccatgcagtttctctcttgaccttgagacctccagagtctaaattcaccttgcactgtggttcctgggccaggccacatagcgagataaagtggggcacagcagccccaccccttggaattcaaaacagaaactgggctgcaggaaacaggctgctgacagggacgcaatttcaatacaggtttcattattcacgggccagctccgcactgtgtggcagggggacagttgttagtgttgcactctgaaagagctgttggttaattcctgccttcctcccttttcccagtccacttcgactgctcagggaagtacagatgtcgctcatcctttaagtgtatcgagctgatagctcgatgtgacggagtctcggattgcaaagacggggaggacgagtaccgctgtggtaaggtcatggctcttcccctggggaaacagaaggaagcagcagaagccaaccctgacccttcccatctgtaaaatgggtccaagtcattgccatttttaggtcatgtcttcagctgggattgaactggcgtttgcccaaagacatgttgggctggggggtcagggagggccttccatggagctctggctctcttggggagaccacataagcaataagatgagaccagcgagaagtctcagggatccagagtcactgctctgtgatggggaggctgccgtggacaagaagtgggtc

SEQ ID NO: 102458 - DNA, 1055 bp, Homo sapiens
ccaagcgaaagcagaagccccttataaaaatcatcagatcttgcaagcctcattcactaccacgagaacagtatggggaaaactgcccccacaattcacttatctcccaccaggtccctccccaacatgtgggaattatgggagctacaattcaagatgagatttgggtggggacacagccaaaccatattaggtggtcacatggttgcctacatttgtccaaactcattgaactgttcacttaaaatggatgttttactgtctacaaaatatacttcaagaaagctgatataacatgtttttaattttttaattagattgggatattaggctactggtaccaatgcccaagggcttcccgtgggccccacggagggccagctcttgtcacacccaccgggtgaggcacagagaggccagtgttccctgaacccatagccaatggcaactgatagagcactttacatatatctttatgatggttagggtatttggatgattctgttaatttctgagttgtctacattttggggcgttggttgaaagcgacactcttaccatgttcgcacaacacaggagccagatttcgaagtggcacaggcagtctagggttgtaattacatgagctcaggttggttcctccgtcccttagccaccaacccccttccagtccctcttccacatacctctcttcattctgcgctgtattattattattattattattattattattattaaagatggagtctcactctgttgcccaggctggagtgcagtggcatgatctccgcttactgcaagctccgcctcccaggttcacaccattctcctgcctcagcctcccgagtagctgggactacaggcacccaccaccacacccggctaattttttgtatttttagtagagacggggtttcaccatgttagccaggatggtctcaatctcctgacctcctgatccacccaacttggcctcccaaagtgctgggattacaggcatgagccaccacacctggctgctgtattattatttactcacatacatatcttgc

SEQ ID NO: 102459 - DNA, 1006 bp, Homo sapiens
atctgattttcagagagtccaaccacacctggcctgaaaacaggatgtccacaactcccacagcccaaaggcgcccacaccctccatcccacagcctggggatgccccacaccctctgtcccacagcccgggggatgccccacaccctctgtcccacagcccgggggtgccccacaccctctgccccctccaccccacagcccggggatgccccacaccctctgccccctccactccacagcccggggatgccccacaccctctgccccctccaccccacagcccggggatgccccacaccctctgacccctccaccccacagcccggggatgccccacaccctctgtcccacagcccgggggtgccccacaccctctgccccctccaccccacagcccgggggtgccccacactctcagctcctggagcgtcttggccaggtccatccgtagaggtcggctttttggggagagttggtgtccacagggccaattcagtgatttgggtagctttccattttggaacaacagttactaattcttcctcctcttcctcttctcctctttcctattttaagtgcaaaaatgtacatttaccaacatttgtgtcatcttggtctggaatattaaaagtgagggaggaaggacaagttttgaaagacaggttttggcttgtgtttcagcctttttaggacgtcactcaggaatcagaccagttgctgactatccatggtataatctcagggttgagaatggatcttgaaagagccagggtgaggaataaagtctccagagcaatgctgggccagcgagctttataatgggtgccacaaaaggctttcagatgagcatgtcgcagtcgcctgcaatagctaagacatggccaggactaagtggccagaactgagtgaccaggagtaagtggtcttttcaattgttcggccacattttgcaactctaatataaaaaatcgtgtattatataattatatgtctattgagcttag

SEQ ID NO: 102460 - DNA, 1457 bp, Homo sapiens
catgggagagtttgtgtacgataatatattcttaactcactaggaggggacacctcaacaacttcagagaccaaaaaacaaacaaaagcgtgattccacactcctccttaaaactcaaaacttcttacagtgagaatgacctcatctaaacaaataagtcaaaaggatcaaaaccagtaccagggtcaggaaatgttgctgaattgctaattatctagagggattgatcagacattaataatgagaggaataggaacacatatattcccacctcaacacacatacgcatctcgatgccttataacggcaatattagctgactagctttactattaaccagggaatgtcaatgtagtgttaatattaatgttagatattggaaaggaaaaaacaagagaaagacttaccaacggcacgttcagaggagcatgctgcacaacggacaagctaacagtcactggacaaactgtggcaacaccagttacagattcagttttcacttgcaggacctaacactgtctagaaccctcccactcaggattagttttttatttattggttgtttgtttgtttgtttttgagacagagtctcactctgtcgcccaggctggagtgcagtggcgtgatcttggctcactgcaaactccgccgcccaggtttaagcgattctcctgcctcagcctcctgagtagctgggattacaggcatgcgccaccatgcccagctaatttttgtatttttagcggagacagggattcatcacgttggccagtctggtctcaaactcctgacctaaagcaatccaccgcttcggcctcccaaagtgctgggattacaggcgtgagccattgtgccctgccaggattagtttctatcaacaaaaacggtatctatcaacaaagtctagagttctgcaataaatgggaaatgatattgtttgcttctggcaatttagttctgtactaacacatgcagataaggaaaatgaaaatgtgaaagtgcctaagagttggcataacttttaggcgaatcacctccaaccttgcaggatcaatatttttgagcagctacttccctgttaatgtaacaaaaccctacatgctccgcaacttaccatatctgttaaacgatattcaccatgttgttcacacccaacatcaaatacatactttccagggccaacaggctacgagcaaagagaaaccattcttaagtgtcaacacccagcagaaaatacaaaatacaaatgtcaccaccacaatacccacctcaaatcaccaaattgggtaaagtgtaacatggattaaggaatgcttttgtgaattcgtggctgatgggattggaacttatatgccctgttttgtttacttttggaaactttaaccacattttacttttttataaaagtgatgtattcattttcagaaaacctcagtgaatcagtatccataggcaaa

SEQ ID NO: 102461 - DNA, 1001 bp, Homo sapiens
tgtactgacaagcacatttcacaggttagtcagaggcaccacgaagatgcaacgaggagggagacaaaccaaggttgtctgacccattgccagtgatcctaacaccacacttcatttaccttgcaaatgtttagagatccagcaacaactccagggcttgaccatctatcctcagccacctggcagcatttcagtctatctcccacccaatcatctgactccaacatgccactctaaccccagctgcacaccagctccatccgctggtgccatgcctctgtttgaactcttccctcacctcctcacctccatacggcttctgctaagtccttataggcttggtaggcagtactgaaattggcaaggatatcataaaattcataataccactccatgatgtggacaactgcaaactacttttgtcaaccacagtatgaatccctgcactagaaaactcaaaacgtcctcaaatcttacagctcacttaggaaagaaacttaatagaggtctcccaaaggtgactgctcttaaaaacgtgcatattacaccaagtcattaagctaaatgatatgttttgagactatgaataataaaaagcaaatgttgatcaatttgttgatcaaagagaaaagaaggaattatatttctattctctctatagaaaacattacaaaatggttgccatatggagaagcattcaaagagtattagctaacaaaggtagagaaaagctattctagaagtatgtcagacattaaaactcaggctacttagattctgtgatgtttgtggtatttttaaatttttaacttattttgatttatcattgcaaatgaaaattcacttttataccaactttatattttcttttttttaaagaggttctcaaaacttacataagcttctggcttacacaaaaactggacccacttccacatgaagataaagaatacccaataggctaagaaaatgctaattattcaagtaatatttgtttatgt

SEQ ID NO: 102462 - DNA, 2087 bp, Homo sapiens
cagcgaaagcccgtgcgccctcggagccggggaaggcgcgggccatgacccgggttcgcccgcaaaggccgggcagtgccgcaaggcgtgggggcgcccccgcccggtggccccggggctggtgcgaccctgggcacgccggggccggggccggagccgggggtcgcggcggccggggagggggaggagccgcgcggctccgccggcgccccgcgggccagggaaagtgaaagggcggcggggcctcccgcgcgccgctccaggaagtcgcgagcaggaagcgcccgcggcggccgggccgggctgggctgcggagcgcgggcctcggcggcgcaggtgaggcgcggggccggggccggaccgggaggcggggaccccccgcccccccgcccgcacctgcggggcagccggcgctcaggcgccgcagccgctcagcacctgcggcgccctcagggagccgggcgcggggccctgcgcactcggagctcggctcctctccttccttttcttttttttcggggggaggtgggggctggtttggatgttttccgagagccggggacggtctcaagctattttcgcggagggaagtctttgaaatacgacatctagaagagtggccctcggcgacaatgccgggcgttcccggaccggggcaacgctgggattccggggaagtggaggcagagggagcgggcacggggccggcagccgctccacggagtccccggcaggggcgagcttagctgtccagccgggtcccctgcccaccccggcccgggccgcggtgacagctgagggtccagagagccggcaggaggggaccctgcgcattgtctgccgcgatggggacgtgggcgtgcccgcggaattcacctcctccggggaccagccgcccagggaggagccggcacagaacgctggctcggagcgccggcaccctgggcctttgcgttgtttgtcggctgagcagctggttcccggagcccgtgggcctcctggccaatgcgagtgacagcgaccttctgggtttataataaagggcttgacgcgccggaaagtcccctcgccgctggccaccagccttccagcccttacggcccacgccgtaatcctggtgaccgagaaggtacgttcagtctaaggatttgcatttgaacgaaggatactggccaagccccttaccacccccactccccgctaacaccccagcccgcggccccaggtttgaatttccaaaggaggaattgctaaagcctgccctttccgggtctcccttagctctttgcctggaaggtgcctgcctgcctgcctgccggcccttgaacttaaatcgtctgaagttgtgtaagtggataaatattttagacttcccccgttgtttttttattaatcccctttgagagcaagcttgaaaacacctggccccagacctgtgattcaccaagtcattttggacctgcatttacacgttctgtttcatgcagcccacctgtgatgttctctttgttgggggttggaggcaggtaagggaggtggtgcaaatggaattcaggttccttgtacttcagccaaggggaaagagatagtgaccattttcattcatctttaatatggaaagcgcctttaaaagcaaaaagccatagaaagagcacactctggacaggaagttgtattctatctcgtaatttaaaaaaaagaaaagaaaaaatgcatgaaaacttttggaggagaattgcatttctcacccatctttgcctgtaaagtgagacccagttaaaaaaaaatgtcataaagtagattatttaaaatatctgtggggccgctttgattatgtgtaatgccacctcagccctaaaaagactgaggaaccttactcctgctattgctcacttcctatccccattatttgagtctctgcagattacttggaaccttctaggcagcgcagatcacatgtgggtgggtctgggagtggagcttgtgaatgtttctttcctcagcttattctgttttacagttgcctagggtgggttttttgaagaaataggtataaaaccatgtgtctttcagagtctgtttgtttt

SEQ ID NO: 102463 - DNA, 1085 bp, Homo sapiens
tctttcacccattttacagggaaaagaatccatcattgttttaaaaagaaatcaaagaggttttttttcccttcttgatttgtcagtgccttctgggcctttgatgttgttgtcacaggttttatcagagttggaggtttttgatttatttagtagatggcaatggaatgtttccagacacgctggacatggagaagcagcacttgagaggaagacgtttgcttctgaccatccgtttccagacactgttgaaccaaattctttactctgaagttgtcatcacaaagtcatttcccagagtagatccagacccattctggagcccacccattttgagcaaaatattgcttaaatctagaggtttgagcagacgtggttttgaagtatttgtggctgttcattcaacgtgagtttcttgagcacgtggtctgtgctaggttctggacaaggagatggaagtaggaccttgccctgcagtcccgggccttcctcttttgaatttacaatgaggataatatcagctagtgtttgttgcgcatttactacgtaccaggccacttatcaagtgcttcccataggttatctcattgcatgtttataacaacatggatgctatcatccccattgtttagccttgaaggagagggagcagaaaggttaagtgacttgcctcggcttacacagcccagggtcagccttggaaggaggaggtattggagtggggtgaatcccacctattcaggccctgtaggacctaggagaaaggtgtagttctggctggagcagatagaagagatgaggggcggctcctgggacgaaagctcagcagggattttgaatctttttgtaaaaggtggtataagggaaaaatccttggagaatgtgcatttttggaagctcactttcgagggaggcaaaagtgaatgtggggaactgattggctttggaggacgcagtgactcaggaatgtcatgagtttgacattgggatgggagaccaggcctgcctgctgtgctgggccccttctcagttctctggcctccctccccattccttcctatattgctctgccttcagccctgact

SEQ ID NO: 102464 - DNA, 1341 bp, Homo sapiens
cctcttgtctaggcccacatttctctgtcactacggttcaaaggtggcctggtccataggggtggaactgaggcagtccagtgccctggcatgccttgatatctgggcacatagcgtggctgctggacacatacttggttttgtgaatgggttgatctctagatgcctcccagatagagatgagttccttggttcctttttatccaccatcagaacattatttgaaattcatttccaggttctcagaacaaaccgcctcaagggtagatactccacctcactccccctcttcctagtaacactgctggtgggggcccctgcttgtatcagacgtgcagctttgatcaggactgggtactgctactgtacgtgtgtggttacttctgccagtaacgctgaaggtgtgaatgtcacgacactggactctgaatgcctctcctcctccttgtagagagcagagccactgccagaaggaaggggacaagacccagcaggacaccttctttccacgctttccagcctgtgggagcggcaggggcaacagagagaggatctggagccaggattaatgactcatttatgaagcatcttattctgcgaccgaggctcagtggtcagtggcgacgtaaatggctcgactccccgctggcattcgcttcatcatctcattctccagggatcagtggtgagtcctggtggggcaggcccttggcatggagctgtgtataggtgagggctactgtgcaggtagttgtgttgccccagtttcattataaaacacataaaacttgaatcactgacctcacccataaccgttgaattgctttttggtggtggaagccgtgacccagaacagtgctgaggtgtcctttgtccttggtactggcattgtcagatagtgtttgggctcccgcgtggtctccagtggtttctctaagaaccatggtccctacagaaaaatgaccactgactaccagcagggttagcaaatggctgtggtgaaataagcacataacttatatataagttacacaactctgagatcagatgagtggccttgccggggcagaactttcagagagaaaatgaaatgttctggtgcagcccagaatgctgctttccgttcagagagtgcctcgccttgcatattctgagaatccttctcttaggtggcctcattaattccattctccttgaaggaaacagttgacaagcccagagtctgaagctgggctccctggcctctaacttgtcctgctgacctcttctgggagaggaaaaactttgcttctaccctcgtaggttctgttttgggggacctgggaattaaactgacaaaag

SEQ ID NO: 102465 - DNA, 1593 bp, Homo sapiens
agggtaggaaaagcagtctggtttttcctgtctcttacagtgttcagtttccatttggacaaagcaaacgtggcaatattttttaatgttccaatattatagtgacataagtaatattgataatggctgtagaactgaatgaataatacacagcataagaacgtttcagaacacagtgatatgtattcctaacataacttctgttatttcatatcatcctctcccactgttttgtgtttcaggtacagagccttcatttttattttgacatttctgctgtatgcaagttttcacttatctcgaaagcctatcagcatagttaaggtaagaatcatggaaagcactgcctgtcgtctctgtgaggagttcgtcacttgaaaagcttgtggggcagaggatggggatggtagcaggtacatggggaaacagattatgtagaaacaagttattctgctgctttggcttttcggtttccctttgctaaaattaaagtcttttaaatgttttttggatttatactttcagaggtagtagacttttagttttattagttgacatttccagaatttgaaagcttagctaaatatttattttatcttgtgtgactgttccttccaaatgtatccagtcttaagtggttccccaaattccagctcttcgtgcgatccaaccctaggtctggctgcggaggtggctctccattgttcttggaacgctgcatttttgtctgagtgatgggtgggcaggaagttgttaagcaggtgttctactagactttgagaaaagaagattaaagcagacaagcctacataatcaccagttataacctggagaaaagcaggaataattttcttaccctcattgggattacgtcacccggcctgtagaccatcaggggcctgagaggcattagagtctctatcgtagaagaacgaggaaatcatccactgccagagacagtgcattcacagcccagtggcccctcgctcactctccgggagttggcagggacccagctccaggactgcaattctgtgacctttggagctgtgcttcctccactcctgccggtggctgagccctgggtggctgccctctgcagccctggtcggcagaggcaatgcagaggctggctgttttgtgacggtcctaggttccccactctccagcagctttcaggggatgttaaacattcatttacccaaaagattctaaaattcccccttggcccctgataagcaagaaacttccatgcctctcaagttgttgactgtggaaaacgtttgcagacctttgaaaatgtggtttttaagagagaagaatatgaaaagaggtggtgggccttaaacactcatccgcttgacaagaaactctcaaatcagtaccagtaaccagtcattataaatctgaatactactacttcttgtctttctggttagagaaatatacaaacagctcaagaaaatggtaaattataaagatggaagtgactattgaagagacttggtgagcgtgttggagttgaaggatctggtgtagttggggagcttgtgtggggtttcaggattgacctagaaaggttgggtgtggatt

SEQ ID NO: 102466 - DNA, 1070 bp, Homo sapiens
tggtgtccaggccactcaagacttagggcttctgaggaggcggcgtcagggtcagctcttagttcagtgtcataagtaacaatataaataactgccgcttacagagccctggggtatgacaaactgccacatacattacccctgtgatcctcacagcaaccctgcgagtgcccctgtgaggaaattgaggctcgggtcttcgttccccaggcagggctgccacacactcgagaattccctgtgggtcaggctgcctccagggcccctactcatcctctctgtgcctcagggtttgtccgggtttaattacctgagtacagtcccagcatcaccctcagagcctcctaaacgcacagatttcctgacctagcagctgcgatgtgcctgggcatggattggcttgacgctgaatcctgtgggtttctttacctttcaagatagatcagaacatcacaccacatcaaaactaaactttatagtgccttctgaagcgcccgtgtgcttgagctcatgatataaatggcatcaacgaaactgaaagtagtagtgattctgttgacccacaaaacagttgagtgattatttatagcctgcatttcccagaatattgtaagcaaaaccaaagcaaaatgtatttgcttacttgaaattgaaccagaggctgtgaattagaaagtgagtcttattctgttatgtcatttatagaatgacacggcacaccaggtcacatttaagttagttaaatggaatgtttagacttacctttgatcactgctgattaattgtatttttctcgatgatgatgataaaaccagggctgggaggatagtggtgttataagtgcaaccctgtcccttctatctgctgctccagctgtggcctagcctcaggactcaaggcaagcgtctgcccaagctggtagacaggtgagtctgactcccagcagagatcttagtgcgagctcttttcacctggactgggccagaaaagaaacctgaaagcagaggcttcccggagaagcttaaactgcaggggtccctggagccagggggatggcagcattgatttga

SEQ ID NO: 102467 - DNA, 1041 bp, Homo sapiens
ttttaattttttgtagacaagggggtctctctatattgcccaggctggtctcaaattcctgaactcaagagaccctcctgcattggtctcccaaagtgctagaattacaggcatgagccgctgcacctagcctctttctatgaagtttttggattcaaaagagaccgggaagcttggccccacactgttatgaggtgtgatctgctggtggtggggttctggctgggttttttttcctcgcttttctctgcttattctaaaatttccacaataggcatgcattgcttttattttgaaaaatatatagatacctgtatacatggttttaaaatatatatgtagtttaaactgtatataaatataaaattgacagtccatctctggctgtcgtgccccctgctttgtgtaagtggagcaagctctgtgcacctccctgcagcgctgtcccgggcctgcttcccacaggtcagtctctcctttggcctctcctgcaggtcatcaacgggctggtgcagaccaccggctggcccagcgtcgtcacctgcctcggcaactggtttggaaaaggaaggtgagaaaaagcagccctgtttccaatagcagatgaaaactagaccattttacttttagtttttctgtagactgattacagcaaaaacactttagtatcctctttaaaataagatggctgaaacctctggggcttgaattgctgaaattcagatggcctgtgtcccacgagacaggggagctccgccctcccactgtgggcctggtgaagtccgtgtcactcggcggctcctctgacagctgcatctggcctcccaggtgttgtgggagatgcagagtccaggaccctgccccaggccttttgaagccaaagctacatgttaacatgggagtttgggaagtcccgacctgggtcacccagcgcacagcaccaaagtagcagagctgggacccagcctggcgagtccagatttatttgtaaatggcttttattttatacagataaaatttatttatttgtaaaattcagct

SEQ ID NO: 102468 - DNA, 1059 bp, Homo sapiens
agctctcgtgagcatcgcgagtcctgcatggcacagaagcagggtctgcatggccccccgttgattctgcgccgactccctactttgcaggcactgctgcgccctgcactgctggactcgtttcagcttctcagctccatcttctgtcttctgttttgttgtgctgcaggagaggtttgattatgggggtctggaactcccacacctccgtgggcaacatcttggggtcattgatcgctggctactgggtgtccacatgctggggcctgtccttcgtcgtgcctggagccatcgtggcagccatggggatagtgtgctttctcttcctcattgaacgtaagtgcacgtggccttggagaccacccaccaagggaggcctcggatttccctgcctgggtgggccttgggggcgagtgtgagagctgcgtggcctagcgccctgtttgcccgtggctgcctcagcgctcttcttaccagggagacttccccggggagccggttctctcctggttttgctggatttcctactctcccctgattctggagtgacccatgtccccattccttcctcccgtcctcctgtcctcccttgccccggcatcaggagttcatgcatgggagtcttccatcttcccacaggctgttccttctcatgcccatcttgccaccacagcctgaattggacccagtcagctctttgccttctgataagatatatcttggacagtgttataaaagactgacttaatatcttaactgggtaaaaagtatctcttggaaaatcaaatctcttattccatttcagattcaatagcaaactctttatttaattgaatttgaaattcatttctgaagtagagatccagcaggctctggtgctgagaagattcaggacagttacagcaagaatagagatgcccgggtggccctggcggtcacacgacaggggctcgaatcccgcaagccattctgataagctgtactcaactcttagttctttgactgagtttaaaccatatggcaggagacagctccctcatgctgcctgccaggtaggga

SEQ ID NO: 102469 - DNA, 1029 bp, Homo sapiens
gcggtgatctgccataccccccttgcacacaagtgggctgccaggccgagtgactggggacaggccggggcgtgtgcgggagtcactggtgggacagccaagctgtgcccttgccctcacctggcatgctatggcgatggcttttttctgaaacgaatgccaatttagtaaaggtataagatggcatcttgtgttttattaaattttattgtgtatatttaaggtatgcaacatggtgttacagatacatagagatagtaaaaaggttactagtaaagcgaagcaagttaacatagccatcgcaactcacagctgcccgcttttgtttttgtggcaagagcagctcaaatccactcatttaatgtgaatcctgcatacagtccagtttcacacccggtgctcccgtgttgccctgtcctcgggttacgtagcttacttggcattgccatggtggtggacctgctcagcctcactcatgtttgctctttcagatccgaacgacgtcaggtgctcctccaccctggtgacggtaaggaccctgttttcttgtccttttctagaacagtgtgcggttctgaccacttccccagcctgctcctgcctgtgcggtgtcagacagaaacacacagggtagacagaagtcccaccctcaaaacattggcagttctaggaatagagaatattctgttttgggtttcgctgataataaccttatcagcaaaacccagacaagaggttcaatgctgtccagatgaaggacttcatgctaaggggaaccaaaggctgggccctggccaggcctcctcaggagtggagacctcctggtttccccaggggcctcagtgtgacggggaaaaacgcacgtgtcagctgcctgccatcacttaagttggtggctgcacgtctcaggtggccgagaggtctgcccagcacgccattccttctcttctgtacccctgcccagctcagccagcgtaggccctgcaggcaggattgctgaccacgttggctgccatgaatgagccctgc

SEQ ID NO: 102470 - DNA, 1852 bp, Homo sapiens
gagttttggagtgcatcagtgcagtccttccacctccctgccctctagcagcaggtccacattctggggctgttgagcaagccacactctccttccctagagacggttttttttttttccttcagaagcattcggctgacctagggagggcaggtgttcctcacatgttaaagggaaagattggtctgtgccttttcatttcaaaaccattgaaacaatctcacggccattcagaaaagttaagttggcttaatgggtatttttacatttgattacacctctgtcttagctctttcttcaagagaggattttatgctcacattctattatctgagagtctggagtgttgagatcaaccattattctgtttaaatcagttgtcttatgtcctcttggtagcttttttgggacgatagtaagtatccttgctacagtaaagccaggtttaatttctagctgttgaatcagtatcgctctaatgaaacttttttttttaccagcactcaaaaggctatgagaatggtacaaacagattgagactccagaagcaaatcttgaagagcgaaaagaacaagcctctggtaagtcacacacaacttccacttcctagaatgtcggagctgcaggaaaactcctttgagccacgtcggctctctgtccctctgcctatgtgacatgtgtcacaaacatccaggtcttaaaaaaattctgtctcattgtatttcttcagtaaaatttgagtttgcccttattggctttctttggattttacacttaaccagttcattcattcagcagctccgcacctttcaatgtcccaggcactattccaggtgttgggggcggtgctggtgtagacggaacgcaggcagagacatcccccaagcggtgccaagcggcaggaagacaggctgagcaggctctattttcagctggccttgggaggcttccctaggcaggcagtgttgaaacagagctgtgagggactggagggagagtctgcaggtgcctgagcacagagggtgtcagggtgaggggcgcacggtgggctggccacgtgaggtgcacacagaaaactgacatcatgggaccaagaaaagggagaagcaggtaacagaaggaggcatctccacctcccctatgtcacagatgaggaattccggacacagaaatgctaagttaatctgccttgtcatccgcggtagcagggaggcctcagtgcaggtctggcccacccctagcacctgagcctcctgtgccctacccttcccatcattgatccttgtagaggctcctcacattgctgctgcttagctgaccacaccaagctgcagcgggcattttaaatttgagtttaatcattgaagttataagctgttctctttctagatcaggtttttgtttgtttggttggttggttgtttttttttttttttttttttgagacaagatcttactctgtcgcccagtctggagtgcagtggcatgatctcggctcactgcaacctccgcctcctgggttcaagtgattctcctgcctcagcctccctattagctgggattacaggcacccaccaccacacctggctgaattttgtatttttttagtagagatggggtttcaccatgttggccaggctagtcttgaactcctgacctcaggtgacccacccgccttagcctcccaaagtgctggaattacaggcttcagccaccgcacccggcctctaaataaggtttaaccttctacagcagacacagggcctctcctctgtcagaaagacccctccagcatgtgtaaggggctgctctccctatctttttaaattaaatagcttaaaggattaatgta

SEQ ID NO: 102471 - DNA, 1026 bp, Homo sapiens
gtagtatgaaaatcaaacccgtccatgtttgcattgactcgactctgatgtaaagacactgggttttgatcctgaactccatttcgaaattcagaaacgccgtagataaacagggcttcctgtcttcacttgaaaagtagaaaatctggccacgctgggcctgcaccccatgtgacagtggccgaggagctgcagctggggccccacccttctcagaggccccgcccctccctggtgcccctgctcggggtgagcgctccactgttcccgcgtcctcactacaccacacagcggtgcagcaccctccccagtacgtgtctggaggtgctaaagccagaccagagacaggatgtctttatgggagcgaagtcatatttaactctgttgcatgtttacacacacctgctgactccacatttggaggagacgcctgactgctctctctttcagggcgtgatagagttctcactgtgtctgctgtttgccaagctggtcagctatactttcctcttctggctgcccctgtacatcacgaatgtgggtgagtatccacgctagaacacattaaattccgcacagtgactggggtccgaagtctcttctgtctgctggtttctagagtattgaaaacacaaggtcatgaagggtgatttgagaggtacacctttgaataaagtactatgatgaaacataggctaaaagaattcagatatgcacattgtattgccataatggtaaactttatggggcttcacggttgacacgttctatcccagctagggctaccagttcatgaggtacttcctgttctggggcagcctgcgtttaaacgtgggctacactgaactttggatcatagcagccagtgagcagaagcagagcctttggggacctgagaaaagaaatctctgatactctgacctggaaatggcttctgggagatagcgtctcatttttggcagggccgacagtttgctttatgtttcagaagccccgcagtggctgcagctatagattatcagaaaa

SEQ ID NO: 102472 - DNA, 1143 bp, Homo sapiens
gttggtagggcccctccttgttggtcattcttgcatgcgtgagccaaacacgtgggcatgttttgaaattggatctctgttcttcagaactgtcaccatttacagttcatcccgtacccacagataacacttgctactatattcttcatctttttctctcttaatgatcagcttttcataatcataggcctcttcgggctagcacttttcatacatcacacttggcaggatgtagatgtgggtaaggtaccagctcaaacacaataagcctgtgccggtagttggagctagaggttcagattcacacagatggatttatttaacaaaaatcttgctattgtcaccagcactattgttcgtacctgccgtgttcccacgacctttaccacctaattgtcgcaaacacctttcatgcaccaagcagagcagctggatgcatcttatctgtaggaggggcccctgttctctccagcttgaactcacctcatacaagggactcctaagctcctacttgaaccacaagcacctaagaaaatagaagagtttctgccttctagagctctggcctgaggcttggtggtggggccatgtgtttggtttttaagtagcccctcgagaccctccagcaccccttccctgcctcccctggaccagtgatccaccctgggtctgagggcatctgctgccctctaagaacgaggggccacgtccagggagagccctcctgtgggctgatgtcccacttggggagagactggatccacactggaaaatgcactagttaaattggaggtagcacaatcatttgtctggatttgtaggctggcgttgagccctcaaacatgtgaagggcacggagttaaagctctgggtccggcgaggagccaaggctgaggcagtgatgttggtggaaagccctgggccccggccaggcctggcctccaaggggctcccagtggggtgcggctgtcctgtgacagcctcttcagaccccagggctggcgccagaggaagtgctcacctggctttagagtcacctgagaagctcgcaggtccacccactgggccacccgcattatggtcctcttgtctttatttcctttttcccactgtggacatttcatgattggattaattttagtc

SEQ ID NO: 102473 - DNA, 1057 bp, Homo sapiens
cagagagccagcgccacacaacatcaagaaggccgacaaccaggttggaaaccaagacggagctcagacccaccacatcgccccagaggcttttccagcacccatgatgtttcggactgacctaaaaactaattgtcgagaagccaagggtgaggaggcaggaagcacctccggttggaggcacccaggcttgccagccacagagcgccccaaagtcaccgtcatcccagcccctggccttcctgctgccctccggggccatggcactgctgttcagctcaggcacaggggcacagcagaggtttgggaagcggtctccccaccggcactgggattggcgggtccaagcccagcaaccggcttcgctccacaacacacaccacacctgggactgtttttaatacatagcaacagactgggttatttatttaagatgtgtattgtgtcatatgaagtttaagagacataaatggcattttgttatttattaagacaaactccaattgttctctggctgtttttttcagttgtgtctagcaaaatacttatctgccctttgaaataaaatgtttttgtttaaaaaatctcagaacactcagagaatgttgatgatttctgcttacatttccattacgctaaaaaagggaacttccaaatcgtgttgtgtgttttgggttttctcaggcttggacacattgaggtttctcgggtttggacacatactgggaaaagaccatttccagcagaaaaggggcctacctctcggtcccttgtttgcacagaaggccaagctgaagtaaacagccatctgggtattttataaatcacgcagtttaaagaatatcctaagatttgtccttgacgaggaggtgtcacaccccgtggtggtggggaaaggtgctgaccttgggaactacatggtggggtccaggctttcaaacgtcctcagaatgctgaccgtccagatgtgcatggtgcgggctttctctggatggagtgctgtggaagttcacttggggacctctcacagcagcagggcaaaggtcagaaacaacac

SEQ ID NO: 102474 - DNA, 1153 bp, Homo sapiens
tagaaaggccacctctctgtcctctgatcacagagtggattcacagctgctctcggggctggcaggtgggcaaggcagacagctcccggcagctggactcagcctctgggtggcatctcccacggcccgtggctcctgcccagcagatctcaagggcactccaggagaccgatgagggttccagtgcttccaagaagtatctagctgcctgtgtgtgagaatgcagagatgcccaagacaggagccttggcctctggcagatctagggatgccaggaattttggagtgtgagtggcaaagagggacaactaaagggacacacatgaaaacagcccactcggccccacaaaactgcatctggccacgcatgaggcacctggcactcagagaacgtcagggcgcctaaaagtgatcacctccctcccttccagcaggggcgcccccacttttctccgagtggtttggcccagtgtcctgcccatcacaaaccagacagaggacatgacttcaggctgctgtgtcctcccatgtgttagggcctccgagggcccagggctgtggcccgtgagcgtggcctgcctctatcctccgagggcccagggctgtggcccgtgagcgtggcctgcctctatcctccgagggcccagggctgtggcccgtgagcatggcccgcctctatcaagtgcagagctggaaggctgcaggagcctcccccgtcatctcatgagtcccccactcacgaccatgcagcccactcagaccacgacctgccgccacatgcgggaactgctggctccctcgtgcccgcccggggctgaggactgcacgtgcagccacagatgcatccggccctcctgccccacagcctctatgaaggccacataaatggcaccaagtgtctctgtctgccgatcagcatcccctcttggcttcacagcagacgcatctgcctttcaggactgccttgaacaacatctgggctggtcaggtggagagcgaggagtttccaggttgcagcccctatggtcctgagggctggcgtccaggatggtgggggtccagcagctctgggcagcgaggcccctggctgggtgatccaggtggcagctgaccagtggcctgggagccagccctcctgtcctcacgtggggcc

SEQ ID NO: 102475 - DNA, 1039 bp, Homo sapiens
cacagcacaggtcagcagaggccttgaccacagcatcccagtgaacctcagcctcgttctgcccacctgcctctggcacctggtgacgtttgataatttcacaagaggccgtgatgcctcagggcctgtcccagggagcatgccgcttcctcagaggtgtctgtctggtgggactgcaggagcatggggacgtgcagttgcaggggcagctgagcggcaggagggacctcctggccaggccagggcacaggcagctcccccagcccccacggcaccttctcctgactctacttgctccacttacatggctgggtgttgctcccccgtgcaggtacctggtgagggcgcctgagtctcccctcactctctccttgcctcccaggtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacaggtgtgtggggtgagggccctcccaccggagtgggggcacattcagggacagagcagcccccactctccattggctggaagctcccagaagctcctggccacagcagtgccctggggacccaagggaacccctccctccttcctcacctcctccagggcccagagtggagccccaaaaagagggtaccctcgccatgcgcacgtgcatcccactgacctgcacttcccagcctgtatttaattcagccttcactggctccctttgagataaatcctttgtccctcttccagcccaagaaactgaggcttagcaaaggtagggagcctgcccaaggaggggacaggccctggacagacacatctgctgcatccaacataggagagctgccccctgccccataaccccagctgctgtcacctgccacccacagcccagtcagcccccttccttttatttatttttttttcttttgagacagagtctcgctctgttgcccaggc

SEQ ID NO: 102476 - DNA, 1068 bp, Homo sapiens
gagtgcagttctgctgcttcttcccgagtgacttgtgtgtgtcaggaaaggtattctatttggtgctttcggcacttttcatcttgtccttatgacagcctggggaggtctcttagctcgttctggaagtacgcaggtgtgagaggagagctgcgcctgagcccagggcctgcgtcctcctgccctgcctgcctgtaccgtgctggttagctattgctgcaccacgagccactccagagcttaggacttaaaaaagtgtacgtcaccccatggtttccccggcgccggcatttgggagtggcgcagctggggctttcagcgtaggctctcctgaggtggcaccggcgagggctgcaccgtctggggtgctggctgcagagcggagcccgtgggcctgcagtcctagtaatcatgctctctttcttcgtggcaagcactcctgtggtctacatcttccagctggacgcccgcagacagcagttggtgtacaggcagcagctggcgttccagcaccaagtgtgggacgtggctttcgaggagacccaggggctgtgggtgctccaggactgccaggaagcccccctggtgctctacaggcctgtgggcgaccagtggcaggtgagactcggcaccttccagatgtcctatgccctgcctttccataagcctgggggtgtggggcggcagctatgttttttgggtccatgggtaagcctctttcaactcagccacttctggggcccagggtctgtgtcctgaatggcagtggctggggcttccaccgtgggtgaagggagccgggtgccaggccggcgtggctggcttgtcccatgtggtgatgtctgcaacagttctttttttgggtgagtgtgtggccccccacaccacacttagcgatgaagttggcactcagtgtggcaagggtgtgtgggactaacacttggaggctggattagcacagcctcgggcctggggcactggctgagtcctcaggagcatgtggagccccgggtagaggagggggcaagggcggcaggctgagctgctttcctctggggagacagtggg

SEQ ID NO: 102477 - DNA, 1050 bp, Homo sapiens
gagacggggttgtccaggctggtctcagaactcctgacctcaagtgatccgcccacctcagcctcccaaagtgctgggattataggtgtaagccaccgcacctggccaatcccagcacttcaggaggccggggcttcaggatcgcttgaggccaggagtttgaggaagccaggagtttgagaccaacctgggccacgtagccagatctcgtctctataaaaaataaaaaatattagccaggcatggtagtatgtgcctgtagtcctggctatgtcagagtatcgcttggacccaggagttgaaggctgcagtgagccatgattgtgccactgcactccagcctggacgactgagagagacccctgactcaaaaaatatatatatatattcatatatagtaccagctattataatggcattactctaaacatccatattcattaattcttttgtcagactatgctccaggaagcccaggtgtttcgaggacttgcttctacggtttctttgtctgcggaatcagggaagagtgaaaagggtcagccacagaattccaagaagcaaagtccaccaaaaagtaagattttgatggtagtcataagggaaagagaatgcaaaaagaaaatagattagtcagccttcgaagcacgacagtgagttttactagctacgtaatttatgcttcttccttttcagcagtgtccagattatacaagacacaagatctataacagattttagaccaaacatttcagtcatgtcgtagtctttgactgaatatttagccctgaaatggtttttcctgtattttctaaatgccaaaccccaacctgaagtgagtgatgccttggtaaaggctctgtggcatttagatggccccggcacagtgagcttgccagaaagccaccttactttccatcctctgatgctgagttgtttgttttgttttgttttgttttgttttgttttgtttcagtctctttgagacccatctgtggttttccaggctttgcttaatcccagtccaggactagctgggactacaggcat

SEQ ID NO: 102478 - DNA, 1007 bp, Homo sapiens
atgaagtctcactgtattgcctagactggtcttgaattcctgggctcaagcaatctccctgcctcaaactcccatagtattgggattacaggtgtgagccactgtgtccagcctacctggcatgtttttgacattctctaaatgtttactgatgaacaattagttgaatttcattgctaacattatcctctcctttggtgaattttagtctgtgtctgcaatcctacatcatagacttatgaatttggattaaatggattttaaaatatcatggcagagccaaagagccccctttttagatacatgcgtctgtgtgtgagtggaaacggagtgcttcattctgtggccatctgggttgtggtttggggaggggaacactgacctgggagcgagccttgggctctcatggagctcctgcctctgtccttgacgggccctgcaggcctctgagcctcggttcctttgtgcttaagcaggatgatcatgccagccttgctgggtggttgtgagactggctgcagtgggatacacgtagctactgcacacactgcagagagctttcaggtgggaggacagttttcagaactaagctcatcaatacacagaacagttgtatcttgtttttttttgagacagagttttgctctttatgcccaggctggagtgcaatggcgtgatctcagctcaccacaacctctccgcctccctgattcaagcaattctcctgcctcagcctcccaagtaactgggattacaggcatgcaccaccacgcctggctaattttttgtttttttgttttgtttttgcgataaagtctcactctgtcgccaggctagagtgcagtggcacgatctcggctcactgcaacctccgcctcctgggttcaagccattctcctgccccatcctcccgaatagctgggactacaggtgcccgccaccaaacccggcaaatttttctgtttttagtagagacggggtttcaccatgttggccaggttggtctc

SEQ ID NO: 102479 - DNA, 1047 bp, Homo sapiens
agtaatatctttctttttctttactgtggcttttgtaggcttttcttttttaattagacaatttgttcctcacagatagggttgatgaagaacgcttggtaggtaagcacctgtgtgtgagccgagtcattcataaagaactgttcacagataggttgatgaagaatgcttggtaggtaagcgcctgtgtgtgagccgagtcattcataaagagctgttcacagatagggttgatgaagaatgcttggtaggtaagcacctgtgtgtgagccgagtcattcataaagagctgttcacagatagggttgatgaagaatgcttggtaggtaagcgcctgtatgtgagccaagtcattcataaagagctgttcacagatagggatgatgaagaatgcttggtaggtaagcgcctgtgtgtgagccgagtcattcataaagagctgtccttgtgttggtctcatgggcatcgtgtttcctccgcagagccagccccagtgcctgctgagccgtttgacaacactacctacaagaacctgcagcatcatgactacagcacgtacaccttcttagacctcaacctcgaactctcaaaattcaggatgcctcagccctcctcaggccgggagtcacctcgacactgagggccctcggtgtgaagatgaaccttccaccgtcttcactgcatcctggagtgcaaaaataaaatccactcaagagtcacaaggcccgctgtgcataatcggtttcacttttacctttttttttttttttttttttttgagacagggtctcactctgtcacccaggctggagtgcagtggcacattctcggctcactgcaacttccgcctcctgggttcaagtgattctcccacctcagcctcccaagtaggtgggattacaggtactcaccaccaggtccagctaacttttgtatttttagtagagacagggtttcaccatgttggccaggctggtctcgaactcctgacctcagatggtctgcccacctccgcctcccaaagtgctgggattacaggcgtgagcc

SEQ ID NO: 102480 - DNA, 1084 bp, Homo sapiens
atgtaagtgaagggttgctaagtaggatttgggtcataacatactgttaaggataatttttttgttctctacatgtaaaaatatgtatttttaaaaattggatgtcatgggctgggtgtggtggctcatgcctgtaatcccagcactttgggaggccgaggcgggtggatctcctgaggtcgggagttcgagaccagcctgaccaacatggagaaaccccgtctctactaaaaacacaaaattatccaggcatggtggcacatgactgtaatcccagctactagggaggctgaggcaggagaaacacttgaacctgggaggcggaggttgaggtgagccgagatcgcgccattgcactccagcctgggcaacaagagtgaaactcggtctcaaaaaaaaaaaatttgatgttatggaatgagggagacaaaaaatgctctacaactattaactgatgcttttctggttttgttctccagacaccattcgcttttcacccaagatgatttgatgtcttataaaactctgatgaaccatgatggctacacagacattaagtatagacagctatcaagatgggcaacaggtgagcttgaacttgattctgcattctaattacaaatcaacctggcactcaagcatgaacattgctttgtatacttgcaattcaattgccatgaggttgcatgctcagtgttagtgtattatgcatttattgtacattcgtgttcagaaaaaaagccatagaataatactatttcgttaactgataccaagattgccaggaatcttgacttccctaagtcatatgacagtttcttgggaatttacctttttaatgtcagtgttaattagcactgttactttgaaagaaaacccggttgattttcatgatgacagattcccatgttgactggtggctcttctgagtgtctaactggatcagcttttgaatgggaatcttgtagcctcgtctccccagttgtaggcatgagaggggctgtcccagtaatgaatttgcaggggccccagtgctctatctttgtaccttgctcgtgcttggatggttgtgccatacacgggc

SEQ ID NO: 102481 - DNA, 1633 bp, Homo sapiens
gaactttatgaaaatgtagcactagcctagggtgagtgtggatgtatcactatttgtggatgtagaaacaggagtagatgagggtgagtcacttgtcctgcctgccacagagcgaatcagtggaagggctaggctttggctcacagcccacacacctagcactgggatgcaccgaggtcaccaccacgcgcctttgtcttccctgcacaccagatgcagccaaacaccaaagcccaggtcagtggcaccggaacaacacatcagtttagaggatttctgatgttattccactttggttattggcagtagagatggttctatctaatgactaagaactggtatgtaggatcatgataacttacaataatgccacctttttctctgaaagtcttcattttctctgctctagatggtaaaagcaatccaggttttgcgcattcatcttcttgagctggaaaaggttaacgaactctgcaaagatttctgcagtcgatacattgcttgtctgaaaacaaaaatgaacagtgaaactctgttgagtggagagcctggaagcccgtactcaccagtgcagtcccaggtacttacatttgggggtctcgctttccctctctgccactgtgaacatctgcattgagtcatgagaccaccagctctttcagaattcactgggtcatctttatgactttctacaagaaggaccctctaggtctctgaccccagcctggtttgggaatgaactccctcagattatgaagtgagtcctcaatctgcatactgggcccccggtcccatgtttatggaaggcacaattccattcatttctttcttttatttcttctgaaaatattttacttattcttttgaaaaattgtgtaaaatacacataatataaaatttaccatcttagctattttaaaatttacagttcaatggtgttaagtttattcacattgttgggcaaccatcaacaccatccatctccagaactttctcatcttctcaaactcaaactctgaccccattaaacactcattccggattccccctcccctagcccctggaacccaccgttctactgtctgtctctgtgaattcgatgactccaggtctctcatgttaagcggaatcgtacagtgtttgtccttctggatcctttgcttgtttcattgtgcagaatgcctggagggttcatccatgcggaagcactattgtgttttagccattctgatgatatgtagtgatattaatatttctttgtggttttaattttcatttccctgatggctaataatgttgaacattattataccctctgtgtattttctttgataaaatgtctgctgcttatgtcttttgccttttttttttttttttttttgagacagagtctcgctccatcacccaggctggagtgcagtggcgcgatctcggcttactgcaaactccgcctcctgggttcatgccattctcctgcctcaccctcctgagtagctgggactacaggtgcctgccaccacacccggctaattttttgtatttttagtagagacggggtttcaccgtattagccaggatggtctcgatctcctgacctcgtgatccgcccgccttggcctcccaaagtgctggg

SEQ ID NO: 102482 - DNA, 1002 bp, Homo sapiens
agcggtcttaccagggcttcttctccgtgaggtcctcctccttcagaaagcccttctgcagcatccacctgtcgctcaggaacttggtcctgcgggatgggggagtcaccgagtccccgcagggccccaccgggcccccgcccctgctgagtggcacgcactgcctgcccagcccctctcctggacctcactggtgcagcagagacccccaagtgctggctggaagccccagggggaagcctgggggctggacttcccgcccccatggccaacaagcgtgtgtgagcatgcacacagccatcgctcaggcactcagataaacacgtcctctcatgctcgctctctgcccctcacacactcacacgcacaggtacacatggcaggctggccaagtatgtggggagatggtgttcttgcactgacgggggtgggcaggagccctgcacagggcatcttgaccctgggcaccagatgtgaatcaccccacactggggaacccaactgggggcacccaccagccaggcctggccctccaagggcagctgagctctcgggagctgtgtagccgctgcagcttgcaggccatggaggaaaccctgcaggtgcaggggacagggcatgggggtctgtagacacccgccctggtaccgcctccggagaccaggtgcagagcagcgccagtctcagcctggctgcccggtgaccagcgaggtctgtggcgttactgtccgaggggcctctgggcaaaacagtcacagcaagtcctagggggccacctgggcagcactcggtcccaatctggagtttgggggaagcagcagagggagtcagggtggataggaggtggcacagggcccggcccaagaggacgtcagtccatgtggccagggctacccgttggagctcacggaccccagagcagtgagggggacagacaccagagaggaagggacaggagggacagagagggagccaccgtctttcatgcccctcctgtcaggg

SEQ ID NO: 102483 - DNA, 2378 bp, Homo sapiens
cttatagaagaggggaagacatcagtgtgcttatttggcctttactctaaatcttaaaaggaagaaaattttaatatttcttagtttgagcccaggtgcggtgtctcacgcctgtaatcacagcactttgggaggccaaggcaggcggatcacttgaggtcaggagttcaagaccagcctgccaacgtggtgaaaccctgtctgtactaaaaattaaaaaaaaaaaaaaaaattagccgggcgtggtggcagtcgcctgtagtcccagcaactccagaggctgagacaggagaatcgcttgaaccccagaggtggaggttgcagtgagctgagatggtgccactgcactccagcctgggcgacagagccagactgcatcttgtgggtgtaaaaaaaaaatttgtagtttgagagtcaactttttcctcacagtttctgaaaatgtggcccttttgatgctgattaaagctggttgtgattttaacaccttagtagccagaatcgagactgtcatggggacatttaaaatctcaccacacttgacaccattcacaagtagccatgtggctcagtctcctgagtgctcctgcagagtgcagctctgccaggcttttctctagataatctcgtgtgtgttactgtagcagtttgagtttaaacacaagagttcactcggttaacatgttctaaccagcaagatttctgttgtttgcaggtgccgtgagcgatgtggagatgcaggaacactatgatgagttttttgaggtgagagaactgaactctgtgactgatagacctgttgatcttctgtatctgtttggaaggatttaaaatgtttctctgctaataaacatacatgagttatatctaatgacactttgtaatgtataacgagtcttaaaccactgtggtctcccttcaggaggtttttacagaaatggaggagaagtatggggaagtagaggagatgaacgtctgtgacaacctgggagaccacctggtggggaacgtgtacgtcaaggtaggagccagggcgagacggcggcgtggccgcttagtgtgccagggccaaggccaacaggcgaaagcgagacagtggtgcagccgcttagtgtgccggggccaaggccgacagaggatggggtgcctgtcgccatgcaccttgagatcctggatgctcaggcgcacagcagggctcaggtgcactggctcggcgcctaccagctgcgtcatatgtggcggtggccagcccacacgtgcgcccagccagcagaactgaaggacggaccgtacaccacagccatcgttatttcagtgtagaatatttagtacctgttggtttagaagctgtgtggactaaggaaaagttaggtttactcacatgtttggtttcttttttcttttttagtgaataaaactttatttgcctacacagccatatttgctcctttaaccagttgaatttgaaaaatgaaggcaacatttggcaaaatcttggactatcttgaagttaatctcattgaaaataaaggatttttcaattatcctgtaatactattccaccttactatacctgagtgtgtatatctctctctgatatacttggattggtaattgagaaagtcttattaaagcgtggatggcaagcacttctgtttttgtcttttcagtttcgccgtgaggaagatgcggaaaaggctgtgattgacttgaataaccgttggtttaatggacagccgatccacgccgagctgtcacccgtgacggacttcagagaagcctgctgccgtcagtatgagatggggtgagtgaggagtggccagtgacgtgactgagcacagttcggggccgtgtgcacacgaggtagtaaatgtctccttccaacccacccacagagaatgcacacgaggcggcttctgcaacttcatgcatttgaagcccatttccagagagctgcggcgggagctgtatggccgccgtcgcaagaagtgagtattcctgtgcccgttgttaagctcagtggcttctttctcccctcacaaccctcccccttccaaaaaaaaaattttggcataggtgtcgtttctgttttttaaaaggcagtgcttagaacatagtacatatttttaaatatccaaatgtcctctttggagaagaatattcacctgcacacaggtaacttcattatccaacttctcaagtagagatcagatcttagtaatcaagcaagagggcggttagctgggcagccgcggacatgaggctcgtggtgaaagtgggcatgcagtttattctcccagatattacgaagaagaagaatagatgttgtaacctcctttagatcagggatggcttccctgggacacattggaagaaga

SEQ ID NO: 102484 - DNA, 1427 bp, Homo sapiens
cacttaataaaatttgggttcgaaagcagattcctggaagttcaaaaataactaaaacagccccggataggttagaaagtgaacttaaatcattctcagaattagaaaataagaagttattttttatcttcaaagataaaaagggggccgggcacggtggctcacgcctgtaatcccagcactttggaaagccgaggcaagtggatcacgaggtcgagagattgagaccatcctggccaacatggtggaaccccgtctctactaaaactacaaaaattagccaagatcacgccattgcactccagcctggagacagtgagacgccgtctcaaaaaaaaaaaaaaaaaagataaaaagagttttgagcaagctcaaagacccgtgtgccagcagtcagatgcccacgttgggtgcacaggctaaggcagccggcccaatctggaaaccagtcaggcttttgccagcccctaatctagctgattggaacatgtttgttgatacaccagctctgtgatttctcaggtttagagaactctagaatttgatagagtgggccgggggcagtggctcatgcctgtaatctcagcactttgggaggctgaggtaagcagatcacgtgaggtcaggaggttgagaccagcctggccaacatggtgaaaccccgtctctactaaaaatacaaaaattagccaggcatggtggtgcgcgcctgtagtcccacctacttgggaggctgaggaaggagaattgcttgaacctaggaagtggaggttgcagtgagccaagatcacgccactgcactccagcctggagtggacagagactccatctcaaaagaaaaaaaaattaattaaatttgatagaatgatgatggggatagagtgtaaatttgccaaatttacccacgcaacagacatgattttacctaatacatgtgaattatgaagaataaactgatgaaaatagtttgggaatataaaacttaagaatacttgcgccgggcacggcggctcacacctgtaatcccagcactttgggaggccgaggcaggtggatcacgaggtcaggagttcaagactagcctggccaagatggtgaaaccccatctctattaaaaatacaaaaattagccgggcgtggttgtgggcgcctgtaatcccagctactcaggaggctgaggcagagaatcgcatgagcccaggaagcggaggttgcagtgagccgagattgcgccaccgcactccagcctgggcgacagagtgagactccgtctcaaaaaaaagaaaaaaaaaagaatgctttcatcagcaaaacattgtaacattccctttacttgagggcgtccacaataccgtaaggttgcgtgaactgtcctactgaatcttcatggttgcttggattttaatcacatcagaagaatttgagag

SEQ ID NO: 102485 - DNA, 6630 bp, Homo sapiens
gctgaacaagtagtgtgtttgcagaaagggaagttgaagttacgttgtcctaaaatacagcaaggaagaggaggtgcttaataccacggaaaaaagtctgtgtcatgtttctgtgaggttaaaagtaatttgatagtgtatgtcatgctgctgacatattccatgtgtttgatatcttcccagcaaaataatcagctctcattttcccttacagagtcaactgttcattttatttcaaaattggagcatgtcgtcatggagacaggtgctctcggttgcacaataaaccgacgtttagccaggtttgtttgcctttttttcatgtaaattataaaaacttcatgttcttttcaaagacagttaatttctacatattaagcaagtcattttttctctcgtagttgtattttccatttgtgttcataagtgtgttcttttatttaaataatagtgaggcaggtgatcgacttccagtggaaggtctgagaccaccactccttgtttttatcattagagaaactttaaaaatcagtttttgatgtttgtgtgttggctgtgcctgatatttgctgccctgccatcttccctaccccctctgatagacatgggtccagagggggtggccgtgccagccttgggttagcctcctccaggcaccagtggacacggagtgggctttctgctctttgctgtctccagacagtagaggtgatggagccaccttccaagttagcgtgattgtcaccaggcccatcatgctgctcgagcttctctggctgcgtcctcactttcacatccctagctgaggaaacagcgagtcgcatcacgtcatggaaacatgaaaaattaagctgaaaggtagaaaatgggccgtaaattgctcttagcgggtctgtttggttaattgaggagtgcctgttatcttgggcttagatccgctctgagttcagttcaatcaaaagttgtgagttttgatagttttatttttggttagttgaagaaaaggcaaaggttggtacactataaaggatcacttacggattaaagggagaaggcacctctaatcggagcagaaaacttgtgcccacgttgatgagaacatttgaaatttgaaaatcgatgcccaagtctttccagatggagggctggggaactccttccaacccacccttgaagtctaaatgtgcagcctctgagctgttgagtagctattatgcgtggtccctgggagctgccaggctctgcctttgagctcacatctgtctgtatacgttttcctgtaagcatttaagaaaatctaccactttgtgtaagtgagctgggagaaggaaacatgggttttttccggttgaagcccatggacgaccccacagcacacagtgtttttagaagggaagaggatgatggcttttccctccattatgctaattaccaagtggttagtataatagcagtctgtcttttgatagctctgaacatgagtttctttttacaaatttcaaaatcttggagaactagctttacattttctgtgtattgcaattgttttttctttaatgttttgatttatgaaccgaatctcccctaactaaaccagtggccatggattgtggtataaccaagcatcttaagtgaccacccagttctttgattttggggggtgtcccaagtgttgggctgagagaaatcaactgttccctattctaaaagttttctttaatctggctggaggcactttctttatgtttttctggatcatagattacctgagaatgtgaaatgtgaagttaatttaggcattccaggtcagtgctggggagagcccattggagctcgatggggtcagtagtatgtgtcagcttaagcatcctagtttgatgcgtgggtttgttttggttggttttaggcaatcctagccacccttggctttcccattagactgcattgcctctttacgttaagcttccttcattaaatagccactgccagaatacctgagtgagaccaactgaattttactgttgaataattgggctcagtttagcttttcatcagggttgtcatggtacggtcatttcagttcaaagctgagtcaagtcagctttgggaagcctcccaggcctgagttcagttgactcagggctgtacttggcggcttatggaagaaacggggccctgatgcaggtctgagtggttcagtgtggacagtttgtcagacctccctcttaggtggggtgggcttcccagctgcacacctttgactgaggaactcttcatacaaccactcccctttaaacagagctagaaatggagctggctggttttataaaaccaccacttacaaaactgcttcacgtggatattgttgagactaaacatttatttttctaaatcatgcgagtgattgctttagcttgtaaatctctagcataattcagggtgggtttctttataagctgcttacagtgatatggacgttaagattcatgtaatatattagcctactaacttaaacatggtttgttttttcagacaacttgattttaagaagaacggtacagtgtaaggtttcaagtctgcctgatccagtttaaagcacaagggctaaaaggattttttttccttaaaagaaggatcggaaaagagcaaatgttttaagctattgtattatgtaaacagagatcccaccaagaaagtgtaaatcagagccgggtgtccatgacagttgacagacctgtttggtgtgcctgttttgctaggagaccagagaacttgatgtactgcagacagctgagttacgcatttggttttgaaaaattatcttgtgtgaggaatatgattataacgtgaatttttccacatcttggtgtctgctagcttgaagtacaagaaaatattagtattctactatttatcttgcattaaaacactttaacattgaaaacgtgggactaatcaaaacaatacagtttcttcttggttgctggctgacttgacccaagtcactgctcaaactctgttttcataatatgatggttttggtgtactcttcagaagacaaatgtctgacttgcgggaaaaaaacaaacgtttagccatttgcaaacaaattgtctctttgcaattgtctaatatatgcacagcagccagtagaattcccctttttatttttttttccccgcagaccatcttgattcaaaacatctatcgtaatccccaaaacagtgcacagacggctgacggctcacactgtaagtcccacagttggagaaatttttttaaaacaatggtgttaaagagcccactcttaattgagacaaataatgttggcttctgagctgctgacatagagctgttgcaaacaggacaaggtgctggaactccttggcgcacacagcaagaacttgatacttggccacgttcaggaggcttatcccttctagggagggtcactggcccggccacctccattgattgacatttgtcatgagagcaggtccgtccatgtgaaacggatttcaacattttgagccattcattggtctttacagtgactgaacccctggcctttattaagttctttgtgtaaaattaaaactcttaggaatattaaggaatcaataaggtaagttgcccagtaagtgtgggttttatttcaccattataatttttcctccaggaagtggagatttcatgatatgtaacaattgtatttctctaatacagtaattttttccatcagtttatgtaagcattattctttccgagttcattaaaaattttctgccacatctaagaacattttggtgctagcctggcaaactatttgtgcttttacctgaattggaattttgaaaaggagagttttcacgttctgtaagcagaagtacaagatgggcatatcatgagacctccgttacaccgcagtgttagggattcaaggcagccgccaactgagaaaacgcctctgcttctccagaaaataacttgctctcttttcagcactgaatctcaactgaagcacttgccagaggcagccggttaagtgtttacctttaattttccataatataaagttgttgcgttttgtatttcagaccattgccctcttgaacatttaccgtaaccctcaaaactcttcccagtctgctgacggtttgcgctgtaagttcatacaagttccttccccggttccctgggcttgcgtgtcagagctcagtgtccactccatctggtctgccgtgctagtgtcaaggaccgcgtttcactagaggtggcaaggagctttcgtcccactgaccccatggaaacctcttttggagatttgaactcccaccgtgtgttaaaagggaaaaagtaactggaaagggtgccctttaaaacagtctagagctgggccgggcgcggtggctcacgcctgtaatcccagcactttgggaggccgaggcgggtggatcatgaggtcaggagttcaagaccaatctggccaacatggtgaaaccccatctctactaaagatacaaaaattagctgggcgtggtggcagatgcctgcaatcccagcttctagggaggctgaggcagagaatcgcttgaacccgggaggcggaggttgcagtgaactgagatcgtgccgctgcactccagcctgggcgacagagtgagactccgtctccaaaaaaaaaaaaaaaaacagtctggagctgctgctgccccttcttcctttactttggccgtcatcctagagggaatgtactggaattaaacgtcgagtcatattcttccctcttagagcaacaaaatttgaatgtttctctcactttctggaatttttaaaaagcaaactttttaagttattttttcagattttatttctcattagccttttttccttgaactccattttggagtgcaccctgtagttgtaagagcattgtgctgagagcgttccccaaatgagggtctgcagcttgcactgacccctgagttcctcacccaccagccccgtgccgacccgtctaacccgtgtgggggtgctccactcaaataggcccttggcagaaaagattgtccgttctgtccacacactgcctggatacagtctccagctctaggagatggaattggtttgctccatttagaaatagatcaaaactgggcattcagtagatggtaccaatatcttcctgtactgggaaatactaaatttagattgtgaatatttacctaatgataatttttagagaaggagatatcatagatgagtatgattgggaagttcagaaaactaaaatttgatttttacagccatccaactatagaatcattagaatttagtcatttatggataaattaaaatgaacacctggactcttgttaaaatcagaaagtccaaaccaaagataggcacttcccattcaccattctgttttaaagcagtaaaaattgaggtgcccttggatatccacaagcctaaattgagtacacccttgaaccagagcccctcagttaatggggtgaccgacatggggtagctgatcccagggggcattcccctctcgagctggccctgcactgggtggcctggggattgtgcttccttgcacagtggtgcacatttctatgtgtggatgagattttcttgtcaacttttcctgccaagacactaaatgcttttcagtgctaatactgacctgatagtagagatttctttccctgagtcggatggtagcaggatttacttggtaacccttggtttaaaatacctgtttttttgtttgtttgttttcttttgttttttaaggaaataagatcaataggcggagggaaattgtttctatatgcacttattaaataatttttgttaacaaccctgccctgggataaaagtgaatggaagtacatgactgagtaacagtaattaattctttgccctgatcgtttatttggggactgtatatgctttcttgactgacaatagaatgttgtattagttttcattgtgtctttatttgcagttcacagcacttttgttttgcatatgctacaaactaaaagtttagcaattacgttatattccaattctggagtccagattgtacaaattagatgaaattctaattcgtcattttaggaagaaatcaattacctaaaattactggctcttttcaacataccctttagtatgtaaaaaaataagcttcaaatgcgtgggttaaagttaactatcaatcccagtttaagaatgatatttctgtaagaaaactgctttattttccaagttgtagtatttaacataggctgagtcacaaataagtttttaattgtatcttaatgcagttgtctctgcctttcaagtcactttgattgaaacattttaagcagaacaaatatagccaataatttaaaataatcaccccaaaaccatttctcaaacctgctaaaactttgagcatgtgaataattttctcctcttcacattcttcttatgtgggaaggaagtgaatttgaaatattaaaatctgccctttggaataggctactttggccgtttataacttgatttctactcggggaggaaggtacattcccaatagctttccaattgggatatcctgtgatatgattggca

SEQ ID NO: 102486 - DNA, 1043 bp, Homo sapiens
ggcagggtcggcggcgtcggcagcagtgtcgacggcagcggcggcggcgggtgggaaatggcggagtatctggcctccatcttcggcaccgagaaagacaagtgagtgggagccccccgccgggggttgggcgcgatcggggcgcagggtggttgaggcggtgggagggcgaccggggaggcccaggcgggccggcgcggcggtggcgggggaggggcgcgcggcgggaaggagcggtggcccttccggccccttgcgcgccctccggagccgccgcctcgtgggccgcgcggcggaaaactggagcgggcagaatgaatggggtctcttttcggggcgccgcggccgagctttctccggccttggggtccggactggctgatcgcccgacgtccgggcctccgagtcgccgactcccggaagccgcctcgagccgcgctgaaagttgcctggagcatccgggccttttggacgtggacacgtttgttccaactttcggctgtgaatgtcctgtcgagcaagctctggtaccagcctcgccagtattcagtcgcttatctaacttagggtcctaagcgttggtgttttatccacttagccagcctcttgcctgtttaagcgaccgctgggccggcagtaaggagatatgacgagaaaaagtatggtggagactactggattaactatctaaccacaagagacgtgatccgctcttaacatacaggtgctcctggatttaccatgggattgcgttccgataaacccatcatgaatcgaaaatgcctttaataccccgataaacccatcatctaagttgaaaatttgtaagtcggtgactgttcttgaagacacaattctgatataaggaaaaagatgttttgattttttccttaaggttgcatgccttccctaatcaatcgttaggttaaaagcaaaacatttaatttcagctttaattgccaccttggcacgtactaatttccagtgagttggctgtagtttagactaaatggaatgttttcagacgtttgaaggataattct

SEQ ID NO: 102487 - DNA, 1050 bp, Homo sapiens
cccgcggtggggatcgggagaggggcagtgtcgcccatccccggaaggctgagcctggtgcagccagggagtgagggggcgggaagccggggtgctgccctgagggtgccccgacacgctctcctggggccctgagcggctgccacgtgcgtccagggttctggccacagggtgggcaggggccctgtgctcctcactggaggcccctgaggctctggaactgagaccatccacccgccggccccctctcgccggctccggcacccctgcctactgtgacttcctgccccggactcgctctgccagcttggggcaaaccacttccctctggggttttcacttccctctttcccaagtggggaaagaccacctgtccccgacccagaaagggcccctgcccgagggcagcagcagtgccaggctggcatgtgaggcttggggcaggcccggcccccagaggcacagggcgatgctctgtgggacgctgtgtcgtttctaagtacaaggtcaggagaggagccccctgaccccggaggggaggagaggcagggcaggaaaccgccaccatctcagcccacaggcctggctgctgggagttgctgacagcccgctcttccggggcccccaggcccaaggccaccctggggtgtagctgtccgctaggccctctgtgctcccggtcaacagacccacagggcctgcttggcggaaggggaggggtgttaagaatcagcccccacagaaagcattgccaggggattttgtaccaaaccgaatgcacgggtggacgggcagggcctgtggatgcgtaggccagagggagcggagcgatgacagggagcccccggggtgggcacggagcacagtcctttccctcccagcaggcacctcccacagcctccccacctgccctccgccatcccaggtcgccccgacccatctgctggggtcctcacccgcagcccatgagtctggccgccaggacgagtgcctatcagcagcctagaccctgaccgctggaaggttgggttctgtggcccaggagcagta

SEQ ID NO: 102488 - DNA, 1007 bp, Homo sapiens
gtgttattccggaagaaacacgaagaggccaactctgtttcttccaccccaagagagtcggttcctcttaggtcagattcagttcctgcctccgagggaggcgagcacgtgcagaaacaggtggatcttgcctcggctccctccaggctgggcccagggacctccctctggctggggcatcccctctctccccacccccaccccgagaggccagtcctgctcctgggagccagtatttctggactgccggaaagccttcttcttatcccgcggcccagcgaggagagcgccagccgttcagggtgacagaaaagcacagaggcagggcccaggcgcctccaggcgaaggcctccgctcccaccgctgcgagaggaggcgcgtccacgacggaataagcaggcggtcaggtcgccaacaatccggtcaaccacggtgcttcttccctggtgggtgtctggccccgttcttgctggggatggcgctcggggatgccaccgtgtttccccagggcccactgtgcaccctgcatgtcgcgcccttgtcacgggagcggcctgctgacccggagcacgcgtggccgtcacaaagggctgcaaagctgcagcaccagaacgcaaactcaggcgtgcggcaacggaggccacgttctcagccaccgtgccactctgcatgtcagctggctgggcgtgcctccgtcttgtgttagcaaggacatggcaatcacctgatttgctttggttgaagctccaggcagtacctggcccctcaccagactgaaaaagaaagtcccagaaccccagaaccccgtatggctcagaagtgccatcgagtactaggggtgcgccagggcccggctcagcccggccaagccccagcaggaaggaacatgtcctcaacgagaacatcctgcaaaatgcccggggtgggtgggggatgctcacggtgccagacgtgggctaggggccataaaggaccctcaggcaaggggcaaacacacccatgggtg

SEQ ID NO: 102489 - DNA, 4062 bp, Homo sapiens
tacctccaccttccccaggggaccatgtgtgtctctggcagtacgtgactttgtccgtgatggcagatggcaccccctgttctccaccgggcctgggtgggaccctcagtgctctgggcaggctggggtgctcagtgctctggtggctcggggcgtcacggcctgctgggatagacacacatgggtccctgagcacgcggcctccatggctggttctgaaagcacaggagacgactctgtgctgggcagcacctcccgacttggaggagggagggcccctggctgccggctgcctccacgccatcctggggcttaggtgccagactcctgtccagacgtgcttgtgtcacccgtcctttccttacccccaacctgaggcttggaaaccccttaagccaagggccgtggatgctgggctgagagccgggtggccgttgacctcctgattcattctccctgcagggctgaaggcctttcggcagcagctgaggaagaccacgcggaccaaagggtttctgggactgaacaaaatcaaggggctggctcgccaggtgtgccaggcccccgccagccgggccagcaggggcggcctgagccccttccacgcccctgcacagagcccaggcctgcacggcggcgcagccggcagccgggagggctggagcctgctggaggaggtgctagagcagcagaggtagggcctgcccccgccctgggaccccgggtgggcacacggcaggttatctcctcgaggaacctcatctgctaagtggttccctcctctctgtagcccagtgcacacccccgctcccagccagggagatgtgtggggcgtaggtcctaggtgctgagccatgggggtgcagcaggcgggcgtgtcctttaaagtccctgggtgggtgagggtggcggggagcgagggcgccttgtggccgcatctctgagctgctgagaaaccgggtggagaatgaaaggtggggcgcggtcagggatcagccacgcacctgccctcggcagccgcggctggcagctcctcgggcgggccctgccacacgggcactcggaaacccgagaaccctgcgagccggcgcagtgaccacctgtcctctgttcccacaggctgctccagttacagcaccacccggccgctgcacccggctgctcccaggccccccagccggcccctgccccgtttgtgatcgccccctgtgatggccctggggctgccccgctccccagcaccctcctcacgtcggggctcccgctgctgccgcccccactcctgcagaccggcgcgtccccggtggcctcagcggcgcagctcctggacacacacctgcacattggcaccggccccaccgccctccccgctgtgcccccaccacgcctggccaggctggccccaggttgtgagcccctggggctgctgcagggggactgtgagatggaggacctgatgccctgctccctaggcacgtttgtcctggtgcagtgagggcagccctgcatcctggcacggacactgactcttacagcaataacttcagaggaggtgaagacatctggcctcaaagccaagaactttctagaagcgaaataagcaatacgttaggtgttttggctttttagtttatttttgttttatttttttcttgcactgagtgacctcaactttgagtagggactggaaactttaggaagaaagataattgaggggcgtgtctgggggcgggggcaggaggggagcggggtggagggaacacgtgcagtgccgtggtgtggggatctcggcccctctctctgggttcgtcgtggttgagatgattacctcggacgtctacggaaacgagcgggcgcattgttgtccgcttgtgtgtgtgtgtgtgtgtgtgtgtgtgcgcgtgcattgattactatccatttctttagtcaacgctctccacttcctgatttctgctttaaggaaaactgtgaactttctgcttcatgtatcagttttaaagcagcccaggcaaagatcatctacagattctaggaattctctcccctgaaatcaaaacctggaagacttttttttcttattttagttgagaagtttcataaactgctcaaggattagttttccaggactctgcggaggaacggcaggaagaacctcagagagggcagaggtgacttcaaagtgctggggactccgtcctgagggtcacttggccctgagcccctgcgtgcccttgcggaagcccagaagcttcttcctgctgcacctcccgtttccgctgctgctgacgtttatgcatttcatgatggggtccaacaagaacacctgacttgggtgaagttgtgcaatattggaggctgactgtagggctgggcagctgggagacaggctcatggctcatggctcatggctcagggcggtgcctgccctgggccgggacccccctccccaccccccacctaggctttttgggttttgttcaaggaaggtaaagtgagaggtttaggtcagtgtttttaagtttttgttttttttttaaagcaaatcctgtatatgtatctacatgggagacaggtagacactacttatttgttacattttgtactatacgtttgtgttccaggtttcagcttccctcgctcctgttgttaagaagcgtccctgtcagcacaggtgtgcattgaggaaggggccccagggccttcgctccctcagcactggggtggaggcggcaggaaggggcggcccttacctggcaggtctgggcgcacctttagcaggtggactccgtggggctccaccagccagaagcctctggaaggcaacgaaggcaatgctgctccctgagtccagtccccgcccccaaacccagcccaggtgccttcagctacttcggcttcttaaaccctgcagtgttaaacagaggcattgagaaaggggaaaggcgggtatttttaaaagccaaagattgacccagttacttgagggtagggaggcgggcccagtgcaggaggctgcatccctggcctgctggtgcccaccgggggctgtgcctgtgccgggccgcagggaagctggctgcccccattcctgctgctgctgctgctgctgctctgtggctgtttcaaagactgggcgaaaggctgtccggagggcagaccaggtgccttgccgcagagaaaacaccaaagtctcctgttcgctcataaagaagtttttgggatgggagagaatccagaccatcttggggcagccaggcccttgccttcatttttacagaggtagcacaactgattccaacacaaaaccccttcccctttttaaaatgatttctgttctaatgccatagatcaaaggcctcagaaaccattgtgtgtttcctctttgaagcaatgacaagcactttactttcacggtggtttttgttttttcttattgctgtggaacctcttttggaggacgttaaaggcgtgttttacttgtttttttaagagtgtgtgatgtgtgttttgtagatttcttgacagtgctgtaatacagacggcaatgcaatagcctatttaaagacactacgtgatctgattgagatgtacatagtttttttttttaccataactgaattattttatctcttatgttaacatgagaaatgtatgccaaatgattagttgatgtatgttttttaatttaatatttaaataaaatatttggaaggaaaaaaccttgactttttcccttcctctctctctcatctctctgggagctctttccttccaagcggcttccctgagaggccacatcctccaggcttgtagaagtttcaaatcttaaagaggagggcagggagccaactcctgcattccacctcactgcagggaactaatggccttccgtctgcagaggacccctccccctgcggcagccacaggtggccccgtggtctgccccctcctcaggacccttccccagtggccgggctcagtcactgaaagtctcagcaccgcccggggctgccggcaccatccatccttaccccatcctccgccaggttctctgagtct

SEQ ID NO: 102490 - DNA, 2597 bp, Homo sapiens
tgagtagctgggattacaggtgcccaccacctcacctagctagtttttgtattttttgtagagatggggtcttgccgtgttgaccaggctggtctcgaactcaagcgattctcctgccttggcctcccgaagtgctgggattacagggcgtgagccaccatgccccggcctaagcattctcaaattgtatgtgaggtgtcttgaattaaatatgaccacagaggggaattctaatatatttagaccttttgtgagagcaaaggtgtatcaggataggcaagtcagtgaggaattcacctctgatttttcaaagctgtctttgtgagtaggaatctcctattttttttttatttgagaaatttttctttttctttgcatttttaaatgatgaatgcctttgtcctagagaagttagaaatttcctggggttctggtggatggtttgtagcgctgccttgtgccttttttgtgcggttaaatgtcaggtctttcttctttaggttatggaaacaaaggacatgctttacatcgtcactgaatttgctaaaaatggagaaatgtttggtaagccacactcgttttcagtatctgttgaaaaccaatggcacgaacgcgtctggatttgcgcggccagtgtctgggccacacatcccaggaccccgcggtgttccccagggctccatgggtggtgggcaggctttgccctgggggctgtagctttgttttgtggctcctcagattatttgacttccaacgggcacctgagtgagaacgaggcgcggaagaagttctggcaaatcctgtcggccgtggagtactgtcacgaccatcacatcgtccaccgggacctcaagaccgagaacctcctgctggatggcaacatggacatcaagctggcaggcacggagggtccggggtgggagcagggacatcaagctggcaggcacggagggtctggggtgggagcagggacatcaagctggcaggcacggagggtccggggtgggagcagggacatcaagctggcaggcacggaggccccggggtgggagtgtgcccgcaagcagccccagcttcccggcatgtgccgaaaccacagcccctgtgccgaaaccgcagccccttgccatttgccgtttaacctcatccatctgtttctttgccgctcagattttggatttgggaatttctacaagtcaggagagcctctgtccacgtggtgtgggagccccccgtatgccgccccggaagtctttgaggggaaggagtatgaaggcccccagctggacatctgggtaggagccctgtgcgcgcagacccccttcccgaggccgcgttccccgagggcgccgtgttcccgggggcaccgccctggcgctgatgtggctctgtggtcctcaacagagcctgggcgtggtgctgtacgtcctggtctgcggttctctccccttcgatgggcctaacctgccgacgctgagacagcgggtgctggagggccgcttccgcatccccttcttcatgtctcaaggtgagtcgtgtggtctcgcctgggcaggggcctgtgtctcctgcagccccttcgtggctggcttctgagtccttgttgagtctgggaatcaggcccaggttactgtgggctgcgggagaaacccagcccatggatgccttctcagtgccctatttcgagggtggacgggtgcccttgctgcacaggcttgtgccttgcgcctgccgtccccgcccagtacccgcacccagggtgctggcatcatccctgagtccaacccactggctgtggctcacccggcttttctgtgtcataaagatgcctgtccacctggtgctcaggtgtggggcacggcagaagggtgaacctaagtggttctctgtgtggtggacacaaagtgtggcagcccccagggtctggatccctggctgatggctccccttgggtggcaggactgagccgatggcccggcccctgctcctgggccctggcgtgtcaaaccacgtggggcggtgggtgggagcgcagccgaggtcccggccgccctggctcagcctcctggcccctccacagactgtgagagcctgatccgccgcatgctggtggtggaccccgccaggcgcatcaccatcgcccagatccggcagcaccggtggatgcgggctgagccctgcttgccgggacccgcctgccccgccttctccgcacacagctacacctccaacctgggcgactacgatgagcaggcgctgggtatcatgcagaccctgggcgtggaccggcagaggacggtggaggtgagcctggccacacttgccctggcctcacccgcaggggctaggcagctgtctcaggggaagcaggcactcaccagctgagttaaaacgggagcacaggctaatttaggggccggcttgtccaccccactaaaggatattctcagtcacccaagaataacctgggatcgggtgggccctggggctccccgccatccccatgctgatctctgctcctcttgttcccagtcactgcaaaacagcagctataaccactttgctgccatttattacctcctccttgagcggctcaa

SEQ ID NO: 102491 - DNA, 2041 bp, Homo sapiens
gccgtgggggctccgcgcgggcgccgggccggggctcggggttgcagccaccgcgcagggtccctggccttgcgcgcgcggggttcgcgggcggggttggcggcctggccgccctcgggctcccctttgttggggggccggggtaggagtgagtccgcggggctcaggggctggggagccgggggtcaggttggagccgaccgcgggcggagataccgggtgtggggggcgggtccgcgatccccgaggtgcctgggatgtcgggggtggggaccggacggatcgcgggcggcgggggcagggtgtgggagcggggcaggggacggtcctgggatccggatcgagccgacctcgggtggcagggccaggtgtgggagcgggtccgcgcccagaggtgctaaaggggtcgagggtggggacggaaccgacagcgggcggcgggaggcgagtgtggaatcccggctcagggggtcccgggatcgggacggaaccggactcgggcggcaggggcctctatgagagcgggtccgtgcgccccgcggggctcaagagggtcgggggtccgggtggagcgggcggcgggggcgggtccacacctcccacggggctggaggggcccgtggatagagtgggggcgacaggcgtgggagcaggtccctgcgtcccgtggggactgggggctccgcgggcacggatggagccgaccgcgggcggcgggggcgctggtgggctctgagctctgtgcggccccgcaggtgcgcgcggagccatggttatcatgtcggagttcagcgcggaccccgcgggccagggtcagggccagcagaagcccctccgggtgggtttttacgacatcgagcggaccctgggcaaaggcaacttcgcggtggtgaagctggcgcggcatcgagtcaccaaaacgcaggtgcgtgggggcggtgggacccagccggcggggcctccccactggacccggggcgacccgacctttggcgggtggaccccatgcagattcactgctccaggcttgattgtcgtggtgggtaaatagtaaccgtttttagttcggtaaagaaaaataatgctttatattatgttgctgcataatttggacatatattgggagaaagcagagaggataatagcaaaaaaaaggaccaacctaagattgcagtggttcatggactcagagctaaaccctgtaaagtgagcctgcaaatacttaagtcacttacttaactctgattattttaaataacattagtggttactttggttatgttttcccaacttcttgtgaccttctggagacagagtgttgagaaattaacttgcaaaaaatgaaatgtgtaaattaggttgagggtttcttttctttttttaaaaaaacccacagaatatcctttttctttttaaatttgtaggttgcaataaaaataattgataaaacacgattagattcaagcaatttggagaaaatctatcgtgaggttcagctgatgaagcttctgaaccatccacacatcataaagctttaccaggtaaggggtcagcttgcctttctctgctaatcctggcaaatgtgttatattttatttccaacagcataagtctgcaatttctgaaggtggcttcccttttggggagtgtgtggaagttgggcatttggttgtataaggtaaatagattgatttttataggctgtgcagatatatttacaattattttattgcttttggatcataattgagatttgcttcattagaattttatttagtatcctaacctgatccagttttaaatgtgtagaagtctgttgtaaatttgctttactatgaaaacagacaaacttatctgtaggtattgccacaggtcacgcatttagtataaaaggacaaatttgagtgaaactggaaacttctgcctttgcagataattattaaactttaaagccagctgctcttactggttttcattagtttatttttgcaaggacagtagtgagcatttgttttccctatttaaactcttccatgaaaaa

SEQ ID NO: 102492 - DNA, 1055 bp, Homo sapiens
gggctccctctccctctccatgtgcttgtgggtgggggcagaggtcccggccttgtctcatgtagaagagatggttccaggccacataggcctgagctggtctgctgcatggagtggcctgaccaccaagcagagagcaggaacggcaggggcagtgcttgtgcttcggggtttttagggatttatgaatgtgcacaccaagaacagcaaacaaaccaaagttcaagttatttctctttcttacaagtctgcatgaatatagtctcttccagaggaagttgattaaactctattgcaccagcctctgaagaatgcatagtatgaaatagcagagcatttcttgtggctcccagatctgccacctgcagtggggccaggctacccgacagctcccaggcctctgggcaccatagctgtcttcaggtgctccagctcaggacatggccattcagaggcaagaatcagcaagctccttccaggctggggcacatcctgaagccccatcagagcagccccatacagtggcttaggggtgtgggcttgtgtcctcctcatggaggaggggagcacgttttcccagcagctcaggtttccagggcccccccaccttccaggtgtgacagtttttcatacttaaaacatcactcaactatcagagtggtatactggggagaggcagggctgtgacagagagctgaagtggtgtgcaacagtcacaaacagctttcacctttgaccttggaacatgtgatgtgttttgcccaagttttcatttctccctgattgcatttagcttgggatcttgttaaaattcgtctgcatttccatagcataccctgagcactcaagaggcaggacaaggggttctagccagggacccagatgttcctgcagacattgcacactggaggcaagcgacgccaccagggtgaggctgtcctgatgcagcatccccaaagaggctgggccagggcagcagattttccctgcaacagggcatggggctcctcctgtcccctgccccttgggcctgggcctcacagtgtggacttgtc

SEQ ID NO: 102493 - DNA, 1062 bp, Homo sapiens
ctgtctctgtgtgtgtgtgtgtgtgtgtgtgtgtgtgtgtgtgtgtctttgtgtgtgactgtgcctctgtgtgtgcctatctgtatgagtctgcatgtatgtgtgcatgtatgtctgtgtgactgtgcctgtgagtgttgtttctgtatcttgtctgtatgtttttgtgtgtctctgtgtgcatctctctctctgtctgcgtctctgtgtgtggggactgtcataccttccttcccatgctaaacatacctgtgtcttgactctagtccggcaagcttccctcgctacacctctgcctcaaccctaaggaatttggctgacacgcatactaaggttttctaagggggagttggcttttggctgtgtgggctggaactagggtttaggggaatgtttgtctcccatttgcttctggctctgcacccccgtgtatgagggggcaggagggcactgtgactgcacctctcccatgagcccagaagatacgttttaccctgtgggcactgaagacagggccaggtttctagggctctataatctttttaactatttttggctacaggtcaagtgtagatgtgtcaggggtcatagacctctgaatcctgcaggacaaacctgaagctatctgcttcatggagttaaatgttcatcagatttgcatttctcccttaaaaccttgtcactggaaacctgggtggaagtctggcccagtgcagaagccaccagactctcctgccagctccagaggctgtcttaggatccagagccccttgcttaatcctgttttctctgctgtgctggaagaaagtcccattcctgggtaattgccagaagaaaggctccgtcttaaggttaaaggagctagaatcacaaggggaatcagtaaacccagttcccaggccagggacccaagctttgggatgagcgatctggtcttcaaggccaaaatgcttgctcaccagctttctttctcctccacactctgtccaggtttgggggcactgtcttaggcccctttgacgtcatcagcacaagagactcagagcaaggaacaaaactgcc

SEQ ID NO: 102494 - DNA, 1078 bp, Homo sapiens
gtaagaagggcaagagataactggtacacctctgtcttcacaaactctcatctttaagagccatggctgcctctctgctctgagaatgcacacatttaaatttatctccagatgtagactaagaaatcggagtctttgtgctaattagtgcatgctatgagatgaaaagtgttgttactgtcctttttaatttgtaattttaaaagttttaaaaattgttaaatatacctaatataaaatttatgttttaaccattttaaagtgaagactcagtggcattaagtatgtcatagtgttttataatcattaccattatctatttctgaaacttttcttcattccaaacagaaactctgtacccgttatataacaacacattccctaaacctttctcccctggcccctaatatctgctcttctttgtctccatgcatttgactactccacgcatctcatagaagtacagtcatatgatctttgttcttttgggtctggcgtatttcacttagcatcgtgacctcaaggttcatccgtgttgtagcgtgtgtcagaactcgttccctcttctggctgtatcatcccatgtgtggacacagcacatttcgttcattcatccatctgttgagggacacttggcttgttttcaccttttggctgttgttaatagtattgctgtgaacattggggtacaggtatctgtttgaatttctgctttcaattttttggggtgtgtacttaggagtgaaattgctgaatcacatggtaattctgtgtgtagctctctgaggaactgccaaccgctttccacagcagccgcaccactttacatccccaccggcagcagtgcccaagggctccagtttctccacgtgttcatcaacatttgttattttctgttttattgataatagccattgataatgggtgtgaaatgcatcttattgaggttttcatttgcatttccctaatgacgaataatgttgagcatctttccttgtgcttattggccgtttgtatctcttctttggagaaaagtctattcagggcctttgcccatttttgagttgggttgtttgct

SEQ ID NO: 102495 - DNA, 1050 bp, Homo sapiens
taatcccagcactttgggaggccaaggtgggtggatcacttgaggttaggagttcgagaccaacctgaccaatatgatgaaactccatctctactaaaaatacaaaaaattagcgaggcatggtggcacacacctgttatctcagttacttgggaaactcctgcctcagttacagaggaaagctgaggcaggagagtctcttgagcctgggaggcggaggttgcagtgagcagagatcatgccaccgcactccagcctgggtgacagagcgagactctgtctcaaaaaaataaaacaaaaagaaaaaagaaaattttattctaaccagaagcattacctcttttccctagatccagatgcagaggtgtgccttcatgtactgaggcttgtccagtctgtggttctggaacctgaagtcttctccaagtcggcctctgagttccggagctccctgcccctgcaacgcatcctggcaatgtccaagagccgcaacccccgcctgcaaaccgcagcccaggagctcctggaagatctccgcactctggagcataatgtgtaggtgtgctcggccaccagggttttggtgaaaatgccggtgtcccttctccccagatccctcatttgatactccaaaaccatcaccatgtaccatgtgttagagttggcaaaatgtgattgactagagatggacatgaattgatatgtatcccacataactttgtcttggaagtgagagtgcttgtaggtggttggttaagcttgccaaaggagaggccatgaaagaacctgtccttctggaaaagtggtccatgtctgtgctggctggaagagggcttgcttagggcagcttcttgctgctcagcagaccatgacctgtaggttcacctataaaacagggaaattgaataaccatctaccccattagtcagcattttcttgagatacatttctttgaaaagcaattcattctctctctagtaattgtaattaatccccccaaaatgcaagtttacttttataaccttttggtgaacctgctatttcggatga

SEQ ID NO: 102496 - DNA, 1095 bp, Homo sapiens
ctggctgtctctgtgagggggttgaatgctaggcacttctagctggctatcttgataatgttacccagaatgggtagtttctgtcgtcctatcttccaatttactgattttttttttttttttttgcctctgtcccctccattctgtcttcaccaagattttaatttcagttattttattttttctgttttaatttttccattttggttttctttatatgttgtttttttctcattggtttctagcacagttgctcactaaagaaattttttgatggccgatttaaaaccaccataaatcatatcagataatttgaacatctgtgtcatctttctgctgatgtcaggcaattttctttttcatttaagttgcctcatgtgtctttaaacccaaagttcagccatgactatcgtaaatgttctcagtctcaagtaatgaggcttttcatgattagacctgagctctgtgttattcttctacctatgttgtgagcagagttttggtgcgttatcagccattcacattcttttcgtctgtgttcccctcaaaggctgtcaccctgctgtagtgttttccttatgatgacgtcctcatgaagttgttccatgttttccttaggatgatgtcctcatgaggttgttccatttgggttgtgcccttgacagcatttgtctcatggataaagtggcctgttttattttaccctttcagggggctcacatagctatctcttcagcttgactagtgatgcaatttgtccagaaatttccttatcatttgtgtcccttgtatcccatcagccttagccacataaaataaatcctttccattcatttagcaaatatttactgagcccttactgtaaggtggtgaacaacacagccaatgttctgctttcatgaagctttcagactaaggaagaacacttattcctatttcatagaataactattattgagagaactaaaataggttaatgggcttgacaatgagtgggcgataagggatggcctctgtgaggagagaatatgtaagctgaaatgtgattcttttctggaatttccatttctgtttatattatacatctgttctttc

SEQ ID NO: 102497 - DNA, 1028 bp, Homo sapiens
agcctggggacagagggagacttggtctcaaaaaaaaaaaaaaaaaaaagaaaaaaaaagaaaaatccctaactaggtaagaaagtaaggacttggtaagagagcagttgtgtttcttttttgtcttccacagaatacagtgagggagctttgtgtcccctcttcagacaatgctgccgagccagcgtgctgaacctgccctggctggggatggtgccgtgggagggtgcgcttcagcttggagtacactcatgagagttagtctgcagggagtgggccggcctgtttattaccattgttgttgagctcccagcactcgggtgggtcagaatgcagggagtggaccagccccatttgttatagttgtcaggctcaggagtgagcaagacagagttctttccctatggaacttatattcaggtgaggagacttgatagtaaacaaatataatggcatatatcatatagtaatgcaaataaaaatggagtggcatgaggagcaggctagagagtgttgggcggagctgctcttttgggtatttgagtggatacctgaaggaagcgaaggacagcctgtgctgagatctttgagcagagcatcacaggccaagggtggcaggggaagggtctgaggcagctatgggcaaaggagtattgtaggagtgactaaaggccagtgtcgctggagaggataagaagggaatgttaggagtcggggccagaggaacagctggtgctgggaatcatcatagtgtagaaggtatttgtagccatggtaggggactgcattgctgagggagtgatatagggctgaggatgaagctgtggggccagcattttcagtgcagatgaagatgatgagggagcacagaacagccaggtgaggtcggaggaaagccgggaagatgcagtgtcctccagggctaaatggaaacagtgtttccacatgcagctggggactgtcctgtgctactgagctgggcaggtaagcctacaggcgggcgggtgagagggcccagctgtgtgagt

SEQ ID NO: 102498 - DNA, 1904 bp, Homo sapiens
agttcgtggtgctggtggtagtgggactgttttcagaatttagactgttttcagaatctagaatcataactgcttaggactaagagataatttgaaaactggcttcttctattcctttggttttaggtagatctagtttatgaaaatatactggacagataagaagctcttctaatttttaaaagatcgaggaaaaggagaattgtttgaacccaggaggcagaggttgcagtgagccaagatcgtgccactgcacttcagtctgggcaacaagagtgaaacttcattaaaaaaaaaaataagatcgaggaaaaaaaagatctcattatccctttcagtaatcagttcctacttttatcaatttctgttaagaaatttgatgtattttaataagtacacgagctttggactcattcaacccagatttgaattgcagctttcctgcttgtgaacttacctaaccttttagaatcctgcttttctgatgtataaaatgagaatttctacctcaaggatcttaatgtatattaaaatgcaatagtgtttaggccaacacctaatgtagtaggtgttaaataggtgctagttttcctcttttatttctagtctaaatatctcatgctttagggataaaagacttgaaatgaaaaaaaaaatctcatgctgcaatgaaaactcattttcttttgtttgcttgctgtaaaggtggcaggttactttcaagtatctagacttccctgattcagagtacgagaccagttgctattaatcatccctgactaaatcatctcatttcctttaacgtttgctagatttcatttgtcttcccttcgttcagctacatggctggctttttcccaggctttgtccacattcttcacattcctcttaagccacagaactggcatagaactcgagcaaatagccgacgaggacagagtgtattgagatggtggccacatgttacgtaactgttaatgcagactagtattgtgatcacaggaaactgcatttcctaccatgttttcaatgctaaaagggcagataggcggttatttccatcttacatctatttggcttgtctgagtaacacaaagcattgatcaggttctccagatttgtgccttcagcccagacctctgtcccgagctctagcctcatagattgagctgtctacttgatatctccacatggacatctaataaacattcacattcaatgtgttcagactaaacccctaatcttccctcacaccaaattctaatttctattgattacaattctatttttctagtgtctcagacttttaaaaaaccttcgagtgattcttgactccttgactccttttaatctcttacgccctcattcagtctgttaggaaatcctgatggctctactttcaaaacatctccagaatctgatcaccagctagcactcccacctaggtgttttttttttttttgagacagagtcttggtcagttgcccaggctggagtgcagtggcacagtcttggctcattgcaaccctctgcctcctgggttcaagcgattcccctgtctcagcctcccagtagctgggattacaggcgcccatcaccacgcccagctaattttcccacccagttttgagccaccatcaccttgggttgagagcttcctataggtctccctatgttccatccttccaggccatgaactgggagccaggggtatgatggaaaaatccctgaccacctctccttactgaacagtcaaaatgcggagtgagacacaaaaaaacattttacttacttatttgatacagtgtcttgcagtgtcacctaggctggactgtagtggagtgatgctagctgactgtaaatcgaattcctgggctcatgggatcctcctgctccagcctcct

SEQ ID NO: 102499 - DNA, 1063 bp, Homo sapiens
tactgagtgacctaaagggcgcatagcatatgctggacaaagggatgattcatgtccctgatgggatggagtgggatggcagcatgagatttcatcatgctacgcagaatggtgtgcaatttaaaacttaagaattgtttatttctggatttttccatttgatgtttccagaccatggttgactggctaagtgaaactgtggaaggtgaaactgtggataagaggggcctactgtatacctgttcttctgtagctgaaggaaattttaaagtattagaaagtaggattgattgtaagatgttctttcttttaaaaaaagtcaaattttagaaaatttcttggtatgttaagtttactctagttctgtttctgaagtattgctttcaatttggttataatttactggtgtccctacaacacaaagagaaattgtctcttataaaacagcaggtaaacagcatcagcctatcccattctctattacagcacagtactctatgtgggtatgtggttctgtcagataaaagagaagacccattgttaaataatttgggtaaaaagaaattggaaagacactgcagctatgaagagaagtacacatgtatagtatgtgtgtgttttaaaatttctttaaaaagctatctttactgcatcctttcctcttcacccttaactaccaatctaacctaaagttctgtcccaatttcatcataatttttaacactatatgttgtttaatgagtatacatttcacccatgtataaaaataaattaattttccttatttttttatgattcaaattaacctcttttttttagtgtcagttccatttggtggtgaatgcttttttaaaaaatagctttattgatgtgtaatcgacatgtaataagttgcatatatttaaagtgaacaattgataagtattgatataaatgtccacctgtaaaattattatcacaatcaaggtaatgtgcaaacccatcacctccaaaggcactttgtgcccctttgtggtccctccttcctgctcctctccctgctttccagagagtgactcgcctc

SEQ ID NO: 102500 - DNA, 1044 bp, Homo sapiens
ggatcttgttgtgttgcccaagctggttttgaactccgggctcaagcagtcttcccatgttggcctcccaaagtgctgggattataggcatgagccacccctcttctttcaagggggcacttctcttcagtttctgcctgcctttggctgctttccattccccttaaatggttcctatattttgttcagaatttgtgattcttattggtggagggttagtccaatgcaagttactctgccattgctgcagctatttttttctggaataagtattaaaggctgtgtgtgtgtgtgtgtgtgtgtgtatttcactagcatcacaagttttatttttgtatattcattcttgttcagtttcccaattttcctcataatttctttgacttattcttatagagatgtactttcagttttctaaatgttggagttttaaaacctacttaaaaaatgatttttaacttaattatgtggtggatcagagaatcagcttaatgtattaagtgctataagaggtgccttaaaatctaccattattgtggactggtcagcattttcttgtagttttatcaatttgtgcctttatgtatttttgaggctatattattaggtacatacaagtttaaaatgctaccctcctgatgaactgaacttttcagtatgaaatatttagccttgccgggcgtggtggctcatgcctgtaatctcagcacgttgggaggctgaggtgggcggatcatgaggtcaggagttcgagagcctaaccaacatggtgaaaccccatctctactaaaaatacaacaattagctgggtgtggtggcatatgcctgtaatcccagctactcaggaggctgaggcaggagagtcacttgaacccaggaggcggaggttgcagtgagccgagatggcgccactgcactctaactctgtttcacaaaaaaaaaaaaaaaaaaaaaaaaaaaaaaaaattagcctcttaatttttaaagatgctttcccttcttttaacattattattatttttagttattatttttgagataggg

SEQ ID NO: 102501 - DNA, 1033 bp, Homo sapiens
tattttttgtagagacagggtctcaccttgttgcccaggcttgtctcaaactcctaagctcaagtgatccacctgcctcagcctcccagaatgttgggattacagcgtgagccactggacctggccttaaagagtatttttatcatccacctatcatctgtctgtctttgtccttctctcccttccttcagatttagattgccagtgaggttgaggctcttcacatgtttgtaccattccagtttttcctttgagtcacctgtctgtgtcttgtgcccactttcctgttgggctgcatttttcttagtgatctgctgtaggtctttgtgtgttctggatactaatccattgcctcttttgcttctgtggtctgtacaaggtccatatttatgggccagctaaagtcccccttcaacttccaaggcaaagctgtgtgtgagggctgggtcacttctagcctctccggttccagtccctggagctctgtgcctttgggtcctggtgagctcttgttgattgcagtgggagatggggagaattgccttcagagccattcactgactttcttggcagtcttccatttggccactgagcaaagccgcgtgtttaccctctatcctgactcgggatctcagcatgcaccagcctgagaggggccttccccctgggatctttggctgccttccaacatgctcatggcttgttccgtctcaccacatctccaaggcactcttctcccctcttttcacctcccccacttcactaacgcccacccttgagtcctctggagccccaagacctttctcatactataaatcagcctcttttcttcctggcctccccctgccttgtgtatagcttgcctctctctggggaactacactttcactgccactttcatgatcgaaggtcactcattttcagcagttagtaccttagacccagagataggggttatttttttcctagttgcccattttttaaaaaaatttaaatttaaattttagattcagggggtacatgtgcaggtttg

SEQ ID NO: 102502 - DNA, 1141 bp, Homo sapiens
tagactggcactggcttgctgcaccagggcatgaataggactcccagccttcacacttctttttgcccctcctcccatctttcctacctggtcttaggttttaggttttctttccctgtttagcttcacagattgtattttatatttactggcacctttggcaatattctcatgaggagttaaggatacgtttatacaggatgagtttttctaaagtacttgtttttttacaaatcctgatgtccaagtgccttttatttggtgtctgcctctggcagatggcgttttttcaatggagtgagccatttggaggaggcagtctcctgtcttagaaatgttgctttctgggtaaattgctttgtgaggttgtttttgttcagaagcctcggttggtgctggttctgggtatagttacttggggcttgagatatttcatgtagttacttaaagcagatgaattcagctctgtgggtttatcaaccataatgtggtagtatgttctttcctcagatatttctcaaatatttttgcctttgaaatttcttttgtagatacagattatggttctcttaggactagctttcatttgcaactattttctataattatacatgcatttctttaataaatatctttgtgaaagaggaaatgtaataaagatatatcaaggttgaatgctattatttatttttcaattttgttttgcttttaggagaaactggctcttcgacagcagttgaatgaagcgaagcagcaactcctgcagcaggcagagtattgtacagaaatgggagcagcagcgtgtaccctcttgtggggtgtctccagcagtgaggaagtcgtcaaggccattttgggaggagtaagtatggtcagtgggctctccagatattgttgattactgcttgtgtaaattagagcatatagcttattaaggcatttaaagactaagtccatatctttccattttcttttgttcactcatcagctagttattgaatacttatcgtatatggttcattgtaacctgatgcaaagggaatgaaataagatcccttctctccaggagaccttgtggtatatgtggacatattaccacttcagtattaatactttacatgtgtttaagaagatcaaaagt

SEQ ID NO: 102503 - DNA, 1058 bp, Homo sapiens
tttgtatttttagtgagatggagtttcaccatactggtcaggctggtcttgaactcctgacctcaggtgatccacccgcctcggcctcccaaagtgctgggattacaggcgtgagccactgcgccgggcctcctgggcacgttttcatatttttgtagtgacagggtctctccatgttgctcagactggtcttgaactcctggcctcccaaattcctgggatttcaagtgtgagccaccatgcctggcctgtttgtccttattatttttaacatctggctccctttttgaaggctgaagcttcagctttcaaaatgtttgtatgtacataaaatatatctatagcagaatatacagtaggtagagacatgatttgaaacaacgatgcacataagaggtgtgaaagaaaagcaagttaacttgagctgttgttttttttctcatgtgaagagaaatataataagatctgcttgttcttttagcacatgggaactaaagaggaatttgttaaagtcagaaagaaggatctggaacggctgacaactgaagtgatgcaaatacgggacttcttacccagaatactaaatggggaggtgctggagagcttccagaaattaaagattgtagaaaaaagtgagtcttcattttcagcagtcattggtggtaacagtaatttgttctagcagatttaccctaggtaaataattgtaaacgaattttaaggtactcttacagtccttgtgatgatatttgggagagtctgatgacctaagaaagggaggtttcctcagtgtagtgacttggacatatgtaagttggtataagttggttgccagttttctgagcatctattaacagcttctctttctctctctcttcattggcagaagaattttatacttttgataactgaaaagctctattctgaaaattaagtacttactgtgtaagttaaggatcttgccaaatggaaaccttgcatggagtttacttgtcagtagagatagctggaagtgtgttcacttatctttaggtggatgggtgagccagtatctagaa

SEQ ID NO: 102504 - DNA, 1314 bp, Homo sapiens
ggtgagccagcccaggatttgcaaatgcagaggttatgcgggggcctaagaccagtttacaccagtgctccagagtcctgtctggttagtgcctatcacacccagagtgacttgtcttgtatatcttgttcaccaccacattgcatggagtacagtggaccttcagaaaataactccgcagcatgaacgtcgtggacagtgataatgggacaagaaaacacaaggtctccaccacagctatgccccatcacaattacagcacaagtttggaaataacttggcctgacattcgactcccgatgacaggctccaacttttctgcatcttgtcttaggcatcataaaggaaatgtgagctatcactcttcctgaaacatgagctgttctgcagcaacatcaatagatagctttgtcattttaaaaataaattggaaatctttgtattgctttaagtaacagtgttgcgctcttgctttaactgttcaagttgggtgctcacagtcataaaatgatcactctccatggctttcatccataagagcttatttgtcccaattcattcattcattcatatatttagcaaacatttatggagtgccaactgtgtactattatgtacgctattcttggcactgggaatatagcagtgaacaaaacagaccatccctgcctatcttatcagttctgcaactttaaaaatattgactaaaatggggaggcatcccaaaatcaacccagtgacaatttcatttgtatcattgctttctttttggcagcatacaaaataacagtacatcttatggttgatgctatattagattcagtgtagatgatggaggatataagtttttttataatgatggggttagggttctctctatccaagagttataataaatagaagttgtggatgttctgacactggggtgtgttcaagtttaacactttacccccatctaaaatggcttctgggctcattgcgtggtgagagtggctgttggatttgctcatttcaaaacttactaatatttcacatgtctacatgtctcactttgatgtttacctcgtttgttttgtgtgtttttgttttttgagacagagtttcactctttcacccaggctgaagtgcaacagcgcgatctctgctaactgcaacctccaccttccagtttcaagcaattctcccgcctcaccctcccgagtagcgagcgcccaccaccacgcctggctaatttttgtgtttttagtagagacggtgtttcaccatgttggccaggctggtcttgagctcctgacctcatgatccgcccgccta

SEQ ID NO: 102505 - DNA, 1536 bp, Homo sapiens
tctcttgtaagatttgcagttttacttcacaagaccagcgaaaatgtcagtgtgcaggatggctgcacgtggtgggcggggagggcgttgatgaggagccgatttcataagtggccactttgttcatgaattttgtgttgtgatgacatttgcttcctcacgctgaggccgggccaccactgccaccctaccctgtagctgataaagctgcaggtacagtagtaatttatttgtgtttcttttataacaataaggaaatgtttgcttcaattttttaaaaagacgtgcaaacgaaagagaattaaaatgtatgtgatacttcaccactttctaaacttgaagaaaagagatgcatagactctaagatgtttgtattgttttgccttccaggaggtttcagtcaggaagaacttctgaaaatctggaaggggctcttctactgcatgtgggtgcaggatgaaccccttctacaggtaacatgcgttccctttgtcatgctcccgggttcttgctgtggatggataagagacttgatcactcatgctgtgccagtcccccgatacactgacgcacactgacagtcatgcttcaaggagtcattttcgtacctcttgtccatacagaaagggatgcagggtcaacacagttaggtgaattgtcttttcaaataaaaggaaagatgtgcattcgttgtcaatttactatttctctgtaaaatttcataggttccatgctaggttttacattacttaaagtttctctcttctggtaagtttattttttgtggtcaaggatggcatgacaggagcactaactagtcaagaccctgtgaaacccaggagagggcagccgcgtcactgggcttcgggttccatggagagcagcagtagcgctcagcgaaagcctccctgttaaagccgagtgcgcctgcgcagtcacccaaacgcgcagcaggctcggtctctctgtgcggggcctgctgagcccgctaagcccaccaccaaagccaacactaaagatgtgactttcactttttaaaagctttgttctgacccatgaaagtagatccgatctgcctctgtagagggagagcaggcttgtccaacccacagccacatgtggcccaggatggctttgaatgcagcccaacacaaattcggaaactttcttaggaccttatgagatttttttttttaagctcttcactattactagtgttagtgtatactgtgtgtggcccaagacagttcttccagtgtgacccagggaaggcaaaagactggacacccctgaggtagaggaaccagccttgagaagtgcttgcaagtctctgatgcagatgacaggtcctcagggcaagattttacttttctgggttttaatgtgcagccttgccacttctcccgtgctgcgtaataacttgttttaatttatttttattttactgaacatattttgagtaggagcagggcaaaatatttttatattacattcaaaagtaacaaccaacagctttagtggaggaagaaaaccaat

SEQ ID NO: 102506 - DNA, 1286 bp, Homo sapiens
ttcttagtggaagtgacaagaggggcagaccttcccacgagcggaagtgggagaaggaagcaggccgcggcacaggcatctcatgttgccccacgataacccccatgtttctccccaaccccgcctctgcaggaagagctcgccaacaccattgcacagctagtccatgctgttaacaactcagcggctcgtaagtcctgttgtttcttctccttccttccaagttttccgacttgctagtttaatgggaaccttgtgccggtattgtgtagatgtcaggggacaagccattcctgtttttaaaagctgtgataaacttagtcattgacttggtgagagggcacagtgtcttggggagaatcaatttgacatctcaaagatttcagaaaatgcttttagaaataacaatcctccagaatcttcaaattctgagttactttaacacttggagcctggagagccagatgcagggtccacggtgacctctggatgccaggttcgtcttccccaagagcagagccgtcactggtaataaatacatagaagacaccaccggtcacagactatgaagtaactcctctcaaccatagagaaaaaaaattagttagggtgcttctgtgtcaggcgttgattgcttataaaggaagaaaaaggtagccgacttcgtttgttctgcttaatgctcttcagaaaagcatcctaatgatttcaaccacccccagtggtgctctgaatattagctgactcatattgaacaaaattctacatatgatgtataatagatttacaaagatgaaaaaagaattgtgcaaaaagaaataaagccaaaaaatcaacaaaaattgtttttgaataaaaaagtgctagttctgtgggtcagaagagaaaaattcagtgttttgtaccgtagctcacccagatgccacctataatcagacaaaaatatgagtttctatatggattatataagtgtcagaattaatggttttgaactgattgtgaggtaccagtgcagtaggaagagttactagaagtggaacaaggagtcttgattttaaaagaaacgtggctttgcagtggataaaggaaaaatgctccagagagcgctcaaatctgacattgcaatgttgccagcccttccggttattctgtttttatttaaattcaaaagaccaaggccaggcacggtggctcacgcctgtaatcccagcactttgggaggccgaggtgggtggaacacctgaggtcaggagtttgagaccagcctggccaacatggttaaaccc

SEQ ID NO: 102507 - DNA, 1586 bp, Homo sapiens
ttagtgtgaaggaagaatttgaatgtgtcctggaaagcttctctgttttggcttttgcagttcttaaggatgagtttggggagcattagtgaatacgttgggtattttttgagacagagtctctcttgctctgctccccaggttggagtgcagtggtgcgatctcagctcactgcgacctccgcctcctgggttcaagtgattctcatgcctcggcctcctgagtagctgggattacagacgcgcaccaccatgcttggctaatttttgtatttttagtagagataagggtttgccatgttggccagggtggtcttgaactcctggcctcaaatgatctgcccacctcagcctcccaaaatgctggggttacaggcatgagccactgttcttggctatgaatatgttttttgatctagaaggtaaatatgactgttgtgaatatttttttacttttgggatccaggccataacaatttcattggtcccttcattctgctgagctgattaatatttcttacctttccttttttttttttttttttttttttttaaacaaaaattgcctttctttagctgattcgtctggtcctgaggcagtcctttgaagtcttgaagcgaaatggctgggaagaaaggtcagtaaaccatttgagttagcatgtggtagccttaaaacttaaaaggtagtagagtgtcaagttttctgaacttgtagagtaccaatgagaagctcgatacatcgttacctatagagaattgaaatccagtagaaggcataaaacagttaagtatatatgacagttaacattttatcctgatttaagtgattgcttttttccttgtaaaatgatttcagccttgcattgattgttaggctgtgtaggttctagacggagtatttttgtttctctttgggaagtgggacgtgttggcatactgtcattcacagaagcatgcgtttggttctttagccgaatcaaggttttcttggatgtcctgatgaaggaggtcctgtgtcctgagagtcagtctcctaatggagtgagattccacttcattgatatttacctggatgaactctccaaagtcggggggaaggaggtaagcagctgccgacaggctgcccacggggtgagggggccgccagtgttcgcagtagtcgccagtgaagtgctgtggggtggcccttcgcatgaccagcgactgtagcagcgtgaattgcttcagtcctgtctgggaatgtgtcctaagcagctggtgggatgggatttgtgcactgaggatgtacatgacagtcttacctgtaaaacggaattgaaagcaacctacagactccactaaagaactcactaacacgggggagtactcaggatctagggagctttataaagcgctaggaaaagctatgcaaatggtagacatttttaaggtatatactcataaatagacaaaaggctggaaaggaaacatacattttttagtatgcaaatgattctctgaatgtgggaatgtgcacagattttacttttctttcacaggtgttttgcagggaacatgtatttttttgattaaaagaaaatatgt

SEQ ID NO: 102508 - DNA, 1037 bp, Homo sapiens
aggacatgtcaagaagggaaaggctctttctcaatttttccctttttctaaattacagcttttagcagatcagaatctcaagtttatcgatccattctgcaaaattgctgcgaagacgaaggagtaagtgattcccctgttcgttcctcctgctccgtggcatttgctcatgggagttacttgccgtcgtgcagcctggcacagggtacccaggacactgcttcacagcagagagcggctggagaagacagccgaagctttgagcagtgatttggctcttctagcttcagtatttgcctcactcattccaggaatgccctcccacacccaaagatctgaccgctgggcgtcccgtgcctgtcgggtggcacttaggcagttcctctcagatgcttgctggcccgtgggggccactccagaccacagcaacgtgtgcagggcttccctctgtgcccctgaagccagaaggccaggccgtttgttctcatcacatgctctccgctgtgcttctaccctcagccacaccctggtacagaccatagctcggggtgtcttcgaagctatcgtagatcagtctccttttgtgcctgaagagacgatggaggaacagaagacaaaagtgggtgatggtgacctctctgctgaggagatacctgaaaatgaggtatccttgagaagagctgtcagtaaaaagaagacaggtaggaggatgttcttggtcagtgtagctttctttctgctaaaatcctcctcagacaaacagtttttaatacatttgttggcatcttactgaatgcaacctagagttgatggctctgcctcagcccctcccaagaaaggcagcagaggtgggttcattgtgcctggggggtgcctagcggggctctggggagacctgagatctgtcccatgtggcatacacacatttctgtacctctcaggatctcaggactctcctcgaggattttaccattgtcactgctagtgctttttgtttgctttgttgttttttgtttgacacgctaacaccttagcat

SEQ ID NO: 102509 - DNA, 1095 bp, Homo sapiens
tgtgtttataaacggacagaaggaaggcttccagtcacagttggggatggaggaagtgggaccagacgacaaaggtagtgggcgcaccaagtacctcaagggagacaggaactttcctcgtggtagaatgtcaggaaattgcgtccgccagtcatactgtctgagaatcgccagcaggactctggcccagctggcactgggtgcttgttgatgggtttctgtctttttaggaagcagagtcttttgtgtagaggaagaggacagtgaaagcagtcttcaaaagagaagaaggaagaagaagaagaagcaccacctgcagcctgaaaatccaggcccagggggtgcagccccatccctggaacagaaccggggcagggagcccgaggcctctgggctgaaagccctgaaggcacgtgtggccgagccaggtgcagaggccacgtccagcactggggaggagagtggctccgagcatcctccagccgtccccatgcacaataaaaggaaacggccacggaagaagagcccgagggcccacagggaaatgttggaatcagcagtgttgcccccagaggacatgtctcagagtggcccgagtggcagtcatcctcagggacctagagggtccccgacaggtggagcccaactcctaaaaaggaagcggaaacttggagttgtgcccgtcaatggcagtggcctgtccacgccggcctggcctccattgcagcaggaaggccctcccacaggccccgcagagggggcgaacagccacaccacgctgccccagcgcaggaggctgcagaaaaagaaggcagggcccggcagcctggagctctgtggcctgcccagccagaaaacagcaagtttgaaaaagaggaagaaaatgagagtgatgtcaaacttggtggagcacaacggggtgctggagtccgaagctgggcaaccccaggctctggtaaggtgggagcacccacaggccagctcgccacagaggcactcactcgcgtccatggggctccactgcctcctgagaggaagggtgggggctggcggccaggcctctggactcagcagcagttagaatagggtgtgttc

SEQ ID NO: 102510 - DNA, 1072 bp, Homo sapiens
ctcagcgctgctccctcactaagagggccagagacattgcctttcttgctgtcgtctcaggcccctggcagcctattgtaaagaggatggggtgttgctcaataagtcccagggtcaagggaagctttcccctgccatctgtcatggcacagggaaggcgcacaggagaagctcctcgggcttccctgccctccaggcggcacacttgaacctgccggagccacccgtgtgtcggcagcggcactgggctgcccacacctctgagagccaagtacgagacccggtctctctctgggtggctgtcagttgctgcacacgcaatgagtgtcctgggcctgcctgtgagggacccacagccccacatgggcatcactgtcctccacaccagactgccagcgcagtgacgattcagctacaaatgggagagtcgatcttattaacagatcggctttgaaaggccaaaatccccattttgaagatgaagataaaagtgggtccttactctgacgaggcgttttcatcgcccctcttggcatggtgccatgatagcggtcgtgttgtgcgtgaagcctgagctctgccgaatggaagggctgtctgcaagtgcggtgcggaagaccgcgggccgtcgggtgggctggatctgcctggggctctgccttcccctcctgtgtgtgtgggcagcacaggaggctctgtcgtctgacccctcctccgcttctcacccctcgctcacgtagggaagcagtgggacttgcagttccctgaagaagcagaagctgagggcagagagcgactttgtgaagtttgacacccccttcttaccaaagcccctgttcttcagaagagccaagagcagcactgccacccaccctccaggccctgccgtccaggtacgcaccctccccagagtggcacagcacatttcaccacaagggcacagatgggcttgagctgacagtgcttcccatgccgggcctggagccccactgtggccctctgagcctgtccacagtggacaggttccacggccagggtagcataaggtctgagtggtctgggacccaccctg

SEQ ID NO: 102511 - DNA, 1041 bp, Homo sapiens
tgtgtccattgtccattgcagtgagattccatcataggcatcgtctcatcgatgtcatagagtcttcaagttagaagttcagaactctccagcaaaaggcaggggagtcttggcatttttcctcacgggttctcagtggtgaactgtttttaggacagttcaggcatcctctctgtttgcctttcttccctggatcgtagaaccctgcagcggtaatgaggcagtgaccgcagatgggccaagagtgtgggcaccactgaccctgggctggggggttgcgtgtgtgggacgctgggaaggacaaagggcggtcctggtgaagccccgacaggagggtcggtttcagtcttggccgcagtccctttggcctctccctatatgtgccactcagtaagcagcagtgtgggcggcataccctccagggcaggttctccagaaaaatctgactaagcgcctccactgcacttgcgtcactccttttgttcctgttatttctcttctgcagctaaacaagacaccatccagctccaagaaagtcacctttgggctgaacagaaacatgactgccggtaagtggggttttgccagcggcaagcttctctggagcacagctgcagctcctggcgcggctcgcagcctggttccacaaggcggtcggggaagaggggggtcctagctcctcactgcccatttctttatttttattttttttttttttttgagacagagtctcgctgctctgtcacccaggctgcagtgcagtggcgagatcttggctcactgcaacctccgcccccccaggttcaagcgattctcctgcctcaggctgccgggtagcgggtagctgggatcacaggtgcacgccatcacatccagctaatttttgtatttttagtaaagatggagtttcaccatgtcagccaggctggtctcaaactcctgacctcaggtgatctgcctgcctcggcctcccaaagatctgggattacaagcgtgagccaccgagcccggcccctcactgcccatttctgagtcagaagg

SEQ ID NO: 102512 - DNA, 1093 bp, Homo sapiens
gaggcatgggatgtggcctcactgccctcctttcctcagaaggctcttgggcctgctctctgcagggccttgagatggccctgcttcgtcctagcaagtgggtggggtcggcacccaggcaggacgctgtctaaggtgttgaagggacagctgtcggacccacttaatatggggccttgctctcatttgggacagaattcaagaagacagacaagagtatcttggtcagtcccacgggcccttctcgagtggccttcgaccctgaacagaagcccctccacggggtgctgaagacccccaccagctcacctgccagctcacccctggtggccaagaagcccctgaccaccacaccaaggagaaggcccagggctatggatttcttctgaggagcagcagagtcccttgtaaaagactgcttttgtacagaatgcgctataaattatacctttaagaatgtggggccttttttatgattttgtaagttcccataagttgtgtgcacgaggttctgagagtgcccgcaggctgctgcgtcctggcccctctgtagtggctgcgggcgtcttggttgaatcttttgctacaaaccatgtttgcgtttgagctctccaggattttacatttttgggtaacctcagtgattcccattggtgtaggaaatgagaccctctctgaagctgaggagagcacgttgatctgaactttaaatcaatcagtgctgctggcacaatgaaaggtggaactgcacttctgttgagctctcagttctgcggaatttggtactcattaccgtattcgccgtactaagttggtttctgttagtcttaacagtctgttttcttttaaaagcatgtagggcttcattgccatgttctgtgggtgtttggcaggttaccgatggggaagattcttgtcacagaatcagcaataccatagtttttctacatgtgctcagctgggggtgtggacaggtaggggtggggaaagaagaggctctgcgttctgggggctttttcttctcctccccctacccggtttccctccctgttttcctacctctacggcaagcccaaagtgtcttcccgggagc

SEQ ID NO: 102513 - DNA, 1044 bp, Homo sapiens
gctgggattataagcgtgagccactgcacccggctgtagacacattttttaaaagagaaaaagaaactgtcaatctttttaaataatgtatttccaaaatataatttcaacacgtaattaatattaaaaagtattaagatattttgcaggcttttttttctgtagtaagtttccaaaaccaggcgtgtatgctgatggcacgcgtcgcctggcactctggagtcacatgtggttgcagctatgatattggccatggcgattctacagctaaagccgagaggaagtttgtccagagaacaagtcggggtggggatctcagtagagggaaccgcacctgagtagaggcacaaaggagggaacagccagtgcagccaggatgtaggggggctggccagggacggccatgggggccgtgggggccgtgggcagggtttgggctttgtcctgtgcacacttcaggagccactggagagcacccaccaggcagcaggggaaggaagggtcagaggcccggatggaccagaggcgggagggcagccaggcctggggcccacacctgggctcagcgggcaggatcggaggaccggcttctggttgatgtggggagggcccagggagaatggggaaaagaagacagggaggtttccagagcgtgtcggcctctctcctcgtttcctgatccacctcatctccatgggcacgttttccttctgagaagagctgggaagcccgtcagcaggcgggcctctgtcctcacctccactaacctggcccttgcaggcgtcccaggcttccagggccagccccctggggtttggcaccctgcagcctctgactttctcttcactgctcctttgggagcacgtgccagaagagacactgcctccgtggctggcacggacgacgacgcccagcaggcagctgtctcaggaggacaggcccagctgcaggaaagggcagccccgggcttctggcaggggctgaggcagggaggccagccctacctgggggctggaggtggcgttgagtgggggtgtagggggt

SEQ ID NO: 102514 - DNA, 1105 bp, Homo sapiens
agctgtgacctccttgccgctctatgtttggacatgggagccttgcaggcacacacataggcacaaatgcacatacacttgggcacaaatgcacatacgggcacacacgtggacatgggcacacataggcatacatgcacacatacacacgggcacacacaggcatacatgcacacggacacatgcatacacacggacacacatgcatacacgtgggcacacgcacacacatgcacacacactcggatgcgtccaggtacatcctagttcttcacgccgtcgttactctcgggagtttcacagcgacccccgaggcggcctgaccgtgtggccctctgagggtgcagtctttccctttcccttgctgcggtgatggggaccccatgcatgccctgagcccccacgtcctgagcaaggccaccttgtgctctgcccctgtgaccctccctgccgccgtgcccaggaggatcagggatgggaggctggccctggcagaggagcggcagatctcagtgaccttgcccatcttctccccctagggaatcccgctggctccgtggtgatggaacgcatccggatggacattcgcaaagtggacgccgtctttgtgggcactggggacctgtttgctgccatgctcctggcgtggacacacaagcaccccaataacctcaaggtcagccacacgcaccgctcccctcctcgcccactcccacggcacctcatggggagcaggatatgagagtcctggtggggggtccctgctgagctgacagggcatggccctgagtgctggccccagttgtgggggagggcagtggccaggccatgacaggagttgcgcctgtcactctcacatcgcctcccatctccccttatttgggacctagggatgatcagagtctgtgagggcttgggtgacagatgtttcagaacagacccatgggggtcccaccaggattcagatgccacccgcttggcgttggcgcagggctgtgggatgcatggagctgttgtgtccttggtgacttgggggctgctgcagaggagtggcaccctgcagcatttcccacagtgtgaccacggcagtgacctgagggacgga

SEQ ID NO: 102515 - DNA, 1042 bp, Homo sapiens
gtgggccctggctgccactaccgtacagaggccgtgtcgcgctgggctgggcctgggtggcctctgtctttgcatctctgagaaggagtcgggtggtaacggttggggtcaggaagaattctgccaagtatctttactgtcattctgaccatagcctctttgttcccgcattcgaacttttggttcttactttgctgctcgtttagtccctggggatttcagatcttaggctgttgtttcaccgtatgggagggttgatgtgagcttgcttggagacacacggtgcagcatcagggaccttcccaggccccagcaaattcaagtcggtctgcagacctctcagctacccgcgggacctcttgtaacccatcggcatcttccaggaatccgccgagtgacttgaggaagatgctaacgcagtaaggtctgtgctgggccaagagcagctttgaagctccagagaaccaccccgtcaggttccttgtggaagctcccctcatccgtggtgcagcaggctgagcactgcgcgtttgccacgtgctgcccgtgacagcacattgagccacagcatttgtagacaggacagaggggtgcctgccccctgcccctgctggcacatttaacccttgtcccctgacctcagttctgtgccccaccaaatgcccaggggcaagaggccaccctggaagctgccaatcttccaaggtgggtgtggggcacggtgggggcgggcagctcccaggcccttgggcaggctggggtgacggcagaggccacagcaccagctctgacaagtcctatcatcctctgctcagcagtgacctccctggccccactttgcccagagtttggggtccccccaggtatagctataggcggcagtgcctgtccctggcctgccttgatttcagccacacccctgcagccctgcatcccagctctggggtgtgcagaggtttgtgtctccagggaacccacggctggagagaaatagggagatgcaggaagtgggggcccatggggcccccaagaagcggactct

SEQ ID NO: 102516 - DNA, 1020 bp, Homo sapiens
gtagtctgaatgcctgagttcactttcttcttttagtatttgagatatattacaggagagtgcagaagccctcagtataatgctggatgaattatcaccaacagattaaccttgtggccactgtccagcttaggaaaccgtcaaggttcgcaattttgaatttccaaaatggagtatggtgcctgataccttgtagatctcagtcggttttactgtgtgcgtgaagtagcagttacctggagtagccgcatagccacaggcgcggcaggttctgggttagaaggattgtttgaaggggagggccagattctgccccccagttgcctttaccgtaagtgggactttggtctcattcaggcagtcacgtttctgtggcttcctttctggcactcgaaggtgtgggattcatttggtccaaccgttgctgttttgatgcaggtggttttacgcacgacgagctgctgaaggtgtggaaaggactgttttattgcatgtggatgcaggacaagccactcctccaggtgagtggggggagcagcagagcaggtacagaagcagcgggggaggatggatgggcatctggtcaacccagtttttcttttttttttaagtcggagtttcgctcttgttgcccaggctggagtgcagtggctcaatctcggcttactgcaacctcagccttctggtttcaagcaattttcctgcctcagcctcccaagtagctgggagtacaggtacctgccaccatgcctggctaattttttgtatttttagtagagacagagtttcatcatgttggtcaggctggtctcgaactcctgagctcaagtgatcctcccatctcggcctcccaaagtgctgggattacaggcatgagccaccgcgcccggcctggtcaacccagttttaatatggccagagaccgtggggaggtcgtatagccttgacgcttggttcggcacggctggtgggcctgggcctttgttaggtgagtcttacacttgctgaggtgttgatgtg

SEQ ID NO: 102517 - DNA, 1061 bp, Homo sapiens
tgggccatattccatgcccactgaattatcaaggggaggctgtgaaatgtcccttagcaagtattctgggcgatggctggcacggtgatgtaggcagatagccagtgatctatggggtctcgcagccctcttcctcctgatggttagggggctgtgagtcccaaggctcccttccgctctcccacgtccctctttaaccgtgactctgtggcttagggcacagcctctgtcaagagggcagtgcctgctgtggttgtgtgagaggctgttgaccccagctgtctagaggggcctcccgtggttgtgtgagagcctgttgaccctggctgtagaggggtcttttggagcaggggtgaaacctccagtgcactgagctgagaccccctggaagccgactctctgtgatgagtgagtgagtgagtgggtgagtgggtggttgcgtgtgtgtcattgtgagagcctggtgcttcaggggctgagggcgtttttgttgtttcctacacaggaagaattaggaaggactatttcccagctcgttcatgcttttcagaccacggaggcgcgtgagtatgctctgctgtagttgggtgcatttgtagatgtcagaacctctgagcatcagagccaccagacccaggaggtttgtgttctcaaatccagagtaaggaatgcctaagggcaagagagcgccagctggtgtctgtgggtgcttagcatgtgtgcagtgctggtgtaagtattcaacatggattagctcatttacccaaaaccctcatttcgagcctaatgggctaatatcttacactttaaaaataaagtgaaaagccaggataatgtcaccaagagattggactgaattccgcctgatggtcctgaggttcctgcagttgatttttctgactcctctgttctctggtgaccggagttgagaagttcttaccctgcctgtctgtaggactcacttgaggagcctctaaaaatcctcatgtccagatcctggtccagcaagatccagttctgggggtagggcctgggcatcagcattttttatctatagctat

SEQ ID NO: 102518 - DNA, 1731 bp, Homo sapiens
ggctcatggtcctcggcccctttctgggcctccaccttcctttctctgcctgtgctgtcctgacgtgtcttccccagcggtacccagtggaggcagtggagaggaacaccaggcagggcgtctcgtctcagccaagcctttctctctgctagcaatcttgaggacagagggaaggcctgtctgaatgtttacacgtgctgcattttgtagctgacatgcacactcaggccatacgttctggtggtggtgctggtcacataactccctaactgcaagactgccttgcgctggaggagacctaggatcgttgatatcatctgcgtggactttaaggctggcatgtttgcagacagtggcgcctgcccgcacttaggttcccatcagagcgtgtaaccatgggagagtggggggcacggctgtcttggggctcatcgaggctgcctgtcatgtttgctttttctttcctcagacagatcgaggagctgctagagctgctgatgactgagatcctgcaccccagcagccaggcccccaacggtgtgaagagccacttcatcgagatcttcctggaggagctgaccaaagtgggcgccgaggaggtgaggctgggctccgacggggcggtggagctgggcgtttgtggaggaggaactgagctcccgctggctttccccgtagcttacggcagaccagaacctgaagttcatcgaccccttctgcagaattgctgcccggaccaaggagtaagtggtgggtggcctgatcgggcccgactccttcactgagttcttccatggggctgctgttgtgggggtgctgctccctcgagggatgaatctgtctcagagtggccgctggccgtgtgggtggggagaggttgcaggggagtcggcggcttccgcttgggaatccagcataacgggcctgctcaccggcctctgctctgcccctcagttccttggttttgaacaacatcactcgaggcatctttgagacgattgtggagcaggccccgcttgccattgaagacctcctgaatgaactggacacacaggatgaggaggtggcgtcggacagtgatgagtcctctgagggtggtgagcgtggagacgcgctgtcccagaagaggtctgagaagccgcccgcaggtgggggtcacactgcgcctggcttctcctcggggcctgtcctgggctgagccagtgcgatctcctgctgggttgctcctgccacctcctacctggtccccttgtctctgcccctctccacagtccatcctcagcatagaagccagagtgacttctgtgggcaccaagcacacgtcgtttcccctcatcccccagcctctgatgtgctccacgccctctccggacccctgggctcctcggtctaacgcatgcctctggctcagttggccccctagactcgttcctgccttggtgccgagtctctccgtccctcccaccgtctctccccccatcactctctggggctggactctttcagcctcctggcctctcccagcccccaacgcagtcctccccatagcgtcactctgtggcacgggatgtgaatcacttgctcctcgtgttcctcgttcctggcccgtctccccagaggacagcaagctctgtccatattgaccatgactgggttcaggcctgagacctcagggcacctgactgctctgtgtgcagtgtgtgtgaggggcaggtgtactcacctgcccct

SEQ ID NO: 102519 - DNA, 1065 bp, Homo sapiens
tcagctggttcgtttcagctgtggcgggtactgaacacgctgctcctgggcattagaacagggcgctttctcacacacattgtcaggaggtggtgctggctggggcctgctggaagcagcgagcctcaaaccataagtccccagcccccgagagccccctgacttctgccctggttctcaggcattttccctgaagatgagatcccagagaaggcctgcaggcgcctgcttgaagggaggcggcagaagaagacgaagaagcagaagcgtctgctcaggttgcagcaggagagaggtaggactagggggtgtgttagtcatggagccggcgtcctcacctgcttgcttctcccctggatgggggtcacctgcagtgtctccccctgaagcatgagtgccgagtcccccatcctgggtgcctgctatccacgcatcccggaaatgccctgtcctcggcatccctcctgtaggcctctccctgcctcccccacccaccttccttgtctgcagctcccccgagctgtgtgcgctgccctccctcccggtctggagacatcctcctggctgggctgcctccttccgtgcctccgtcttagatccaagccccgtccgctcctctcccgcaccctccagagattcctgagtctctccacgtcttccttccccttcttccctccacttcttccctccacttctgtccttgatttctggggctgccttccgtgttgggcctctggccacacgagtgtggttggcatgtgatgccctcaccaggggcaaccctgggtccgcggcagaccactcagggcctggagctgcctacctgcagtggagggggttgagcacagtgccgggcagggcagggggcccatggcaagaatggggtgcagaggaggcacatggtggctttgccccacactgggaagccttccctgttactctctccatgctaaactggccccagggcctagggattcaccccttcccttgcccagagctccgtgccattgaagccgtccatctcatttcccatgaggcagtggcctcctctttgtagccggccct

SEQ ID NO: 102520 - DNA, 1006 bp, Homo sapiens
cttgtttgacctcagaatcagaattgacagcagagttgtcatgaggataaaatgagatacaaatatgaagcacctgtcactgtgactgcggagggacctggcacccatcactgtgactgcggagggaactgggcacctatcactgtgactgcggagggacctagcacctatcactgtgactgcggagggacctagcacctatcactgtgactgcggaagggcctgggcacctatcactgtgactgcggagggacctagcacctatcactgtgactgcggagggacctagcacctatcactgtgactgcagagggacctagcacctgtcactctgaccacggaggggcctgggcacctatcactgtgactgaggtgggaactgggcacctatcacggtgactgcggaggggcctggcacccatcactgtgactgcagagggacctggcacctatcactgtgactgagggacctggcacctatcactgtgactgcggagggaactgggcacctatcactgtgactgcggagggacctggcacctatcactgtgactgcggaggggcctgggcacctatcactgtgactacggagggacctaggcaaactccagctcccccgaccagggctgtgtgcgtggaaacggtcctgccatccacgaaggaagctttctccttggggattcagtagacagatccccaggcgtggacaattgtcacagcatgcaccagcccagctgggacacgcacaaacaccagacggtctgtaattgaactctgattaatacacacagcaggcagcctgctgagaggcaagccatttcacagcaaacccggcaacagtttattttataacctatataatgaagaggtcgtggtttaagtgaaatttaaaaatgtctgtcctgaggaggagggttcagttcagatgtgcacgattcccctgtggcccggctgccaataccaactgcctgcacctccaacagcccccctggatgggtgagtgcag

SEQ ID NO: 102521 - DNA, 1029 bp, Homo sapiens
gcggtggctcacgcctgtaatcccagcactttgggaggccgaggcgggcggatcatgaggtcaggagatcgagaccatcctggctaacatggtgaaaccccgtctctactaaaaatacaaaaaaacccagctgggcgtggtagcgggcgcctgtagtcccagctactcgggaggctgaggcagaatggcatgaacccgggaggtggagcttgcagtgaactgagattgtgccactgcactccagcctgggcaacagtgagactccgtctcaaaaaaaaaaaaaaaaaaaaaaaaaaaaaaaatatatatatatatatatatatatatatatatttcactgagccattactacagggaaagttcctgtagagctgagcagtcaagacgtgtgacttcaccaaggaccagcacagagttcaaggctgccttccggctgtttgactgaacaggtgatggcaaggtccttccagcccctgtgggggcgtgatgagggccctgggccagaaccccaccaatgccacggcgctcgaggtcctggggaaccccaagagtgatgagatgaacgtgaaggtgctggactttgagcacttcctgcccctgctgcagacagtggcagggaacagggaccagggcacctaagaggattatgtggaaagacttcaggtgtttgacaaggaagagaatggcaccgtcatgagcgcggaaatccagcatgttcttgtctcactgggtgaggagatgacagagagaggaggagagatgctggtggcagggcatgaggacagcagtggttgcattgactccgaagtgcttgtccgcaggctgctgaatggctgagggtcttgccagcctccccagagcccaggcctttccctgggtgacatttcgtatctagcctgaggctccctagggcctctggttgcagcacctttcccatcttgtctctcttggatgatgtttgccatcagcattcaccatataaacttgctctctgtgtacccctcccacccaaaaaaatttcaaggctgg

SEQ ID NO: 102522 - DNA, 1081 bp, Homo sapiens
aatggcttctgcttccacgctttgccccccctctctggccttgtcaaaaactcttgtgatgtccctgttataaggtatcgccggtggactggtgtttctagatcgcagcgtgggacgtgattggctacatttgactgtttcctttttaatgacttgtttaatgtgagatctttagctgctccatctcattgcaagatttttgttacagtaaagttggactgagttttctaaagacagttgctcagaaatttcatgggaatttacttttggttaaccgaagagtgtttggggttttaaacgggtcgtttcaagtggtaaagtaacatgaccacgaggcgtctgtccttcctaaaaccacttcatcataatttcaagattgattctaaattaccaatttcaaagcgctgcattttaggcaagtgcattaatcgttcaccttctgacaggctttcatgtagtcatttacaagcggccatgttttgattatctttgtcaagcaaagtgcaggagacaggcagtctcataaccttggggcagtgtctgtgtttagttttggaggcgggaaggccgagttgatggtgaaagttggccattctttctgcagggccaaagtctgtacctggctattagggtgcatggatgctggggttaaattggccacgtcttttcccaagcctaggtagaaggattgcagataggatatgttttaaatgttactggtggtgaattgaaagcaacacaactatccttcagtgtgtgactggcagaaatctacctcctggctagcgtgccctgtgtcacttaagactcaaagtggagctgggtgctcttggtgggacagtgtgcctgcagcccagaggcctgtccccagtgactgggaaggctatgcatcattgttggagatggtctcgattcctttctgaaagcgggtagagaatgaaatgcataataaataacaataatgatgaattataaaatgagcagcagtaacaagctgtacaaggaaatacctgtcctgagatcgattactcacccctgactgtctgccctcctgattctcagccaggtgctgggagctgag

SEQ ID NO: 102523 - DNA, 1073 bp, Homo sapiens
aatgcaggctgagtggaggccccggccctcgccactctggagcgatggctatttcaggctccaggaggccgctgagtggttcccgggctggccctgcattgcggctgggcaggggccacacgtccctcccccgtgggccctgggtgcctggaatctggagcagagagagagagggaaggtaacagcgtggcctgtacatccctgcctgcaggcgctggccttgctgtccctgggtgctgcctgtgtactccagggcactctctttcctggagaggaggccgcgggagtcatcgcggggcagatcctggaggccagcaaggccgcccctcctcctaagtggcactgattgacaggggagaaagacagaggcttgttccccagaaaagcacagaaaaccagccttgttcctcagacaggagatgcatgtgccgggaggcaggcagggggacggctgtgctcggcctctgtgcagtgggattattagggacaaattccagaacaaaacttgggtttcatctaagctttttggggatttggggaaagcagaagaaaagagggagcccaggaggaggtcaatacaccgtgccaggaaatgaggaaaagctcagatgtgcagtgtcagcgcttttccatgaatcacctcttacctctagaacagcaagtgcgggaggtgtccaggtgcgggggggccacgtgccctcaggggcttccctccccagcccgcctggagacatcatcactgactcagctccggcaggcaagggtccctcggggtctaccactgggattgacgccagcaagtcggaccctttctcagaagcccagagggagggcagagccgtagccacagtttggaggcatctgctgggctagtgcatgttttaacagcacctatgacaaggtgaggcagcatgggtggccctgcaggtggcggtttgcatatgtgcacatccagccagctccgttttccagtctggggactatggtgacaggaagtaaaaagcctgcgatttggcctacggggtcccagggtcatcccggggtcgcaccttggctaccaggcttgagggttc

SEQ ID NO: 102524 - DNA, 1019 bp, Homo sapiens
tgtgggatgtggcgggtggccggggcagtgctgggcaggcaggtgttggtattcacaacgttgctttcttgaccgattattttcctgggagacttcctcagtcaaagggttgatatgcttgcgagctctcgatgcacgctatcagattctccaaaaacgtacagccagcttcgcctgcacctgcagcttctgtgatttgtgctcttaattgacgtggcgctttttttaggttgagtcgtttttcattgccaacaatcttctcctgcattgaaataatagcttgtaaagaagcctcacgcttcctttttctctgttgactcttctaggacgcgctccaggagatatataatcagaagggcatgtttccaggggagcagtttaagcctgcccggaggccgtggaccctcctgaacttcctgtcctgggccaccattctcctgtctcccctcttcagttttgtcttgggcgtctttgccagcggatcacctctcctgatcctgactttcttggggtttgtgggagcaggtaatggacactgtcgctaacagctcacactctgacgggcctcacagtatcagccacagggtccgggacctggtgactcatcacagtggctgtgggaggcaggggcctggctgttatggaccctggagccaggatccccccacggcctgcgggcctcagagcctggattcttgcactgagctgagggtcgcctccccagagagccgaacggccgccacctggcgccatccccactgcagccccactggctggcgcccttgaggatgccgacgagagggtccccgagagggtccccagcccccctgtctgcttttgggctcttaggggtcaggctgggctggccattcgggaggtttaagcaggacatcatcattcagctcctccccattgacccccagtgacttccccactgtgtgcccaccccaggcacaatgccaggcccaccacgactcatcagctagcctggggccgaacagacacccagcctgtccctg

SEQ ID NO: 102525 - DNA, 1049 bp, Homo sapiens
gccgcccctgccaggggccttggtgggaggggtcctgagaggcagtgactgccaccagcctctcccattggactacgagatgacttgaggccacccacagaggacaggatgtgacctgcttacatccgagggtcctgctcgtccacctctgtcacctgttgggtttgcaaggccgagctgttagaatgccccgaagcccttctgctcccaccagccaaagacccagaggggcaggcagggcaaggtccacgtgtccacctgcctcggacccagccggtcagaagacgtgcccctcacccctgcctgagcagaccacggtctgagagggctgtctccccgcgggccacacctactcactgacagcagaggccactgggtgcggggcagagggacagggtctggggcagaggaaggaagccccagtaacacgttttacagcaaaaaggcaaagtcatccgtctcacctcttctctctctctcctgtcttgaaagcttcctttggagttcgcagactgataggagtaactgagatagaaaaaggctccagctacggaaaccaagagtttaagaaaaaggaataattaatggctgtgactgaacacacgcggccctgacggtggtatccagttaactcaaaaccaacacacagagtgcaggaaaagacaattagaaactatttttcttattaactggtgactaatattaacaaaacttgagccaagagtaaagaattcagaaggcctgtcaggtgaagtcttcagcctcccacagcgcagggtcccagcatctccacgcgcgcccgtgggaggtgggtccggccggagaggcctcccgcggacgccgtctctccagaactccgcttccaagagggagcctttggctgctttctctccttaaacttagatcaaattttttggtttttaatcagttatcttgggaacttaacctggcccctcacctcttctgcaccccccgcccccgaaactgtctcgtaatgaatttctgctgtcctcctgggagtggacggccgggtcccgtcccccgggagc

SEQ ID NO: 102526 - DNA, 1027 bp, Homo sapiens
tgtgcctgcccctttctctactgagctagtccccaaaccaaaggcaagccccctcgggcctcgggggatggggccggccacacccctgactccgccctggctctgccccatacccctgccgtggggccgacctgggggatgcagacatccggctccgtattcctgcctatcggggccaggatgcaaaaacaatttttgcgtaaaagatgtcacactgatctgctggagtggggtggacacatgaattcagttttatcatgaacactcgccactggctgcttgttaattcagggataatggtggcattcttacaaactgctcgggaaatagaatgacgggaacacttttagggagcccaggaagttaccagggacattggtgtcgccggcccaggcaacagcagcgtacgcttttcaaagatcattgagttgtcttagaatttgaagctgtgtaatgacaatgtcacctggagttcgtctccatttcttaactttttgttgcacaagtatttggacagaagtcgaactgtgaatgagatactgaaatgcactaaattgtattacattaaactggagttacttgatacaatgaagaaatgcatctgatctacttgtatttattgtctcagaattgtacgttgtgacaatcaaatgttacttgcctaaatgccaggaaattcaactggccttttaatcagcaagatcgccagcaagtactgtaactgtaaaggaaaatctctctctctggagaacccacacaaaccattgacctgagtgcgcatgacagccactggcttctttttctatgattgaaaatctgccatcgctgactgttggccagtttcaaagggacccattgtatacagggtgcaaatgtattatacggatgtttccttttgtacacttcatttttacaagttttgctactcacaagctttatgtagtggaggatagaggtatttttggtctttagaagcttgtcggggtgagggctgctaacttacacttcagaggcctgtgtcccaaag

SEQ ID NO: 102527 - DNA, 1029 bp, Homo sapiens
aggcagacacaatgtcccaatacataatttaacaggctctttgcagcctggagacgatgtaatgggttaccaggaaaaaccatttgagttcaagttccagcaacttttcaaaaacaataaaacaaaataaaaaacaccccaaatgctgcctcatgaaaaaaggtactaaaaaaaaaaaaaaaagaatgaacatcgattgacaggactagcatcatttcaccatgattcattaaaagaaagtgccaaaccagtgtttgtgctgaattcaagcattttctaaattcccaagtggaaaaaaaaaatctcttataggtctgctcagagggaaaataggcttgcagtccacttactgcccacgcaccaaaggctgcctggaccagagccggtgggattggaggaggggattctgcctttgcctcccttcctccagaaagaacactccctaacgtgggagcccatccagccgcacaacgctgtgtccacgtcttcgggaaggggaatggctagtgtctgtcttctcagagcagctggactcagttctctgtgagaacagtacaaagacatagatattcctcggcttggagtctacacttggtattgtcgggtttttattttttatttacttattttttgttttttgagacagagtctagctctgttccccaggctggagcgcagtggtgcaatctcggctcactgcaacctccgcctcccgggttcaagcgattctcctgcttcagcctcccaagtagctgggattacaggtgcacgccaccacgcctggctaattttttgtatttttagtagagacggggttttaccatgttggccaggctggtctcggactcctgactcctgaggcccacctcagcctcccaaagcactgggattacaggcatgagccaccgtgcctggcctcgtcagggtttttaattataaatttaaattttatcgatttgagtacatgtgaagtggcatctcattttcattttaacttgcatttccctgatgtctaatgagcgctgagtg

SEQ ID NO: 102528 - DNA, 1019 bp, Homo sapiens
tacaggcgcatgctgccatgcccggctaattttttgtttgtttgtttttgttttttttttttttcagtagagacagagtttcaccatgttggtgaggctggtctcgaactcctgaccttgggttgtccacctgcgcagcctcccgaagtgctgggattacaggcttgagcccccacccttggcctcaagcaacatagtgaatgttaatctctgcatggatggtacactgtcctagaaggtgcaaactttcattcattggagtctcagaagagaagggggcttcagtagactgtcaaagttaacttgaaaaatgatcactttaaaagtgaaggtaaaaagctgacttcatacttcccacttgaaattatgttgtggtatatctgggactgaagctttaggaagcacttggcctggtttcactttatgccttcatcttgctcctctctttcagctatacatgttttgaaaggagaaggtggtatgaacaattgctttaaaaaaatccacccagaggctaattaacccttaactttttaatattatgtacatagttctcttagtaggcaacatttttgttttcaaaaatcttttaaattcttacttgaaatggtattacctcagatctgttcattttaaaatgaaagtagagtttatgcatgttgtgaattttttttccatagaatgtataatattttacttcagtgaaaatgcattctgcttagacctttctgggaagaatatagaatgtaactggttcaggtgaatttaaaaactgtgtatatgtagggatagaagaatgaaaagttcccaaagattaagggtaattagaatagattattactttaaaacctagctgattatttcacttcattttattattattatttttttagagatggggtctcgctctgtcacctaggctagagtgcagtggcatggtcatagccgactgcagccttgctgggctcaagtgacccctcccttagcctgccaagtagccagcactacaggtatgaccc

SEQ ID NO: 102529 - DNA, 1061 bp, Homo sapiens
ttggataaaatacaagttgttccaaaaatacgaatgcaaccctaaagctttcgtaattaaaactgcactttggacatttgggacacacttttcttcttttatggtgacataattatagattccgttacactgaaacccaccgtcgagtctgtagtggccctggttaaatgcagtacttggaagaatgtattcctgtgcctgtatccttgaggaaaatgaaagattttgtggaaatggagctttgacctgtacacgtgaactgtgtttaaaataattcctagaatgtttctgagcagaatagcgtagttatgatttggggttaatatatgtgctctgaactcatgcataccattacattatttgttgttctatttcccctcttctgatgaatgctgtttagttgttttctcagtgacttcaaacaattgtttacaggtcctatggccgggctccgaagatgattcacctagagtctaactttgttcaattcaaagaggagctgctgcccaaagaaggaaacaaagctctgctcacgtttcccttcctccatatttactggacagagtgctgtgtgagtaccagcaggggaagaggatgcgcggtgggatggggttggagatgcgtggagagtgctgtgtgagtaccagtgggggaagaggacgcgtggtggggtggagttggagatgcgtggagagtgctgtgtgagtaccagtgggggaagaggacgcgcggtgggatggggttggaaaggtgtgggtctaggctttgttgagccagctgtaatttttcaaatttactttttaacatactctgttataggttgtcccttcattccttggccaagtgcgggacttgctgttgcgtgtttgcgccctggtctggcgtgctgtgctcaccgtggcgccgagcgtggtcgtgttcccatgtctccagtcttgtgagctgtctcactgtgccccacggctgccaggcttagtctaagctgtgtttgatcatgactttcagctttgttttcatgacccctgtgttcccatcgtggctccattgtccttggtcatctg

SEQ ID NO: 102530 - DNA, 1016 bp, Homo sapiens
tagatatttgttcttagattaagttagctttttaactcattggattattggattcagttagctttcccccctgcatatgaaaatacacaccctcatttgttaaaatgagctttcaaagaaggtggtacactttcccactcaaacttattttccttttgtggctggctgggtgtcaaaactggtgtttctcacccactctaacataaagttttctctgacacaggatatcctgtaagttccactaactcaacaggatttggcctgtggaaagtacagctatttgtcacattttttagtctagggcagggcttaaatctcgtgctgaatgtctctacaatgccacaaatacagtttagataagttgaaaataccttattaaagttaaatttaagcatcagttactcagaaaatcacgaattgagagattctgagggccttgtgaagagcccaagcttagaggtttaggcacaagagcagggggtacaagagggaaagaagtacaggcctttctggagttcagagagaccgctgcaccgcgctaccgcaggaagctaactgcaaaactgggtgacgtggtttcaaatgcctgattctttgactctaggccaaggaacctggaacgtatacactcaggcagctgtgcgcctcggtgggctccgtgtggttcgtcctccctcacatctaccccattgtgcagtacgacgtgtactcacaggagccccagctgcacgtggagccgctggctggtgagtggggtccccagcctttgaggaggcgtgctgctggggcagttctgaggagacctgctgagatgccaggcttctcataagttttagctgtgtctgcctttaagagatattttgggtaacataatggaaattttgcctgggaactagctgactgcctcttttgtttatctgaatgtttgctttcctgtaattgctttttcatgtttaataaacatggtgtatctgaaaataagaaacacagaagaattagctctgagagtggaaaaa

SEQ ID NO: 102531 - DNA, 1051 bp, Homo sapiens
gaacaaaactccatctcttaaaaaaaaaaaaagttttcctttgaaagggttgattaaacttgtccgtctggcatggcatttgagaaattcaaagctattgtcctttctgataagttctaaaattggaaggagttgctataaacaaatgattgaagaacatgtggcagctgaacaagagtgagtgaatgtctcctttgttcgggctagcaacgatttatttatttgcctgtttcttctacgtggaaaaaaatcacaaagggcatttttctgttattcccccattccccctatttttctgcatttgtgcctcttgtgtggccaccagcaaaggctgtcagatgtgggacacagcagtcagtctctccagtgattcttccattggaacattgtgtagagaagctgaactcgattcccgcaggggagccgaagcaccagccagcaggccctgccctccccatggcccagcggctgcagtgccaggctcatggcctggctcctgcttcctgcctagtgtcccctgtctctgtccactctccccccggtcctggtatcttgcctgccttctgtcttccctgcagcaggattctcagaggcctcagctcactcctgcctctcattgctgtcttggagtgagggggagccacctgactgctgactgttcttaacccaaaagcccgtggcctgaagctgaaaaatccagagaaggttttgaatatttgagcagcaccagcacagtcaagttttctttacagtctcttcttaagcctcattatgtgattctcttctactactaatgggcaggcaaattttgtgaccctcagagacgtagtcatgatcataatccctgacttgctgaaccaagatgggtataagactccttgactcacaggattcttttttccccagcaaggttctccttcaaccctgtagtccacatcattgagatgaaaagttagggcagaagggaatggaagtagaaggaattcatggagatcccaaaggagcaaatctttcatagtaaaagaaatagagcccctttcaccccattgcg

SEQ ID NO: 102532 - DNA, 1044 bp, Homo sapiens
gtggagggtgaggctgcagtgcagctgctggggcaggggaccctggcacgtgactctgaccttgcctcttctctgcaggtaccgaaacttccgcaccttcacctctccacgccccacccagttctcctgtgtggcggtggatgcgagcggtgagatcgtctctgcaggggcgcaggactcctttgagattttcgtgtggtccatgcagacaggcaggctccttgatgtaagcaccctgaggggctgggctggggctcaggaggggccctcctgtctcctgggagaggagcgcagggagctgaggttacactccgagggcccatgcccctggcccagagctgcccagagagccgcctcggccgccacctccactcttcacgcctccttgctctacggtaggttttgtctggacacgaagggcccatcagtggtctgtgttttaacccaatgaagtccgtcctggccagtgcctcctgggacaagacagtgcgcctatgggacatgtttgacagctggaggaccaaggagacgctggccctgacctctgatggtgagcacgaggcagcaggcaggagcagcggcctggggaccagcagcatgctgtcacacccactgccctgttcctcgttgtgggtttggtgtgaaccttctggtgggaagcagggggtggcttttatccagacctgctggtgtggcagcccttgaggttggcagtacctaggagacagcagattggcgagtcaggccagcgtggcttccacaagtccttgtggggctcccgctctgtgggcaagtacgccaggcaggagagaacagctccccgagggtgaagggctgctgccgcagctgcttcctgattttcggagttgctttggagctctgccagggctgtgtcactgggagaaggacacagggaccatggggggcccagacgctggatgcggccagtcccggaatctgcagactgggagaaggatgagggggccataggtgggcccggaagccagatgcggctgcccagggatctgcagactggcctcaggc

SEQ ID NO: 102533 - DNA, 1878 bp, Homo sapiens
aagcaattctcctgcctcagcctcccaagtagctgtggttacaggcacacgccaccacccccagctaatttttgtatttttagtagagacagggtttcaccttgttggccaggctggtctgaaactcctgacctcaggtgatctgcctgcctctgcctctcaaacaaagtgctgggattataggtatgagccaccatacccggcccagctcctttagatttattccctcttatgggatgtttttagagttcacgtaagtgcattgttccttggacctcctgtctaggcgttcactgccaatctgtagggttgccattggctgtcaggaagagtcctgcacagagggtcctgtgccctgcagatgcgatggggcgcttccttcctttctcatccatttatctttcagttctcctttcctatgtaaagtgatggtggcatcacttttctcctttattccattaactcagaaaattaactgattcagagcgtgccttcctcccctctcgctccacaacaccacatagctctgcagcggtctcttcctaagtgtttggtggaacttgctggtgaagccatctagattgggcccagcggaagggctgagctgccaggatgaccccaaagggatgggatgttacagttgggtccttgggtccttgaaggcctttgctgccccagggctggatggggcagaaccagattgttggggcagggaaaagaggaaaaaaatggctgctggggtggaggaaccggcatgtccagcccctgctgcttttctcaggggtcacagaggaggtggttgggtgcaggacaggccagggcctgggcgttgctggcattgaccatcccctgtgtgattgacagctgtagctggaaccactataacatgcagtacgcactagcagtttccaagcagcggggcacaaaacgctccctagacccgctgggaagtgaggaggaggcagaagcatctgaagatgacagcctgcatctgcttggaggaggaggcagagactcagaagaagagatgctggcctagagccagccggttgcagcgttggattgtgccggctaagacctgccagggagatgggacccttgtgccacctgggccagcaaagaggaggggtccagagaacagctgaaatactgtcactagtggtagtgacttgcttttcctgtgcacacatgtagcccatcaggacagcgagccgacgggtcacgccaggggccggcacgcactggcacctggccccaggagcggggccgtgtgaacggtgatgaatgttgaaaatgcgtctcagagaggtattcacatgaactttgtatgagacttatttatatctttaacataaaggtttgataaagaacttagggattaaaaaaaagatggagttttctaacgtgaggatgaagtctacacttcagattaaaaagggttatgttgtatcctgctgtcttgtgggggctcaagacctgcctgccttaccaccagggcctccgtcctggggaagcaggctgacagagcagggtgctcctgctgtctagcgggggctctgccttgtgacctgtgcatatccttggggtcaggggcacagagcctctccctgacctcttggggatgctttggagtctggggctgggattggcctgtcttggtgagctcactcagacctgcaccagctctgcgtgggccacacggaggaggagacagctcctcccctctgcagtgcccttgggaatagtcatcatgagagaggcttgggtctccatcatggtagggcatcctggtccccacagctcagtaacagcagcctccagggtcaggacctgaggctgacactgaggtgggcacttcaccgactgccagtgctgtct

SEQ ID NO: 102534 - DNA, 1125 bp, Homo sapiens
ccaaccgacagtgaattggaatgggggtgtgggggacgtttggcttggtatggaaccaactgtaactttttgcagagcaagtaagatattaatatacattaggaatttgctcctggtacttagctaaaatcctgtttttaaaaatgtgttaacacaaatctgagtggggcacgttttgaagagttgtctctggttttcccccgtgcaggatcctggtgcacctgagccgtggaggggctgaagtccagatctttgctcctgacgtccctcagatgcacgtgattgaccacaccaaggggcagccgtccgaaggcgagagcaggtgtgggggtgggattggaacttgcttcttgtctacctcccacggtgcagcctttttttgctggcttagcttaaaccaagtcttgtgtgcaaatgaacgtccttctgagcagctgtgctcgggctgttccagaagtaatgctgccaaggctcaggagtgccttccttccagtactcacagaaggactgaaaatggcgaccggatcgcttcccactgagtcaggctgctcataccttggtcttaagcaaaggtggtggttctcagcttggtcgcccaccttcttcccctgtctgggctccagatctgttttgctggttcccagcagcatgtctgttactgcggtgtgtgtggttctggcctgtgtggcctgagatccccttcccttgcctgtcctgcctgacagccctgtgcaggccattccaaggtgccttccaactggcctcggaccacgagaggtcggagctggagattcgaggaagaagccatagctgcctcctggggctgtgcttctcaccagtggggacccctgtgatttcttttcctgcctgggaccctggcttctgcacctggacttgcaccttcggcccccacacctgggggctagcagcttcctgcggtggctggccttcgggttgcttcactggtcctgagtcctggcttcttaccttcccctctgagtcccaccgtcctgatgagtgcacagaattctgtctgctttagacactcggagagacttccatttcccatgggccttgactgcagaagattcagagtgatttggcgcaggttctgaagtgctgatc

SEQ ID NO: 102535 - DNA, 1002 bp, Homo sapiens
gcccccaccaccctcagcagccccaccccactcaaccctgagggtccccagggtcctgatgaagacctccgaccccagcgccaggctcctcggagcccaacagtcccaagggggcaggagacggggtggtccagtgctgaggggtacagccctgggccctgaccagccccggcacctgccatgctggttcccggaatgaatcagctgctgactgtctccagaagggctggaaaggatgctgccaggtgacccgaggtgcactcgccccagggagatggagtagacagcctggcctggccctcgggacacattgtctgccccggggctatgggcaaatgcccctccttcttacttcccagaatcccctgacattcccagggtcagccaggacctgttacagccctggtcacttggaactgacagctgtgtgaggcctgcacttctcagacccagacttagaacaaaaggaggagtgaggactcaaggctacaatgaggttccagtacttgttacaagaaattggttttctgcaaaaaaagtccctacctgagcctttaggtgaatgtgggatccactcccgcttttaacatgaaagcattagaagatgtgtggtgtttataaaagaacagttgtcatcaccgggcattgattggcagggacaaggagctgcttgggtgtggaaagttggggcgttggaaagtgggctgtggtgcccatttgcagtgactgtgaagtgactccaggacggacctgcgggggcacccagaggtcctaagccccaggactgagggtcgtgcatcaccactcgggtgtcccgggaggtgccctgggcccggggacctcacaggcaggacggcgacactaatgcagggagagggagtctggccccagcttttcctatcagaggcgattttccttcaccaggggatgggcaggaaagaggcaggggccccagaagcttctgtccctcatgcctgagggcacgggggacacttggaggct

SEQ ID NO: 102536 - DNA, 1186 bp, Homo sapiens
gttccgcacagggctgtcccgtcactcacctgaccctgtcacgggcacgcctgatgttctccgtctccccagcattttaagtgacactcctactatatgtgccctgaaagcttttttttttttttttttttctgatttcctacaacttcttggcatctgtccccaggaaggctagaccagcctcactggcgtccctcgctccccttcatcctcacgccagcatcactgtgtttctggggatttgttaccgcgagagctagagagtggtgagaggctgccagcccctcggacttgctgtgctgggcaggagggtggtggtcctggccccggaccccgaattcccatggagaacagaggcaggcaggctcctggctctgccttcacatttctgtgatgggcttaactacctcctgctcatgggaaccagcctgttcctgtttggaagatacaggtaactccctggtggccccgcctcacctgcctttctggttgttttttccagtcctggactgctcttcctgctcttcagcagccttcgagctggtaagttcagggggtgctttgccatggggcgcccagctcagagatgggctctccggctgtgtggactgctggccgcagggcactgggagcagcctcaccaggctccttcttgcttctcaagtggtcctttggagacagttggaccctaaacctaggttgctgcacaggatagaagcgtttccttaaagggaaacacttctgcaaactccggagttcttgtttgactccgtctttgttgcgggcagaatgcagttcctctgagccagggcttcctgggtcccctggtctccctgtcccaggcagcagccctgctgagccctaagagccaccagcctctggaagagccaggaataaggacgaagcaccgcagcacaaacctgaaaccttgccaagccttccagcccagagggctttgggggcaggggacacacacagattttcctgcaggtgccaggtgcagtggctcactcctgtaatcccaggactttgggaggccaaggcgggtggatcacctgaggtcaggagttcgagaccaggctggccaacatagtgaagcccgatctctactaaaaatacaaaaaattagctgggcatggtggcgggcacctgtaatcccagctacttgggagggtgaggcaggaga

SEQ ID NO: 102537 - DNA, 3133 bp, Homo sapiens
acctctgagcgccctgcccctaccccacagccacccctatcccccaccccaccccaagggcccccctctactgaaacccccctcatctgccccatccccagtcctcccatctccacccctcccctgaaccccactccccactgaggtccccaaaccccacccctcactccaccctgagggccccatcctctgaaccccaatcccccagccccactgagctcttaaccctccccacctgagggttccctttccctgcccgtcccccagcttcctagctccccaccccaagtgaccccccgcagctcctcgcccctcccactgcaaaccggcactgaagggctgccccgcccccgcccctccccgcccccgcgggacacgcccagattctttgcccccatagcctggtgacctctggccacccgctgtcccaggtgggcctggatccttccagctcattctttgcctgcgccgtccctcgttccatggcccagtcctccccggggaccctgagcctggaagccccggaccactggaaccttgaacccaccagctggctgtacccggagccgtggcagcagccctgtgagtctctttcctactccctgaccatgctgccttcaagggtgcggctggccaagaccatccccaggggtccctgctgggcctgagggacactgtaggaggctggggcatgggagtccctgaggggtcgaaggctgggcccagaggaaagcaggggctgcagcggccattggccccaggtcctcatgagggccctgccctcccctttttgccccatcttccatgttgtaacagggccaggcaggtggggggcacgcctcaggggacccttgagcccctctcagggctggcactggccttggctgtcctgcccctcatccctgggttgggcaggtgggtgtcaccgcgggggttcaggtggcctgaactagtcaaggtctgctcagcaagctgcttcccgtgctggggtgcatcagggatctgagcaggggctgacggctttctcacatctgtgtccgtgtgtcctgacacagcatccccatggcggccatcccagccctggacccagaggccgagcccagcatggacgtgattttggtgggatccagtgagctctcaagctccgtttcacccgggacaggcagaggtgagggctcatctgcttattggaccagtcacttaggatgctgatcccaggcctggatgaggtctggagttccaggcttctggagtattcatgcattattcaggcacccgggctggggcaggaggttccccacccacagtcttcccccaggtatgggcgtttaacacaccaagataaggtgtgagggcgggatggcaggggacctcaggctcctgtgactttggaaaacgaattgtgatgctcacttcctggccgaatttaaattaagagatcagaggaagaagaaaggggctacttcttatcttcctttccagatcttattgcatatgaagtcaaggctaaccagcgaaatatagaaggtgagtgtttgcatactggcccacaccagacaaaagagacggggcacagtggctcacacctataatcccagcactttgggagaccaatgtgggaggatcatttgagcccaggagtttgagaccagcctaggcaacatagtgagactctgtctctacaaaaaaataaaaataaaaattaaccaggcatggtggcatgcacctgtagtcccagctactcaggaggctgagttgggaggattgcttgagctggggaggtcgaggctgcagtgagctatgataacaccactgcactccagcctgggtgacggtgagatcctggaaggaggcagtggacaccactgtgccacgtgtatcccttctccccctcccaaggcccctgtagcttcatttaaagcatatagtttaatgtattttagtttatttacagagtcagcaaccatcatcaccatctaattttagaaggttttcatcaccctgaaaagaaaacccatgtctagtaacagtcactccaaattcccccttcttgcttcccttcttttaactctaggcaaccactcctcgactttctctcaacgtgggtttgccttttctggatcctttgcatttccgtatgaatttaggatcagcctgtcaactcctgcccaaaagccagctgggattttgagagggctctgcagctccatttggggactcatgctattttaacaatattaagtcttcttctttttttttttttttttttttttgagacacactctcactctgtcccccaggctggagtgcagaggcatgatcttggctcatagcaacctctgtctaccaggttcaagtgattctcctgctcagcctcctaaagtgctggaattacaggcatgagccaccacacccagccaatgttaaatcttctgatccatgaacatgggatatctttccattttgttccatcttccttaacatcttccaacaatactttgcagttttcagtgtataagtctcatatttgtttggctaaatttattcctaatcgtctgctgtatttgacagcactgggaaaacacagtgtgctttgaatgtttcctttagacatctgcatctgctgcggaagtctccaggttcacacacagcaccctctgtttgagggagggatctgcgccccatgtaaggtaggcagggaggctgggggtgactccctcatggcctcagagcagggatgacacaagccagccttgctttgctccttccaaggacaagttcctggatgccctcttcctgtacgacgatgacgggtaccaatcctactgctccatctgctgctccggagagacgctgctcatctgcggaaaccctgattgcacccggtgaggcgaggggcctgcccaggggggtgaaggggctgaggacacacccatcctttcagctactcattctggagtgtgggtggattttcttcccaaatggatgatttccctgagagcttctgatttctgtctccaatgcgtcatttggcatagagccctgagctatgggaggcgggtgtctacggttggcgattgtgatttttcttttcggtgttgatattgccacatcgctgtgcaggggagcgatg

SEQ ID NO: 102538 - DNA, 1017 bp, Homo sapiens
cccgtgtgtagacgggggaggagggaggaccacagagccaggaagtgccacagcctttcccactcagtgtggacgccttccaccatgccagccctccgcccccaccatgccaggcctctgcccccaccctgctgccctgggtttcagggtcccagcagtcactgactcctgggtggtgccgggcaggcgcccgctgcccctctgatgctgacccttgggttccagctccccccggggcttaggtcggcgggagaggaggtaagaggtccacctggggaacccctagccggcatggacacgactcttgtctacaagcacctgccggctccgccttctgcagccccgctgccagggctggactcctcggccctgcaccccctactgtgtgtgggtcctgagggtcagcaggtgagcggggagtgggggtcagggtgggctcttcaaggagcccaggacctacggggcggatgaattcacctgaaacaggaggagagggaggccaggcgagaaaggctccgggaggcacagggcctggggctgtggggggagcgtggggggctgcggggggaaggggacgctcctagacctccactccagctcctggccctgggcattactgctccccccacaaggcaggacaatgaagggggggatgtcccagcacacgtgggagccctcccctccctgcctcaattcccttccctgcacccctgtgggcaccgcctttcaggagactcccgcactcagccccaaaggaggccaggcccgccaagcaggagagaggtgcgggcgccaggcttgcaggcagcagcctgagggtgcttgggtcgcccctgcctcctggggatgggactggtcccgctgtcctgcagcctgcgtggcaccgtgaggctcctcacttgcgcctagacccgccgtccagccctgggtggtcccaggggagagcgcacagggctcgggttcgggttcagctacatttcccccggccccccgcgtcaccccgcgctgttgcctccc

SEQ ID NO: 102539 - DNA, 1074 bp, Homo sapiens
ggcgcggtggctcacgcctgtaattccagcactttgggaggctgaggctggtggatcacctgaggttaggagttcaagaccatcctggctaacatggtgaaacctcgtctctactaaaaatacaaaaaattagctgggcatggtggtgcgcatctgtaatcccagctactcaggaggctgaggcaggagaatcgcttgaaccaggaggtgcaggttgcagtgagccgagatcgagccacggcactctagcctgggcgacagagcgagactctgttgcaaaaaacaaacaagaaaaaaccccaaaaatcagccaggcgtggtggtacatgcctgtagtcccagctactcgggaggcagaggcaggagaatcgcttgaaccggggaggcagaggttgcagtgagccaagatcccgccactgcactccagcctgggtgacagaacgagactctgtctcaaaaaaaaaaaacagacttgaccaaaaaaaaaaaaaaaaaaaaaatggcccggcctgcctatgcctaccttcatctcgccctggcctgggcacttttaattctctgggccctttgtctagtgccccctccctgcccctgcaggacaccgtgccctgcctttccctggctggtgtgtttggacgttggtttcctgttatcgcaggtgaggacttagcttcctggcccgccacgcctccctgacatggcctcctgtttggagccttcaggctcatgcttacatccttagctgatcattaaactttgtgaccatttcatgctcactgctttcttgcctgggagctaatggtgaggaaaggtcactgggaaccagcgcaccaacctcagacattgattttgttccagccttttttcctgggcaggggtggctatcacctgctggtaggcagcggcaggcccactgtcctgcctgccctctgactgcggtgtcggcgactgctgcccgaggtttattttgagaaagaaaagccgattaaagggccattaaaaaggtcttttgaagattacagcttccaatgaggttaacagagaaaatttcctccttcaggccgcagccagtcc

SEQ ID NO: 102540 - DNA, 2004 bp, Homo sapiens
tctgctgccatggaattgttgggtcgcagggtcatggggttgccaggggccaggaggacctggagacgtggccgtgctgggtcctgggggagccctggctgaggctggctatgaggggccacgtgagcgcacctggagctgctgaggcttgagccctggaggccctggccggttccctgagttggtacagggcctgtgtgtgcacgtgtgcacgcacatgtgtgtggcaacctatgcgtgtgtgtactgtgctttccagtctccaaagccttccactctattaccttggggcttcccaagcccaggaccggacggacatcatcctcctctttgtctctccaaggagagaggcccagggaggtagggccacctcaggtttccagagaccccggggcttctgcctctcactctgcagggtctgccagccccttgctgcccagtcctggggtccctctggtgatccccaggggctgtctgccgcctgccatctctcctgaagtttctggtctcctctgtgcagggcggcactatcattggcagcgctcgctgcaaggcctttaccaccagggaggggcgccgggcagcggcctacaacctggtccagcacggcatcaccaacctgtgcgtcatcggcggggatggcagcctcacaggtgccaacatcttccgcagcgagtggggcagcctgctggaggagctggtggcggaaggtgggtctgtgcccggcgcactgtaggccctggggttttgttttgccgctgctgccaggcgtgggaatgggcaggacagagggacgagggatccctgggtgccccgaggcagaggaggggctgtctggccgttggccggggaggagtagtgtctgccagcacgagctcagatgtctcccagagatggaggtcagtgctcaagcctgagggagggcacccaggcagtgcatggggctggtggaggccggtgttgctcaccctacgctgcgtagacaagtcttctctgtgattgatccgagtgagattctggacatgcatggtcacagtctgcagaaatagagttgaagttggggtgacataagacacagagtcccgagattgctgcttggaaagtggcctctcggagccatgtctgttccatgtccctcatgtgggggaccctgatgtgaggccttggccgctctgcaaggcaccccagaggtcccccgtctgcacttggccccagcggatccagccatgctgccacagggttccaggcaggaggaggctgagcctggaactccggggcccctgccgggctgcacgcctgggatgcgggggaaggggtggcaggagaggggtctctggccctgtggtggggccagtggagcctcagccaggtcctcctgctgctcctggcccaggtaagatctcagagactacagcccggacctactcgcacctgaacatcgcgggcctagtgggctccatcgataacgacttctgcggcaccgacatgaccatcggcacggactcggccctccaccgcatcatggaggtcatcgatgccatcaccaccactgcccagaggtgagtgaggctggcgccggcggccagcccagggcccctcctccccgcacggtggtgaggtggtctcagggtgacggccatctgcaagggcagtggactctggtagccccagcatccaggccagccgccctcagcccccagctgggggaacgcacagcgggctccactcccactctgccaggccgcggggggcctttgtgcagccccttctgaggggcagctgcttgccctggggtgtgacgcccccaaaggaagtcctgggctggccaggcctgggcttggcaaatgaccctcagcctgggaggagatcagtcgaaaccagcccaaaggctggaaggatcccaaggtatcttttagctcagagcctgggcatgagaaggggctgtcccctgcctgcctctccatccactgggtcccttgagcaccccgcagggaatcgggctgg

SEQ ID NO: 102541 - DNA, 2669 bp, Homo sapiens
tccactgtggccggttcccggggtggggctggggcctgcctttgcagtgtgtccctggggggcagctcctggatgtgtcctctgcccagccctttggccggtgcggacacacaccagggaagtcacgacatgagggcctccacgggaggatccatcgcagcggatggggccctggggacctggctcccgcccttgccttgcgcgcctagcgatggcagcgagcgacggtgggtgggtcgcattgcatggcaccctgcagccagcagtgcaggctgggccttccagcagggcagcgaggactctgtgaaatggtgtctggtgtgccgtcgtgaatgctggtcagacacgtttccatctctgatgccacctgttctggaagcttccgtcagcgtggggggctctggaagctggggtttgcacatctacagaggatgggcatgtggcttggggtagagggaccaagtgggtgtgccagcctgaacccttccccacagagcagcaagatgggcatggaggcggtgatggcgctgctggaagccacgcctgacacgccggcctgcgtggtcaccctctcggggaaccagtcagtgcggctgcccctcatggagtgcgtgcagatggtaagccctgggccccccccatcagaaccgcctggcccctctccccagtccccactcacaggccccactgctctctgggggccccagcactgtgagcaccggagggcagggcctcgtggctggcccagggcatcccaggtctccagggaggggagggatgtgagcacatccctgggtgggacgtgggacctgggacgttccccaggaggtgtgtcggagctgcagggagcctggtgagcatgggaagtcacaggggtccacggccactgagcttctgtaggcagtggtgggagttggggttacgatgggacggaggaggaggggccagtgatcagagcagagccctgggaggagctcaggcaggtgatggggaacactggggtggctggagcagggaccccaggagaggaggtacggggaaggcagaggcgagggggccgggtgtgggggctggtccagccctggctcggtgggtttggaggcctgcaactggggcagagtgccctgcctggagctggagctgctgagaggtgaggagggcagctgggggcagggtagggcctcctggtctcagccagccccagaagagctggccttggtggtgaccgctgttcctagggagaggctgccaggcctgggccagggtcaggagatgccggccagatctgccctcgtcaggcccaccagacagggcagtagccatgggtgtgcgggccaggctctccatagtctgtgttctgtttctcttccttaagaccaaggaagtgcagaaagccatggatgacaagaggtttgacgaggccacccagctccgtggtgggtaagccccctcagcagacccctgcactcttacatggctgggtcccggtgccaggcagcatgtgctgcagtggcgctatgcacgcctggcctgggtcatccttctaggcaccgcgtctgaagatcgagggaggaaggggcctgcgggtggtacaggaggcgggctgggaggtgtggtaccacaggagaccctgggcggtggcacgggcagggcccagtgcacagggatctgggcatggcgaggggatgagaagctgtggatacaagcccaggacatggggtggccccgcgggggctgggaaggctggcagatgttgggtgtgggtaccacccccctgcaggcgtcctggcggccgggtcaggctggattggacgtctgggttcccatgcgtgcctccacccgctaccaaggtggccaaccctcccttgagctggatgccggccacgtgctttgctgcacgggctggcgtggcctcgtgttgtgttgggggtctcgcaccttctgtggaaggtgccctgcctggcatgcgcggtgtctgctgcctcatggctgagcttccatcgggccgtgtgcctgtgaccagcctcctgggctctgtcacggctgcgctgtggctgtacgccgtggcgctgcagggctgtgcatggtgtgacccgaatcccttccaggagcttcgagaacaactggaacatttacaagctcctcgcccaccagaagccccccaaggagaaggtgaggcagggagcggcgcccacagagggaggaacgggctcagttattctgcagcctcttcacgctggccccgtggctgggcctgcctgcccccaccttccctcctgctggggtccgagctgtgagctgggagggtgggcctgacctctgcctgggctcaggcaccactgtggctggcaggtcccgggtgctgggaccctggctgcagggctggctgttgcttctcagtggtggatggaaatgaagtcaggccacaggcttaactcaggagaggagaagccattgtgtagaaaatgtcccccggggccaggctcacacctgtaatcccagcactttggaaggctgaggtggccagttcacctgaggtcaggagttcgagaccagcctggccaacatggtgaaactccgtctctactaaaaatacaaaaattagctgggcgtggtggtggcacatgcctgtaatcacagctactcaggaggctgaggcaggagaatag

SEQ ID NO: 102542 - DNA, 1027 bp, Homo sapiens
cgtcactggattcacatggatgtggtggggttttgggtccatcaggttaaattaactgtagtcctgatgggactgtctccatgtcttttcccttcccttaacgtggctactagaaaacaggatagccagggccccttccttactcgtggctgtgcaccccccaccctcccgcccgctgccagccccttgtgtgggcactgacctgtgttcccgcccgcaagcctggcttcacaacagtgctcgccccttctgcctcctctgttgcctgcgtgccagggggccaggcttgcaccgtgtctcttttggtcttcaccagaatcttctggaattagaacagataccgtattcccagggcagttgggcggtgtgctgggcagcgtccaggctgctggcagggcctggcccctttttccagaacctgccggcctgctgacctcctgtgcaggttgggggtcccctccccggctgtgcctcacgctcatctccccttctctctgaagtctaacttctccctggccatcctgaatgtgggggccccggcggctggcatgaatgcggccgtgcgctcggcggtgcggaccggcatctcccatggacacacagtatacgtggtgcacgatggcttcgaaggcctagccaagggtcaggtgggtccggccggggcaaacaagtgaggacttgggccttctgtgtgcacacttggggcatttcctgtggaaggccggctgctggaggtggaggctgagacctgggtccgcgtgtcggtgcccacccgggcctgggtactcagctctgcctgcagcgtgatgcccaacactggctggcccccgggcacaggcccacccctggggggaattggccagaggctcaggctggcccctgaagctgcatctcctcctggcaggtgcaagaagtaggctggcacgacgtggccggctggttggggcgtggtggctccatgctggggaccaagaggtgagctgcctgctgcgggtacctgggggcaggagggccagggcgcagtatc

SEQ ID NO: 102543 - DNA, 1050 bp, Homo sapiens
cacctgggagggctgccagggttggggtttgtggggcacaggcccgggtgaaggggctcagctccctgccatagccacttccaggtccaggggggccctgcgttgttcctcgctactgtgatgagctcagatggggagactgaggcgggaatgtccctgcgccccagtgctgggtagtctaagagcagcgcctggcctctgtccaagggtgccagggacacccctgcccactcacagccagtgtgtgtgcaggctgctgtccactgtgccctggggggtggggtcgcctggttgagaacccctggtcctgtggggcccaggtgggaggtgggcccaagcctggtgctgctggctgtctgggtgcgtcagccccaggctggctttggagacacagggctccctgcagggtagccatgccgacggcctacagggaagggtgggcacgtggaggacccccgacccccccttgtcccccagagctgtgaccgcatcaaacagtctgcctcggggaccaagcgccgtgtgttcatcgtggagaccatggggggttactgtggctacctggccaccgtgactggcattgctgtgggggccgacgccgcctacgtcttcgaggaccctttcaacatccacgacttaaaggtgagcccagcccagcccctgctgcggcagacctgccggcatgccagcctgggccccagacactcaggccggccagcgcagggcagggcccgggcaggtgggacgcgtagcccagtgctcctgctggccccggatcgccggtcagcctggaattccctccccacagtcctccggctcatccgtgtccgcccctcccgcaggtcaacgtggagcacatgacggagaagatgaagacagacattcagaggggcctggtgctgcggtgaggctgccgtgggtccctggccacagctgcgcgtccaactctcggggctggggtggggctgctgaggagcggctgggcaggagaaggcaggaggggtccttggagagggtgggccagggcggctttcctgggagctgccactc

SEQ ID NO: 102544 - DNA, 2062 bp, Homo sapiens
ggctggagccggggcccgagccagggcattcacatgctgagccgagctccccacccctgccaggcctcccgcggccacttccgccgaacccctcacctagatccccgcatgctccctgccttatggtggccctgcaggaagcccgcgtcctggggttttctgagccagggaggggagtcagggtggctgggcatggggcccgaggtgatggggcccgaggtggggccgctggctgccgatgcagggcccaggagtcacttgacttggccaggggcagccgactgccggcctcgggaggcagcttctggcctggacttggagctggagagagcaggcagggtcctcgatcgggaacagacgggaacggtgcacgggttggaaggaatgggtgttcacaagctgcctgggaggctccccgtggggatcctgtctgcactggcgttggccttggcccaggcagcccaggggagtccagggaaccgggcctcacctgtttccagggtggcgctccaaccccctttgaccggaactatgggaccaagctgggggtgaaggccatgctgtggttgtcggagaagctgcgcgaggtttaccgcaagggtaggtggtgggtgcgacccgaggcctcactttgccctcccctggctccctggggcagggcctcaccatggagggctgccacgtgcctctgtttgcaggacgggtgttcgccaatgccccagactcggcctgcgtgatcggcctgaagaagaaggcggtggccttcagccccgtcactgagctcaagaaagacactgatttcgagtgagttccaccaaagcctcgtggaggcgggtggggctgaggggtggcccagaccttccctgaggcaggtgtgccaggcccagccccactggcaccctgaccccgcaaggcctcctgggcccccatgcccaggtccccgccaggccgtggagagcagggaccatgcccaagtcttctgagcacaacactgggcaatcctttcgggtgggcatgggggcacagcgggtagccaggagtgggcacgcttgagggcggctgaggctgactctgtgctgtgcctccgagggatggggaccccagacctgtcccagctccacggataccgagatgttcagacagaggggcatgcacaggctgcagggtcggggggggtgggggggctggggacgtggctgaagagctgccctgacccctgactccccatcatcctcccatccccgtcctgcacaggcaccgcatgccacgggagcagtggtggctgagcctgcggctcatgctgaagatgctggcacaataccgcatcagtatggccgcctacgtgtcaggggagctggagcacgtgacccgccgcaccctgagcatggacaagggcttctgaggccagccatgcccacgcccctccccagcccccacccatgccagcgcagcgccagggctcagatggggcctgggctgttgtgtctggagcctgcaggcaggtgggggctgcgtccctgctcagcccatcccctgcctctatccctggccacctgccaggcctccctcgggctggtgtcttgagaccagcctgccaggccctccagcaggaggacagagtgccctggggcatccaccttcctgcccaggggacgtggcgctgtcggtgtttggaggctgctgccccctggctttggcgccccatgggccctcagcgtctccccatgctgggctcactacatgggccagcccttgctctacctggccggtaggctgctggcgcctaggttgtgttgagagggggatgcccctggccctgcctcactgtgacctgctcctgcccacgtgcagcacctgtcaccttttctagaaataaaatcaccctgactgtggggtgcatcggtctccggagagcacagcctgcagaactcctcagagagaggggggagcagcaccgagcggccagcccagtgggcagcagccccaggggtggagggccctctggccagtgcctgggccaggtcaaagggacatgtgccctgagaggccacaggtgctctcc

SEQ ID NO: 102545 - DNA, 1050 bp, Homo sapiens
accgtggggagggagcatggagcctcacagggccccgtggggagggagcatggagcctcacagggccttgaagagctgtgccccagggggagctgcgtgtgcgggtctgtgaatgcgcacacacgtgtaacacgtgccccgcacggagccgtcctggcccctcagcctctcctgctgtcctggtctgtggaatgtgggcccgggccctgctgggctgagggcaacaggagtcacgtggaagaggtgccacacacgcgtccacaggcggggctcctctgctcagattctccgagtgtgccggtcagtcacttggacggcccacacccccgggaccagtcgctccgtggtggggcaccgctggccaggccccagcccttgtggagggaagcagcctcgccgtgccgggtgggcttagtccgcacccctctgccctcagaacgtcctgactgccatcctgctgctgctgcgggagctggatgcagaggggctggaggccgtgcagcagactgtgggcagccggctgcaggccctgcgtggggaagaggtgcaggagcacgccgagtgaccgcaggacctgaacgccgctccagcctccacggggaccccagcgtcttccccagcccccgggagctggagggtggctgccatggccgcagccccggccccacacaaaagcctccccggtttgccacatcggccgagggcaggagtgggtgttaggtactggctaaccggggcggtggagatgcctgtctacaccagtcctgtccccaggactccccttctgtggtctggaggttctaggctggcctgggctcttaaagggaggattttgcaggctgtcctccctaataaaagattttcccaaggttgatctggaggtgacgtttcccaaggcatggttgtgacagtcttcctgaaagcaagggccgtttctccacagaatgaggaggtcttcacggatggctttgccgattccagcccttggtccttggatagatttctgttgggcaagggagacttcgagaatgctggcacccatagcgacat

SEQ ID NO: 102546 - DNA, 1002 bp, Homo sapiens
ctgtttaggaagggacttgttctttcagttcgtagacggagaacgggtttactgacctatttattgatctgatgagtcacacccagtgcaacttccactgtttcgttgtctgccgctgtcattcagcagtcctgcttccttatcaaagaaagatggtgcaagatcttttagaactcctccaatgtgtgttttattaatgtgatttgtaggagaagaggagttcgtccctggtgtgaaggtacaggcatagtggctgacactcttcctctcctgtggccatcatgccttgaactgttggtcaagatagtgttaatttatacttgttgggttttaaaccttaagcaggatttctgaaatggtttcatctatttcttccatttacacgtgaggaaagtataggtccagggagactcagtgcctgtgtctgtgcccatgacggggagttgctccaatgttgcatcagtgggatgaggcacagcacatgggcctgcaggtgcagcctggagtggtggtgcctgtgtgcctagcctttcaccgagcatgcagcagtgatcacatgtgctcttcatctgcttcttgaaggttgcaaagatgccttcttgggcacgtttaaaaattaaaaatcacctttgaaatacaactcttagccccacatctgttgaaatacaatgtaatcttgctataccctgtgccgtaattcatacccttatcctaaaatgtgattgtaccacatctgcagaaaaaactcccagatcttagagcattgacattagttcttttctctgatctccttcttatcaagaggttctgctgcttgactcttaaccttcataaatgtgaaaactgcctggaattcagtctttgtacttgtacctaagatttagaccagattgaaactggagaatgggacattgctttccactgaaaagaaagtaccaattcattgttacttagataatctttttgtgtgcatttttattatttatttttatttttgtttat

SEQ ID NO: 102547 - DNA, 2520 bp, Homo sapiens
aaagttaacttccttataatttacttttaattgccaaagttccttcaaagttaaaatgttgtgaaattttttctcaccctacaggccccatgaatgaagagaacttttttgaatgggaggcattgatcatgtaagttaattttaggtgtactagtttttagggctttgctggaagtcagatgtaagaatcacatcagcagtgtgactgtgtccaaaagcatcagctggaaaaaagactgagttctccagtaatgcccagctctcgtctaggctgctggtctgaaagcagagaacctgagcattgatccaaaagaaatgagtgtttccttagagccagtcaaaggtttagttataattatgtaatatatgtattatatatttgagagttttaaggtggtaattttggaatgttgtatgatcgtggttaaaataacctcaaatggcgtaggtggctttggcttccagaagtagccccttcaggtgtgaaattttgacgagaaaagggtcctcaaagatgtgtctgaccacaccaggcatgttagcgcagccttgcctgccctgcctttgggccaggacttctttttcttctcctttcctcccagttcgtatcttcgtgtgctgcatctcctttttctgttgccttgtctggacttgttggccttgtgttctttccgacccaagacatggcttagtaagtgagcagtgtggttctgggattcgtggcatttaacttagggtgacgttgcttggaaagagaaacacatggacccctgattttagagtgttctatggccttgactcactttgctttttcttctttctaccttagatgtgcaatttttggccattcttagtgtattttcagcaaagtgaggttaaataaaatttaggaagttgaaatttgtaatcagtctctgttttctttcttttctttttctttctttcttttttttttttgagatggagtttcgcccttgttgcccaggctggagtgcggtggcacaaccttggctcactgcaactcctgccccttgggttcaagcgattctcctgcctcagcctccctagtagctgggattacaggtacccaccaccgtgcctggctaatttttgtatttttagtagagacagggtttccccatgttggccaggctggtctcgaacttctgacctcaggtgttccgcctgccttggcctcccagagtgctgggataacaggtgtgagccaccgcgccaagcccagtctttgttatctcattagtgaggtcttttaatttgcagcaaggtcttgggttggattttgttgcattgagaagtgctctagagggcaaggaccggaaaagtgagggctgtgaaacaagtgtgggctctggcttgaagtgatcttaagcttcatgatgcttttggaattcgccagttgcttggatcacattaattcttaatgctctatgggttggtctgagaaacagattgcagctaagtgttgtctgtggaggttaaattgatatgaaaattagtattttggataaacaaaatgtttttaaaaaatcatcaaacgctattcagatggtacagcacgcctgccatttcctgatcatttgtaatatcctaattgcttgggcctatggcacatgttttttcggtgtctgaaggtttctggaatctgtgtttgtgtgtaatgtggcccccaaggcagttatgagatggatggcgagtcccacagtctgggctgtcctcattagtggactgtgcggctgtatacttgtatcggggcagctctttttatttctgtagaagcaggagatcatatacatgaactgatgtgtaacctgcttgtttcatgtgttaatgcaggcgcacctgcactcatgccagcggggcagcacgcctgctgcaggggcccagagtggcgggaggcctgtctgtgtgtagaggttgaaggcgcctgtcgtgtctgcagttatttgtggggtgttggctcctccgtaggcctatttggaagctcattaaaggaacagttgagccgtccagtgtggttttaaaaaaatgttcattgttaaaaatcgattagggtaactattaccaattttaaataaacagtgtaaaattaaaccaatattttgaaaacctgtcttaaaaagtaattagaactatttttaggtagagcacttctgtgtttgaacaaggctttttgcattagtttggaattcccctgcttgaagatcctagtgagtttgtgggttttggtcctgttccagacccttcacaaacaagaggccgtttacaagtgcacttaaaatgcctattagggaattaactgtcctcccatcgatttgtctcaccctgctattttggcagacatctggccaagtctttgctccttggtgataagtttcttctttttctctttattctttgatggcttccagggccgcctctctaccctagtatttctaaaacccgtgcttgcctcacagaagtcgaacggctgttggtttttgctgttgtgcttgccttaag

SEQ ID NO: 102548 - DNA, 1367 bp, Homo sapiens
gacaggtattgggggcaaggttggtagggaggacagactgtcacttgctgttacaggcacaggtgattaaaatgctaaatattgcaaatttaagctttgtcagtatatggaaaagttgaagggaaaatactggaatgcttcttcaaaggttaaaaaataaccgagtcttttggtaatttgaccccacgtgctctctggccctcaagcatgtaacctcggggtctgaggcccaggacccacccccctgccacccctcccaccccactccctgctcagtacctggcgttggtacacaggcaaggattggcacaaccaaaattggcctttttctccctcttaatattgaagaaattcccacatttctcatttggtaatggtgttgtggcctcagatttcttctagtatttgcttctgatgaatgattatggtctatacataaaaaagtaagactaagtattgctgaatttgcagttatgttgtcgtgtataagagctacttccaagtgtggttacaaatgaacccatggaatgatgacttcatgttcttctcgtgggtttgtgccgtgctgctttccaaataggtattgaatttatgcattagtctggtgatttcagttctgtgaaatattttgggatctataccaattaaacattttcatagttctgcctattgtccttccctgaggctccattgctgcttggtggccattctctgcctttttacagtcacctgaacaatgacccatcatctcttgcttgcttgaaatcttgctgaaatgttctcatttcctgtttgctgtatgggctcgggtgggatgtttgttggctctgttgtgtttattcaccaatttgtacattatttgttgtcctttactactgtaaacagtaaatatagtttggtattctgtctcttggcttctactaaacactgcatttgaaggttggggcatactggtacaattcagtgtttgaattgaccattccaggcagccactgcactgagaaactttgattgaaaagctagccgctggaaggttagtattcgcctggcagctcatttcccctcccctggcacatcaccaatgctagtccagccttcttcctgctgagggatgcatcctctcctcagagacctcctggctgacagctgtctgagctggcatcactgtgacatgttaccctccctctcctgggtttcgtatgtaaagaaagggtggattttagaggcaggtgagcttgggtgttagtctaggacatctctcgttttctggtgtttgaatgtaagtcagctttccttctgccatggacaacttacctatctgctttgaaactgaactgacattgatttggctttaagaatttcccagt

SEQ ID NO: 102549 - DNA, 1873 bp, Homo sapiens
actagtgctgtatagctgcatgacttttggatatgtgtttttactggtttcataagaattttttaaaaaagagatggggtcttgctctgttgcccagactggtctcaaactcctgggcttacgccatcctcccacgtcaactcccaaagtactgggataacaggtgtgagccactgtgcccagcccacaagaataactttaaaataaagatggattttctcttatttttccctagactttgtttttttctttgaattaacaatgtcagaggaccctaggcttgcattgttttacacatggatgcttaacaagtggaagttaaaaataaattctgtgtaaaaataaaaccatcacgagtgactctgaattgctggagaattttaagaattaggttggttttgatgactttaaaaagccaacaattacctaaagacttgcccattcaagtcgcggttattttgagacacagttttgaggccagtctctggtgtcttctgcaggagggtgtgaagacagagaatgaccacatcaacctgaaggtggccgggcaggacggctccgtggtgcagttcaagatcaagaggcacacgccgctgagcaagctgatgaaggcctactgcgagaggcaggtgcggcaccttgctcccccgcagagcctccccgtgtgcgcactggtcctgtgcgttccaggcatccccagagcacgagcgtctcggggctggacccagatgcagctgcccgaggtgccctcttcgtggatgggcaggcgggggcttgtgctgtaaaattagtccaggctgggcttgtcccccatggccttttataaggtggagggacctagaggctcggagaagtgtggtgggtttttcttcctgacagggcggctgcccggggtgctgtgttctccatggggtactaacatctgtgaagtctgtgatgctgaaggctcttgggggccctgctcaggtctggccattctggggctgcaggtggcgtgtgccccacgccgctgtcaccctgtcctcgcgtatgagctggcctgaccctggagagacactgccctcatgtgcggtgtggttttccattttgttaggaaaggcaagaaagcgcgtgattctttccccttcttccccagtttcaggataatgagctgccccactggcagtgcccagctgggtggatgccttctggctgctgtttgtgacgtggtgtgtgtgtgtctgttgttcttggtaacgctgtggcggactcaccctgggccagggggtccctctctaggccacttttatgggctttgcccaccagctgctgcctggtgtgttgggggcccggccctgcagccaggcgcccttccccagggagccctgcttgcctgagtgggacctagaggctgcttttcttcagccgctttgaaaatacagcaactcgttgcccttttattttactcttttgcctgtggattttcagttagatttcctcctctttccctcccactttggataccctgctcataggggcagtcactggcgactgccttgcattctttattggcaagcagcccctgacttcctttctttgtgtttgctgagggcagatcttattttcacctgcgaaaggtgagactgagcttccagacacgcaggtcccggtcttcccagcagagtgagtggcctggcgccgtgtaggccccgtgatccagcctctgcctgatgctgggccctggcccttgctggagtttgtactgcctgggctcgtggccactgtgtgtgtgacttcccgggtgcccatgttctcctctgcgctgcgggatggcaggcgtgtggggccgtgtacatgtggggggggctctgcccttccccctgctctcccggag

SEQ ID NO: 102550 - DNA, 1017 bp, Homo sapiens
gctcctgagagggaacgtcacccccagcgtcctccctcctccgccccaggtccctgcggccatgggcggcggccccggcctcacttcccggcgccccaggaacgcggcccccaggaaaggagtcggggcccgggcgacgcggggaggcgggcaagggtccccagggcccgggctccccgtaaacgctcctggcccgcgccccacagcgccctagggcttccgcgcccgacggggtcgcgcgggacccgccccgtgacgcatctccaaccgcccagagccgcggcccggcctgcgcgcgcccgacgccccggggagcgcgcctcgtgaacgcgcgcagccacgtgacccccgtgccggccaacgggtgcgccgggatttgggggataaagcgcggccccgcgcacagttgcggcgggagagcggcggggccgagagcgtgactcgcccgctccgcgctgcttcccccgcgccgcctccccgcgccgctcgcgcagccatgtccgaggagaagcccaaggtaagcgcggcgaccccgcctgcacgcgcgtctatcgcgggcgtcccgcccccagcccggctccgcccccaccccgactccgccccgcgtcccgcccctgacaggctccgcccctccccgccctctagagccccgcccctaagtgggcccgcccaaggtgcgccccctctgcccccgcgaagcgcgctgtgccgcgagctccgccccctccgggcctggccacgcctccgctccacgcccgtctcctccccagctgggaaggcgcgcgcccagcgcctccttgagcgcccggtgtcgggccccgcgctgctgctcctgcagagcgcggcgccctcggatcccgccccagcagtgtccccgaagcgtctttgcgtgctcctctcctgagtcattgctggttggggtcgccctctcccccggcatcgccctgggtgcgggatcctgtgtcgagtgcacggagtcggctcgggaacaagcgtctggggttacccccaaggggc

SEQ ID NO: 102551 - DNA, 2634 bp, Homo sapiens
tcttcgccgagcatcaggaagtaagtgcttatctcttaggatctgttagagttcttgtttctagtaaattttatttcagttttaaagtttaaagtggtttgacttcaaaaaaggttaagcactgtatgagagcctgcttacaatgcccgttgttgctatagcctcagtaaatcttcttataaagcttggtttgtatggctttctaagattttgtttctggttgaatgaatgaagttatgattcaagtttattttgtttcaggcctgtttaaagaagaaaacccgtatgctagatttgaaaacaactaaagcgctccagcacatcagtcccgacgcttcctgtgaggtgcacgctccgcagcccagcccagccgggagaccacgtggccattgcggtctcctgaccttggccagtgaacctgccagccttccaggacaggcggccggagagctgcccctgaaggacagtcctctcgtcttgcagactggtgaccttctattccctgttcatctctgtttctagatttagtcacttgaaataagaaatctttggggtttgggcttttttatactcttctcagtttgtgaaacgctaactgcacacgaagccgcctgacggcacccagcgctgtggctgtcattctcccagggcagaaccctgcgtttctctctgtccactaacaagcttcacacgcaacacagggaagtcggtttgacttttgtcatgaggagaactgaccagccctcatcattccccataaaaccacggacagcgtctgtgtgcgcatcttgagtcttcacacctgttgactcacacggcttttgctgatgacacggggctccagtacacagtctgataaggacttaacgtcctaacctcaattgtattaaatagcattggggaatagctaaacctttttaaaaaaatttattggattttcctccctgcttaaaagatttcaccagaaaaccttcatataaaaattcaggccctttttggacaatttttaaaatttgtatctttactagaacatgagaatctttttcccttggaagcttgaattataaatgtggtgtttggcctgcctcagcagcaccagttgactgctcgtgtgccagcggtgtggggaggacggggcaggacgctgcagctctctccagccctgttggcatcctcagtgcctgcaggcctctcgctgcctgttgggctgtctggggggtggccatttagggatcgtggggacggggtccaccccaagaagaaagaaaggcccgtccacaggcccggctctgggccacgtgccccggaagcaggtgtgtccagagtcagctgagggctctccccacaccacccagcaggcgctggtgctccttctgcctcatgggaccagtccagcttccagccgctctggctcgagggtggtctgaccacttccttctgagtgggcttctctgggagctctccagtggcactgctggacctgcccacgtttctgtaaaatcaggatacgtggctttagtaagcagaccaagcgcttcgtggcagggaaagcagcgtgcggggaagtcactgaaaagtgctgcctaaggaagtttggaaatagtccctgttccagattgccttgaattttaaaacattttgctttgggaaagtaggtcagcagcacctaagatcaaggatgcgttccattttcacacttcacagtcatgaaaactgagaagactgtcttcagcgtgaactaaagttcacaggcagatcactgatccagaacacttcaagaactcgtcaaacagctcgataagcctttttgactgtgtacatctgtaccgggaataacattcctaggctgaaatttccacaaagaatagaacctgtacccagttcttcaggctgatttccctgacctcttgggcatttgtatttgtagtaaagtattgcagagattcctaagtattttatagcagccatcaaaattggactttgtattgtttattcataaaagacacttggtaatagacttcagtgaactctgtatgaatgcagtagtgtgtgtgcaaaatccgcttcctgagcgtagggtgctgagctggcgctagggctcggttgtgaaatacagcgtagtcagcccttgcgctcagtgtagaaacccacgtctgtaaggtcggtcttcgtccatctgcttttttctgaaatacactaagagcagccacaaaactgtaacctcaaggaaaccataaagcttggagtgccttaatttttaaccagtttccaataaaacggtttactacctgcgtgtgtttagtatgctgcgtgttcctgtgttccatctcagtggtgtcgacatgaccgcttggaatgctgggaggcaggtaggcttttttgggtaaagtgggcctctgacccatcgtgggatgcctgggcagtctccagactaaatgcctgtggctgtcagaacggaccaggctgtgtcctaaaactgtgcccacgggcctgcctcgcaggggaggtcttggctgtctctgccctccacagctgccctgcgcaccgcatgccctccactcgcgctgggtgccgagggccgggggagaaggcagggctgcctcgggaagggcgaccttggcccccccgtgtgaa

SEQ ID NO: 102552 - DNA, 1050 bp, Homo sapiens
tggtttaaataaaaaaaaagaaagctgcatcaggcttaacctccatttctgtgagtttagaatgtcttacgagagtctgagtatgtagcttggaattttggttagttaacttttctcaggcttgaaataccttttcaaactcagctgagacagactaccctgtcacttcagttcattatggttaatattataaattgttaataaattctaagtcacagataggaacgtgtggctgaaaggagacttggagagggcgggaccctgtggggtggaggcagggccacaggctctccacacgccaggagccagcagcctggccgaggcggctttcctccttatgctcctgtgtcctgaggttgttccccaggggcgagggaaggctgctgtgctgggtgggttctgtgtctggggcggccctaactccaggtgcttgaatctccagtgaactttgaggcgctgatcatcaccatgtcggtagtcgggggaaccctcctcctgggcattgccatctgctgctgctgctgctgcaggaggaagaggagccggaagccggacaggagtgaggagaaggccatgcgtgagcgggaggagaggcggatacggcaggaggaacggtgaggtggtggtgatgcccgctgggaaggttacttcgaggggattcagatctgcaaggccatggaaatcacatggatacatcctgagttttcctcagtttttagaaattaagaatgtgtatagtgcccaggggatcttctaggtcgtggtagagagcgagagactgtgatgggaacctagcagtggctgcgaaccttgcttctataggcttcctcgcccggtgtcctcccatcggtgcagtaaggctgagtctgtgcgcggtgacacgggtgtgtgacggctgctaaggcggctcgtccaggcccagcatttgccaagagcaagctgaggctcagaggggacagcgtctgactgtggctgggtcagctctcctgtcgccctttccctggtgacacagcactctcctgagtgcttgctggggctctggggcaaccc

SEQ ID NO: 102553 - DNA, 1051 bp, Homo sapiens
tggggtcagactcaatccaagagcttcatctggaggaaagacgaccccaaaaaggagctcagactgctgtgtgagggctggcgcagtggtggccagtgcaggtccccgaggtggtgggtcccactcagctgctccttacagtggggactcctgatgtggagttctgcccctgtcaccctgagaaacgtggctttctaactgtacagagtgctacagtgtacatagggttcacagtgttgatacatactcctagtcttcaactctttcttttgaaatagtggagtttccaagaacatttttttgtctccatatctgccctcttttctcacctggaattgacaatgtagttgttctccatgcctctgtcacagtgcagagtgggcaccatgcccgtttggctgctcgttctgctgatgagcatggagactgcagcctgtggcctgcggtgtgacaggagcatgacaaggaaatacgtacacttgctggtgtgttcctttgtccttagtgtgtttattgactcacctgaaacttcaggaaagcactcaaatgggtcatggagggttggtgtatcctgacagaagaaaacgttatttgttgttgttgttttttcctttaatttcggaaacaaatgagactgaaaggtctttaaaaattgataaatggagtctaagttgaagccttgcagtcataggacccagaagtcagggcagtcacattcagtgttagacttaagcaacacaagggcagtttttatctctggttttctagcacatgttttttctgtatcttgtgatgagataagagatagtgatcacttagagaaataaacactgcttgtctttgaagcagtaacaaatgattcatgcctttctttttttttttttttttttttttgagatggagtcttgccctgttgcccaggctggagtgcagtggcgtgatgtcaggtcactgcaacctccgcctcccaggttcaagtgattctcctgcctcagggattacaggcgcatgctatcacacccggctaattttcgtatttttagtagaaatg

SEQ ID NO: 102554 - DNA, 1082 bp, Homo sapiens
gcggggctgtggcaggaggcagtgccgagtccccactggccaccatgtggggcacgcaggagcagacaccagccactcacagagcaccggtatcgcagcacaggccatgtgcatggctgcaacacagctccacagtgagcctgccgagccactgcatgcgcaggccaaggccaggtgtctgctttcccctcgggacatcctggggagggaacgcggggcccctgcacgttttgagcacatttagtccgtggcaagtgctcagtaggcctcgaggaaagcaaaatgtgccataggggtgttctccaccaagggcaaggggcctggaggacagggcggctgtcccttgtcccacatcactggggggagcctgaccttggggcccctcctgtccccaggtgtgacactggctacattgggaaaaactgtgagtgccagacacagggccggagcagccaggagctggaaggaagctgccggaaggacaacaactccatcatctgctcagggctgggggactgtgtctgcgggcagtgcctgtgccacaccagcgacgtccccggcaagctgatatacgggcagtactgcgagtgtgacaccatcaactgtgagcgctacaacggccaggtctgcggcggcccgggtgagcccgtgggtccctgctggacaacggccgtcctgcggcacagacttggtgttggggggtgcgttctggaccattcaacgagtggaacagaaaggggggatcctgaggacagacagtgcaagtctcgcccagccaccgggcgtcagcaggaacttggatggccctgcaccccgccctgcctcagtttctgtgtccatgaggacaaggcgtccttgtggggagggcccacaggaggaacggtcatagccctattgaggtcccattcacagcagggcaggggaggtccagactggccaggaggcggccacgtggctggcgggggcagaagggcctggctagtggccccatgccttttgctcaggaacatcccccaggctggaggaggcaggcgggccggagggagcaaccgcagtggggtttcgggcgggtctcggttccc

SEQ ID NO: 102555 - DNA, 1003 bp, Homo sapiens
ctgctgagatgactagttctgatgggatgtggtcagtctgagctgaaagagctgtcaggctgggagctgcctatccttcatctgctcagctgcaggtttcttctgtgacacaggagaatgttgtagaaagagtaagacgaaatggttgggaaggaaatttggttcttgagatactggtcctgactcctgaagaaccaggagtgaagcccgtctggtgattgaaggcagggagcaggtgggcctgggcgctgcgggtctgccctggagctctggaaccggaggcttctgctctgggaggtgagggttgtttcccccaggtcctcccgggcagagaagctggggaatccaggttcttgtcttgcatcttctcctcacctttaacgtccctctgaaaccacagagcaagtctcacacctcttcttttcgtccgtttttgttggggacattaggactgggcgttcatcaacaccaacatctttgccaggaccaagatagaccccagcgccttggtgcagaagctggagctggacgtgaggagtgtcacttccgtcaggagaggtgaggcaggctcgagtgcacggagcgtcccttccatcaggagaggtgaggcaggctcgacgggttaccatgctgatacccagcaggtctgggattgttccctcaggcacccgaggtctcagcagctttccagctaacctgtacctgacaatgtccttgagcaagggatgcccctggctgtttcttggggcgattccccagagtagattacagctgtggttttgcccctgggctgcatcatgtctccgcagctctgcaagaactgctctgcgtcctggcagccacgctgaagccacaggaacttgggctttggtgaccaacagggtttgaactgttttctccgtgtgtgctgattctttcggtctgtctgtatgtttggggcagttttgatccttttcttaaacaagtgctttatgtgttgcagaggttagctgcttatcatttt

SEQ ID NO: 102556 - DNA, 1082 bp, Homo sapiens
ggcccgttctggcgctccccagccctgagctcgtgctgacagtagcgtggcccgttctggcgcttcctgcttgtgtgcaggtgtttcccatagcccgccttgaggggcacgaggatgggaattatttgagccgtgcggcagggtcagggttttgggtgttggggaggagccttggcctggggaggcacttagtgcttctggccaggagccggtggctttgtgcactgcccatggctgtgatttctgccttggtgccccagggggattcaggagaaggtgctccaaaatggtgccttggaggttgtccctgaggtgtgttccaggaggctgtcctgtgggaggggcgttctgagctcatcgccgcgggcccccattacagccctcctggagcgaggcctctggccagccgtctctggctgtggctctcagcccagggttctggtgcatattccttccaccgccctgctgtgggttttctgcactgaagagccccgggctggatgaaggggaccatgggacctcacagagggctcagacggagggacaggcctccacttcccctgccctgggatgtgaagcaccagcttggcagggtggcagggcccacagaccctcatgggtgggacctgcagacccttagaggagtagccccacaggcggaggggcttgccctggtctgggggccccagccccttttcttcaggcctccgaggtatccaggcgcctcagtggggtcctttgcatcttggctgctcctcaccatgttcctccctctctccaggaacagttctgtttttttggtgtggtctcctcagctcctgattggctggtgccctgcgtccctacccccaccccaccccgggtttgtgctggggcctgagtgcccatgtcatgcagatactgcatcctgtgacttggccgccacccttcaatgacccgcctggctatggaggtgaggtggcggcctgtgggtgcctgtctgcctggcttagtgcaacaccgccttcccaagatgtgtctcatcgtccgtgccctgcctgagtcaggaatagcactgcatgctgcgtctctggccaaggagc

SEQ ID NO: 102557 - DNA, 1029 bp, Homo sapiens
cattttacttccttcttactaaccattattgcattccgttctcgaagtataacgaaaagtggcatgatatcaaacttgtttctttaacgtttaactccataattaagatgatagaaccgtagtttttttaattgagaatacaaatatgtatttaatcctctttgtttcctcttaaattttgccgtatgttttattgcttcgaaaggtgccacccagagctgcattttccaaaacgctaggttgtcttaagagcagttgtttctaggagatagaaaagctaattgtcttttgatgaccatcttttccttggggttgagactgctgtatcctttttgcctgctgagggtttcccagaggggaaagggagaaggaagaaaggataaaagcttggctgatacagttccttcttggataagagaattaactgtctctcattgcgcggttcctccggaggacagggtccagtatgcatggacagccacaacgggggctcggtaagtatttgatgagacaggctgagctgggtgcctatatcttgcctgtggtggagaggatgaactcacacagactctgaaaggaatgcattgtctgtgagtgatgccctgttagatgtctgagggttcctaagactgggtatatcccactacatctacatcacatttgaagctgtagttggaaaggaaaaaaggaggccctcctgcagggacaggggcttaaaaataatcgatccagctctgagaaattgatgacacatgtgtctctggtgtgacgtgctcatgcagttgttactgggaggccaagggggaaggattagctatgaagtgataacatcatccacaaaaaacatcttggctcagaggctaatttcacttcctcgtgaatttatgtattgtaaaacatttgaattcttttagatttttggaataagaatttttttaacttctatttgtccagtgaatgcataaaacaaacttaatccatttgacaaatacttgtctgtggcctgttatgtgctaggccttccctgtt

SEQ ID NO: 102558 - DNA, 1180 bp, Homo sapiens
tttatgattagttatctgagtagagaaaggtgaatatggatggaaattcaaggtcaggttcaagaagaggttggggccaaatatgtaaatttgggagtcatttgcatattgctgatctatgaggcatacagtatggatacagaggagcaggagatgaggaatggcctgggagcttttggcaagcggtccacattgggagggagggtctagcaacgccattgaaaaggactctgtttgaagaaggaagaaactagtgagagtctagtggcctggaaaccaagacaccgaggggttcttttcttcttattcttcgtgggctggagagtttcctattggctttgataagaggtggttgtgagtgaccttgataggtttggagtggtggggagaggaaacaaatagagtagaggtgggaacatcagtgtagacgactctctagaggagttctgttaaaagggaagagtcatgggatggtggctggaggggacatgggtacaggaagtttttagttgtatttttaaatgagagcgatgatagcatgttatgagctaataggaatgatccagtagagggaaacatttataatatgccaggaaagaggataatgttggagccaagtccttgagaaggtgagagggaggcaggaagagcagggatgctcagctctagaagggaggcgggacttcaggagggaggcaggacttctgcacgtgggagcctggactcagaaatattcctcaagacatgctgcccttttgaaaggaggataggaaataaatcatggttttgtcctcagtcctaaaaagttcggaatctcaccctaggactcaggatccagcttcttaccagcttgtgctgaacatgccatggggcgtacttacggaaagatacatgtggaaatggaattttttatttatttaaaaaattcacttttctctaaaagtattgttacctggaggttggcacctttattcaccaaattcagtactcagaggactagaagactcggtgcctgatttgtgcttgatttgcctagctgggaatttcagttttgcatttaagacgactccctcaccaaccctacccccagaggaaagcaggtattgttgctttgggcctgttgcatgtatatgtttatgttccactgggtcagcagcattcagtgaaacacagttgcctg

SEQ ID NO: 102559 - DNA, 1003 bp, Homo sapiens
cattagcaagcatgtctgcgtgtggatgtgtattttcatttgtcataggtagattcctaggagttcgtaggagcttcgaaatggagtttaagacagaagcctttgtttgatactgataatgctagcaagggccatttatttggcttgctcttgaagtctgtctctgtgatgtgcattgtgcttcttgaattgtatgagcctactataggatgaaatatggttataatgtcgagcagaagctattagcatttcttaagctgaccacctgtgttgtgcacactattaggtcctcagcagatgagttcttaccgggtgtttgatgttttccccccacttatcagaagaggaagtcggtgaagtacggttgggcatattaaaaccacattcagcctacaacaccacagaaacacttaccctttgacccagcaattctgcttctaggaatccttccagaagatagacctccaacaatgtgaaaatacattcggaataacctaaatatccatatgcaggagagggttgagtaaactctagtacagccacacaaccacatccactgttgaggatgacctctgtgaattggtttgaggtggtttccagggcacgtggatgtgaatgaggcaagtaccaaagaacatctaaatgctgcccttgatgtgagaagaaggggatgcaggaagacacacgctccctgcacacttgtgcagaggagatacaggagggcagagccagaaacaaaagagatggtgactgcagagggccaggggacggaggaggagtgggtgccaggtcataggtggggtgcagagggcgagggggcagggaagtggagtgggtgccaggtcataggtggggtgcagtgctgctctcagtacaccttttagtgtggcccagctcttgaaaccacagcaatacttcatatactccaaagtaaaatagatggttaatatcagccaggatgtgggggacccaaaatgaaatataagcggaaaacacacatctc

SEQ ID NO: 102560 - DNA, 1053 bp, Homo sapiens
tttatttttattttatttttttgagacagagtctgtctctgtcgcccaggcggtgcagtggcactgccagctctgcctcccgggttcacaccattctcctgcctcagcctcctgagtagctggaaccacaggcgcctgccaccacgcccggctaattttttgtatttttagtagagacggggtttcaccgtgttagtcaggatggtctcgatctcctgaccttgtgatccacccaccttggcctcccaaagtgctaggattacaggtgtgagccactgcgcccagcctttctcctctttttaaatgttctcaagtagcttcctcttcaagtccggtttctttttcttgttttctgctgggaactagatgtagttcccctccttcctcagcagcaccctttaggtacgagatgggtggggttggccctttccattctttaaggagagtattttccactgtgagatggtcacataccttctctttggtaacaggacaaaagagcaaatgctggaaaaactaagcttatgagctttggggaagcctggtgtgcaaatgagggaggctaacatgattttcgggctactggattggtgctcactcccaatttgaaaactagtcaggagataccgaggccctgtgtgatgtggtacaaagtataaggcgttggccatggtagagaatcatgatttttttttttttttctggaggtgggaagccattgtggttgggggcatgaactcagagttgtgccgtggaagggtccctgtggcaggagaacaggtggagagcagacgccgaggggccgctgtccaggcaggagtgatggagcatggctggtggggacttcagacacatgtgcaaggttctgaggatgcctgggtgctggccatgtggcaaggtggaaggcagtgcctatgactggacagctgggagggagcccactgtggtgatggggagggtagactagcaggtctgtttgggtatgctgacttgggggcactcaaggggagctgtcagggaggccattgggtggaagcaattccagagacaaac

SEQ ID NO: 102561 - DNA, 1055 bp, Homo sapiens
ctgccccagctcattatatgaccgttgtctcccatcccgtcctgacctgcctgtttatggaggcatcctctaggttctcagtggagggtgcctggcccctggaacaaaactgttgagtttgaatcatccccaccctgcctcttcctagctgcagtgctgggcctcagtttccctatgtgcaaaatggggacactcaaacctgcctcattcccgtgaggattacatgattaggtaaagtgttcgtggcagtgtgggggatggcgagtgctaggcaggagctggaggctgttctctttgggctatttgcacacatatgctcttagcctcctttcgagcactttcctcagccttcaatcttgtgtatatttgtgtgtgtttctcttttaggagagagacttctctggcattgactggacaactgtcagagcttatccttgacctgagctcactgcctctgcctcagaattgggggtcaggttattcttagtattctaggtttataaggccagacagagtccttcttccctgtagagcagaaatgacccctaatataggagcatattgttttccctcagcagagcaaatgcttcagtagtagtgttaccagcagacagatggcgctttagaggtgacatgtgatagatgcttgggactgaaatttagccgtggatcatagcctgaatgggattttcacgcatgtcttccctctcaggatttctcttaagggttgttgattccacatttctccttgaggagggggtggtggtagggctggtgaccggggaactgtaatttcctgtgggagagcagcaatttcattattcctttaatgaagctatagttgatcatccttcagtgcctagtatacagcctgttaaattagggtcttcggattgctctgcaagcctttttaaaaaaataatttacaggctgggcgcggtgggtggctcacgcctgtaatcccagcgctttgggaggccgaggcgggtggatcacttgaggtcaggagtttgagaccagcctggccaacatggtgaaaccctatctctactaaa

SEQ ID NO: 102562 - DNA, 1033 bp, Homo sapiens
ttgagagaagttgtgacaaatactaaaatcccagtaaaattagtatggtgtcagattaatttacttatgagcagctgagtgactaactcaggaagtccagttgtacatttccagggaagctttttcatgggttcagatgagatgaggggaaagagaaggtgtcagagggctgctgctggctggaggaacgcaggtgtgctcctgtgtccatttgctctgtggatactgacgagcgcccactgggcctcagatgccctctgggcatggcagggaccaggcgctcgcttggcagctctcatgtgagccgctcactggacacagccgtgctcccgcctgggagttcgggatggcatgcagagctgtggggagggagcggtcaccagggcgtgagtgtggacagatgggagtggctggtgcagagccataggtagggggcggtcaccagggcgtgagcgtggatggatgagagtggctgggagcctaggggggacgccgtctttggggagtagagacacacccatgtctgactactgggttttgagtttgtgccagcaaaggtcctgcttgccatttctgtctgtaaatgtcaggaatttcaggtaactggttccctagcgagacctttaaaggaggctttatcttcaaccgatgctttttttgggggggtacacaggcagtccaagtatgggaaggtcaaaatcaggtcacctttatcatggcttgtgctgtgggatgggattttattttcagccacagcgcttcttctagcttaattagtgataggaaatcagcttctctgtaaccagaggttattgaaagaatgaggatcccagagttggaatgagtctgaaagagacgttgtggtttaatattgctaagttaagtgtcgatttgtgactacctatttttaacatgccacagaagtaaaacattgcattaattatgccatatatgtgaaatagcaagtatttttatataatataactgtgcattggagaaatgaattatttataatcctttgcaccaataaatt

SEQ ID NO: 102563 - DNA, 1032 bp, Homo sapiens
gacactcatcactaattatttaagttgggaaaaatattgagaagtacaagaataattctgtcatcattcttttggaatttactgtgattcaagcttaaaatgtctttttcatgcattccataatctcattctgcagtgggaaaaccactctcaaatatgttgcattttcagaccaaggttataagaaattgagagggttataagatgtaacaatgaggcccacatattaaatggcttgtgttccttggtcattcctatgtgagtaagttcattgtgagtgttactaaacagtatcatgttatgtgttagttctcgctgttggtattttgtaataagcattatctttgaaactaataaaaatacctttgaaattatcgatattattaagattggccatcacatttataccaaactggcaaagttttataagatgtaaaatagtcttttatactgtatatttctaaggtactgtaaatcatgtgtattgcatggttttttccctaagactgatacaatgtacgccttttaaaatgtaattctttgatgaaaacaatgtagtagcaagttacgggttttagttggcttcagtggcaatataatttcagtgatttttttcatcactcctggattatacttgcagttactgccttccacagggcaaataattgactgttgactgtgtgtgagcctcagatgggttagcttaatcatcaggaaaatagggctaaagaataatgtaccatttaaatactggccagagtccccatcaagcagacactgccaccctggcagatgctgccagcacgagacctgggagaggtctgggagccacagggcaggattctgagtagcagttagtgcccatatatggagcgcttcctgcacccagccagtgctcagtggctgctgctgtagcctcattcactcacagcactgctgctaagttcatgaccagtgggaggggagagagatgggaacaaagaggcagtccttcagtccccaccctcctgctgtctgaatagcatcctgtat

SEQ ID NO: 102564 - DNA, 1038 bp, Homo sapiens
cctcccacatttttctgtgaagagaagccgatgttgtagtgctaaaacgtggacattctggtcctgtatttgtatcattttgaaagcaatgcaaagccctgtcatgatcagtatttacatttatgaagtgtagtagcatgatacagaaagagaaggcatctgttgaagaaaagctgtgaaagtggcatctttctctagttttagtattttcctttatgatagtagcattttcagtgacagtgagagtagtatttcagtgtgcccctgaggtgaataagaatttagaatgtatggaatctgtatcacagaaagtgtattcttctcaagattatttgtcaatccaatagtaattatttttatttctgaaaggaaagcatttggttatttcagaggttataaatatttggttaaatgcatgtccaaatacatttataatgatttgatttttgatattgataattgtttagcaacaaagtcaaaatgtaagcagtaatctagtatgtcatgttcttgctcagtttattaatctctgaattccatcttggctctattttttttaaccttttgttccctttgagcaccgaaaggagtaacctatcgagcttttgctggaggatgttataaatgaaaatttagtgtccattccatcagctttgtcaactgggagaagtggtgtgtgtgtgaggattattttggagaaataatgtctgtagagaaagttttaaatctcttagcctctaccacagtgtggcatcagttttcccatggattgtgtctaaaccaggtttatgctctgctgtcttggccgaatgatgacagccctggaattagagatctttaacctcaaagattggcagccaagggcgaggacttggtccctttaaacattcccatggatgaagctgatgaatattttcacaacttttcagtttgcttaacgtaatgagaatctaccattttacacatgtagtagaaatagaccctaaagccaccatatggggcactcgtaaattggtttacaattttagtaatattttg

SEQ ID NO: 102565 - DNA, 1047 bp, Homo sapiens
ccagcctagcccagcctcctctccctgtcttaccaccattcccacccccgagtgggaagaatcccgtgatgatcttgaacgaactgcgcccaggactcaagtatgacttcctctccgagagcggggagagccatgccaagagcttcgtcatgtctgtggtcgtggatggtcagttctttgaaggctcggggagaaacaagaagcttgccaaggcccgggctgcgcagtctgccctggccgccatttttaacttgcacttggatcagacgccatctcgccagcctattcccagtgagggtcttcagctgcatttaccgcaggtgaggaactatgctgctgctttaaaacacggggtcattgctcttggtaatgcttctagacagcattttagtttcaggattactgttgactttccaccttgacatcactctgtccccaccaggaggagttactggtaagtctggctgcttgatttccatggccatgtggccactgagaagccgtctgcatcctagtgcatgctgggtctgtcgcaatgcaaggcagggacacctgagaccccgtccaccagagcagtgtttacaacactatccataactcccttcccgttaggcaaccccccccatgaccctcatcccacagcaagcctttagcaggagagacggaagaagagcccagtctttgaaaccttgcccccagttcagcaccattttccttcaaaggtctcatccaagaatctcacattcaagataagtgacaccagcccgtcagcagctgaaaacccaagtctgggtcaagatggcagcctctgggctcccacatgactggctggtggctgtttgctgttcctaagccgaggagcccatcaaagcagcgaatgagccagcacagcagtgagcacctatcagagcgcagggagggaggggcctccaacaactgttctagggcctgccagttgcctgggagtctctactttgaatttcctacatgggctgtatgaggacttccccgcatgcccaggctggaggtggacagccacccttccat

SEQ ID NO: 102566 - DNA, 1050 bp, Homo sapiens
aggacctgagtatgcagagcagtgcctggcagttgcagggttcttcagtaaggcacagaaaaccccaattataaagaaaagtgaataaatttgactaaattaaaatttcaggaattatttactataacccacatatttggaaaagaaaagccacatattgggaagagatttctgatgtctcatgtgaccaacaaaggattcgacttggttacaggctgactcctgcacctgcatagcacaaagccatccatttggaggatccttgctggggcgtggggatgtcacacacataaatgcaggagtcggggctcatggacctgaacccttcagatccaagccttttattatatagtaattagactttacctcaaggaagaaacaaacacaagctgatagaacctagcatgggtgggccaagaaatagcaaatggccagaaaagttgcccggaaagagccctggtggccaaaatgatgccagttggctgcagctgtgtccctgctctgggagagttgagagtggggagcagccaccttggagggccaggtggatggggctgggtgaggctgaactgttccccttacacaggacacagtgacaggcagagggcccagggccatggtaggttgggggtggggtgggagccacagcactgccattggaggtcaccagggtgtccatcccactggcaggcagtttggcggtgaatgcagccccagagagttgtccacaagaccatggggtgagaggctcccatggggttggccaccccacggtgattatgttggcgcgggagccgtgggaaggaacgagagtcttggttcagatgacctcggcctgtgtcctcagctgcacagagctgtgggaacaaacaagaccatccagaggaggaccagcagcctgtctattcagagtcggctatggcaagggggccagagcactgtgttgggcagactcaaaggcacgcacaggaagggggatggctttattgtagggaaagggggaggctttgggtatgttctgatggaggtaggggaagccaagatgggctc

SEQ ID NO: 102567 - DNA, 1083 bp, Homo sapiens
ctaacctgaaacacgtttattttggggtgtgtgtgtgcttgtgtttgtgctgccttgttttctagtgcctggcaactagcacgcctttaatttgagaaaaagcagtgtggaattttatttgaaagcatgcctgtcagagcacatgaaggaggcagggatggggaaaaacagttgtctttaattaaattttacagttccgtaacttaaccattgtgttttaagaaaaacaaaatagataaaacttgatggtaggtaggttgaaattgtagcatcaatgtcttttgaagtattttgttgtgtattggtgtgtgaatttctcatgattcagaaaatttccctctttgctctctgtcttctgtacttgagcaaagagtgctttaattttagctgtcactcatcttttatatgcatagatacttaaaacattgcatgtggaatatgggacacataggtgatactcaaaaatagttgttaattagggccttgttgaatagcgctgtctaagcaatatctcatccgtaactaaaatctgcaaagacagaatcattttgctaaagaaattttctaagatattgaaagtagagctcatttataaaagtcagtgtatttttatcatatttcacttatgtgaaaagcatctatatctgttaaaagaccttgaaagatagtgtctgcaagatagagacttcaaagttactgatgctgctgtttatcctttcctcctcaatatcttctctggtctttttttttttttttttttttttttttttttgagacagagtcttgctctattgcccaggctggagtgcagtggcgtgatcttggctcactgcagcctccacttcccaggttcaagcaattgtcctgcctcagcctcccaagtagctgggattacaggcgtgtgccaccacagccagctaatttttgtatttttagtagagacggggtttcaccatgttgaccaggctggtcttgaattcctgacctcaggtgatctgtccacctcagcctctcaaagtgctaggattacaggcgtgagccaccgtgcctggcctccgttatctctaatcttgatagcctaaa

SEQ ID NO: 102568 - DNA, 1078 bp, Homo sapiens
taggccagacattgacagtcctgacgggagctcagggctgcccagcgcccagcgtgcacgggacggccccacgacagagggagtcagcccgggaggtcaggagcgcggcgggcgagggccctgtgtggaccacctccaccaagctcagagatttgcaccaggtgccttgttgcctccgctcaggatgaaagaggagctgagagaagtgctctgcctgccagtgcagtgcccagctccaaggctctagagggtgttcaggtgggtctcctggggccatggggagagattggtgcagaccttaccccacagcatacacctgccacagcgaaatccagggtgttggcacctgtgtgtccgtgatgagcctaggaaaccagagcaggggcagaggggcgtcatcctcccaccggacgctgggagctcagaccccaaaactgaaacaccgtggcttcggcggggggtgtgcctcctgatgtcaggagccccatccacgtgtgtccacacagatctcgtcgcagcacggcaggaaggggtgctgcttagggctcattgttggggacatgaccgggttcagcggctagaacatctgccccacagcagcctcctcctccaccgaagagggtagttgtctccctgaagcagtcacagcaggcgtctctgccgctccgtcaccacagtggggttttgttcaggcagatcgcgctggggttctgcacctgcagaaggagaggggtctgttgtcgctggctttcccccaagcaggctcttgcacactctagaaaaaacaccttgtaagtctgtgcatttttattgtcttgataaattgtatttttttctaatggggattgggagatggacttcgtttttaaaaatatgtggattttggttaccaagtttagtgttaatatattccatatacatacaaaactacccggtatgtctggcttttcccttctgtcaggtaatagctaaagtcagcatgattgctccctgtaccaccccaaataagtgagtgcctcaccttgtggggcctgagcagctaccttgagaccatgtgaggtggcacctttccggggtg

SEQ ID NO: 102569 - DNA, 1112 bp, Homo sapiens
aggaatctctcattgttcaccatgtgacccccaggaggtattcgacctgcactggcgtgcctggcctgggatttggtgacggagaggagggctcccagggggacatgcggtgggacaggagcgtggcggctgctgactgtggggtgtggatggggctgcagcaccaggcagagcccctcagggcgccgatgtcgagggcacctgagcgaggggtgccagcaagggggcggccggctggtgggtgctcgggggacggccgtgttggttccatgtaactgtggaactcatttcactcagctgctcctctcagttctccctgactctggaacctctgtgacgccagttctccctgactctggaacctctgtgatcctttgcaggttttttattggcacctcagtctcaacattttcttttcggattcatgaggaaagagaaatcctggggttggaccccaagacgacgtacaacaggttctgcggagaccaagagaaggcgtgtgagcaacccacccactggaagatcacctactgaggaggatcctccagggccgctccccggacccgacaggcgcgggtggatgcaggttctgtcgccgtggagtcaccgtctactgccagccgggagctgggcggacaggaccgtccctcgcagggtcccaggcccagaagaggccccacgcctctagagctgggctccgtcctcggcgttgccagccgccatggctgatgaagaggctccgctgctctcgggggtggcggttgttttcaggcagcgtctgtgaacccacagctcggttgccagcagtgcccgcgtggtgacccagaagcaggagtgtttgtcaggctcccgctctggcctttccagccacctttcatgtcttcatattttaagtgcattgaggatagatgcaggcgggtgagctgccctccgtcaggtggacccgggctgacatttccctgggagctggtgcaaggagaagcgtcattttaaatgtctgcagagcgaccaggggcctcatgaatctctccgttgccctccgcgcagcaggaggctgcctgtgtgtttcctcctgggatgcgtgcaaggcagacctggtgctgcaaaggaaa

SEQ ID NO: 102570 - DNA, 1153 bp, Homo sapiens
ttcttctaattcattttttaaaatacacttattttttatttaaatatgtggtttttgttaacatgtaatggcttcttatttttagctgaattaaatacttgtagctttaacgtctaacataggacgtatcaatagacatagtgcacataaccagccgtcagtcattgtttccagtgtaaaggggtctttaaaccaaacagtttgagaaccatgtgggtactgattcttgggttccagtcactgggattcctctgccttagtgttgaactattgctaattgttaaaacgatgttagcatgtctgctgcttctgcttacaggctccgtaagtaactggtcatagagaaacaggccactcactgccttcacaaactaggaaccattgttaagtgcctagagtcgggccacgcgctgagacttgtgagcagtcgggttttccgtgcagaaacctcagcatttgagacctgtggtcctccttctccctgctcaggtatcttctgtatgacgtcaaccccccggaaggcttcaacctgcgcagggatgtctatatccgaatcgcctctctcctgaagactctgctgaagacggaggagtgggtgcttgtcctgcctccatggggccgcctctatcactggcagagtcctgacatccaccaggtccggattccctggtctgagttttttgatcttccaagtctcaataaaaacatccccgtcatcgagtatgagcagttcatcgcaggtgaggccgagcggcacgctgggaggccgtggttgcttaactggggccaggcagtcatttctaaggtagacatcaggttgggcttacgattgcatccagcctcaccagcatcctccagtgcccagtgctgctgcctgaggcctgtggcagcacctcctccgttcaggagcacagtccctttcccacgctgcagtgagcttcccaaaatgtttctcggaaatggacctgaagtggatgagctttgtgccccctcagttagagccgcccttacaccctaagaaagcggccacccctgggtgttatagtgacaggactcggctccctgtgcgaaaggctgttttacgttcaggaagacgcactgcgtgtggagtatgcttcgtggtgtctcagtgcagcgccagggataaaggtct

SEQ ID NO: 102571 - DNA, 1054 bp, Homo sapiens
gccaggagcttccatgcagctctcacacacaaggcaggtccccagctggctctctgcagagcctgacctgaggcacccattcgatgagagcaggttctctcagtgtagaacccagaccagcagaagccgcatcacagggacgcttcagagacgcactgctcagcccagaactgccaggcctggcagccggggtgcggggaccctgggaccctgatgttgtgtgagttcaggaaaaacagcgttgccttcctgaatgctgttccatttacttctagctcctacgtgtttcttcaagtaaaacacagtcgagcctcattattcatgggcaaatttgcctacttactagcatttaccctaacccagattcaatactcagggcacctccacggtcattggtggacgtcacagcgtcacagcaatgagacgtgagtttcctgacacggtgtctgggcgggggcagaacgagccatgctttggtgtctcgtttgtgtgtgcgtgagtgtgtgaatgtgggagtatgtgagtgtgtgttcatgtgtgtgttcgtaagcgtgttctcacctcaacactaacaaccctgactggcatgtgatggcagcctcatggggctccaagcccatgtgtatgggctccctgtctgtgctggaaggttctacagcaaaaatcagcccctgctcaccagaggcaaactgagcatgaaaggaaatgaaagacgtgaactttaatgcctctcatgtgccgggagaacgaggtcacacagcaaatcacggctcttgggaatcaggatgtgtttgaaaacttcaggggctctgagccctcatgaacccaaccgatgggcaagcagcccaggcccaggctggagatggggatggggctggccatggtccctgccaggagctggaagccactcccgcccctcctgctctctccatgtccactggacactgtccctggtcctgggagaagagggaaggcctctcagcctccactggagggactgctgggcgagcctgatctacaccacagcactccccaccacaggagcgacttcact

SEQ ID NO: 102572 - DNA, 1572 bp, Homo sapiens
cttaaaaagcacccttgagagttgaaggcctgaggcccagtttgctgatttgcacatttttttctggccaagaatgatgcatctttccatgtctctgtgctacacttgatccctagaaaagtcttttgcttttttgtgtcaggattggtcgctgtgatgctgaggttcttgaatggtgtttgtgcctttccctgtaatcaggaacctgggctcagtggtcacttggccgcttggttgccacccagctgtgtgaggtgccgcagtcttacctgcaatctctcctctggtggatttgtgtgtgcgaaacagccgtgacccccaagaggtgcttgtagtcagtgcttcagagtcagagtggagctgaggaagaggactgtgtcaccggggcagttgctgatgcccatggccacgccaggagcctggtctcatgagtctccttgtctctgagcctctcctacactccaccatggcatcaagctctacccctgcctccctgcagcccccagaagatgcatgtcctgcccctgctcaccactaggacctcctcctgtctggtggtcagcacagagcccagtgatgtgggtacaaggcagggtccctgcgcctcacttcccactccctctgaagccctgcagggattgggcttcagtgacctgggttccgtgggtgtggctcaccccagggcacacggcgcctaggtaacgagagaccctcccgcgtagaaggtggtcttgtttctgggctcacccactggggagtcttcaggattcagatgcaaggactttggaagatagttttgaatttcagcaaaacttgtttttcagggcactcctgttttcctgtaaatgaaagcagagcaggggaagtcctctgtaggaaaacctagaaggagtgaactgccctgctccagagtgcaggcgccagacactgggggccagtccaggagagccccacttcacctgctgctgctccatttaaaagtgcaaggcacatgcatacacgggcatgcacaattgtgcacacaggtgcacattcccagtcacgcgaagtgcaggggcacaactgtgtacatgcacacacacacaaaagtgcacatgtgtgtgcacacacatgccccccgcaggcgtgtgattctcacagtcatgctgcatccacacaaagtcttcctccctcagagtgccttgttctgtcttcacctggattgttgaaaaggctgggggctgggttctttgggccccgggagtgccaggggatcctgtggtatgatcaacagcaccaccgccctgggagcagctcctgattgctgggaacagacagtaggggctgggctggggtagaagctgcagcctgcaggcagcccagagagaggggcccccacaacaccctccccagcccccgctgattgtgtgggggcagggagtatgcaggcagctcggagagaggggcccccacaacaccctcccacccccgctcactgtgttgggggaggggtgcctgcttctgctcaggaaggagacccggctgggtctggctgtggagcgtatgttggagacccgaggccaccctggaact

SEQ ID NO: 102573 - DNA, 2564 bp, Homo sapiens
tctgggcttgggtgctcctcttatccaaggcctcccaggcctgggagtttggggtctaaggcccttttcaaggcccaggcacctgcccagaatgactgggcagctgagacccgcctgctgggagccttgccagggccagcactgggcggtcacaggccagagccctgcaccaggcggtcataggccaggacctgtccaaggcagcggagtgccaggcaagtgaagccctgccatctggtgcctgagcgcagaccctgctccacggccagtggctgtcaccagccttgctgcctcagtttcccctccttaaccccggggcgggagtggctgcttcctctaggggttctgtgagcggccgctggcaattgtgtaaaagccacataccacacactggatctttgtgccagatcccgtgtcacttgaggagacagccagcccaggcagggagctgatctgtgttgtcccctggcgctgcccggggccacagagagtgagggagcggtgcttaccggccctggcggtaacgttttagatggcgagtttgggcctctgcagaagggctgtcaggaggagcttttgatcacggatgcgctgagtcagatgaaatgtggaggctgcaggggaagtgtctgtgccccgtgcctgcaggagcacgccttccccccgcagctcctccggcgcgggcaggccccggcacggcctttctggcttcttccacaggagccgtggaaaggggaattattctcaagcccctgcatctttctggcactttctggcatttcatggtggcagatggggtcacctcgccacctcggggctgatcccctgtgggcccctcgttcccacaggagccttgtgatgggcagggcaggcaccagcaccaggctgggtggcggtttggctctcaccacgccggcttccagaaggccagcaggcttgcgagtgggcacacgctggtgctggggccgggcactggtggggggtcaagggctgaccctgcggggacccctgcagacagacactgggccagagccacagggaggaaggccagtgggaacggcaggaggagggagcgtgattggttacggtggcggaactcgcacccacccccgcagccgtttgttcgtttgctcatttatttttggtctgaagtccatgcttttgtatttccccaccgttccgttgagcagcttcaacatttgccgcagttaggcctctctggaatctgtgcttagagattgtgagacagggtcaagtttcagcagctcggactcctctgtctgcagagaacctgccagcacagctgctcctgggggcaggagaggcactgtctgttttggggtgacgtgagctgatgggaaagccaggctggacatagctcctgggccggcagcccatcttggtggcggcttcacgccgtctggcatctccggtcctggagcatgagggctcaggaagagcctctgattcggctgctctggaggcctcgtctggacacacctgggcaggcccgagtccacacaccctatggcctcaggaaccgagagagaccttccttccatgtttcaacttagacaacaggagactttgttttgggaggaatcactcaattcaggtggacgctgcagctgggcgggacatctggcctctccctgtggcagggaggggcatgggagagacaggggtagtgtcccaggaactccgtgggcctgtggcgaagtcccagccctgcagctgccagtgcagggtgttatccaggggcaggacatcgtctgcagtggctctgccttccccgatgccaggtgaccccatggagccagtgtctgtgacctcttccatgctggggctaaagaggccagcaggattgggggctggcattagtggagaacctcagagcccagggctgtgggctgatgggtggcgaggcccccgccagctgcttggggatagcccagccactgttcttggtccacccggcctttgattcctttttcctgtgtgcatttttgagcaccttctgtgtgcgagaggccgtgcctgcccgagaagagaaggaaacaccacaatgagcctcggacacccacagtctgaagggcccggagtaagcctcagacgcccacagtctggagggcccggcgctgtgaacgagcagtcacagggaacagcgtgcccttatcgctgacacaggctctggagggcccggcgctgtgagtgagcagtcatagggaacagtgcacccttatcgctgacacaggcgagggcttcgtcttctcacagctcttatcttgggtgtcaccccagccagagtcagggctgatggcggggggtggggggggggcaggctgtggtcagggacctgcaggagaggggagggcctcgcttctgatgggcgacgttcatttacacacagctctgcggcccaaacggccaggctggatcctgtcttttaaaaaccttgctaatttggttgatggaaaatatcatctcagagttctgttttgtgagtccccattgccatgcgggcaaacattttcatccactaaggggccgtcgtgtttctctgg

SEQ ID NO: 102574 - DNA, 2114 bp, Homo sapiens
ctctctgaggccgcccatcactgttcgggccctggggtgggagctgggctgcaaagtggcctggactttatgtcctgccaggtacagtgtttccctcagcagatttatcaggcgttttgggtgtaaatgccaggaagcctggctggcgctgaaggaccctcctcaaagccacggatgggcaccatgcttaggggaggacctggggccacttggttgcattgtgaaatgttcatgatttttaaacagttttattttttaaaattactgaagtccaacaggagcattattcagcatttgaggccccagccagtacagcgctgcctggaataaaaagtaaaatgtcccccggaaccccagccctcagttctccctccctggacccccctcctgagaatcttctcacaaccttggcttactgactccacattacggccgtgtccccgctctgtggcccggtggacgcaggtagctttgactcaaaacaggaatttgtttccatcctttcatggtcacaaataataaaaagcagcttctggacaacaatgaagttgagataaataccaggaccagaccggccacgggagccgtgggtgagccgagggtccccctcaggacccctgcatcctgcctgagtgtgcagcagctccccccgacaggagcgtcagggccggtctcctccgagtctcctggcagaggcgttgctgtcgcagctggcactgtgcatggctggcagcagaagtctgtgcttggcagccctcgacacctgctggatgtgtttgcagggctgggcaggcacctgtcccacggcccagccccgagggtctcgtggcaccagcctggcaggacgggcagcagggagttaacgggagccactgcgaggacactgtgatctcagagctgcgtcatcgctgatggaagaggtgacgtcccctccacagaaagcgcctttgtgggcgaccctggctcgtccccctgcagcccccacgcaggtagtgggctgccctctccctctcccggagtcccctcggggcaccgagaacagacccctccttcatccctgctgtcagctcatgacaccggacaatttgggtcccaattatatctagagaaccaggggaaaggtcacgttgtctagacattaatccagcactgtggcattttttcctgggcctgtatcctggcaacaggagggcgagtgggggccccagctcctcccctcctcagaaccttctggggctggaggtgtggcatgtgcagggaaggcagcctggagaaggcggtgcccttgggctgggcctgcagtgggcagccatgcaggactccatgggaggagaaaccacagctctcggctgtgctggggtggggtgaacagtggcggggaaccttggggagctgtggatggcccaacctcattggaagctgtgcgtggccaagctcaggcacctgctctgcctctcccagtcctgcctgtgtctgtcctggtcacggattcctacctctgtcccaggagggtgtgaggacagtctgtgccactcacccgtgtctgctccgagccaggagactctggccacccccaccccacccagccctgcctcgaggtcctgcactggtccctgcccggtaccgggtcagctggtgcctgcctgtcctgccctgcactcctcaggctcctcaaggacagacggacagacaggcactctagagaagggaccttggccagacggctttgccgcccccacccccataggtgcttgctttgagccccttgcaaaggtgaagccagatctgggatcccagggcctggtgcggctggacatgggaggagggccacggtcacgcttgcacggggcagagactcccagaaccacaggcctcaggagagctgggaagggaaggagagggcactgcggtgcctggagagccagagtccgcccgtgtggaagtgttgggggctgtgttgcagtgacagccctggcgtctcaggagcggagcaggacaccgcgtttctggctgtgcaaggctccacgcgggtcagcagcccatcctggcttgtcatgctgttaattagattggaaaacctcggccttccatttcttaaattgctcactcctgca

SEQ ID NO: 102575 - DNA, 1095 bp, Homo sapiens
gtttgaggctgggggtgacgctcctgtgcgggaggaggtcgcattccattcatagcggcttatctgggctgtcaggcaggcctgggagggagcctgcctctgtgctctccaagggtgggcgacggacagacagggtgtcccaccccttctgggccaaggacagagggtcagtgtttgcagagacctggggaggcccaggtgacctccaccgagcacctgctgtgtgcagggccagtgctggctgcagagacagcggagcgtgtgtggacccggcggcccaggggaggggggcaggcaggacccggcggcccaggggaggggggcaggcaggacccggcggcccaggggaggtgggcaggcaggacccggcggcccaggggaggggggcaggcaggacccggcggcccaggggagggggcaggcaggacccggcggcccaggggaggggggcaggcaggactcggcggcccaggggaggggggcaggcaggaccaggcggccctgggggtcaggggtggaggccaggcctagacggcccacaggagggtggactcattctgaccgattcctggaagcccccggaaagtggtgatgttctggagggcccagcagaccccaaggcccccaagacaatcccagctggctctctgcggctctcggtgtctgccatttgagacaatttgggcacaggcagggcaggccgtcgcggacggtctaagccgcgcgcattggtgggggcagcagagcccctgctctcagctcctcggggtacagcgggggtaccaggcgggtgagtgggtgggtggtcactgctcctgccaagggcagccctggtttggtttgcacttgctgccctggtgacggctgctctcattcctgccccattgctaacaagggtgtcataagctactttcccggcccacatcctattaagcccatggagaccctcccacagctgagcctgctgtgggctgcaggccctgggcggtgcccacctcggtccccactggcctccttccagcactttagagcagacacaggttggagataaggaaagttccagagcacagactggaacaagccccaggcctctcc

SEQ ID NO: 102576 - DNA, 1058 bp, Homo sapiens
tgtgtatgcatgagtattcacatgtgacatgtgagcctatatgtatgtgtgtgattgcgagtattcatgtgtgacatgtaagcatgtatgtacatgtgtgagcttgtgtatgcatgtgagcattcatgtatgacatgtaagcattatgtatgtgtgtgggcttgtgtatgcgagtattcacatgtgacatgtgtgagcatgtatgtgtgtgtgattgtgtatgcatgtattcatgtgtgacatgtgagcatgtatgtacatgtgtgtgcttgtgtatgcatatgagcattcatgtctggcacgtacgcttatatgtacatgtgtgggggcttgtgtatgtgagtattcacatgtgacatatatggcatagctaagcatgcatgtgcatgtgttcatgcatgagcaggagtgagcatacatatatgtgtgcatatgtgggtgttcgtgtgtgagcatgtgcgtacacatgcgtgcgtttgagtgatgatgtgaggaggcttatgtagtagccacccttgccaggtgcttcctggtgggaaccagatcccgggggctgagctgtggagccgtggcagagccgcactaggatttccaggaggttaaacgtgcgatgctgtggaggtgcttggaggtgagggaaccccaatggtggacaggaagctctcaaagcacttagaggtggaggagtcctggacagtgggcaggaagggtggggtcaggaatggagtgggcaggggaagggtggagggagctgggcaccctgcagatggcagggtgggtgctcagtgccatggggctgccaccatcctccaagtgtggccccgagggccggagctgctctccctccattgctaggcgtaatcagttccttgtgcctggctctgcccaggaggtgtatattggggggcatgaatgtagggccagcccagctggccagtgaccctctgagcacagagccttcgggatggggctgggggtgtcccccacaacagagttcccttcctgagatgcgctggtggaggagggggcagtctctggaatttctgtttggagacttt

SEQ ID NO: 102577 - DNA, 2544 bp, Homo sapiens
gtgaacgtgtgtgtgagtgagcacgcctgtgtaaactgcctggctccacctctgatgggctccgtgatcttgagcggggtcaccaggctcatgcctcagttttcttcatctgtgaaatgggccgatggccaggctgcacacaggtcctcagagggcataaggcacactcagcacccactgctgtgcctgggcagctggcgggggggcacagcagccactcacatgccactcacatccctgtgggttaccggctgcctggaatgttccagtctaaccggatccttttgtggacggggagactgaggccgggaaggagtatgcattcctgccctggtcccgggctccgtctctgctgggtctcctgggcagaaggtcaggaagggctgagagggacacagtccaaggcaggtaaagccccagctttgaggggaggcacagcagctctgagagggtctgagcccctcgagaccctccccgggatgtttaacgacttgggcagccattgcaacagtggaattggcactgcagcaagctgagcattttttcggttccaagtttcccacaacacaatggctccaggccaggcgcctctgggcgttccaggtcagagggggagcaggggctgggggccgctgcctcagtgcttctgggatggggtcctggcttggagccccaatccagagactcagcagccctgccccggcagagcctagcggagcacgttgggaaccctgtggacactgcacacagcaccctctgtcctcacggagcctggggctgctgcagggccgtgggaaagaagttataaatccttgggtgctggaacccccgggtgctgggcaccttgattccaaggctggtgccttctttccttctgcaagagtggggggtggaagacagccggccagaggctgggaagcctgcacaggggagggcaggagggcgtgagcctggctagccccacctccaggcacagaggccctcccgccgcccgcagctccagccgcactgccccgatggctccctacccctgtggctgccacatcctgctgctgctcttctgctgcctggcggctgcccgggccaacctgctgaacctgaactggctttggttcaataatgaggacaccagccatgcagctaccacgatccctgagccccaggggcccctgcctgtgcagcccacagcagataccaccacacacgtgaccccccggaatggttccacagagccagcgacagcccctggcagccctgagccaccctcagagctgctggaagatggccaggacacccccacttctgccgagagcccggacgcgccagaggagaacattgccggtgtcggagccgagatcctgaacgtggccaaaggcatccggagcttcgtccagctgtggaatgacactgtccccactgagagcttggccagggcggaaaccctggtcctggagactcctgtgggcccccttgccctcgctgggccttccagcaccccccaggagaatgggaccactctctggcccagccgtggcattcctagctctccgggcgcccacacaaccgaggctggcaccttgcctgcacccaccccatcgcctccctccctgggcaggccctgggcaccactcacggggccctcagtgccaccaccatcttcaggtagagcttctctctcctccttgctgggcggggcccctccctggggaagcctgcaggacccagacagccaaggactctcgcccgccgcagccgctcccagccagcagctccaacgccctgacgtccgcctgcgcacgccacttctgcaccccctggtgatgggctccctgggcaagcacgcggccccctccgccttctcctctgggctcccgggcgcactgtctcaggtcgcagtcaccactttaaccagggacagcggtgcttgggtctcccacgtggctaactctgtggggccgggtcttgctaataactctgccctgctcggggctgaccccgaggcccccgccggtcgctgcctgcccctgccaccctccctgccagtctgcggccacctgggcatctcacgcttctggctgcccaaccacctccaccacgagagcggcgagcaggtgcgggccggggcacgggcgtgggggggcctgctgcagacgcactgccaccccttcctcgcctggttcttctgcctgctgctggtccccccatgcggcagcgtcccgccgcccgccccgccaccctgctgccagttctgcgaggccctgcaggatgcgtgttggagccgcctgggcgggggccggctgcccgtcgcctgtgcctcgctcccgacccaggaggatgggtactgtgtgctcattgggccggctgcaggtaactggccggccccgatctccccaccctttcctttttgccttgccaggtaagtgtgggcggggctgacgtgagcctggtacaggttccccccacatcgaatctctacgttcaggggcccgtggccctcgggaggtgggagagctgggagtgaggcctcctgtgtggggaggaggc

SEQ ID NO: 102578 - DNA, 1005 bp, Homo sapiens
ccccagggcagctggcactgccacaagcagccagattcctgggtcccactcatcctccgtccctggaacacccaaatgcccagcaagcaccagccgccttgcaggcaacccccccggagccacaccccacctggctactgttccccaccaagcatgtgggtagggcagccttgcaggagccgtactgactggagggacccgggtccggtgtcctggagccccgggaggctccagcacagcccaccttgtcctccactgcaagcccacggaggcagacaggacagcggtgggctgggagggctgcagcctgtgggaggggaaacgccaggcctgcacacctgaccctgccctagccctgccagcccgagactgtctgggatcagctgagcactgtgagcaagcttcagcctcagggaaggtgccggtctcctgggagttggggcacagctgcatggcttgggggctggggtccgagtggggctgtgagggcgaggaatttctgcaactgcagctggcccggtcggtggcacagcctgatggggacttttcactgaacatctggacagcttggtagcgtccccgtgcgagggaggccgtgtcccgtgcagggtcctgggggactccatcagcgttcctggcctgcattgcctctggccaggggtgggcctcaagctttatcaaggagccccttcccaggtgtggcctggccgggagggtcctgccccctcttctggcctctcagctcctccccagcccaggctcctcttgggttagccccaactcctgccggacccctatgttgggctggacactcccagccctgggtgaggggcaggaggaggagggggagcccagcctgacccctcgggcagacttcgaggccccgaaagtgggggtgctgggctgtgatccgggcaccagaacagagccctcgaggcccacagaggtccctggctgcatctccagggatcagggagtatgtgcccctgaggggaggggagctgg

SEQ ID NO: 102579 - DNA, 1440 bp, Homo sapiens
gccagccccagcccctcacagctccttgccccagcgggggtgccggccagtccctggtcccttctccccactggctctgcccatcaatgctcaaagcatggaaggggaagcctgtggacaccatgtctgctgtgcccatccctgctcaaagcatggaagggggcctgtggacaccatgtcccgtgcagacaccatgtctcctgcagacaccatgtcccctgcacacaggtttctgcatggagcctgcctgtcgtttgggaatgagtgaaccagggtggccgttgggtggctgagcccaggggatcagggcaggctgccaggcacgtggagagccctcccagactcagtttctcctttctgcccctgcctggctgcctctccaggccgcgtcggtggcccctggttccgtcctgcacagccacctcaccagctgtctttctttttgcagagcgcatcagcgaggaggtggggctgctgcagctccttggggaccccccgccccagcaggtcacccagacggatgaccccgacgtcgggctggcctacgtctttgggccagatgccaacagtggccaagtggcccggtaccacttccccagcctcttcttccgtgacttctcactgctgttccacatccggccagccacagagggcccaggggtgctgttcgccatcacggactcggcgcaggccatggtcttgctgggcgtgaagctctctggggtgcaggacgggcaccaggacatctccctgctctacacagaaccaggtgcaggccagacccacacagccgccagcttccggctccccgccttcgtcggccagtggacacacttagccctcagtgtggcaggtggctttgtggccctctacgtggactgtgaggagttccagagaatgccgcttgctcggtcctcacggggcctggagctggagcctggcgccgggctcttcgtggctcaggcggggggagcggaccctgacaagttccaggtaacccccactgtgccgtcgctgggggactggagcagctgggatggggtggggtgggggtggccactgggacagggacggagctgtggccggaagaggagagcccccaccccagctgtggtcagcccgggcctccagcgcaggcctcctgggttcttggctgctcagccctggcctccggcgcaggcctcccgggttcttggccggcctggctggggtggcattcactttcttggctctctggctcctgcgcccccaggaagggtagccctgggcttccatggtttctctgagaccccgaggcccagcccaggagggccctctttgaacgactttgtaactagacatccaccccagccgtgaccccgtgacccagagacacccccaggcctgtgccaagccctgtggtgaagtggggctcccggcctctgaccggccggtcgggta

SEQ ID NO: 102580 - DNA, 2587 bp, Homo sapiens
gggttttgtttttgatgaaaaggtgaagttcaaagaaagcaaagccatggtgccacctcggttggtccgagtcgggagatgaggccgcctggtgcttgcgtaaagctcccgggacttggggttgggggacttgacctgcagcccctcgaatctgcccgccctcccaggccttggatcgagccacacctgctgtggttctaaacccgtagccctcaggtggcccatcagctgcctcagatgagccaagtctgagggagcagcctccgcccagccgggtgctttccacatgaaagcgcccaggacgcccctgggtctcaccacttcttcctaccatgaggcataccgcacccccagggaggctgcccgagaccccttccctctccgagactctcctgccctttgtgggccccccgaaatctggagctcaagcagcaccggggttgccactgccacctcaggaccgctggtgacccctttctctgtctgcatttagggggtgatcgctgagctgaaggtgcgcagggacccccaggtgagccccatgcactgcctggacgaggaaggcgatgactcagatggggtgagtgacatctggggcacgggtggggtctcccctcaatccctggcacgcggagttcagggccaaggtctatgacaggaaaagtcccaaaatataccacttggggcactgggaagctgcgataccatttctgtgctctcctgtagcacctcagagcccttccttgccctgaactttcccataaaaacaaatacaaagcatgatataaacaccagaaaccaccctccatggcagctggtgagacagaggatgtgaggcagctcagcaaagtgtgtgtgtgtgtctgtgtctgtgtggtgtgtctctgtgtcttgtgtggtgtgtctctgtggtgtgtctgtcttgtgtgttgtgtgtggatgtgtgtgtgtctgtgtggtgtgtctgtcttgtgtgttgtgtgtgttgtatgtgtgtctctggtgtgtctgtcttgtgtgtcgtgtgtgtctgtggtgtgtctctgtgtgtagtgtgtctctgtgtgtggtgtgtctctgtgtgtgtggtgtgtctctgtggtgtgtctgtcttgtgtgttgtgtctgcatgtctgcatggtgcgtgtgtctctgtgtctgtgtctgtgtgttgtgtggcgtgtgtgttggtggggtgtgtggaatcacgtggtacccaaggggagaatcccccagccccaggtgtgaggaacagcagggaattctcactcaggggcccagatcacaacatgccccacgtgaacatggacccacagcctcgctcctgggggcgtgggcaggagacgccgtggacgtggacccacagcctcgctcctgggggcgtgggcaggagacaccgtggctggactgtgggcagtgtgtgaacatccatgttactttcatgctttttctttattttgcccaataagcccgttgtttttgcctggaacatgccagaagacgccagatcgttcacatggcggccatgacaaggctgcgccctgggacagcttgctgggtgcggggggtcgccgaggcgccgcacccctcccctggcctgtcttgccctcaggggtcagtagcggtccctgaggatgtttctcctccgggttttcctgaagtttaaaacatccagccgccttggcgcgtgttcggcccagccgggcgtgcgctggggaaacctgtgcggggagcatctgcggtgcggcctcctccagggcagggctctggccagaagagaggagcgcgttccccctcccgcctccgcatgtctgaccaccggccgaggcaggttcagaagcgtcactgtcctcgacccgattggacacgacttactgaagctcagatggtgcctgggcagggaaggccagcgtgcccaccccagcggccccccggagagcaccagagagggctggacgaggcgagagggggcctggaggaggcgagagcagcgtcctttgcttcccaggcctgccgggctcggggcctggcctggctgccatctctccagcctttcccttttcaaactcctcaggcatccggagactctggcagcgggctcggggacgcccgggagcttctcagggaggagacggtgagtagccggacggggcccagcccacgctgcagggtcccgggagagcccctcccagcagtggggtgacacatgtgcacacgcaggtgtggctccaagagctccctctatgccacgaagacatattcctggctggggacagggatgctgggctgggcagacgctcggagcctgggcacaggccccgctccggccctgcctggccgccgcgtgtctctggtgagaggatattcctttaaaacgaggtcctgccctgcacactccttggtcttcgaggcaaccttggccttcccttcgccccatccctccgttagctcgtgcgtggccatcagggaatgaacgcgtgtgtgagcctgacgaccaggaggagaaggcggcgcagggagcgcgcggaaggctttccccagctcgggccacctgagaaaacacaggaggggcggggagtggggaggc

SEQ ID NO: 102581 - DNA, 1932 bp, Homo sapiens
ggcagcagcacggaagattccagaagtgaagaagtcgaggagcagaccacggtggcttcgttaggaggtaagctcttttctggatgtggtgtgtgtgtggtgtggggtgtgtgtggtgtgtaacgtgtgtttgtgtgatggtgaggtatgtgtgtgatgtatggtgtgtgtagtgtgtggtgtatatggtacatgtgtgtgtgatatggcacgtgtttgtgtgaaatatatggcaggtgtttgatgtgtggtgtgtgatgtgcatgtttgtgacatgtgtgatgtttatgtgatgtgtatgtagtgtgtatggtgcatgcatgtgggcatgtgtgtgtgcagtgtgtggtgtgtgtattgtgtgtggtgtggtgtgtgtgttgcgtgtagtgtacgtgtgtggtgtgcagtgcatgttgtgttgtatgtgatgtgtagtgtgcgtattgtgtgtatgtgtgtgatgtgcatgtgtaatgtacatgtgtgtgatgtgtattatgtgttttgtgtgtgtgtgtgtgtgtgtgtgtgtgtggcaggtggggagatgccgaggcccggatggtggctctgggtacaggctctgggtgttcactgtgcttctcttgcaggatttctgttggttttcatttttattttaagtaaaagttaagagggaaaaaggaaaagggacaaagcatgctgggtgataagaaggcattctggggggccagggtctcttgtaacaaattcaggaagcatctcccagacttcagctgtcattggcttagatggccacaccggcctcactgttgattttaaattctgtctccctgttgcctttgcctgggagctggagctcaggggagtgcggcctgaggctggggatctgacagtgtccagccgggctccaggactgaaagcgtttgggctgccggggccgtctggggtgccgagagcagagctggggccacccggggggcgtgaccgtggccacctctgcttctcttcccagctcagacacttcctggctcagattctgtctccacgtgggacgggagtgtccggacccctgggggccgcgtgaaagaggtaaggccacctccctgtgctcctgaaccattctgaaccagagcacctgtggccttttgggccactcactggtgagccctgatgaagcccctctgtgcccgtgcctcctttgtgcccagcactcggtgccagcatgcgtccaccctgcgtgtccactgtgggaagcagcccagcctgggactctggagggcgcagcgggacacgtgggcagggtgtgtggggccccaccccagcccgagccctgtgttctgtttattcccagggcggcctgaaggggcagaaaggggagccaggtgttccgggcccacctggccgggcaggccccccaggatccccatgcctacctggtcccccgggtctcccgtgcccagtgagtcccctgggtcctgcaggcccagcgttgcaaactgtccccggaccacaaggacccccagggcctccggggagggacggcacccctggaagggacggcgagccggtgagtcctcacgtccccccgagtccggcccggtctggagggtgggggcttgggtaggagggggagaggctgcggccgacatgggagtgagctgagctgggatcggggcaggtcagcagcctccttaggcccaccgttgctcggggttggtgctggaaggtggtcagacgtgggaggcggagctgctcagacacagcccttgtgggtgtgaggaggctcctggcgcgggtgcgaggacatcgggggaaggcgtctgccgcctcgtggggacttggagcgtggggtgcatttccatgtagacactgtaggtggcgccggaggagtcatttcccatcactaatggcttctcttgcacacccagggcgaccccggtgaagacg

SEQ ID NO: 102582 - DNA, 1050 bp, Homo sapiens
cttgcggggcaggggccaggagtaggccaggcggggggccgagctcagggcaacgtgtctctccggctcttttcctcagaccttcattgacatggagggatctggcttcgggggcgatctggaggccctgcgggtgagtggcccttaaactgcagcgctgcccgatgtctgtgcccatgaggaacaggccatggacccccaagattcagctggggtcctgtggggggtggggatgaggcccgttctgggggtggtggtcatccctggtgggtgccacatgggctgtgactatctgtgttcgcccacgtccagggtcctcgaggcttccctggacctcccggaccccccggtgtcccaggcctgcccggcgagccaggccgctttggggtgaacagctccgacgtcccaggacccgccggccttcctggtgtgcctgggcgcgagggtccccccgggtttcctggcctcccggtaagtcctgcctccaccgtcagtgtcgggagccctgtctgctgggagtgaggggtgaacaccccacatgggagcccctgccccgcctcaggcctccccagtccccgcctcctcacctcatctcctctaggagctggcgggcagttgctgactcggggccaccctggggtgtgcggaagcacctgagtggccaccccatggttctaggggtgctgaccagtgggggtgaccgcaagcaaggcctccgacctctctggccctgtgggtccacggactgcacagagagcgtctccatgagcaattcccatgggtgggtgtgggagggccgaggtcagcattgctggagggccaggggagggaggagcctgcttggccaacgcggctcgtagggtctcaggtccccacggcaggctccccaccagctctgccacacatgacgggcagcaggtcatgactggcagcaggtgcctgccccaccagctgtgccacacatgatgggcagcaggtcatgactggcagcaggtgcagacgtggctgctgtaattgggtcatgctgcactggcatcccgtggcctgggg

SEQ ID NO: 102583 - DNA, 1357 bp, Homo sapiens
cccaggaccaggactccccgctggatttgtgagtaccgcctacacctgaccccctggagagccgggggctgccgttgccccagccctactacccctggcatctcactcacagagcagcacgtcctgggcggtggccttgctggcactgcctcatcctgggattccatattccgcatggtggggctcgagtctctcgcccgtcgcccgtgccccacggtgctgatggggatcttggcccagccatgccccagcacccgtgccctgaccaagagcgaatgagctgacccgagacgggctgccccgggggggctccacccaggccctgccaccaggtagacagtccccatctgagaacggcggctccccaggccaccgtggccccaaagcatgtcccaccctcctctcgggcagtgccaccccagggaggggtccttccctaagaagggacacaggcccctacgtgtctcgtgtgtctcttccaggatgacatggaaggctccggggggcccttctggtcaacagcccgaagcgctgatgggccacaggtagtgttgtgagctgggcgtggccggctctgaggggtaagggggtgttgcctggggcaggagagtgtccctgagagccaccggccttgcatgggatcggaagccgccctgcagagccgtgaggaccacgtgtggcgggcgctgtgccccgcgggccacccttgttcttcggagatgccccttcattgaactaaagtcacggggtgagggcctggtctgcaaagtgggagacactgtgagtggtcaagacaaaggaacacggggccgcatgccccctgaaaggcctttctggggaaattcaagtcatcacattctttttgtggccccaatttttggtagtaacaaatgtttggcctgagtagaatctgaaattcctatgaaatctccactttcttctactgttaacatgtatactgctcagggttagagccagcaaggagtgaccaaaatcccaaaacaactgtgctcagacagctcagacgtgccaggggcagacccaggggccacaagctccttcctcccctgcccccactgtcccctccacaccaccagcgctctcgtggcgccagcatggaggagcccccggggccacagccctgcccaagagacacgtggggtggctgaagccacagcgtccagcttcatgctcagagactcagcctgttgagagcacgggtggctgggacacatttcttacttggagcaaaacgaatgagaaatttcaattaggcagaaactaattgattccatagtaagttagaatggctttaccattttaacttagtacatttccttttacacacgtattttga

SEQ ID NO: 102584 - DNA, 1033 bp, Homo sapiens
acccccaggtttgactgcgtcaggaacatggccttcctccctcccggctgtctggctgtgcaggccccgtcggcccctgccaccggcctcccgcctctccctccttttccccgacttccccctcccccacactgcctcccccacttgcccctcccccacacctcctccccgacttccccctcccccacttccacctgccccacacctcctccccgacttccccctcccccacttccccctgccccacacctcctcccccacaccctcccccacttccccgtcccccacacctcctcccccacaccctcccccacttccccgtcccccacacctcctcccccactccccccgactcccccctccccccgactcccccctccccctgactcccccctcccccactcctccatccctccacagcccctgctcaggcccacaggggtgagagagagaagtccaggccatcgccacgtccacgggtgccccggactcctcgtgggggtccctgcattcctgggcgtgtggccaatgccctgcgtcctccatgtgaccctttcagggagaagttggagcagatggagtccccgggttccccggcctccctggcagagagggcattgctgggccccaggtgagttgccttggtgggcccagggtgcagggggggcgtggagccctgaagggactatgctaagatgaaagctggcacgagatgtgccctcccgggtccctgggtctccatgtgccctcgtgggtccctgggcctccgtgtgccctcccgggtctctgggcctccgtgtgcccactcccgggtctctgggcctccgtgtgccctcctgggtctccgtgtgccctctcaggtccctgggcctccgtgtgccctcccgggtccctgggccttcgtgtgccctcccaggtctctgggcctccgtgtgcccactcccggagcgccaggagttaagtataagtctccgtcagggctcttggtggctgcctccctcccaggccccagccggtcgggaaataaagaacc

SEQ ID NO: 102585 - DNA, 2726 bp, Homo sapiens
atttccttcctgtctctccaggggccaaagggagacagaggcagccggggagaaaaggtgagtgtccctggggcgggtggatggggatggggggcgctgggacatcccagaaggtttggcctcagctgccccaggtccgtgcccctgctgcccatgtgacctcagagactcagggcaaagaccctcaagttgacaggggtggctttcaggctgggggcagcgtgtgtggctcaaccgtccctgttggagcctgccctgcctggcagggggctccaaggccacagtccacagccccgggcgcctcctcacccaccgtgggctctgggcaccccctccagggctgggtggactctggggtcctggccagagcggttgagatgaaatgccggacgcgtggcctcctcttccagggagatccagggaaggacggagtcgggcagccgggcctccctggcccccccggacccccgggacctgtggtctacgtgtcggagcaggacgtaaggacgctgcgtgggtgggcacccaatctgtccagaccccccacggggtgcagagatccctccccgagccccccccacacccccacatcccccaggtcaggacaggccctgactgccagtctacactccacctcctcggtgggggctgcagacgccctcggtcagagacgcctggggagcccagctccatgtggtgttggagacaccgaggagaggggagggcctgcacaggggccagtgtttttacgtcaaaggctcccattgggctcactccctgtgtccttgacactgtggccccaaagctgcatgtagtcacccagctgccccgtcagaagaagcagatgcacccttggcccctctggtgaaggttgtgttggttccggaaccttcctcccccactgcggcccgtccatcaggcctctcagctgcaccctctgcgcctgccagcagtgcatcccactggtccctgtgccaccctggcctcacagaggcagacgcatctccgcccagccacatggaacacagggaccaagccccactctgggcagggagctgagccctgggcagatgcagggcccagggcagcagagctgggtgtggccaggggttcagatccctgcagagttctctgtggccaccagtggaaggggggctgcccggggcagagctgagagcaggcaccgtcagctgtgtgacactggacaagttacctaacccttgtgctccagctccccacctaggaggtgggactctaacagtcttgagaggaggggtggagttgggaacaggcaggagagggcttgccccagcacggctttgctaggagcaggcagacaggcatcgggaggcaggggcagcccgagaggccacagggacctcggcgtgacggtcaagacatcagaacatcagaaaagcctcccgtaggccgagccacctccgccggcaagcaagggagcgtctagcagaggcaggagcattttaaaacaaaatggaagtaaaaaccatggcccttagggcgtctggagtctgcatccagctgctctgagctgaggggcgtctgtgctgcaggagggatgccccaggcccaggaagactggaaagcaacattttccttgaatttcctggtttggtgttttgttgatctgtaagtcgctcgagtccagttgaattttaaacgcggctctttgtttccgatttttccttttgctcgtggacagggatccgtcctgagcgtgccgggacctgaggtatgtgcctgcccagcttctaagagacgggcctgcggggacctgggtacaaggctgggtggggtccgggcaggcgcgagggtgcgtgatgaccccagctgacgccgtccctctttccccagggccggccgggtttcgcaggctttcccgtgagtaacctggtgccagagctgcatgctgcccggctggggaggggtctccacctggtagcacagagcagcccggtcgagctggggtgggccttgtcaggcccgagggatagcgacagtcactgcccccaaggaaatgatgggagtgggatgtgggcgagagccgctggcaggccctgtgctgggtgggcacccgtgagggtgaggcagctccttgcacctgcagaggcctgcagtgtccagagtgaggctggggccgggaggtgtcctggtgggggtcacctgcggaggcctgcagtgtccagagtgaggctggggccgcgaggggccctggtcgggctgtcgaggcaggcatattgcggggggcagctgtcgggggagatggagcagccgtcggggatgggggagatgccagccgctcgggcctcacggcctggcctccattccagggacctgcaggacccaagggcaacctgggctctaagggcgaacgaggctccccgggacccaaggtaaggggctcaggtgctgtccctcaaccccctttgtgacccaggggtggctccagcctgcccagatgaccactgttgggagggacctgggaccccccggctgctgctgtgacacgtgaggggtacatccctgctcgggccgtccctgtggtcacctcccgtgaaaggacccagcctgcgaggcccagtcacagcggccctgccttcggggctctgggtgaggctttgtggggaaggagctggccctgactctgctggacctcctgccattccagggtgagaagggtgaaccgggcagcatcttcagccccgacg

SEQ ID NO: 102586 - DNA, 1172 bp, Homo sapiens
tgccctccaccctccaccctccacccctgcttcagggtcccggggcatgcatgcacgcaccaacctggacgcaaaccccaaacccgaccctcccctcaccagtggctcctgtcctccccagggctgcctgcgccttggggacggcccagtgcacccaaagggaccacagcggcccttagggaggctatcaggtggggcacaagccgccacctaaccgtgccttcgccacaggggccctcagagaggctgccaggtggggcacaagctgccacctaaccctgtcttcttgtttttttgctcagggagagccgggcttccgaggacccccggtaagtcggtccctggctttctctgcactgagctcgggcatgacggcccccaaggacacggtcgcccgcggctgctgagcttgtgctgtgcggcccagggctcatctccctagtgcagttttaaagcgtgtggggcaggtgtcggcgtgaggctgcagtgggctcctccgagctgatgggtggcccagggtgctgtgctctgcatggcccctccccttccccaggaccccccaactcgtggtcaagggccagggtctgccccactaagcctggcccccttcctcttgcagggtccatacggacggccggggtacaagggagagattggctttcctggacggccggtgaggacctggggtctccagtgggggcggcagatggggtctggcaggtggggagcagcccaggcccacgggggtgacatgcccagaggggagtggacggccgccgcacccactgtcctcccccaagaaccggccctgcctgagcgcagctcttgtcctggatgtggctggcagtaccccacgaggggccagtacccaggaggaagccctggaggcagacagggcagtgggcctgtgtgtgctaggctcagtcacctcctcccaaaagggtccttgtgcaggaaaggggtgagaagggccggggtagcctgagagctgggaacgtgtgaggctgagcgtgggccggccgggcctggcgtggggctaacggcaggcaccctgcgggaaggtgtctggtaatcatcagtgcccagcagtccccaccccctgtgctccgccccagggtcgccccgggatgaacggattgaaaggagagaaaggggagccgggagatgccagc

SEQ ID NO: 102587 - DNA, 1041 bp, Homo sapiens
ccctgggccccctgggccccctggaaccatgggcgcctcctcaggggtaagtgtctgggcagccggctgggcacctgcgtcccgtgccctggctggttctgcagcccctgcccctcagagacactctcccacggaccccacagggagatatacaggaggccaagatgcggtttccagggtggaagcggggccaggccatgggggaatcaggtggacccaggaggacgaccaccagccgggaagtgcccagggcctgtacattgtccacggaggcgcaggagctggcggcaggcaggggtccccatggtgctcatgggggcagccgcctcagtccacacctgtccaaagccctgcggcccctgcccagcaccctgaaacgggcattccttccttccgcccctgccccccgccctccccgccaagccccacacctctgcatttggtcccagcaggtgaggctctgggctacacgccaggccatgctgggccaggtgcacgaggttcccgagggctggctcatcttcgtggccgagcaggaggagctctacgtccgcgtgcagaacgggttccggaaggtccaggtgagcgctctgtgtgacgggttctggacccgtggaagggccgaagccgcctcctggggcttaaggaaggcgagaggctcaggccccggacagggatgggagcaggtggcagccagcgcttcttaaactttcaaacttttggtaaagtttagtaaaatacttttgtgagcagttttgggtttaaagaaaagtgagctcaagcttctgaaagtggatgaacacatggcgtgtgaggggctcctggtgggtcatgtcacagtgaacgtttacaaagataaatgtcacctcacacacccgataataagacaaggcgcctgacgggacgaggcggcaggggggctcaggccctccagggccacgtgacgtccacagcacggccccggctggggggcaggctgtcccgtggctctgcaccccgcgttataaacaccaaggtgggatgaaatgcatcctctctgct

SEQ ID NO: 102588 - DNA, 1960 bp, Homo sapiens
gcttcggccatgggtgggggtctggcggctcagggccactcagggcggcttggctggccctgggacttgccctctggtggccaagcagtggtcatgaaagtccagccgctgtcacatccttgaggaaccggcgtacctccgcctacagcggcagctgggggcacccacgtggcccggggctgctctgacctggcagcgtatgggggctgctgcctgggcccctcagtgtgtcacttgcgcgcctcccgctcagcgcccctcggccgtgcctgtccacacaggtgcggggccggggtggtgcgcccggggcctgggtgcagggggcagcgtgggacacagcccgtgacgcgcccctctccccgcagctccacctggttgcgctcaacagccccctgtcaggcggcatgcggggcatccgcggggccgacttccagtgcttccagcaggcgcgggccgtggggctggcgggcaccttccgcgccttcctgtcctcgcgcctgcaggacctgtacagcatcgtgcgccgtgccgaccgcgcagccgtgcccatcgtcaacctcaaggtgggtcagtccagtcctgagggcgcgggctcctcggcccccacttgacctctggggtgaactcccagcggggagctcccctctagggcctctggaggccaccatgttacagacactggcgcctaggctggcgacttcagggcaggctccgggtgggtcacacccctccaggctcaggccaggcctctgcatccctgggcactgccacgtcccccagggcatcccatgaggcccccccgtggccccctgaccccccgctcccccggcagtgcccctcagagggtcccatgctgctggaccaagtgtccacacaggtgatagggctcacatacaagcctggaatcaggaaccgtcctttgggcctctagtgccatgcgggctggtggcccctctgccacagcacccatgtggctttattctgtggccccttttcgtgcactgggctgtggcttctgggtgccccggggagcacccacattccccagaaccaacagcagaggggtcagagacccagggctgggagcaggcggctgtggcctggcgttaggggacagggtcccctgccttagccaaggcctcttggggtctgcagaggctgcctggccaggcctggctcccccacgcttgttccctggcaggacatgcccaggggctgcagaaccccaccccccaaaaaaacacacacccacaacaccccacatacacccccaaacaccccccacaccccacacacacaacacaccccccccccacacatccacaccccacatccacacacccccccacaaacacccacacccatccacacccccacacaccacacacacatacacacggtttctcttccaggacgagctgctgtttcccagctgggaggctctgttctcaggctctgagggtccgctgaagcccggggcacgcatcttctcctttgacggcaaggacgtcctgaggcaccccacctggtaggttcccagtgccgtgtgagcagctctgagagccccagccagggaaggcgggcgggcgggctcctatctgcagtttccccccgagtttttggacaaatcttatacatgctcattactttaaaattacaaaatccaaaagagcattgagaaaaatgagaactgctctgagaagtcatcattagcaatgcgtttgagagccaggtagttgtaagaaggccccgaaggtgcccccggccctctgctcatggcggatagactccatgtctcccggatgtcaccaagcctgtggtcagccatgtaagcagcgcagcgagtttattcaccgagaataaactcctcaaagggcaacacggagtccgagcatgtgtgcccttaaaatgttgacagaaatttccagggtatctagaagaacgcttcgtcccaaatgtc

SEQ ID NO: 102589 - DNA, 1050 bp, Homo sapiens
tctcggggtgccacacagcgtgtccccagcagtgcctggccatctgctgtaacggagatgcacctgccaagggtctctgacaggagtgctgtgggcagggctgggccccagggaaggcctgaaagccaggagcccgggaggcggagctggttcctagcgaggcagccacaggaagcctctgctcagcaggcatgagggccaggttcacccagccaggccaagccctggcccctctcccctctgccgtgggtgtgtctggcagaagcagcatggggggcagtctgggagatgcagccccctccacaggcagccagcagggaggccatgtggccctccaggttgtgggagcctctgcagccccctggtaaccccagggctggcctcctgcctccacctttcctgcccggggagcggcctctgccctaagcagagcaggtctgggtttgactgacggcccggcgcgtcttacaggccccagaagagcgtgtggcatggctcggaccccaacgggcgcaggctgaccgagagctactgtgagacgtggcggacggaggctccctcggccacgggccaggcctcctcgctgctggggggcaggctcctggggcagagtgccgcgagctgccatcacgcctacatcgtgctctgcattgagaacagcttcatgactgcctccaagtagccaccgcctggatgcggatggccggagaggaccggcggctcggaggaagcccccaccgtgggcagggagcggccggccagcccctggccccaggacctggctgccatactttcctgtatagttcacgtttcatgtaatcctcaagaaataaaaggaagccaaagagtgtatttttttaaaagtttaaaacagaagcctgatgctgacattcacctgccccaactctcccctgacctgtgagcccagctgggtcaggcagggtgcagtatcatgccctgtgcaacctcttggcctgatcagaccacggctcgatttctccaggatttcctgctttgggaagccgtgctcgccccagcaggtgctgactt

SEQ ID NO: 102590 - DNA, 1041 bp, Homo sapiens
agcggggccaccacccgcggcagcccccggcccagggcctgaggagtgccgcggaggagaaggcagcacaggcactgagcgtgcaggacaagggcctcggaggcctgcagccagcccagagcccgccgctttccccagaagacagcctgggggctgtggggccagcctccctggagcagagacagagcgacccatacctggcccaggccccggccccgcaggcagctgaattcctgagcccagtgacaaccccttccccctgcactctgtgctccgcccaagcctcaggccctgaggctgcagatgagacttgtccccagctggctgtccatcctcctggtgtcagcaagctgggtttgcagtgtcttccaagcgacggtgttcagaatgtgaaccagtgactctcgggcgcccctgtggtaactttgcaggcggccctcagtgcatccccacgacccctgcctcgagggccgcctgccttagcaatgggggcctccgcttatcctgctagcaggccccctaggattccccctgccctgtgccgcactctggcggtggccacagcgtgctggcgacactcagggcagctgcctggccatgctgtccctgcactgtgccccgcgggctttgttgctggaagaggtgggtggtgggcttctgcgtccaccaggcctcactggctcatgccccttggggggcttgagacaaatcctttctgccccccagggctagtgaagtggcctcttggataccagctcaggggacactggccccacaggagttgtgagccctctagggcagggtgggagccgggaccctcaggtgtagctgagctgtgacattgctggtcatccttggtgctcttgcttttttgaaagatgctttttttttttttaactgacgtagaatgaagaactgcatgtggcttctctgtctctgtggaaaagccatctcaggttggcggcagacacattgtcatcagaggggagcagcggctctggtcctcggagctggttcctctctcccaccctaagggcagcc

SEQ ID NO: 102591 - DNA, 1049 bp, Homo sapiens
gcgtgttggggagaggggtcccaccaggcagtgttggggcaggaagccgtcagcagccatcacctcgggcgggctgtgtctgccgcagcggcagcattgctaacacctggtggggcgcacgcccgcctgtccgcaggtcacgaacgagatcacgccggtgctgtcgtactcctacctggccgtgctggtgcccgtgttcctgctcaccgactacctgcgctacacgccggtgctgctgctgcaggggctcagcttcgtgtcggtgtggctgctgctgctgctgggccactcggtggcgcacatgcagctcatggagctcttctacagcgtcaccatggccgcgcgcatcgcctattcctcctacatcttctctctcgtgcggcccgcgcgctaccagcgtgtggccggctactcgcgcgctgcggtgctgctgggcgtgttcaccagctccgtgctgggccagctgctggtcactgtgggccgagtctccttctccacgctcaactacatctcgctggccttcctcaccttcagcgtggtcctcgccctcttcctgaagcgccccaagcgcagcctcttcttcaaccgcgacgaccgggggcggtgcgaaacctcggcttcggagctggagcgcatgaatcctggcccaggcgggaagctgggacacgccctgcgggtggcctgtggggactcagtgctggcgcggatgctgcgggagctgggggacagcctgcggcggccgcagctgcgcctgtggtccctctggtgggtcttcaactcggccggctactacctggtggtctactacgtgcacatcctgtggaacgaggtggaccccaccaccaacagtgcgcgggtctacaacggcgcggcagatgctgcctccacgctgctgggtacgcatgccctggtccccgaggcttcttcccgcagaggcttcccgtccacctccgcctgccccgtggatccttcccccggaggctccctctcccgccccctgccccatggataccttcccccagaggctctccgccacctccccctgcccc

SEQ ID NO: 102592 - DNA, 1113 bp, Homo sapiens
ggtaccggtggggaacggggccacggggccgcgtgtcgggggctgcggggtgtctcggggccctggggtgagtgcggggcgcgggccgaggtttgcagggccctgtgaggtgagtgtgggggctggcgctggggtccgcggggccctggggagggtgcggggcgtgggccggggtctgcggtctgcagcctggggtccgcggggccctggggagggtgcggggcgtgggccggggtctgcggtctgcagcctggggtctggggggccctggggagggtgcggggcgtggccggggtctgcggtctgcagcctggggtctggggggccctggggagggtgcggggcgtgggccggggtctccgcgggggtcgcggtggcccgggcgcctggcagaaccgttgctgtgcagcgggtttcccgccgctcgctttccgccgcagcctgcgaatggggtggggagtcccggcccccagcctgccctccgcgtcatcctggggcgccaagtcccacccccgggtctggaggaaagcgtggatccggcgttcgcgcccaggcacgtgttgcttcgggacgggccagccggtgggtgaaccctgccagccacgcgtggggcgggcccctggcacatctccagaccattgtctcctgtgccagaagctttgtaggtgcaacttccccttggagcagctgtgggtgcggatccagcggagcaatcccgaggcgtctcagagagagcctggacagccgctggagcctttcccgagtgggtccttccaacaccgctacagcaggaaagccatccccctagggtcctgtccatcggaaactcctgtcctggggagtctggcctgcctggcctcaggacacaggccaactaagctggccccgaaatccagaatgcatccagagggaaggtgggataaagtccttggaggcgcctgttggccgccctgtaaagaggtggcctccccctacggagacccgaggatccccgcacagcccagattcaatcagcagagccgaggtgcctctggcccagtgcacctgcctgccctgtccaggcctgggagccaggctgcatctcactggccgcctttgcctgggtgccacctg

SEQ ID NO: 102593 - DNA, 1292 bp, Homo sapiens
aggttggaataaccggagtacagagtgtgtagtggtgtggaggctggaggtatggaagcatagtgaaggagttgggaccctgctggaagtgttaggggcattgtgaaatggttggaactttgttggagatggaggggggtgaaagtggaggaggagttgcatggtaggtagaataatggctcataaagctgtccacatcctaatctcaggactatgttatgttacatggcaggggagttaaggcagcagatggaatgaggttgctaatcagctgattttaaaatagggagattatcctggattatctgggtgggctctgagtaatcacaagggttcttaaaagtagaagagagaggcagaatagtcagtgtcagagtgatgtgaggtgagaaagactctagctgccattgctggctttgaagatggaagggtgcactagtcaaggaatgtgggaagcctttggaaaaggcaagaaaagggattctgtcccctagagacttgggaaaggaatgcagtccttggtttctagcccagtgagacccttgtctgacttgtgacctccaaaactgtaagataaatgtttgttgtattaaaacactaagtgtctggaagtttgttccaacagcagtaagaaaccgataaaaactgggtctcttcatttggcagtcttagctgacaaaattaaggagggaataacatgattagattggttttagaagataaaatgatggagctgccacttgggtataattcagcccagataagcatagttctattctctatttcacctcctaggtaagactggcatctgatattgtcttatttggcccaaatcccacttccagtctctctcagcagcttccacagcctataccactcccaattgccgtgtcccactgggtcatctttcctctgtgttggacacttgagaaagagtagaccaggtatgcacttaccactgagattgtggtgtcacaggctaggcccaattccaacctcatagctgttgtcagattactttccagaggtttgtttctttacatcctcactaatccttcgtagcttcagatgttttaattattgccaattgagtagatattaaatatcttactgttttaattagcatttccttggctagtgagtttgaggattttctacccatactttggccacttgagcttcttctaaaaattgtattcttatattgtttgtccacttattgtctggattatcctttttatagctttttagaagttctttacatattctggattctatttgtatcctgttct

SEQ ID NO: 102594 - DNA, 1045 bp, Homo sapiens
gtccctcccataacacatgggaattcaagatgagatttggttggggacacagccaaaccatatcagtcataatatatcctcctctttaaaaaatatttaaatatttgctttttatagtctacttagaacttatttttgtgtggggtatgagatagagatccaattttaaattttttccaaattcataaccaattgtaccagtattgtttattgaatacagtcctttccccagtgatctgcagtggtacctctgaaacacatcagatttcacaaatgcatggatcagtttctggttgcttcatgtacctaatgataatttaatttctttctccctagttcttaaatcttttattgatctttttttgtcttttttcctttgcttggaccactagagaaagttgtatggagattgtggtaagattatccttatattgtttttcatttaaaagaaatgctgtgaaagactgaattatgaactttgttattttttttttggtagattcctttattaggttaaggatgatcactttactagtagtttaataaaagctttttaaaaaaatcatgaatagattttgaattttctcaaatggttttctatacagtgtacttatttagataattttaagctttttttaaaaatcgtgattgagatgagatattttattcttttaatttaagccatcattgatttcctgggagaaactgtgatgtactacattaaaaaatattaccaggccaggtgtggtggctcacacttgtaatcccaacactgagaggctgaggctggaggatcatttgagcgcaggagttcaaaaccagactgggaaatatagtgagaccccatttttacaaaaaaaaaaaccaaagaaaaaaaattagccgggcatggtggcatgcatctgtagtcctagctacttgggggactgaggttgaaggatcacttaaggctgggaggttgaagctgcaatgaactgtgatcatgcctctgcactccagcctaaattattggacccaatatgcaaatatttgggattttggcata

SEQ ID NO: 102595 - DNA, 1030 bp, Homo sapiens
ctggcaaacactttgaatgcagctttgtgagaccctaagcagaggacccagttaagcctgcttaaattcgtgactcacagaaactgtgagatattaaatacatattggtttaaggtgttaaatttgtgatagcttgttatgtggcaatagaaaactgatgtactgatctctactgacctccccttagaagtggatttgggttgatgaagggtgttcgactctatttaaggtaaccagcttattatttattttcttttatacaacgttttttctatttataaaagtaatacaaatgttttgtgtagaaaaattggaagaaacagaaaattataaagtagaagatcaacattatccttaatcttagcacaaaaggatattcagtgttttttcctacttgtatttatgtatgatatgcatatcctaaagttgggattcattccaaagtatgttttttgaaccaatatttttccttttactagatcatgagcatttccttgtctcataatgtgttcttctaaaatatgatttcaaatggctgcatactattccaaagagtgtcccagtttattgaaccatttccctatagctagacatttatgttgctttaaaatactcatcatgataaataatgctttgaaaaatatcctatacaaaaatcattgtgcgtatcactgattgcttctaaatttctaaaggtagaactattagctcaaaggttgtaaatgtttttaagtccttttctacctaaccatctattttccaacatttctaaaaaataatgtaagacttagacatctgtttctgtaactcaccaggttgggataggacagaactattgatttttgagcatctaggttcctgttttcttaaccctgtttgcagagtggttttaaattattcattaaagtgcaatatggattctatttatagacgcatttgtgtatgagatcgctcctttaatgtttggggaaaagcctacaaattgctattatcacattcctatctttgtaaatccttttctactcctatt

SEQ ID NO: 102596 - DNA, 1057 bp, Homo sapiens
ggcttgtaattttcctttcttatagctgttctcttttctaatctgagatgaatgcttaatttattaatttgcagcttttcctttttttctaatatgtgtgtttaaagtgatatattttcttgtaaacaatgcctcaactacatcatacaaagtttgatctaaggcattttcattattgtttgttatgctttctaatttccattatggttttttcttggattcctaggtaatttagaagaacgtttaaacatttctaaacatatgcatattttcttgttttattattcttcagcaaaattatattgcccaaagatcctgctttctatgattttaatcctttgaaatatgctgatttgccttgtagcccagaatatggtatgtaagttttctcagatattcctatgtgcctggaaataattgggttcaatgtactatactaaatattctgtttagctgagttggtaagcatgttacatctgctttcttactagttttttttggttgttatattcattactgagataattacacaatttcatgatgattatggatttgtcttattttttctagcagttctgccagtttttatgtataaatttttgagactgtgttgtcagggccacacagatttaaaactattaggtcttcctgatgaatggagactttaattattatgactggttctctttatatctagtaattaatatttgactttatgatatggtatgtctgatgttaatattaacatagccatgctagatgttttaggctcatatttacatactatctttgttttttatcttattctcaaccttactatagttttatgctttaggtatgtctcttgcaaagagtatagttagatatttttttcattcaatctgacagtctttgtcttttaattggaacagttcatttacattaaatgtaattactgatctatttgggtttaaatttacgattctattatgtatttgtcttgtcctacattttctgtgtttatttttctctcttttcttgcattattttaatctgataatgtgattttttgaaaaaa

SEQ ID NO: 102597 - DNA, 1345 bp, Homo sapiens
tttcccatgctattcttgtgacagtgaataagtctcttaagatctgatggttttatacagggagtttccctgcacaagctctcttctcttgtctgttgccatgtgagacatgcctttcaccttctgccatgattgtgagggcctccccagccatgtggaactgtgagtccttcaattaaacctcttccttttgtaaattgtccattctcaggcatgtttttattagcagtgtgagaacagactaatacactgggtaagggctagagttccagatatgacaagctatatgtgactctggactctcttactgcctctttctctaaattggatggcactgaggtttgctgttagtaacaaacaggaagcgggtgttggttgaaagctctactggagtgcagtggagggagggcagattgaactctggcttatcttctaatctccatcgtctcctgctattcaagaatcaatcgcaggagtcagtgccctccacaaaaggtctccaggatgaaggaataatgaaaatgcagaaagtgatgtggaattgttagcttctaggtcacttgggagagccctaggccatgcctcgctggggacttagaggtgtggattaggttgtctatgcccattttatttcttttattaccctctaacatctttcattaccttggggtatgaagactttcctccatttgtgagccatgtttgagttgctacataaagctcagggatgtggcaggtgacgttaatgagcaagctggtctttaaatagcacagctccaataaacagaatcacctgttttatagcttgctattggagaaaagtgttcacagaggattctgaatagctgggagaacattagaaaggcagtaaaatgttccctgcccctgccgtgaagcaagactggctaagaacacaccccacagcaaagacacttcctttggtgtggaccagaatcattcatcatgatgcattaaactcaggttgcatcaaaatgaagaagggccaagccaaaatctccttgattatgggaaacttagtcatttgttctctgagtcagcttaatggtgcataatgttcacatcatattcttttggggctgggccaagaggccagcatgtttgccagcagtgcagcaatgagctaatcagccttttggctcccacattcctggccaagagctcttctggaatgagtgctgtcactgcaccagaccagagacctcacgtagactgctctttcttttcctctatgtcacatgctggtccttgctttcatcagatgatccccagatcccttctccccaagagagccctgctaggctgaggctctgagacgtgatgctag

SEQ ID NO: 102598 - DNA, 1047 bp, Homo sapiens
ttaaaccaaattgttctgttatccaacaacatttattagcacttggtggggacactgtgctgttctgagaaggggatcagggatactgcagatgatttttcgctcctaagggtttttttcagtactttaggagggagaaaatgttggtaggacaagctctccactgaaaggctgcctaagaagatgtaaaatggtggaggagatgggaaagctggagccacagcagctctctacagaaggctctgggctgagggacgcagtgcctgagaaggagggagtgaccagccttcatgtaggctggaagcagtctggcaggttacagccctagacaggaattcacatctcactgcctggtatcgggacatggagctctctggctggctcactcacatgcacgggatacctatggcacactgcgcagtggagaaaaaaaaggtctgttagcaccggagaggtggttgttgctgggcgggcaccttgcagaaggaactgtccctgtggagggtgtgggacacaggcccaagatcacagtacagggggtgctgtgtactcatcctcacttggcctcagtcctctccatctgtgggctgcttccagggctccttgtggaaatacaggaacatctcttctattgggaatccagggaacagagaattctgattaatgcgttccctttcagtttccagatcattattagaaaattccttaaaccgtaagactaagtttctgatttattccctagaacacattaaatatgattgtctttctaaaaagacaggatttttcagggcctaagggcatcattgaccacagaatattagtaatccaagtgtcctgagaaatcatctggtttagatctcctgtctcagagcagaagcacccagggagcttttcctgctattgcagagcctcccaccagactcatcaaacattgtcactggcatgcatgggtcctgtccctcagcttcttgactacagaaatgaaatcagaaaacctgacagatgagacttttgactgtggacatttgagctaatggtgaaatgagt

SEQ ID NO: 102599 - DNA, 1066 bp, Homo sapiens
gcaaagccgacgttctgcttcatcactgaataaaactatgggactgaggaagtttaattctactgagatagcctgactcagcataccctacttccctccttcctaggggttccacatgccgaaattgggaaaaagctttagactggttctatgtgaaaggaggatgtttgggatcaccatgtgggtactatgggggagggataggttgcagcttttcttctcaagggctagagtggtgctctggtctcctgaaggtattcctgcagagggtgggccactttatgggaggaggtgtggcaggagggtcagaatctgcatttctgcccaattccaaggtcaaattgctgctgtgagagttcagggatcctgtgaatccccatggtttctgaccccctgaacccttgaggaacactgttgatcaagaagccaaggagggcaacaccactgttttgctgcttaagtttggaaaccatagaaatcttggaagctgacaaaggattctcctaaaattcaggaaacaaagtgaaagggatcacttgtaaaacatagcttcatataagcaaacttcatgagataaagaaataaaaatcaatgtctcatttaaatagaaaaagaaaagctagcaaccgtagcttgcagcaggggtgggagttaatacaatgaggggttaatcccttcaaagattcagaaatacttttagggaattaatgtccaagatctaatggcatattggtgactgtgattcatgtgggttccgtagaggcttttagaccctggctctgtttcaagggcggaagaatcctttgttccccgtaggagcatttgcactgttcacacacatgtccagttgtccagaaagctctgcatatggctgggcgaggcccccactggcaggcccatgtgtgtgcagaggccaagggacccagcatggatgaagaagctggcctgagcttcagtgcctggtagatgtgatttcaaagactggtttccttgcttgctagcggcagaacttttggacaaatgcttagcctttctgggcctccgtttccccatttgtaaaacagaa

SEQ ID NO: 102600 - DNA, 2093 bp, Homo sapiens
taagttcatgtactaactgacattgaaacaaaaatcatttcgtaaatcattacaagttgatagtgagtaaagcccatcagtgtaattttgtaagattgaaacatgggtatatgtatctatattgacacatacctgaagtatgatctatcttagatatgaaagtgaaatgaaaagtacacattgtgggcagatactgagtgtctggaaggagggaaggggctgctgtcccagcaagggagcacagcccgcacaacacgcaggttggatgccaggcccggggtcgagctcagggtctgtgggatctgcattccctggccttgtcagtcatgtcatggccatgccacttttgaggtggaggagtaaagaagttcacctgctgactgcttccttctttttccgctgagaccatcaccgagagtggtaattatttataatagaaatggtgattactggtggattctgtgataggaattaagttgaatcttccttgcccgtcctcctccagcataagctgttttaaattctagctcccccacatcctgcttcttgttggcactgtaaaactctcaattcactcacctggagggggtaagttaatgagacactctctcccccagatctggagaaattcagagtcaaggctgtccccctcctgaagtcagatccttcctgtggcctatttaggttttaggtaaaaacatagcatttgctcattttcctttattgagatctgttgaagtctgagctcctattaacacatttatcgaaaatggaacctatgagcaaattcctaggagctgcatttccaggggtgtccagctgtgacccaccccgccccctcccggtgttaccctgagttatgagaatgcagtctttggaagtggtgggctaaaacactccacagggtggtgcatgggggctgcccacactccctgctgctttctgctctctgcttgttcatcctctcccaacggggcagccccagaagccaacactgcatgttggaaggagtcccagccctgcccctgccaagcgaggtggggacagctgggaatctcgctgccttcatggtggcgggccaggctgctctgtaacacgaacattaaaactgatttgaggtgttagcggtgtcactgtaagtgtgagaatgagaagcggtgtgagacgtgtagatttgtgggcagtgatggggaacagcaagggtggggtgcctcggtgggatctgaaagagaacccgcccccctcagctggagtggcactctgtaacccgccccccctcagctggagtggcactctgttggctgttgttttcaggctgttgggccgtgaggctgctctggtctgagaaagtgggtggcaggaggacaggacggcctctctgtgagggaggcactgactctcaggagatgctgtcattgggatactacagtattccatgaacttcctctataacttaaatgatgaaagttacagataatagctcaaataaactgttgtgagccgttaagtatggcagtttgtatcatggttaaatctgcagaaggtgtaacattttgcttgggtttttttttgccttattactggccgtgttttaaaaatatctttcttatgaagaaattctgtcgtggctgtgtgatttcccctgcgatgctaggatgtgtttgcaaaccagtggcaatgccagagcctgggccctgggctgcggtgcgttggctgggtgtggtctgtggtagcttccacctgctgcctgcgcttgggaagtgccctgacctctgagcagatgacctctgagcagatgacctctgagcagatggtttctgatggtggttttttttctgattaattgaattacaagtatcctgtggtaggtacagggttttccctttcccttgtccaataaatcttaacttcattctgtgatttttagaaaaggaagaatgcccacagatgtggaggcacagatgccctgggcctcgcagcaagcttatccttaacaacccattctccttcaggccctgccacttagggagaagactgtgggggcagtgcctgcctgtcctctctccattaagcctctgctgggggcctgcctc

SEQ ID NO: 102601 - DNA, 1731 bp, Homo sapiens
tagttttgtaaaactaccttgagatgactccttttaaaattatccttaagatgtctttctttttctaaagcttattaaaggtcattttcaaaacgttttcagcaggaacttggtgtatatttgcagttctgcatggaaaactaatggagtcatgatggctgctgatgctgatgaagtagtaccagccagcctgatttcataacttccatagaatcactcccttcttcctcccagtgcccctttgagatagggattgttattccctgaggcttggcgaggtgaagtaactcactcaggttatcttggtgccagtggtggggctgggatttgagccaagtcttccaacttcacaatagcagagtaagaagagctgccttgttgatgggacgtgggtcggagctcccagtgtgtcttgccttcctggtgtgcttgatggcagccctgggctgctgtgaggtcctgagcacagtgcatcctgaggagacagtgctgcgggccccgcctactaacttccagagatgtcagctgcagcagggcagcgccctggttagagagacggcatggggagttggcagggggaggccctcggagagatggcatggggagttggcagggggaggctctcggagagatggcatggaggggttggggcctgtgctcctaggtgcttaggcttgcaggtgactggaatcctgactaatatcataagaggagagttcttactaacaaattacttgaacaaagactttgtttgttccttcattcgttcagcacatgtttacagtgtgcctgtgatgtcccaggcgcactgccagaatcctgacatccttgtggggggatcgaaaacataaatctagtcagtgagttcatcctgtggcatgtcagggggtgacagtggctgtggaggaaacagggaagggcagggtgtgggagtcctggtgctgtgtgaataggccgtcaggtcagccctgagacacggggcatctgcgcgagtcttgctggaggtgcacgtgtgagccccttggtgcaggaggtgaggagctgcagggccaagggggtttggagcagaagctcgggtctgacatgcctggtgcatccatggggcagtgaggaggctgcggggcaggaggtgagagtgccgcgggttaggaggtgagggtgcagctggggcacatcaggggtctcacaggtcatcccgaggctgctctcagtccacgtggcgtcggggctgagaggagcccacagcagggtgggtgtgggagcagggagccagccagtctcttctctgtgctaggttattgttgtggctttagctaaagctgctgtaatacctgtttcttagaggaatccaaatccctgttgccttggggccaactttgtaatcttacaaatctggatctaattttcaccaaactctcaagggaagagcctctgggactcagacagataaacaacacctgttatgtgctgttcccattttctcttcgactttggtgttgtccaaattcttctgagcctaactgtaggctcttcagacccagcctacagttctggaaataaaccagcgtgctggggtggggcgagcccgaccatgcaagccatgccccggcagccaggctgagaggcagagcaagcagtgcaggtggacccatcgcctgccagcatgtgggttctggaggctgcagcaggcagattctggaaattccctgaggccttcgttcagtacagaca

SEQ ID NO: 102602 - DNA, 1917 bp, Homo sapiens
ggaagctaacagctgatacataaagttgtaagatcaagaatagcaatacaaactcagtaattagaaatatggagataaagaaatgccaaaagaggctaagagctcagggaaggattgtgatgtagggggcaagggaggggtagggccactgcttttcataagctttatcgaattatttgcttttaaaaactgtgtatatttatagttttattaaaaataaaaaattttaaaggttatatggcaaatattattttataaaaaattgatgaacctcaggccctgagctcccttgcttgccctgctcctgccagggcagacttccactgcccttgccctctggtcctctccacttcagaggcccggcctctggcttggtgaatctgaggcagatctttctcctcaggttgcttgagctctgcagcgttaggcctggtgagcgcctcttgcccagtgccctgggggcggtggggaaattccagtccagactgtctgcctcaggcattcagtacacactttcgtgccctgctttttaactgaatagtattctgcaaagtgttcgaccttacctagtttgagaacattatttttagaaggttgcatggtttcccatgttgtggatctaggtatcatttattggattattccctttttgtttattttttctgattttccactaatatccataatacgaggtaaacacccttgtgcataaatccacagcagcttcctctcttttgtaggcagtgttcacacctacagaattcctgggtcagaggacatggacatttaaaagaggcataatgtgtaattgccaggttgatctcaaaagtgcaagtttgtacttgaacaaggctgtaccagagtgcctgtgctgttgtatcctgacacaccaggtactgcatacgtctccatctcgaaatgcagaagcacactgaacacacatggcttagctctttaacaataatgtcgttttcccccatgctcataagcattcttgcattattgaagatactctgcttttatgtctgtgggaggaattttccccagttgagtcgtgcactttttcatctgatctgtagcattttgggtagctcgctcagtattttccgttgtgatgtcgtctcttattgtgtttacatttagaaaatccttttcttgggatttaattaggtgtatgttcttaggtgaagatctaagttattttttcttatattagaaacaccatttattcaaaatacttcatttttctaatgattcatgctgcaactttttatgtatgtgtaccacatatgaaaatattgtgtattttagtgtctgtttctgaattctctaattgacctctttgttctagtgctggtacactgttttaattattttagtttcacgatatatttccatatctgataaaggtaaccaatatttcaaaaaatattttggttattcttggctacctactttctaaatgaactttagaatgattttcaagtttaaaaagttaatcatattgaggtttcttttcaaatggatcagatctataatttaaattataaacagctgacattttaacaatatttaaatagtttcctatatagaaagggaatctgtctttccatttattctgttattagccttcagttacatttcatagctttcttgctgtaggttttatctttcaaatttttttccaactaatttgtgttatttggttattgtaattgggatttttcccattgcatttatcaaatatttaacattatataggaaaactatcagtttttatatatttgaatgtggtcacatgttaaaatggttttatttgcaaaagggttttcaggtgaaatttgacttatttttaccttgacccaacattcaccatgaagtatgctccctgtagctctctggtatatattcttcatt

SEQ ID NO: 102603 - DNA, 1038 bp, Homo sapiens
tacttactgggatccccagtgggatgttgattagagatggtgagaagggacatctttgtcttgtttctgctcttgggggaagcatctggtttctcaccttaagtatgatgatagctttttatcaggttaaggaatttgctgaaaatttttatcatgaatgctagttgaattttgtcacatattttatctacatcaattaaaataatgtatggtttttcatttttaatctatataatggcaaattactttgatttttgattgttgagcgaaggtttccaagttaaatcctactaagttatgatgtgttacagtaaagggattttgttaagaatttgtgcatctatattcatgggggatttgggtttgtagtgttctttccttgaagtggctttgtataggtttgctgttaagataaatttgacctcataaaatgatttgggaaggatttcctccttttctgttttcaggagtttgtgtgaagtcatgttttatctttcttaaattgtttattagaatttgccattaaagcaatttgggcctggagtttcttgttgttgttgttggagagtttttaaactgtgaattcagtttctttaattgttataagatttttttctgtgtggatctgagtttttgtttgatatcatccggaacagcttccgctaacattccatgttttttatcttgtcaaatatcacctctgccgcattatttttctcttctttggaaacctcagttacattatgtcagacgttcttactctgtacttctcatcatttcttttcatattcaccttccttctctggtttttactgtaatccacagtagacagacagaacacagcccagagggacaaagagatataaactattcaagagaagatttcagacatggagagacatggacaagttataacatataattcattggttttccagaaagagaaggggggacaatggagtaaaagtaacatttggaataatggttaacagttttctagggtgtgtgaaagccaccaatctacagtttcaaaaactc

SEQ ID NO: 102604 - DNA, 1050 bp, Homo sapiens
acaagcagcagtggcgctgcccctacatggggcatgctttgcagggctgaggttttgcagttcccaccattgagggctgtaacatttctctatttctggcttagaatgtgtgtaggatgataattatttattcagcattcattccgctcacgctgtgctccgaccacacaccaggctctgcgtgcggtgctggcacagtctcaggactccgcttctcagctgtagggctcagggtgcagtggagaaggcgcgaaggggctgcccgcggatggatttgttcccttggcctttcactgttgctcctctcactctcttctcctaaactcggcgtagaggagcatcctcaggagaaacaggaagaggcaaagttcactgcaaagttttttttgggttgaacgcctgtaggataagaatagcagagggcacccccagatgagatgcggccgtggtcgagcatcaggatcgtctgcctgcgcccaccagtgtggtccgggagcagggaggtggcagagccagggccgcgccctccccgcgggtctcccgtgctgctcgctggcggttggtttcatcagtgccctggcgagtgtcgctggttgcacgtgggcactgcccacacagagcgaattctcaggcaggcccccttcctctctctccccggaagctgcttcatggcactccctccctttgcccttggccgtgggaacctctaggttgatcactgggtcattggatctgcttttagttagccttgatttttgtctgcattaaacaattaaatgagcttctaataatacggtgttttgaatgtcatacatggcttttcctgttgaaacatctgcagaaaaaaaatagctttattatttgtgagtgaagctgtctagctcctcccttttgttcttagtgagataattgcttttgtaatacaaagtttctcattcttttttttttcttttttttttttttgtttttgagatgaagttttgctcttgttgcctgggctggagtgcaatggcgcaatcttggctcaccgcaacctccgcctcccgggtt

SEQ ID NO: 102605 - DNA, 1135 bp, Homo sapiens
atctgagtttcgttttgtttgagacagggtcttgctctgttgcccaggctggagtgcaatggcgtgatcatagctcactgcatcctcaacttcctgggcccaagtgatccttccaccccagcctcctgagtagctgggactacaggcgcgtgtcaccacacctggctaatttttttttttttttaaatagagactaggtctccctgtgttgcccatgctggtctcaaactccagaccagccgtagctcaagtgatccttccgccctggccccccacagtgctgggattacaggtgtaagccgctgtgcctggcctcatccgagttttttggaagtgtttccttgctgcctaaattatatggtggggcctccagggaacaaagcgagtccccctgcttgggccctggtggtcactggcattcctgcccacacagcagtgggggacatcccaggctagggctaatggctgtccacagggtagggccttgcttctccgtcactttgctccactagacagtagagtttggttggggtctgtagcatgccaggcacctttgacgcttcacaaatgtgttaccagatttttaaaaaggtatttctgctataactgaggatgtggactgttgcaacaggaaaagttgaaagccttactaaagagatcaggctttgaggtatagctcaggtaatgctacctgcaagtaaagggtaactttttagcagactatagcaaaggcggggagagactggggagacctacgggggaagatgggggcacctacagttgcaaggtgggcaccagttgtcaggagttgacaggagggcatagccaggaacagctggtgtctccttactgggacatgctgtgacctgtagaatcgtgtctgaccatttctggaggatgcagtactgaattcaagtaacaaggtgtcctgtgaaccccccacagtcagatgggtgagggatggggagggtcacgcagggtgtgggcggcgtgcctggcatgggtcctgccaagttcgtcaggtaacgtgatacttctcccttgctttttggtagatggacagtgtgtcaccctcggggagcaggtgggctggcaggacaggcggccccaggccgggagaaggagacactcccag

SEQ ID NO: 102606 - DNA, 1054 bp, Homo sapiens
ttttttgagacagagtcttgctctgtcgtcccgggctggagtgcagtggcgcgatctcggcttactgcaacctcgggctcccaggttcaaacgattctcctgcttcagcctcccggagtagctgggattacaggcacttgccaccacgcccggctacttttttgtatttttagtagagagggttttgccatgttggccaggctggtctccaatgctgtcttcttttaagatttgattttccgttgctggctggtgtggggatgtggagcgccctcaccctgtgaaggcatcccttcccgtcactgtgtcggtccctgtggttttcgctgcccgtgtcccctgtgctgctgctccttgctgctggcctctggctgtgtcaccagctctggagtggccctagactcacgagagagcatgcaggtcccaaaccgagagtggctggaggcaggagtgctgcaggagtgcctgggccagccccctgtccaagtagggagctctgcccagctcccaaaagagcctcctcacaaagccagtcactgagcccgagcagcgcggtcgcccctgacgcggcaccttccttccaggctcctacctggctcagggcgtccagcggcagccagacaggctgggggcccctccatgttgcgcgctccggctgactcaccggggctgggggcccttccacgcggcgcgctccagctgactcaccgggcctgggggcccctccgtgctgcgcgctccggctgactcactggggctgggggcccctccgtgctgcgtgctgcggctgactctctgctgcacatgtgctggcagctgttccaggttgccacatcctgggattatcttttccagtaaactgtggggtcagcaggcccagtactcgccttgctgctgcttttcaccccctgcaccatggggatgcattgggtcaagtcacacaacgtcagaaaactcaaattcgattaaaaactcaggtctgctactgggctcctgggaaagtgcagagtcagttggggccactctggcaggctgcagtgcctctgcttccccc

SEQ ID NO: 102607 - DNA, 1056 bp, Homo sapiens
ggtcaggggactctggcaccccgtgactgtgtgttgaggccacagcagaagcagggggcaaagccccagggcgctgggcctgtgagctgcaagtcccctgggcctcacaggggtagctcctgccagtctccggctgctgagagaggtgcttccgtgaccctgggcagatgcagacctcggccaggggctgcggtggcctgcccagcgtcaggagggaggcagccgtggggcctccctggagacctctcccaaggccctcccctgaactcccgtgcaccctgtgcccagcaggcgaggcctggtcagcacatggtgggtgggcaaccccattctcctgccacccgggaggccggagtgggagcggcccaggacacccctggatgtgcgtggtccgtgagactcttctctagcagcagctgtgccttctctctccaggtgacgccttctgggccccatctgtccttcctcacagcaccctcagcaccttaagccaccaccctcagccacaatttggcagaaggatggagtccaaggtctcagaaggtggcctgaatgtgaccctcaccatccgcctgctgatgcatggaaaggtaagaggagccgccattgtctctgtaggaaaggcggccgcggcagacagaaccagagatgcactgcccgggccattggcactgtaggaaaggcagacatggcacatagaaccggagatgcactgcccgggccattgtctctgtaggaaaggcagacatggcacatagaaccggagatgcactgcccgggccattgtctctgtaggaaaggcggccgcggcacatagaactggagacgcactgcccgggccattgtctctgtaggaaaggcagacatggcacatagaaccggagatgcactgcccgggccattggcactgtaggaaaggcggccgcggcacatagaaccagagatgcactgcccgggccattgtctctgtaggaaaggcagacatggcacatagaaccggagacgcactgcctgggccattgtctctgtaggaaaggcagacatggcacatagaac

SEQ ID NO: 102608 - DNA, 1045 bp, Homo sapiens
aattttcaaaaccgtaataattagtggagacctcttactgggcagatcactcttcgattcttttgctttaagaaacttggagtcggaagcatcaaggctgaactgtttccctcccacccgctgaactggccagctcagctctgcccgcccagaggaagtgggtgcggctcccctggggctcctggtgccctgggagggttggccctttgtcctaggatggggacaggtggagaggcacacgagggggaagcttctaccggagggtccttgtcatgctggagggtggcggcgggtgctgagccgtggtgcagccaggttgcagtctgacggggtctctctctctctctaggcctacacaatccagggacagtatgccatccctcacccggatgtgagtcttcactttgtcttcctctcacctttctcttctcatggttgtttacctacctgcatgctgctgttaattgctactaacattaatattacacaataatattaatcaacttctcagcgttcctgacctgtgtcgtatccatatgacctcgaataaccttttaacctcttagcactaattctgcttgtgttgaggacttggcctgatgtcaaattgtctcaattctgccgcagtcctgggttttcctccctcccacggggcctgggagggaactgagacgggctctgtccccgtgcagggcagtgaggatgtgctcacccgccacaggcaggcgtcagtgatactttctctgcgcctaagaagttgggtgacattatcaaacaggccacaaagataccttggcaagcacatttgagggcctggtgaaattaactccccctttcagagtccacatgaaaacatagggtccatctacacacacagatccaggctgtggaaagccagtggaataggcctttgtcttcattccagaatcagtgggatgccaggcgggcatagcgtccttggctccgcccgggccatgcggagctgggtcccatgcagctccatgaccgggggctccgacacctcttttctgctcctgctgggtct

SEQ ID NO: 102609 - DNA, 1120 bp, Homo sapiens
gagaatagataacaatagttattccattaaaggcaacacatgaatcaaatggtagagaaacgctgatcaagaaaagcctttccccacctgccccagaggccgtttttagtggttcctggcgtcagacctttggtgatgctgctgtagctacatcaaggacatctcatcctggggtcagctgtagacaccagtgcctgaccccactaggaagccgggctgtggccaccacacaccggaaggcactgttggggctgccccagcctgcgcccagcagcagcgttgggcagaagcagaggtgtgtgtgtgtgtgtgtgtgtgcgcgcgcgcgtgcgcgtccccgtgcatgtgtgtggcaggggtgtggggggcaggtgtgatgtgtcctaacagaaagcctgtgtgaaggaagatgaagatggaagccaggggagtcagaggcgactttctggggtggcccagttccattaaggactcaggacaggtggtcacgcacatctagagatgcacgtgtgcagaggcaggttccaaagggggggtcacttgactttgcaaagctctggaacccaaaggaaaggcagtgtgcggtgcccttggtaaagggaaggttagtcgatggggtcagggtttgtgtttaccccagacagtcgccctgaagttggatgctcagacctgcagggaccctctggtgacaccttacggatttcctgtggccacagagcctaacgttctcactgtggcctttggctgagcacccgtctgagccagaatgcttgtggtctgaaatttccagaggccgtggctgtgtgccacggtgggactgcaggaccctgatgtttggtgattggcttttacttcgattggtggctttgctctttctcatgtgactttctcagtatctcttagaaatgggtagttgtgcagattgtttcaaattagtttaatgtataactaactgttaagagaactgcctcagtgcatgtggtaatgatttgagatacctggtgctatggtttaaatatgtctattcctccacaatttctctgttggaacctaatcaccaaggtgacagtattagagggtggggggtcccagggctggggagtgattgggtcatgagcgc

SEQ ID NO: 102610 - DNA, 1049 bp, Homo sapiens
agatgggagaagtccagacgcgtccctccaacgagggcctctgcatggctggggatgccccagaccccgaggcctctggcaacgacctcacgcgtgcggcttgcagggacgcgtgtgggcgtggtgcagtacagccacgagggcacctttgaggccatccagctggacgacgaacgtatcgactccctgtcgagcttcaaggaggctgtcaagaacctcgagtggattgcgggcggcacctggacaccctcagccctcaagtttgcctacgaccgcctcatcaaggagagccggcgccagaagacacgtgtgtttgcggtggtcatcacggacgggcgccacgaccctcgggacgatgacctcaacttgcgggcgctgtgcgaccgcgacgtcacagtgacggccatcggcatcggggacatgttccacgagaagcacgagagtgaaaacctctactccatcgcctgcgacaagccacagcaggtgcgcaacatgacgctgttctccgacctggtcgctgagaagttcatcgatgacatggaggacgtcctctgcccgggtgagcgtgtgggcgcggggcagtcggccgaggagcagcaggccccagccgctgtctagcgtgagccccagggacacccctcacctgagggatgaatgtgcagcccaggatcttgggctgtgggtgggaaggggtcgggccctctcggggctgcagggcagaggccagctgcaccctgagcctgtctaggcagatcagtgaacggccgctgagggttcgctagggactgaccctggcctggcccggcctctctcctctcttccagaccctcagatcgtgtgcccagaccttccctgccaaacaggtaatgcagggcaccctgagccaccaccccagactagcaaagcagccctggtgtccttcctcctcgagggccgggctgggggaggggccgtgcagggacccggggggcggcggagccactgcggaggctgctccttagggagatggccccaggatggcagcacaggggaggaggggcttggggaag

SEQ ID NO: 102611 - DNA, 1020 bp, Homo sapiens
ggggtgaggggcaggcagcagttgtagttactgccgcggggcactgctatgtgcagggacagccagcacccagcccatcaccactccctgggctggctggcaggtatggcaccctgggagcccggcatatacccagggcacccctacggctgccgccagtctcatgcccaggtgggtgctctgggctggagcgagggccaggttttgggccgaggcttccccaggcaatcctgtgagctcccttctagcctctgacccagtctggtctggcttgcatggatgtagggcttggggtgggaagttcaggtcctggctttgcctttgcctgatgtggatgagcagctcacatgctcagggccacctgagactgtcactgctctcccctggctactgggaggagtcactgagagcttcgttacccctgctgccttgcccagggcacaccctatacctccttatctgctcttcccctccctgccgccttctgggcaggtagcagtccctggcctctccccctggctgatcactctccctcaggcagtggagatctgcgtctggacaccctcagatcctgtcattgcctgcccagagtccttcaggggcacccctctgccttggtgtgcagtccagggctctcacccaggtgccgcaccctctggggtcttctgtccagctcccttgccccatgtgctgtcactgactctccttgggactcgcctgcctgctcagagccctgcagggcttggtcagctgcctgttcagtgtcaacacttccctgcacatcttaaaactgggctttattttcgctgaaggaactgtgttgggacccttgacatctgtcaggtttgcacatgctgtttttttttctcagcccacgtgttctcccccacgtggggtagcagcaggacagacagtgaatcacagagtctgccctgagcagaggctgctgtccctgggactcctagccatggtcagactgtacaaaacggttttccagaaatgaaatgtaaatccattttt

SEQ ID NO: 102612 - DNA, 1035 bp, Homo sapiens
gcctgtgtccccagcctgtcattgctgtggctccgcttctcagggagcctaggaagaaggtgtggcaagagcccgaggcgctggctgcacctggcggggcctgtgggcgtcagtttagacccatccattctcactgcagcattccagggtttgcccttatgctcggctgtgtgagggtgaggatgatgctgtgggggcatgcatgctgggtgtgtttcagccttctcttccaccaggcatcctgacatcgaggcccaggagagaggagtccggtgtctacttgagaaacagctccccaatggcgactggccgcaggtatgccgccagggacctgagcgcacaaggcccagcactgacctccagcgtgcatggctgtttccacgtccccctgctctgtgtcctttttggggtactttggacacttgggaggcgtcacctctgccagtgaatgccacagttggtggcaggtctgtggcaggtggtcgggtcctaaagtccagatcttgctgttgtttcaagtgatgctctgggtgggggaggagctggatgggagaagccagtgggcgggaagcctttttgctgcaggacagaccctcccactccagatgacctagtggcccctcactgagccagaagtccctgtggtgtgggtgtcatgaggtcatgtgaggccaaccgccctcccctgggatgaggctgagttggtggaagctgatgtggttgtgaggggctggtgaccctggcttagggtttgctgcagggcggggagtctgagctgggctgatggtgccatgactgatgcgggatggactacttgctttcctatgctcttgcttaattagccctttccaggctgactcacccacaagccagccaagccaacagccagggctccagttcagggactagccctcagctgactggtgaagcctttgtgtttatttctctgtgttcttttaggaaaacattgctggggtcttcaacaagtcctgtgccatctcctacacgagctacaggaacatcttccccatctgg

SEQ ID NO: 102613 - DNA, 1063 bp, Homo sapiens
tccacaagcgtttcccggagcacagggcagcggagatccggtaaggagggtctcagccattcagtgtgggcgctgccaagtcgggggccaagacccagacgcatcattctgtgacacggccctggtggcccatctcagaagcgaaactcatggaaacatgcaagaggcttcggatgttgtggaatccagtcatatgccctaaagcatacaaaatatctgttaggggctcagaatagcacagttatgatacaaaaatggattttctctctcttttaataatgttaagaagacatcacatacctgactccaccggtgtcccagaaacggtttttaagtaacctttcctgttgaagggtagcaagtattcagaaaagtgtacaggttggtcttcttgaagcaaacaggaagcgaacagtgccagcattagacatggtgacaccaccagagccctcggcccgccccatgacggggccgcccacatgcctgccaggtcgtgggtgtctgttgctcgctttggatcttgtctaggtggactcctgaggtgtggaattcgtgttgccttctcctgctctcctgctctcctgctcgcggttagtcaggtggctcgggtaacagcagcgttctctccctcgggccttcggttgaacacagatgccgcgctatccagctgcctgttctcagcacctgggaggatttcagtctgggttattatgaagcatctactgtgaacactcttgtacttatcttttgggggcacctgggtacccatttctcatggtcacgtacctaggagtggcattgctgtgttagagggtacgttatagggtatgtgatttttgtaggttcttctttatcctatcacgattacatttttttacttttgttcaacctggtgtagactcaccttggtcacaatgcactgtcctttttatatattgctagattcaatttgaagaatattttgttaggattttagcaactctggttacaagagacgctggtctataatttttttttctttataatgtttttgtcaggttttcctgttaagatgatgctggac

SEQ ID NO: 102614 - DNA, 1032 bp, Homo sapiens
gctgtgggtggtgagctaaacaggtgcaggccctcgcgcgcctcgcagcaccagtggtggctgtggccggcagagtaagctcccaggcacgttctgcctctccagtcctgcccagtctgtctcagcgatgtcccagatggggacgtcccgtggtgacgtgttctctgcttccacatttgccctcgatgctgcccaggtcccagataaccctcccgactaccagaagtactaccgccagatgcgcaaggtatgcgggagccagccccatccctgtcccgtcccccaggggaggccgccctcagcagggtgggtccttccctctgaagggggggctcctccctgggggactcctcccttggcgtttttgggtgtcctgctgtggtggatgcctggcctaggggctcatgcttcatgttgctgagctgcctggcacatggaggcacagttggcttgcacacacagccgtgcctcagagcagttccagtggtcacggcacacacaggcttcagaaggacagccgaagtgtagccagtgtgtccggggaaggcagaggaaagaagtagacctcagagccggtgtgggctgtgaccacaggtgcagactgtgaaattaggcatggacccagctgctgctgcctgtttacaatgggggtggggggcacctgggccccatcctgtccgtcgtgagatctgcaggtgttgagggtgtgagctgcacccctgagggtccctgtgctggaagctggaggtctgtctggatgtacccagcttggggccctggctgcacccacacctttggtggctgggcccctgccctgaccgggtgctctgtggtggggagggatgcgtgcggctgtggggaggttctgagaactggggtgtggacacccccagcctggagtcatggcttgtgctctgcagggtggcttctccttcagtacgctggactgcggctggatcgtttctgactgcacggctgaggccttgaaggctgtgctgctcctgcaggagaagtgtccccatgtcaccgagc

SEQ ID NO: 102615 - DNA, 1006 bp, Homo sapiens
agaggaacaacgtggcccccgacgagctgtacacgccgcacagctggctgctccgcgtggtatatggtgagcgcctcctgaggggccggcagggcagcccagggtcagggtcagggtgtcgcccactcattcacgcactcatcccctgccagcggcactgggccacctcctctgtgccaggccccagggggcgggatctcatcgccctgcccctccaccctgagaaccagctggtcttctactctcaggagtccaccctgtgcaagggtgtgtggtaggaggtgtggggcagcccctcctgggcagggaaggaggagctcagagaccaggcctgggggtgggtgggagggggaaaccctgggaagggcaagtccaggcgttgcagtgcatggagctccaggctgaggccagtgtcatggtgtctggcatccactgacccctgtcccctgtagcgctcctcaacctgtatgagcaccaccacagtgcccacctgcggcagcgggccgtgcagaagctgtatgaacacattgtggccgacgaccgattcaccaagagcatcagcatcggcccggtcagtgcccctgcccggcctctgactgcagcccctgggggttgaggtccgaaagtgaagtcctagaggccgggctgtgagctgggagtggggtttcctggagcctggtgtacctccatttgggaggtggccctctgatcgcacaagtgtctgagggcttctgtcctggacccctgcacgcccagctcagtgaagttgccccaccacactcgaccccccgcttccgtcccccaccggctcttgtcctcagtgtgcctggacactctcctagaggcccctccctgagatcttgctggctagctggctagctgggaggggtgctttttcctcacttggttccctctccccaaacagttcatcattcgccattctcccgtggggtttagacatgcccagggtgggtgggagtagcaggtgccactcctgattcctcct

SEQ ID NO: 102616 - DNA, 1050 bp, Homo sapiens
tgatccaccagcctcggcctcccaaagtgctagggttacaggcgtgagccaccgtgcccctcctaaagtttcttaaatacacttttaaaagtaaactttaaattttggagtagtttccaatttctggaaaagttgcaaagatagccaagagtgttccctggggccctcacaccatatccccattgttgatgttttatgttaccaaggtacgtttgttgtagctaagaaacccacggacaatcctaagcatttaggagctccatcacctggttttaggatgcaaaatgctgaccgaactaggaggtgcagctcctcagagggtgcacctatggttcaactgtgcccctcaggagcacggttgggaaatgcccgcagatgcactgacgtggtggggaatagccatccaccagtgttcgtgcttgaaagggcccaaggtatggatgctggcggagggggcaggcttgagtcttggggtctcccactgactcctgctgttgccccaggctgtttcctgactgggcaccggcacacccctccacactctggtgccactgccggcaggtgtacctgcccatgagctactgctacgccgttcggctgagtgccgcggaagacccgctggtccagagcctccgccaggtaggacctcatcagggaacaaagtgaaggcctctggggctgggacccacagggcctggggcttctggaatctaaccacacctgtccactcacctggtggccctgtggagcggagagccctgtggagcagagcctccaccttcctccatcctataataaacagtgagcaagctctgcccagaggggacttgtgctatgggacagtcagtagctgtagcccagggttcctgggggggacttccaggactcaagggatgcaggaggcagatgtgcactgtgtcctctggaagcaggcctgaggcgaggtttgaggtgcaggatgtttatcaggcctgccatggggaagaaggaggggcagagggaggaaatgagcttctgggcagacctgggactcatggagctggggagctc

SEQ ID NO: 102617 - DNA, 1057 bp, Homo sapiens
ctttcctttgcaggttaaggcggctcagaaacaagacagctcaccagatgaaggttcagcacttctaccagcagctgctgaggtctgtcatgctgcacccttctgcgcaccccctggtgatccccgttccccaatctgtcacactggcagcccccttcatgcatctccaactgaggtctcttcgatgagctccagacttggtttctagtttgcagttcaatctctgaacctgattttcctccaacctgccccttcctgctcataggatgtgtgtgctgctcctgcaagggtctcacacactggctaatccacggtggtctgttcctcccagtgatgtggcatgggcgtctctggacctgccatccctcgtggctgagcacctccctgggaggcaggagcatgtgttttggaagctggtgctggtgttgccggatgtagaggagcagtccccagagagttgtggcaggtcaggaagggttttcccctgtggggtttccaagaggtggagtgggcagggcagggttgtgggccagggccgggtattcctcttatgtgtgatgggaactcggaagtgtaggtttatgttttaatgcttggatttacagtctgttttgctcatgattttaagttgaaactttagatttgattatttcaatttttattccataaacttggtgtattagtccgttctcacactgctttaaagaaatatctgagactgggtactttataaagaggtttaattggctcggctgtacaggaagcatggctggggaggcctcaggaaacccacaatcatggtggaaggctaaggggagggaggcatgtcttacatggccaaagcaggaggaagagagagagaagggggagatgccacatgcttaaccagatctcgtgagagctcactatcatgagaacagcaaagtgggaggtgccacacacttctaaacaaccagatctcgtgacagctcactgtaatgagaacagcaagggggaggtgctgcacacttaaccaggtctcgcgaggctcactttcatgagaacagcaagggggagt

SEQ ID NO: 102618 - DNA, 1038 bp, Homo sapiens
caccaggctaatttttttgtatttttagtagagacagggtttcaccatgttagccaggatggtctggatctcttgacctcatgatccacccgcttcggccttccaaagtgctgggattacaggcgtgagccaccgcgcctgactgactcttgcacttttcaagcaagccctcagtgtctgtgggccccaagtgcagtgtcttccatgctgattgccctgtttctaggaatgcagtagagacagaccagagggtccgtgtggcccgttgctgtgaggatgtctgtgcccacttagtggacttgtttctcgtggaggaaatcttccagactgcaaaggagaccctccaggagcttcagtgcttctgcaagtatctacagcggtgagtcctgtgttcctacaggcaaaatccacacacacggggaagagtcttttaacaaattcaaaatatatgagctattagtttctgtattcagtggtaaaaggatgagggaaaatgttatagcaatgaatacctaaaatagactaattggattatactgcatttcagaaatacttgattacacacacacacacacacacatacaatataaggggaaaagtcaggagttagattgggacgtggtggctactctgtatgtcaactgatatttatagggtgcctgccatttgcccactgcactaggtgctgggagacagctatgaacaagccagattatggctgcatgcaccaataagggtgaattctcaaaatataagtagtggagaaaaagcaattaatagggaatatacaaatagtgtatattcaaactaaataggttgtttcagatttatatatagtggtataaccctaaagaaaagaaggaaaataatgatcataatctcagcatagtggttacttttgggaatgggaggtggtgcctctcatggccacaacttctcaactgggtgtaagtgcacaggtgcttgatgatttattaatcttataactgggcatatatgtgttacgtatgttgtatgattcatttcataataaaattt

SEQ ID NO: 102619 - DNA, 1940 bp, Homo sapiens
ttcctttgaaaagcatgacatgttgtgctcaaaaagtttgagattttggagcattttggatttcagatttttggattagggacactcaacctgtgtgttttttttcccttgtcaatgacttggcttttttctgatatttttctttctttttttttttttttttgagacagagtctcgctgtgtcgcccaggctggagtacagtgacgcaatcttggctcactgcagtctcccgctcccaggtccgagcaattcttctgcctcagcctcctgagtagctggggctacaggcgtgtgctgccgcgcctggctaatttttgtatttttagtagagatggggtttcactgtgttggccagaatggtcttgatcttctgaccttgtgatccgcccacctcagcctcccaaagtgctgggattacaggcgtgagccaccgcacccggccttgactctgattttgaatgctatcccctttgctccgtttagtgtttctaatgctgctatggaggatttgttaacagctgcaaccacgggcattttgaggcacattgcagctgaagaagtgtctaaggaaagagagcgaagggagcaggagaggcagcgggctgaagaggaaaggtaagtgtgtcttgtccatgcagccgaataaggagctcagtgtggacacaggcaagaactgaccctagccacgatgctcctgctattgtccactgtgctaccattccacccctgctgacccactcatgccctcctatgcttcagcccagggggtggatggagctcctcaggccacacctacccgtgagcagtggcccttcccagccaggaaaggcaggggaagggaggtggtgtcaggggagctggagtaggggtggcctaccgactcaggcagcacacctcaatccctgtctgcgtggccagggagtaaaacaaacagcacttatttttattcttaaacattacccttgtgtattttttctcttccctgtaggttgaaacaagagagagagctggtgttaagtgagctgagccagggcctggccgtggagctgatggaacgcgtgatgatggagtttgtgagggaaacctgctcccaggagttgaagtaagtgaaacgctggtgtcttgctgtgccaggagagtgagctttggctctgccctaggctgtgtcttgcaccactgaggatgggctattggaaatggatcttgcctgtctaagctactttgattttgtgaccaaatgtatttgatgcagtcctctgtgctcccttggctaatagaattttattataaaaaattctcttttatatgagggctgccaccacatgatcatagtcagccatccttattagccactggcatttatcatatatttgagacacttccaattgattgcacaagtcagatgttgctgatgagaagattttgtggttgtctgcatggtaatttacaaattctacgccaggcacctgtagtcccagcaactcaagagactgaggtgcaaagatcacttaagctcagaagttccaggtagtgtgctatgactgcacctgtggtggccactgtactccagcctgggcaacatagtgagaccctgtctctaaaataattaaaaattctgactattttattaagataaaggtttatttcttaactgttacgagggcccctatggacctataatttggcaccctgttccacttaattctttttaccctgtctttctaggtgtctgtagtttaagtattaaagcttcttttacaatgaagatagaattacattttaatactgaggatgcagactcttgcactttttttttttaaagacggagtcttgctctgtcgcccacactggagtgcagtggcgtgatctgggttcactgcaacctctgcctcctgggttcaagcgattctcctagctcagcctcccaagtagctggaat

SEQ ID NO: 102620 - DNA, 1517 bp, Homo sapiens
ttgaatttgtttattctattcattattgttttgaaggaaacctttgtcaaaccaatccaagcgtggtagttagtaaactatgaatttaacggcacatttcaccagtaagaccctccttctcagtatggttgaaatccagtatcattattacttgagacagggtcttgctctgtcacccaggctggagtacagtgatgcgatcacagctcactgcagcctcaacctcctgggctcaaacgatcctcccaccttggcctccccacgttttgggattacaggtgtgagccactgcatctggccagtgaaatctattatttatcagatctatcttcatgaaaattttgtcttatttaaaataacattccaaccccttttctctcctttaattaacagagaagtacaacagttccatcctgctgttagaaactcatctgaggtgaaatttgctgttcaggcttttgctgcattgaacagtaataattttgtgagatttttcaaactggtccagtcagcttcttacctgaacgcttgtcttttacactgttacttcagtcaggtgagtaaatgagctgtgcttgcagagttggaagaaagcaggtggttcttgtgctgtttgggtgctttcttattccaagcttttcaaaggaggtctcaggctgatgctgtgtcacccttgcagcagccccacgaaggggttaccggtgttgccctgttttataggggttatcactgttggtcaccatccggaaaggctgtgcaatggaaaatactgttccatggttcaaataagaaaaatctctttgggaaaacataggttgaattcagcactatcatcatccatgaaagctaactaaaaagcaaaaatctcatatcatatgcacaaaatctctgactttgaaatgcttcatgttttaaatcgaagtttctggagtgaggctgatggcgctaagttcctttcagtgggtgcctcagtgtctgtgctttgccgtgtgctagggttgcagaggcaatgggaaggccagtccctcccctggggtttgcgcagagtaaactgtgtcttggggtttccagtcggttattttgttccacttccacggaacttggggatgaggacagagcagcccctgtagcacctgctgttctaggccctgcatgattccgttcagtgcaatgtgaccaggaccgcggcccaccgcacagagcgccacctcacctcgcacacactctgctgcccattctggcagcggctccaaggaggctgccaggattccttgccacaagcccgtagtggccacagcgtggggaggatgctgcctgggagatcctgggacctgccttggttgatctgtggctccaggtcatttctttggtcacacatcagggcctcctgtaaacagtgactaaacccacagtcatgtcacagtcagaaggtcttttgcaggtttgctccttgtcagatctgcaggttgccaaacagaactgatattctggagtaaatgaaaaggttttccacaact

SEQ ID NO: 102621 - DNA, 1058 bp, Homo sapiens
ctctggtatttagattattttcttcagatcctaagaattaaattactgcatcagagggtatgacctttcctgaacattatccatgtatcttcccaaattgttgccccagaaagctgcaccaatatagatccttttggactttgtgaattttgcttatgggcttctcctcttcctggctggtggctttatacacccttcgcctggtgcggggtccccagcccagcaactcgtgtcactgtagggcccctgccccaggagaggcacatgcccagggccttgtcctgtgtacatctctgcctcttcccttggccacgtcttcagcctccttttgaggtgggagatgcaattccaggccccaggtgggcagccagcccctgatgctgtgtcctcagcagtcctcaccgcctgtctctgtttcacttctgctctgtgtagacttaatctggtgtgtgagcgggcctgagaccttttaagtgcttgaggcccttccctgtcccgtctctctgctttggaggctagcagatgtgccttcacttaacattcctcctgtttgtcatgacgcactcatatcttaactccttgtcatatttgccaaaatcaaatttctctatttgtctttgaattttgattgtcaccttttaacagaaattttatgttgaaaaaatatattctcaaatactgatcttgtgtgggtgtgtatgtgattttccccctcattttcaggcataactatgcctggcccaaggtatgccacatgggcatcctgtctcggcttcatgtctctaggtggaccacgcagcagctgtgaaagagtacagtcggtcctcggcggatcaggaggagcccctgccccacgagctgcggcccttgccagtgctcagcaggaccatggactacctggtgacccagatcatggaccagaaggagggcagcctgcgggattggtatgacttcgtgtggaaccgcacgcgtggcatacggaaggtattggctgcctccaacctggatgctaaaaaatccacgcaaattccaaagtcaaactgatatttttattactc

SEQ ID NO: 102622 - DNA, 1054 bp, Homo sapiens
ttaaaaaaaaggggccgggcgcggtggctcacgcctgtaatcccagcactttgggaggccaaggtgggcggatcacctgaggtcaggagatcaagaccatcctggctaacacggtgaaaccccgtctctactacaaatacaaaaaattagccggatgtggtggcgggcgcctgtagtcccagctgctcaggaggctgaggcaggagaatgcatgaaccctgaaggtggagattgcagtaagctgagatctcaccaccgcactccagcctggctgacagagcgagactctgtctcaaaaaaaaaaagggggaaagagcaaatacatgcttgtgagacaggtaagggagatgaatactgctgctgccgcagccagagaccatgcagttagcagacgtgtgggtggagaaatcactgtcgtgcaaaggacaggagctcctggtgcctttgaatggtctgttgtgcttactgcatttgagttttcaatcccatttcctttggtttcctgatatactcacacatggcggttgtggactgttttccaggcatctgcagccctggctagaaagaaggggaaaagtttgcataaagacatggctatcttttggcacaggaagaaaataagtgagttttcaattattcttttcactttttaaaaaaattatttttatttattttatagagatgagatctcgctatgttgcccagtctgatcttgggattacaggcatgagccattgtgcatggccctcttttcagtttctcatgctcttggtccaaaccctttgagcgtgagccctttccccagccagtggaggaggctggctctcagtggatttgcatctcacagttatttccttgggctcttctctaacctcctgtgacaatgaaaataatattactttcttagaaacagagtgaaaaaatccagttccaggtgatctgtgattgcataaactcttttctgcctcctatgtccacaggccccaataagaaacccttttccctgaaggagaagaaaccaggtgacggtgaagtcagcccgagcacagaggat

SEQ ID NO: 102623 - DNA, 1046 bp, Homo sapiens
ggggaactccctagtgctacaggctgtttcaggaagccaattaattttgtacacataatacttaattaccttctaataattggagcagaagatgaacccaactaatcctttcagtgggcagcagcctagtgctttttcggcgtcttctagtaatgtaggaacacttccatctaagccgccatttcgatttggtcaaccttctctttttggacaaaacagtaccttatctgggaagagctcgggattttcacaggtatccagctttccagcgtcttctggagtaagtcattcctcttcagtgcaaacattagggttcacccaaacctcaagtgttggacccttttctggacttgagcacacttccacctttgtggctacctctgggccttcaagttcatctgtgctgggaaacacaggatttagttttaaatcacccaccagtgttggggctttcccaagcacttctgcttttggacaagaagctggagaaatagtgaactctggttttgggaaaacagaattcagctttaaacctctggaaaatgcagtgttcaaaccaatactgggggctgaatctgagccagagaaaacccagagccaaattgcttctgggttttttacattttcccacccaattagtagtgcacctggaggcctggcccctttctcttttcctcaagtaacaagtagttcagctaccacttcaaattttaccttttcaaaacctgttagtagtaataattcattatctgcctttacccctgctttgtcaaaccaaaatgtagaggaagagaagagaggacctaagtcaatatttggaagttctaataatagcttcagtagcttccctgtatcatctgcggttttgggcgaacctttccaggctagcaaagcaggtgtcaggcaggggtgtgaagaagctgtttcccaggtggaaccacttcccagcctaatgaaaggactgaaaaggaaggaggaccaggatcgctccccaaggagacatggccacgagccagcagaagattcggatcctctgtcccggggcg

SEQ ID NO: 102624 - DNA, 1031 bp, Homo sapiens
ctaggaaagctattctgccaatcagccgtatggttttctttaccaggcataattagcagtcctcattgttagaccccttggatatagatattgatgaaggcagtgtttgtggagagccatctgttggccaggtgtggcagagtagactgggtcagccctcgggcctcatggtccccaccagtctgttgactttgtggttctgttatttttttctcacttacctttgcctttactacttatctacatttttgcgcagcttgctcacttccgacagagaaaaacaaaaggtgacagttcgcattcggagaaaaagacggcgaagaggaagggctcggctgtcgatgcgtctgtccaggaggagagtccggtaaccaaggaggacagcgcactctgtggaggaggggacatttgcaaaagcacatcatgtgacgacacccctgatggggcaggaggggcctttgcagctcaggtagatttgctcaatgttgtatttgaacatttcgcttatcttctagtgatttctagtgtgatttactaaagatggtctttggtctgtttttgcctttcaaaagtgaggaaagagggtgttattttagtttataaaaagtgagggccgggtgcagtggcttacgcctgtaatccccgcactttgggaggccgaggcaggcggatcacctgaggtcaggagttccagaccagcctggccaacatggagaaaccctgtctatactaaaaatacaaaaattagccggacatctggcgcacacctgtaatcccagctactcgggaggttgagggaggagaatagcttcaacttgtgaggcagaggttgcattgagccgagatcacgccaatgcactccagactgggtgacagagcgagactctctctcaaaaaaaaaaaaacagtgagtaaatttttatggttttattctttttattttattttttatttttttgagatggattctcgctctgtctcccaggctggagtgcagtggcgcgatctcggctcactgcaagctccgcctc

SEQ ID NO: 102625 - DNA, 1045 bp, Homo sapiens
gggtgtaaggcctgtcaggacagtttagttgggggccatgactgcccattcttttttttctttgagacagggtctcattctgcctcccaggctggagtgcagtggcacaatcacagctcactgcagtcttgacctcctgggctcaattgatcctcctgcctcagcctcccgagtagctgggactatagttgcatgccaccacatcccactaatttttgtatttttttttttgtagagatggggtctcactatgttgcccgggctggtctgtaaccctaactcctgggctcaggcgatctgcctgcctcagcctctcaaagtgctgggattagaggcatgagccacgttgcctggcctgctcagaggttttgactgtgtgatttaaatttctttagcacagataatcaactattgagtttaatttttttttcttttaaattagaccctgaaggaagattgggaatctgaaaaagatttatgtttagaaaatctacgcaaagaactgtctgcaaagcatcaatcagaaatggaggatttacaaaaccagtttcagaaagaattggcagaacagagagctgagttggagaagatttttcaagacaaaaaccaggctgaacgtaagtaatgaaaatgagcaagtttggagtgggactgaattttcctaggtagtactggaaggaatgtcgttcatgtcaccatgcgtcattgcgcacgtttcctaccttctaaatgctggatggccccatgcacgtgtgacacgctggtggccgtcatgggtcacaggtctctcagggtccttaaaccttcctgatctttgtttcagagatttttcttggcatgttcagttgctaaattattacaaagcagcagctttgtggttgttcacttttcatactccagggttgtgtgttccagcttgaccctcatggtgggtggcatgggtaggcgatgtcccctggtgctatcaggcatgtgaggctcaaacgaggggcccgggggcgcccaggatggggctctgggtggcagcgctctgggtgcaccatta

SEQ ID NO: 102626 - DNA, 1023 bp, Homo sapiens
tgtgccgtgtctctggctttgtgactgccacggctccccgcacatggacattgcccgtccttgactggaagcacgaggaggcgcctctgctgtgagcagtcggtcctggggagggaatggcgcacacatggaaaaggggtacgtgtgtaaagcttttataaaatgttttcccttcaggttgtcctgtgtgggtttagaagagaaacctgagaaaggaagaaaagatcacgttgatgaactcgagcctgagcgacataaggtaattggccgcgcgctgagaagtgggggagtcctgtgctcttgaccttccagccctgcgtcttccacattatagagcctgtgtttccgtccttcccaccttgtccaggggaggaaggctgcttgcggatgctgccccgacctcactgctgctccgcggtgggcctcaccatgcactgtttgatcaggaaagggggtggccgggggagccggagcccctccctcagccctgggatgccctggctgtgggcaaggcctccaccctgcagtggggctgcattcgtcagacttgacagtggcagttcaaagggtgtgaaattgtgtctttgctttgagtccacacggagcgtctgctggcttttgtgtttcttccttgagttgcttccgtgctgcgacttctgtcacctttaacttctgtggggcaaactgtccaaacggagcttctgggatgtagactgttctgggtctgtgctgccagtgtggtgcccagcagtatgtgtggctgtggagcacttgatgtgcagcatgagcaagcccggtgtcgggctccgggggacacacgggagggcagggaggagacgcaggggcagcaccgcgtggcttgttgcacggtggaaccagtggaggggaactcggggcatctgggctcagcggccaggagccctcactctggagcagggtccctgggcctgctggaggccacagggtgtccaggcagggtggcagcgggctgtgtgccagtttgagttccctgcaaagcggacc

SEQ ID NO: 102627 - DNA, 1193 bp, Homo sapiens
tctttcctcctaaatgaaattatgttgtctgtaggtaaaacacaatctaattgaagaccaccagaaggaactaaataatgctaagcaaaagactgagctgatgaaacaggaattccaaagaaaagaaacggactggaaagttatgaaggaggagctacagcgggaagctgaggagaagttaacattgatgctacttgaactgagagaaaaggctgaatccgagaaacagaccatcataaacaagtttgagcttcgagaagctgaaatgaggcagcttcaggaccaacaggcagcccagatcctggatctggagaggtccttgacggagcagcagggccgcctgcagcagctggaacaggacctcacttcagacgacgccctgcattgcagccagtgtgggcgggagccgcccacagcccaggacggggagcttgctgcgctccacgtgaaggaagactgcgccctgcagctgatgctggcccggagcaggtgggtttgcagtgacgccatctgcagtccctgtgaggccagacaccttggagggtagaaggtgggcaggctcctgggaggaggcgctgtgggctccactgggcgaaaaggtctggagggagctggaacaaggtgtggcgctctaggttttcagcctaattgcagtgggacagctttgtgctcggacgggcaggctggcagttgccatcctgaagccccctggccgcagtgggacagctttgtgctcggacaggcaggctagcagtcgccgtcccggagccccctggccgcagtgggacagctttgtgctcggacgggcaggctggcagttgctgtcccgaagcccccaggctgcaatggggacagctttgtgcttggatgggcaggctggcagccgccaccccgaagccccccggccacagtgggacagctttgtgtttggacgggcaggctggcagctgccgccccaaagccccccaagtctgcactccctgggtgggtgtcaggggcggggatcagtcattgtctctgttgttcttcgtgtgttttaagatttgaacagcagaagctaaacctcttttataggtgtcataaggacatggagtttatccactaagcgtttttgtgttttttttaacttaaacaggtgatttttaaaaataagcatgtttttctgaaacatacacactcttctttgaagtttt

SEQ ID NO: 102628 - DNA, 1711 bp, Homo sapiens
gaggttctattcattcactgccatggggttcaattcactgccatggggttctcaggcctcgccctccccatgggcccccatgggcagtgccccttccctgttgaggagcagagattaccttgggattcttggttggatgctggctcggacgctgtggtgtgagtaggaggttggttgtgcctgccgtgcgtggctctggcggggatgtgtgtgtgccatctcttgctgagggcgctggttcctacctgtggtctgtgacctggcgactcccatggctttggcctttggcctctgggcttctctggcttcatggggcctcttcactctcccacttactatttctggtggtcgagggaaaagtagtaagagcagttaaaatcccgaaacgatgacctgaacagttgaagtggcatttcctgtgggaaactgacttggcttttgcaagggtcattgcttcctgatgcatgtttaactgtcctgtgttcactttgttgccgcaggtttttagaggaacgtaaagagatcaccgagaaattcagtgcggaacaagatgccttcctgcaggaggcccaggagcagcatgcccgtgagctgcagctcctccaggagagacaccagcagcagctcctgtcagtgacggcggagctcgaggccagacaccaggccgcgttgggcgagctgacagcctccttagagagcaagcagggggctctgctggctgcacgtgtggccgaactgcagacaaaacacgctgccgacctcggcgctctggagaccagacatctgtccagccttgattctttggaatcctgttacctctctgaatttcagaccatccgtgaggagcacaggcaggccctagagctcttacgagcagactttgaggaacaactgtggaaaaaggactctcttcaccaaacgattttgactcaagagttggagaaactgaagcggaaacacgaaggggagctacagtctgtgcgggaccacctgcgaaccgaagtgagcacagagctcgccggaaccgtggctcacgagctgcagggagtgcaccaggtaaggcgccagggccctgccccagcccagggcaggcctctcctcgctgcctgtgtgtttccaccgcgtgtcacatgtctgcgtgcgtgctgtgtgtgcctgtgcgggtgtctgtgtgtctcacaggctgccgagatcagtggggacttctggtctctttgtgaactgggcttttttttttttttttgagccggagtctcactctttcgccaggctggagtgcagtggcgcaatcttggctcactgcaacctccgcctcctgggttcaagtgattcttctgcctcagcctcccaagtagctgggattataggcgcctgccaccatgcgcggctaatttttgtatttttagtagagactgggcttcaccatgttggccaggctggtctcgaactcctgacttcaggcgatccacccgccttgactcccaaagtgctgggattacaggtatgagccaccgcacccggcctgagctgggctttaaaacactgagttgaagggttattttgatcgcaggcaccttgttaaaggctttgctctcgtacgtatgtgggagggcctagaccttggtgggggattttgtgggctttggagtattcctcaaggctgaccagcacctctgcagaagacttggtttccaggctgctgtgggaagat

SEQ ID NO: 102629 - DNA, 1053 bp, Homo sapiens
cttttgttctctttgtctccttgaaaagttgatgggcctgcagccgcacaggcagttgtgggcatggtgggcgctgagtctggaggttgttcaaggccagcagcgttgcccagagccctgctgctgacgctgccgtcactggttctagctctcacattctcagctgcacgtttctgtttccacctcagtaaacgcaaactcttgttcataggcacagctgtcactgcagcacacaaggactcaggtttgtaaagacaaacgattgatttgtgtgtgacgtgctgtttgtttgcactggattttgcaaattatttactaaagaaaagtacttcagaccttttgtggcaaacaataaatacagcgatactctaatcttcagtattcataaaaatgggtggagttgtcccattttaacgccccagcaaaacaggagcatttctctaacggtctttactacagtgcctaagctacagtttgtgctgcttttcagaaactgatgtcttgtgatagttacagctgttcttgggctgggtcccagctctggtctccagggagggcctgggccccctggatcccctgtgcctgttcagcgtgggtgtcacctgcttcgccagctgggattgcgatcctcgtgtgcctccctgagtctgcgtgcatgtcagcaggcaccctgccccagtgcccctggccctgaagatggtgatgttctgggccaagcacagcccaggtcgtgtccaggcccagggagtgcagtcaggggagcagctgccctcaggcctcgccgcacgtctcaggttgtgaatgttaccgcagcagcatgtttacagcggactcgccgttaactgctgacagtggcatcaacatttattgagaatgttacttgcattggtcatgatagtttgtgataaaagacttaacacttttacaaatcaaaatgattttttggaagctggtgaaatgtcagttaacatgtatgaatttaatattttagtttttgggtggcttaaagacttcaggattcaggccgggagtggtagctcacagctgtaatcc

SEQ ID NO: 102630 - DNA, 1051 bp, Homo sapiens
ctgtttttctttacttaactccattttacaaagtgactgtgatgaggggggtatttggagtctgagctgctgggcagttgcacttgtacgtgcagtggaagcctgggtggaccttcgctgcaaggggcacgccagccccgttggggtggtcccaacacgctgcctctcctcccaggagcaggcagccgagcgggagcacgagcgcgaggagttccagcaggagattcagaggctggaggggcagctccgccaggcggccaagccgcagccctggggccctcgcgacagccaggtgagtcagtgcagcgtgcagtgctgctggttgctgtctttcactgtgtttttaagctttaactttctttaaatttttgccttccatgtacatgaaatcggcagcaggcgccgctggatggagaggtgaggaggcgtcaacgagatgggcactccctgcgctggcgcccaggctcccctgcgctcgctgggactgtcctgccacccactcgcttttcttgctcttgtttgggctgcagccatctgctttctcttgtctgaggaagctgtagtaggttcgtttatttttttaaaaaattaatggtggattcacacacagttgtaagaggtaagactcggatccctcgtgcctggcacgtggttccccagaggtctcatccacagagccggaatgcagtgtcacagccagtatgggcagggatctggtgacgctgcagtgccttctgccccccacggaccctcgtgtactgggtcacggccatgccgccgtcctttctcgggcaaccactcatctgtcgtctatttctaaaactttaccatcttcctgatgggtgaagcgtgcctgtcatcttgggggattgacaccattcaccgagcctgactctctggagattgatccaggttactgagtgtagccatagtttgttctttatgttgctgagaagtattccattctttttttttctttttctttttttttttttttttgagttggagtctcatgcagttgcccaggctggagtgcagtggcgcgatctca

SEQ ID NO: 102631 - DNA, 1042 bp, Homo sapiens
gatgggcttgtgaccactgtgtattcttttcttttcttttttttgttgttgtttgagacagagttttgctcttgttgcccaggctggagtgcaatggtgcagtctcggctcactgcaacctccgcctcctgggttcaagcgattctcctgcctcggcctcccgagtagctgggattacaggtgcacccaccgccacgcccggctcagttttggtatttttagtagagacagggtttcaccatgttggccaggctggtttccaactcctgacctcgggtgatctgcctgcttgagcctctcaaagtgctgggattacaggcgtgagcccatgcccagcctgaccactgtgtattctttgcagttttaccatttgtgtgcgggtacaggtacagggtagtaattgctttaggcatgtgcatttaaatatctcaaagctattttaataatgtcttaattattaatattaatagaatattagatgacttttaatacttttcttcttttgttttaatgaaaggttttggacttaaaagaacagctagaaaagatgaaaggtgacttagaaagtaaaaatgaagaaatactacatctgaacttaaaattggacatgcagaacagccagactgctgtcagcctcagagaacttgaggaagagaacacgagcttgaaggtaagctaccaaaggtccacgtgacgcccgagttcatgttgcttatgccggtgccgagcggccaccaagaccctcatcggggaggcgagtctctggtcttcacagacgcccgtggcccccatgtggcagacagtgcagagagcgcccgattctgcctggggacatgtgcatggaagcagctttctagggatcttgagtgaggaaccagcgacccctgccccaaactgctttctgattgcagcactgatagggatctgaggagaggcacttccctagggcagcaccccagggctgtgagaggcgtgaagctattgggctgttggtggcttgctcttctcaaggaggtgacttgagtaagtggctactcactgt

SEQ ID NO: 102632 - DNA, 1708 bp, Homo sapiens
tgtggtgcacgaagtcagcgacagtcaggctggcagtctgcagagcgagctgctctgctcccaggccgggggccctcgtgggcaggccctacagggcgagctcgaggctgcgctggaagccaaggaggccctgagccggctgctggctgaccaggagcgcaggcacagccaggccctggaggccctgcagcagcgcctccagggcgcagaggaggctgcggagctacagctggctgagctggagcgcaatgtagccctcagggaggctgaggtcgaagacatggcctcccggatccaggagttcgaagcggccctgaaagcaaaggaagcgacgattgccgagagaaatttagaaatcgacgctctgaaccagcggaaggcggcccactctgccgagctggaggccgtcctgttggccttggcccgcatccgccgcgccctggagcagcagcccctggcagccggggcggcgcctcccgagctgcagtggctccgagcgcagtgtgcccgcctcagccgccagctgcaggtgctgcaccagcggttcctgaggtgccaggtggagctggacaggcggcaggcccgcagagccacagctcacacacgggtgcccggggcccacccacagcctcgcatggatggtggcgccaaggcccaggtcaccggcgacgtggaggcctcccatgatgctgctttggagccggttgtccctgacccacaggtgggctccccccgcgggccatggcagggtatttttttttactctccttttctcctttgatgtcaatgacttctctctgcgctgggcactgggggctgcagttgtcatggtggctcatgacacagcggagaaagggggcctgaagctcgggccagcctgggcctgttccgtgtcagtacgcagtgaagctgggctgaggatttcactgttttgtaccattttaagcttatcgttttaagcttttaaaaacaattctttctttcacataatagggactgtccagtgaaacggagctcactatgtgaggagggtccgcttaagctgcttctctggtttctaaccaaatggtttgtctgtcgatgagcagtgcctgtgtgagatgtggcgagcgagctcttcttttggagctggaggccctgtagggagtcgtcttttaaggcttccacttgtatttgagcagaaccttgggaacttggtgcctaccacccccacaccagctgggtctttgtagagtggctcccactctcagatgccccagtccaccttgctctgtggggtcgtcctgggtcggggcagctttctgctgggtcctcagccccgttcccatgtggcctgctgtggaccaaggtgctcggctgtggatgtcactgccacctccctctggcatccctgctggctgccgtactggttcccagctccaggccacctgaggggcagccccagcaacagcctcctgcatgctcagctttcctctgtctcctctgtcaagggtgatctgcagcctgtcctggtgacgttgaaggatgcacctctctgcaagcaagaaggcgtgatgtcagtgctcaccgtctgccagaggcagctgcagtcggagctgctcttggtgaaaaatgaaatgcgcctgagtctggaggacggcggcaaggtgtggggaggggggaaggcgcgaggtccccccgggagaggctggacacgcggcagcaaggt

SEQ ID NO: 102633 - DNA, 1185 bp, Homo sapiens
ctggttccacccgcagtgaaagcttctagtccacagaacctcctttcttcccgaagcacatacacctcacgcccccacgagtctgtctctaacctggtgtcacttgtgcagcacgaggagctcatgggggcctgttactgttcttttgtctttctcagttgaactgctggcttataaagtagagcaggagaagtgcattgctggtgacttgcagaagacgctgagtgaagagcaagagaaggcaaacagcgtgcagaagctcctggcggcggagcagactgtagtgcgagatttgaagtccgacctctgtgagagcaggcagaagagcgaacagctgtcccggtccctctgcgaggtgcagcaggaggtcctccagctgaggtgcgcctgatcccccttcctgggacactggcgggagtccccccgttgtgccatgttttcttggtgatgaagggagacagaacctctggtgggccgcagttgggcagccccaggggcaccgcgccctgctgtccctgggttgataatcctgtggtggggggtgaagcacacgtgtgggacctggcagggctctgcctcccctcctggagctcccagcccccgggaacacactctggcccacgtggtcagattgttctgcgatgtctccacgcagatccatgctgagcagtaaggagaacgagctgaaggccgcgcttcaggagctggagagtgagcaggggaaggggcgtgccctgcagagccagctggaggaggagcagctgcggcacctgcagagggagagccagagtgccaaggccctggaggtaacagggtgtcagggcaaggcagccggcatgggctgtgtgcactggaagcctgaagccatgctcctctttcatccttcttttcctgttcttcatggcagtgcacccagttgacagcagtgtgacgtagcaggatagggctgtgtttgcaggtaaaattgcaccttggtgtagtggcagccaccacagggcgaagagtgcgatgacccgtggtggcacgatacccctgctcggagcccccccccgtccctgagcacttgctgtggagatggacacagcctcctcgctggcatccagacagagcacagcctcagaggtctgtgcacaaggcaggctggtggtggggcctctgctttgcatggcggaggcccagcaggcc

SEQ ID NO: 102634 - DNA, 1001 bp, Homo sapiens
tggggttccctccctgacacggcaagccgcctctgtgtgtctgcatcttgggcctcttcccgctggatctgtctttgtgttgtcacaaggaagccccagcggcgctgctgggaatcagaggcccttcagaggctgcttcgtccttccttgccccatcgtgcagtagaccttctgtcccctgcctggtgggagtcgggccctgggcaggggctcaggcgcttgctgacacgcttctcccgggcaccagacatggcctgtgcccccgtcctgcagaaggaaaggctgctgctccttgaggtctggcttaggagctcaggcccacgtggccacccaggctcagccccagggctgcactcaggctcatacgtgtgtgcatgttcacatgcacaaatgtgcctgtctgtgtctatgttggtatgagcgtctgggcgtgtgcgtgtacatatgtggatgagtgggaccagggcacagggaagcgtcatccggtctgttctgtttcagcttctcaggctcctctcctttggaccccgcgtgcttgccctgggcctgatgaaagcctgatagttttaaaaactacgatggaaacgcttttaccactgaatcattctggggtgtgtgattcagctgcctccatgctggagggacacagagcagcacagcacgagggtgtgcagtgtgtcagctgtgggtcccagtacaggaccacaggggctgcctgcccgagggcctgtttctggtctgtgaggggcctcccctgtaacgcggctgtgtgttttgggcttttgcttggcagttgttgttttttttgttttggtttggttttttttggtagatggagtctcactctgtcgccaggctggagtgcagtggcgcaatctcagctcactgtaacctctaccttctaggttcaagtgattctcctgcctcagcctcccgagtagctgggattacaggtgcgcaccaccacgcccagctaatttttatatttttagtagagacgg

SEQ ID NO: 102635 - DNA, 1117 bp, Homo sapiens
tggcatttatgaaatcatgactttgatcgtggagcccacgcatgtgaggtgcaggggagctgcgccgcttaccctctggccccgccagctgaacgtcgttgtgggtggggtgcaccctgccccctgtgttgggccctggtgacctttcagcgtgcccaccctccacaggctgaacgtccttttgatggtggaagtaataaacctgttttgaggggcttcacatccgcccccttgggatgaactaacaacggtccagccacctgttaatttcagtgctgttagaacaaccaaacgggctatgctttgtgacaggcctgcgttgttcatacaagccagttgcgtgcaaagtctgtgattcaatgacttttacaattttctgccagctccacaagcttctcattgaaccccagacacattaattacaatccctaaaaataactgttgacaaaaaacacaagtaatgttcatgccctttaacaacaaattcttacaaatttattttcttttctccaagaaaaaaatggcagcagagctgcagttccagtttgtggacgtcctgctgaaagacaatgtttccctcacaaaagcgctcagcacggtgacccaggagaagctggagctgagcagagccgtgtctaagcttgagaagttgctgaagcaccatctgcagaagggctgcagcccaagcgtaggtgtctgtgcttaactcttacctgcctcagcctaacccaccatggtccagagcagctccaccccacaagaggccgggctccctttagggacctggggatgtgggcgtcaccttctccctaaccgccaggctctgttgcctctgtctgaagccttgctaaatgttgtgggatgtttgaacatctcagccgacttccagctccgccacagacggcgtcctcactgaccctgaccgctacttgatgtttggtgcatgttcataaaagggtattttgactaagaatattataatctgatctaatttagagttttagttaaagtgatttataatttttttttttttttttttttgagaccgagtcttgctctgttgcccaggctagagtgcagtggtgcgatctcagctcactgcaacctccacctccca

SEQ ID NO: 102636 - DNA, 1050 bp, Homo sapiens
tctgccgggtgtagcagtcacatcactaaaggaaaggacgttcacagaataaacttcggcttgaattttgttttaattgtgcacaaatactgagtttctgtgcttgttaagcgtggaacgtggaaggctttgacaaagtcagcaaatggcggcctctgcagcctgagggaggcctggcccaggggcttgccgggattcggcccaagatctgctgcagtctcctgatggcacacggtccccaccccgtgacgtccatctcatgcccagtttggaccttacctaaggggtgaaatgcaagaagcttcataggggctcatttgatgatgctgtggagaggagcttgtggtcctagatcttgtctgacaaacacaaattgatcttccaacagcaaggttgtttctggccacagatactgttggaaggccgatggctctgtgatgatttgatgggaaaaaacaatctgactctttggaaagagcaatggtgttaatgtgcttttgtcagcaagacagtctttgtttcctatgataaaattttactgctttttttcttttagatggaaaaattgtacctgcattacttgagagcagagagctttagaaaagctctgatttatcaaaagaagtatcttttgctgttgattggtggattccaggattctgaacaagaaacactctccatgattgcccatttgggggtatttccttccaaagcagaacggaaaatcacatctcgtcctttcaccaggttccgcacggccgtcagggtggtcattgcaatattaaggtaaatgccatgacgttcagtcagtgcgttccgcgtctgtctccgtgagtgggcagcacactgcatggttttttggtcattttattccttgaaactccataatatgttctttttaaagatgaatggcatttgaggccttagagaaaatacagatgatgaacttgtcttcaagaagtcatgtgtatgaatctctcaccttctaaaactaaagatttaagggcacctttgtattacagaggaacatcttgacttttaatgggtttc

SEQ ID NO: 102637 - DNA, 1048 bp, Homo sapiens
ctctgcatgctcaccatctgacggactcctgcgagggctggggtctccgtgttctgagcctgtccagtggcatctgtgacaggatgaagatgggagggtcctgcacaccaggcgggagcggcatgtgtttcctagtcactggtgtggccggctgactttgaactggagtcgtcctgagctgggccatggtgggtgtctaggggaccatatggtccacggtggggccgcagtgaggctttgtcaggtggttgggcatgggaaggtcgccgccgccggcagccctgcgagcactttggatgtgtgcacccggcatgccaggcccgagtcaacagactggccgaccttggcgtcctggtccccatgggcagcgaggcccccattctgcttgtttggtcacagtggggttttcattgctctttcccttcctgtcttgccgtacttttaagtgtgtcttgtctcttttttttgtagattacgttttttggttaagaaatggcaagaagtagatcggaaaggagctctggcacaaggcaaagcccctcgcccaggtgggactccagctgctgttgaccgctggactcacaaacctttctttctactcttgtttttcattcactttgggtcatttttcagtgttgatggggacgtaataaagcacggtaagaaaatccgtgaattccgtcagagcagtcgtccagagggaaggcgcgcccggcgtagggaggtcagagctcatgttagctatgaacacaggtcacaggggcgtacggcgatgggaaacactgagatgctcaatatattgattatttaatagtgtttagcaaaatggtctttttttattccttaaatcaactgaaactcacttcacgtctctttccttgtagagcatcatgcttatttctggctcactcacatctttgtctcgggagttctctgccgagccattgccccctacagcagagagcacagctggctgcactagtgctgaaggagccagccccagagcagggcatttccaggggctcttgtcccagagcggcaggcgttg

SEQ ID NO: 102638 - DNA, 1032 bp, Homo sapiens
tatatttcgaccaggatataatttgttcagtgtttcttaaatatcataatttaaaccactgtataattcatatttttaccaaaatttacatgaattcagtgatagtgtttcaaaattgtggaattcttttcaaaaaatctgtgaagccttgtaaccaatttgctgcctcatttttatttatatgcagattctacttcaaagaaatcctgccacccgatgattaaacagtgaataaaatgtcatggctctttcctgcgacaattctatttgaggaaaagatttgtttttcccttttcccaaggaagctcgtgggacagcatgggcactactcttcatgtgcggtgacaccagcccccagatgccttgaattaagtgtcctcacctttatgcatgactgcaaagccagctggagcattttctatggagcctccgtatgttttaggcccatgaccttcgtgaggtgacgggcactcactcccatgagccctggctgtgtgctgttgtgtgcctatcggcagatccatccttcctgcctccaaggaggatacacagagaatggcttcctgttgttttgtttattttcttaacgtgtacagatggaaacttcatttaaaaataaaaacaaaacaactcaaaaaggaataaaatttaatcactgttttgtttgtgaatagcccttgtgttgttttttttttccattttatccattttatcagtttgcctttctcactgactaaaaaattgagcagagagtttatgttaaactcgtaagtcaaaaattttcagtggaacccggagcattcttgaatagccacttgactgttgtttactcttacttggtttcttatttttttaaagatgctgccactatgtatccacctctcatggccatgctttttgtttttgagatgggagtctccctctgtcacccaggctggagtgcaatggtgcaatctcggctcactgcaaccgccgcctcctgggctcaagcaactctcctgcctcagcctcctgagtagctgggattacagg

SEQ ID NO: 102639 - DNA, 1026 bp, Homo sapiens
aacataaacttcagaataattaaagttctaaatatgtttttaattataaaaacatacaattcaggagactatttgaacacccctttgagtaggaattgtcttcataggcaagataggagacctgggagctagaacagaaaagatggacaggtgcgataggctccctagaaatgagaacatttcagaatgactgagctgctactcgccaggccacagctctgtatgtgtacacagttcagggtgtccacagcagacaaggagtgaggcttcctggtcttttagtgagggtctttagttgggtaaagtagcagaaatccaaaggagaggaaatgtggatgggcaataaatattaaattatgttcaacctcagtggtagatatggaaatgcaaattaaagggcaccatttttctcttatcacattggcaaaattctagaactttttataacatctagtgctgacagagagtggagaaatggcacttttcatacattgcttgtaggagtgtgaattactgtaacctttttggaaagttatctcttcatatctgttaagttaaaaatatatctactccttcatccaataatttcacattgggttttgtatctatctttgttgaataaatgaatctatctcaaagaataaaaggatgcatattttggaatacaagtgtaaggaagtccgtctgtgtatatgtcactttacagcatgcttgtttatcatccataaggtgtaagactctgtattgtccgttgtgaactttaaagttgttttatccagtcacaaaaagccaaaagccagtagggattctgctcattatgtattttgtacatatatatacacacacagacacacacaaacacacgtgtgtgtgtgggtgtgtgtgtggatgtgtgtgtggatgtatatgtacatgtgtatgctcacattttgaagggctaatactgatttctgtagagagtgttcccattctccagtgctgtataactgaccaccccaaaatgtacacagtacttgaacaacatca

SEQ ID NO: 102640 - DNA, 1078 bp, Homo sapiens
atagtattcttacccaaatgggtacttgctttctataagactttttgtgtggatcttaatttcttttactaagatgctatttatgtcttttagtaaagagaagaacctaaagcactaagaggagcctaaaataagcactaagctaaagcttcctgaattaggaattttacagttattgtcatcttattacctataacttaacaggttgtaaccaggacttatatgcaacagtataagactatttggaaagttttgcggttgattttgttgttgttttattgttggtaccattagaaatgaaaacttttatatgaggtttctctctagcaataatgtattttagtcttcctgttaaactgtacaagatgtcgatagtgtctaatgacttcacattcatgaacttgcattgttgtcatatatttaaagtatcaaaaatagtgacacccatttttggtttgaggtatttggagatactacacaataaaaccaaacacaccagattcgtaagatgatttagtggttttggtaacactttcttgcttaaaagaagtttattgttgaaaaaaatcttagaaatggctgtcaaattattgtttttgctaaatatagctatagacactatccaattttaaaataatgttttaataattgtaaaacccataatgaaacacacagtcatgctgacttgaagaaaccttaatgtacagttaattttgttgtctgaagcaattttctcggagaaggaattgtttttagggctagttcacatgactcccctgaaaggatgcatgtagacagggctgcggttctcccatggccaccatgttgttgctggggccatgcacaggccaggatgccttctcactgcctccaagatgtagggccgggcacaggctctcccctgggtgatgctgactgatgtgtggatatggtgtccgactctgtggacatgcagtgcagcactgaatattcacagaacacccccactgaggtatatgctgaagccgtttaggagatcagaggctgtcttcactgagtgtgtctggtaccctgtggctgagttctctctggggagctg

SEQ ID NO: 102641 - DNA, 1035 bp, Homo sapiens
cggcctaagagttcttgttttatctctgccctggaaatacagagtgtcatataaatccttgctcagatccttccaggtttctctctcatctaattctctcctaactggctccctggggatgcagacagttatgagggagcccatggcgcaccattaccctcgggcacctgcccaagaggagccacaacttccactgaagcatcccctcagcggccagggttttgccatgtacctgggctgctggttagaggccgatggttagaggagagacactgaccacttcttcttttgaagattctaccagtttccattctgtctgttgtcacctctagaaataccacatcatgtttttttccttgaaatctttcagtataaaaccagcaaagaaggcagtacggtgggggtcacagtgtcccacgcatccctgctggcacagtgccgggctctgacccaggcgtgcgggtactcagaaggtaagggctctcgggggtggggcggtggcccctccagcctcacacagatacctgacgtacctaatcatgtgactgtcactgcacctgtcaaaaccacccctgggtagtgcctttgcccattaatccgggtcatgccaggtagggagatgcactgtctttagcatgcttacagggtctctgtggttgtgctggccaagagggcacacggtgtctcttagcagagtccagacaaccccatcagggttgttttcagtaaatgcacatggatgttgattttatggaacatggaacctatatcccactgattgatttatacacagtgctgggttcacaggcctgccctggggggctggcttactctgtgacatactgagggtcagggcatttttcattcaaaaagaggaaaacacttttagttttctattactttatctatgactgtagttttgacctcagctgtcatggatataaatatataagtagaatctttatggttatagatgatctgttgataaagtatagtcagcacctgatttacttcaaatgtcagatacttaacttg

SEQ ID NO: 102642 - DNA, 1051 bp, Homo sapiens
ttgtcgtctacaaactataaattattcttcattcttttgttctatggtgatttgttttgcacaactgtgtaatttttttcatattggaggaaacgcctgttgctcagtattccagttactattgttgtatcacaaacaacaacagtcattttattgtctctcatgctttctgtgggccaggagcttaggaaggcctctgccaggtggttctggcttgcaggagatggtgtttggagggagcggtgaggggctgagacagctttgtgtgtgtacatctcaggcccccacctggtctctcagagtgagctgctctgggcttccttgcagtgcagtggcctcaacaccgtccttctgtttgccgggcttcacagggctccaggcgagtgtcccaagacaatcgggtagaagctgaattgacgttactggcctgcattggaagtcacacagcatcacaaccactgtagtcacaggcccttttcccactgagtggagtgtcgacgtcacattgcagaggggcatgtagtttggagacattgcagcatctttagaacatgcgtttctcacaagtctgtaacatggagcagtggctttggtgcagaatcatgctgcaggcaaggtgggcccacctccctggaatttcatccccctcgtcagttaaacccatggtggttttattttctaggccacctgatctgggaggaccacctccaagaaaagcagtcctgtcgatgaacggtctaagttatggtgttatcagagtggatactgaagaaaagttgtcagtccttactgttcaggacgttggtcaggtgatgcctggaggtaagagacataaccagagtgggtctttgtccatgactgattgaggtaacgaaaagggttttgttttgttttgagacggagtcttgctttgtcaccaggctggagtgcagtggtgtgatcttggctcactgcatcctccgcctcccaggttcaagcgattctcctgcctcagcctcttataaatactccaggcttcatagtagtgctctagaagcaagcatacaagtaa

SEQ ID NO: 102643 - DNA, 1055 bp, Homo sapiens
aactcttctgcagaagttggctctgtaggcctgaccgtcatgttagatgttggaggttttccttgctggcctgaggcagaatctggcctgggaggccctggtgacattcgagtggggacactgccacgtggtctgaggctgccctccttgtagccaccccacagctacttcagctttcctgcctccctgtgatggcccttctggggttcacgggcagctgtcagggccccttttggtgacttctagaggcaggaccccatctgtcagtgcagtctccccccttccaatgcggccctgactgtgttaggggttgcaggcactgcgagaggctcagcgtcctggcccttgtgcctgcaactctgcctcttgcaggcggctgtgctaaccggctgtggctgctcaggtgcagaccctgtctgtgggtggtgctggcagcccagccatctctaacctggagcctggggccagctggtgcctgatccctgtgtgtgcacagatgctgggtcctcattgaataagactgaagtatttcagcctgtgtttctagctctacttgttactcatacaaatggcatcatttttttcctgtaattctactgagaaatagaacagtcagtcttgcacggtgcttgaacctgtcgtaaaataattctcctgagaaatagaacagtcagtcttgcacggtgcttgaacctgtcgtaaaacattttcacagacagcaatcattggggtgtcacttatttactcatggggaaaatacaggtaagtgtttaaacttccctggaaaatcatgatgaggtcatgattctgaatgaatcttaggaacatctgtagttgtgcgcgttttatttgtaaaatgtggattaggacaggacatgcgtgcacagcgctcccgtaggcgtgcacgcagcacacctcctcccccgggcgtgcacacagcgctccaccagacgtgcatgcagcgcacccccctcccccaggtgtgtgcatgcagcgctccccctctgccaggcgcgcgtgcaaagcgctcccccaggcactcccccaggtggacc

SEQ ID NO: 102644 - DNA, 1069 bp, Homo sapiens
ccttgacttaagattagtctggagtcacatggcagatttgcatttaaaataaggttactagaaagggggcaggcatgggcagagttctgtcaggctctggagcaggagatggtgtcccgggctcgtgtgtggtggtgatggtcaggagccagggccagcagcaccccatgtggacccgagagggcagtatgacaagaggaggcacagggtttatttatcgtagtacaggaaatattttgtcagccggggcttattacatgaaggatgtgttgtactttctggtcaccttacattgattataaaaaatattacatataaaatataaagacttacagctaggtagcatgtgtatcatctgtgtcataaaactccttataagaaggtgctgtgtatataacatcctgtttccataaccgcacatacagcagcaaggagatctttgtgagtgatccatttaaacacgttcttgataattttgagttttttttctcattttagctaatgtatgtgttgtgaagttagaaggtaccccttatctttgtaaaactgatgaagtgggagaaatatgcgtcagttccagtgcaactggcacagcgtactatggattgcttggaatcacgaagaatgtgtttgaggtttgtcccttttcctgactttcatgttgaagttaagttgcatgagcactcatggggtcccaggtgtgctgggtgctgggggattgcagaggctgcggggatggtctccttccacacaggcgctgctggggctgttggcacatggcctgcacacccctgtgtgtcctcccagagtgagggcaaggccagtaccaggaccaggcatgctgtggagggctgggagtcagcgtgcttcccacagtcctgcatgggaggagggtgtgtgggtgcggcctggtggccaataggaaggcactcaccgtggccccagggaaaccagccctctgctatatttgcattgttgtgatgtgagttgttcaggacaagtctagggaggccaggcacccagagcagaggtaaaagggatgcttgtttcctgcctcaggaggcctgcc

SEQ ID NO: 102645 - DNA, 1115 bp, Homo sapiens
cttcccctaactggtccactcaaccagctgcctttttaaattttatttttctcaagggggtgccttttttttttttttttttttttttttaaagatagggtctcactctgttgcccatccaggctggagtgcagtagtgtgaccataactcactggagcctctacctcctgggcttcaagcagtcctcttaccgcacctcctgagcagctgggaccacagacatgcaccccacgcctggctaattttttaatttttttgtagagatagggtctcactatgttgctcaagctgctctcgaactcctgggctcaagcaatcctccctccttggcctcccaaactgctgggattacaggtgtcagccaatgtgcctggccaaggatgtgccttttgttactcaaactaaggtacttgggagccaggtcagaccctgcctttgagtagcccttaaagcaatcgtgaggggattctgcaaagtggtgtgtcatcatggttagtcttgaggaaaaagcccagaggatggacaacagagaaggtgggagattgctcagggggctgggaagggcaggctgtgctcatgcatgtgtgcgtgtgtgtgtgtgtgtgtgtgtgtgtgtttgtgtgcgcctgcgtgcagggggagggtggcacagccagggtcatgacccccctcacagcagaaatgggggacacattgggcaggtgtccttagggataacatcaaggtagcccaaaccctgctttgaggtggagcagggagaccaccccctcgcagggccacctgtacctgatggtgactgcgtctgcaggcaggatagcctccctgtccccactagggaagagctgaggaatacaggagcttggaagtggaaccacaaccaattgagagtatatgtgccattggaagaagagcaatagaagatttgcaacatgaactaagatcaagaaatgctaacaaagtaattgttcaaagaacacagtagatggaatacataaaatggatacagctagagaacaagtagagaaggtggaaagtcagattagggaactactctggaagtaaaataggaactttaaaggaactattaagagagatgggagagaataagggctgg

SEQ ID NO: 102646 - DNA, 1030 bp, Homo sapiens
gaggacagcttccagtggatgagccgtgtgctgcaggtgggcgccccggcacggcctatggttcggtgaatctcccaagctggcacccccactccactccaagtgccaagtggttggcttgtcccgcccggtcctccctggctccagctttgtttatctgtatttttcattgcaaattgacaaattacagctgtatgtatttacgggatacaaagtgatgttataatttatgaatacaatatagaataattaatatatccatcacctcaatatttatttttttctgatgagaacatttgaaatgcactctcacagtgattttgaaatgtacattattatattcaccagtctgtgcaatatatctcaaagaaaaaactttcctcctcctgtctaattgaggctttgtgccctttcaccatcatctcctcattgccccatccctcagcctctgatcacagatttgtggacatgtgtacacaaatacagtgtgtgtgtttcccctttctgagttaaatggtagaaaactgcacacacttctcttcatcttgtttcctcatttaacaaagtgtccagagggcattccatttcctggcctggggaacaggtccacagaggggatgttcctgtcccccacccagcatctccccagcctcaagttgggggcctgtgccaaacagggtccttccctttcaggccattgatagcatccaccaggtgggcgtgtactgtctggccctggttcctgccaacaccttgcccaaggctcctctcggagggattcacatttctgaaaccaaacagcgctttctggaagggacgctgcacccgtgtaatgtgctgatgtgccctcacacctgtgttaccaacctccccaaacctcgtcagaaacaaccaggttagttgaacctaacaacaggatgctctctagtctaacagtggtaacagcggtgcttgtggttagggtgcggccctgctagacctccagtgccaactgcccacgtctttggggctggggtcaagagccagagcg

SEQ ID NO: 102647 - DNA, 1044 bp, Homo sapiens
tggctttttagataaccctacatattgaacgccttattcacccacatagtacaagaatagctggaaggaaatggcacctgtccgtgccagagcagggctgagtgcaggtctgtctctgtttccaaagtgtttgcttggccttgtgcctccccatcacagtggcagtgcacgcagggcagggcgggggctctgctcacaccctcttcaccacaaaaagacccctgaccactcaagcctcagacccttgtcacgcagcagaggagatcgggcgggagccttttgtgagctcgcttcctgtgtaggctgtggctgagcgtgggtgccggcctttgtgttagcggctctgcgtctgcaagcctggggcctccttgctagacgtcggaagggtatggatgccacacatgattgcagaaatgatgttaatgggatgttcacgtttgctctttaagatacagaggtgggttttgctctctctttccctgtgtttctcatgtggctgctgcttctgtgtgtgtttcctgtggctgtctcctccctgtctcactctgctgcctccttggcctctgtcagcccaacaggctgggaaagctggctgagcaggtatgaccttgaccttgaccttgttggtgcctctgtgcttccccctcccatgagttcatgtgactttctcgtgaattctagacaaacatgtttcttttgctgtcttactttgttcacagtggatattacttgacatattacaaaagctcccttgtaaccaaatttaaaagtaaaactattttcaaaaaatgttaatgctcatagcattgccttgggaggaagggctgtgtttagttccagtgcagaggtgtttaattccagtgcagacacaggttatgttgtctgggatctttaagggtgatgttgatcagagtactcatttaattgatgttccttattgaataaaatgacacataatgtcctttagtcgggattaatgttaactgtaagattcagaaaggaagagagtagaaaggtgaaggctgccatccatctcacctgagt

SEQ ID NO: 102648 - DNA, 1067 bp, Homo sapiens
acgaaatgtagagtgagctgctgtgagcacatggggtgggtggcgagtgcatgcgggtggcggcacttgggaccgcagcgtggttggggtgtccctgccattcatggcaggtgtgctgtggaaaggttgacatcctgactgttgtcaacagaccctcagagtgatcatttccaacgtcatgatctgccctttcagacattactacctgtgtagtaaattttgtactgaaattgttcccttaatttttagggttcgtttggtagaacggggttctccgcacagcctgccattgatggagtctggaaaggtagtggaaaccaagacgcgtgcattctgagtcgcgtctgagacctttgtctgaagcatcaccccgtggagggtgctgggggctgcggctctgatgaacacaggtcgacttctggttggggtgggctcggctgctgcagaagtctccttccctcctttgtggctggtatatagaattacttagttatgtttttaaacacacatctgagctcaaagccaagaaagggagaagttcaggtgcaggaataaagaactcccgctgggtgggtggcaggcctcaggcctctggggccagggccatggaggggggttccggcccacccacacatttagagttaaatggagtggccctggccctaagttggagatggcaaaatctcatgccctagtttagggtgtcagcagggaagaggcccccagaccctgtcggggatctgggggatcctgagatggcccgaggactcccaggaaaaaactgagatgctgcaagaggtcagcagacataggcacagaacagcatcctctgaaccaggaagggttcaaaggaaggaggaaaagccacacagcccaggaaggcagcatgaagagtaagccaggcttgatatgagtcggggaccctggtgccttcacaaccgcagaggcaagggaaggagcttggccaccctgactccgttcactgccatggccacagccacctgtggggagtcagagaggggtccagagagggacccagccaagccatgtgatgtccaggatacaga

SEQ ID NO: 102649 - DNA, 1068 bp, Homo sapiens
ttggagcggcctctaaacttcctgacctgacatgagcacatcagtcctgcaggccagcttctgagggacgttattttaatgtcactgaatcaagagagtctcgtgtcatgttttctttaacaagggacatagctctcctccttccagatcctccccggcgtgaaggtcatcatcgcacacaccgagaccaaaggacccttgggagactcacacctgggagaggtgagcaggggcccatgggaggggcttgagctctccagcctcaccagcttcaccttccttccctttttgcttcagattttggaattctaaacttgcctttgggaatctaccagaaaccatttggcccttgccccgtgtacctcccagacccagttcctatgtaggattttggggtactgtgggacaaactgcctcatccctaggttgacctaaccaagagaggggaacccctaggtttgagggcactgacaggtgagaggagctgcacaggaaccagtggcagtgtggaaaacagctaccttgtgcaggacccagcagctgctacgtaaacgtggtccctggcacccaggcaggagcacagacacggggaactggcaatagggaactctgcaccagaagagttcagggcctccacctgcagctgggaggtttggggagctcagagcccttgtcctgaggacacagtggagggtgcgggtctccctgagaacacagaggctatacaggaatccgttgggttgaaatgtctacatgtattgcacgtacatcttgctgtaatttgggacaggcatgactcattatttacaggcagtggtggcagcttgacgtgcagtcccgaatgtgcagattgatctgttgtcatgggagcataaggactcacgttcctagtcctatcctcttggggaatgtgctgtcaaattgatgtcttcaaaccaggcgggcacaggcatcatttgtgagctctgctgtgaagccagactgggggcttccagcaagccgtgcccagagggaaatcactcagcctcagctggcttctcctgactgggacaagggtgtgagcgtgcg

SEQ ID NO: 102650 - DNA, 1329 bp, Homo sapiens
gaccatttacggggagaaacttgattctgggaagatagcagagtacaaaccagctgcctcacttctgtttcacagggaggctgatggaaaaaggaagcaagctggacccatcctccctgctcacagagggcactgtggtcacacacagtgcctcctctgccagttcctttattgaaagaggtgtgctggctggccacggtggcttacacctgtaatcccagcactttgggaggccgaggcgagcagatcacgaggtcaggagaccgagaccatcctggctaacatggtgaaaccctgtctctactaaaaatacaaaaaattagccgggtgtggtggtgggcgcctgtagtcccagctacttgggaggctgaggcaggagaatggtatgaaccagggaggcggagcttgcagtgagccgagatcacgctactgcactccagcctgggtgacagcacgagatgccgtcttaaaaaaacaaaaaagaggtgtgctgcttgtcagcatgtattgtcacggacactcaataagtgccattttggactgtcaaatttagatgctttgtttcagaaagataagccagcatttagttttaaatcactttcctggtttgtaacttgatgctgtttagttaaattgctagttttcctaacactacaatattaattcttctcgtggaagtgtactgatttattatttttattccaagtcagcagatttggaagcattgtggtaaagtctaaggttttcatatccatagtgctgtttggtgagtaccggcagtacagttgaggggagcagggaacagcattgccccgtattgaaggtggagatggttacattcttcactgctttttgcattttgagttgtgtgcctataaaatttggccaaaccattttattattttgttcaaacttgactaagctgagtgatctaaaattatacagaacctaaatcaaagaagagaatgtaaagtcctttagttacttctaagaatttgaagtcaagcacgaatctaagacatagattatttttatatagctaatgaagagtatgttacgaaattgttgggtttttggggtattgagggtggcaaattttgtgaatcatgcatgcttcacagaaacaaccaggtttttccagaattagtctggatcagtgcctaacaaagctgttattaattctccacacatgagtctggctaactgggccagctctcatgttttactcctgtctggctacaaatagcactgtgcatagtagccctgtttccccatggtgttggactgtggtaaagtatgttgtgacatactggaattctaataatcctg

SEQ ID NO: 102651 - DNA, 1030 bp, Homo sapiens
tcggggatctgtaaaaatcctgtgcctaacaggtaaggctgtttctttaatgccagtagggccttcgtccctggccagggtctcctcgccttagactggccccagtgatgctgtgaagccacttgggcatctgtagggccagcatatgcctgtcctgtcagggttgctcaccctgagtttcacatgtgggtggaagtggactgttttctggttgcctgtgaatatgccctgcacaaacgctgtctgcttggagggaagttgacgggagtgtggctggatgctgtctgcccgcgctgtcttcctgggctcagcatcctgggacacaggacattgtagtggagcatcccaacctgaaactttgtctcagtgtagagacccagaaagatggggtctgggtgaaggagtgtggagtatggctgctgctttccaggaaacggtttcccctggtaacagatggcattgggcttttagtcctgttgaaattttgttgtcagaagataaatgtaaatagactcaatgtccatgctgtgacttggcttattaataacatctgtggagccataagatgacacacaggagaaacgggctccactcctaccccctgaaggggcatttgcctttgccctgaacagcagcgcccattcaataagtatctgttgacagctggtgccccggccacggggacaaaaagaggacagagcaggagtgaggctgtggtgaggccaaggttgtgtgggcggtgatacggggaagcctggctgctggagtgtccggctgtgccctggattgggtgagagggacacaggagggacgtggggcagagggaggggagaggagtagccactgtgttcaccgtgttgccgtgttccagggctgcccagtggccggattggccagactgtgttgcatcagggaggcagaggccagatgtagggaactgtgtgtctgaggactttgtgccacgtcctggacaccgaagggagtgccactggtgtgtgagtgatggagtaagaggtgggctgtgttttgg

SEQ ID NO: 102652 - DNA, 1067 bp, Homo sapiens
agcagagacccacatcagcctgaggccccttgtgccatgtccagagggtcccccagatggacagaagcctgagctgtgccttggcgctccctttacacaggcctctgtggcttcccaggcagcagttagtctaggcgtgtcgtctgtgatgcgtgttctgactggcagccttcggatccgtgtgtgaattcatgtgtagctcgcccagctcacttgggcttcctgtctcagaggctgctgaaaatggaatgttcttctttgggctcaggattaatgtggcaaagaaaataaaaataaatggttttccttcattttttatatttgttttgtgctttgctttgtgataagtttttgttaaaagtttgtcatttaaaaaaattctgcacctgaatactgttctcttgtccaatattaaaccattaggaaatgtagtatgttaatcaaatgatttatcatctgattgacctgttgtcatttatctttttcaggttggagaaaaagtcttccccatctggagatgacagttgatgctttatttggaaagcagtgtgcatatcttgaggggtgatgaacacaagcaaaccaagttgcacctggcttctgcacactcctgcgaaagtcggtgaacattcactccacattgacccctccctagcctggcaggtgacgtcagggtccttcacagacaaacacgcttgggctcggcaggagctgccgtggccacccccgctgcccagtgtctgccctctagaagtaggctgtgtttccaggtgttcacccgtggtgcccacagtgccgacccgtggctgggtcggagctccatgttcctaagctaggtctaggtctacactcctaggacgcacgcatatcagcccgtgtaccctgtgacagtgactgtccccacctcctatgttagtggtgcccttactgccgtcgctcatccactcgtgtgggacgtaggattgcacagggctgtgccagtggcgtgtagggaacactgccctggctcagcgtgcgagctaaggtggtgatgtatgcgatgggactctgcatgggatagtacagtt

SEQ ID NO: 102653 - DNA, 1029 bp, Homo sapiens
tggtctccaactcctggcctcaagtgatccacccacttcggctacccaaagcattgggagtacaggggtgagccactatgcccagcctcacatcatatttctaatcccgagactgtagagctggtgtctctttttggaaaggatgtcagtagagaaatggagttccccaaaattacagtttcacatattagtaaagtttctaaaatacagtaataatgttgagagctgacatagggactaacttagttttttttttttttttcaaattgtcacctaactttgattttgctaaataaggacattaaaagaaaaccaaaaaagtccactattggctattgccactatttgattttttaaaaaataagcgtattttagcatctaaaagtaggaaggacctcaaataaatgagtctttgttcttggccagggaaaacagcgttgtcagcatttgataactgtttttctagggtatgtgctgttattcagttaaaaccttgcctgggacgctagcattcggtaaatacttgttgaataagcaaatgaaacttaagcttctatgtatagaaacctaagtcacttcacattctgattagcagagtaattgaatattcttttcagtgtgtagatctatacccagaaccacagaatattggaactgtaaaaaccaactgcattaaatagatgtggtatgtggcagtgacaacttgaaggttgtgactagaactccggtctctggagtgttctattatatcacaccaagctggtcaccagcccatgtgttgatcctccattgtgatagcaacaaagaaaagacttcaggacattctttcctttaccctaatccttgatcttcagtcttatttagaaaagcttaatgttaaagatctagtttattcaaaactaaagataaggagtatgagaatttctatttcggagtgtaaaggaggagatgtttccttggcttctctgagcctacaggccttccttgctctttaaggaagtagagagagagaggaaagtaaagtatgct

SEQ ID NO: 102654 - DNA, 1050 bp, Homo sapiens
gcccctggtgcgcgagcctggctcccaggcctgcctggccatagacccgctggtcggggaggaaggaggagcagcagtggcaaagctggaacctcacctgcagccccggggtcagccagcgccgcagcccctccacaccctggtgctcgccgcagaggagggggccctggtggccgcggtggagcctgggcccctggctgacggtgccgcagtccggctggcactggcgggggagggcgaggcctgcccgctgctgggcagcccgggcgctgggcgaaatagcgtcctcttcctccccgtggaccccgaggactcgccccttggcagcagcacccccatggcgtctcctgacctccttccagaggacgtgagggagcacctcgaaggcttgatgctctcgctcttcgagcagagtctgagctgccaggcccaggggggctgcagtagacccgccatggtcctcacagacccacacacgccctacgaggaggagcagcggcagtcagtgcagtctgaccagggctacatctccaggagctccccgcagccccccgagggactcacggaaatggaggaagaggaggaagaggagcaggacccagggaagccggccctgccactctctcccgaggacctggagagcctgaggagcctccagcggcagctgcttttccgccagctgcagaagaactcgggctgggacacgatggggtcagagtcagaggggcccagtgcatgagggcggctccccagggaccgcccagatcccagctttgagagaggagtgtgtgtgcacgtattcatctgtgtgtacatgtctgcatgtgtatatgttcgtgtgtgaaatgtaggctttaaaatgtaaatgtctggattttaatcccaggcatccctcctaacttttctttgtgcagcggtctggttatcgtctatccccaggggaatccacacagcccgctcccaggagctaatggtagagcgtccttgaggctccattattcgttcattcagcatttattgtgcacctactatgtggcgggcatttgggat

SEQ ID NO: 102655 - DNA, 1042 bp, Homo sapiens
gaggctgagggctaaacacagctggatgtcacctgagttcatttataggaagagagaaatgtcgaggtgaaacgtaaaagcatctggcaggaaggtgagtctgaagccctgcacccgcgttccgactatcagtggggagctgttagcacgtaggattcttcagagcagctgggctggagctcccctgagctcaggaagccccagggtgcaagggcaaggaaatgaggggtggtgggtcagtgaagatctgggcagaccttgtgtggggaaggggtgctgctgtgacttcagggtctgaggtccaaagacagcatttgaaaagaggctctgaagccagtgtttgaagaatttgttcctgaagtacctcctgggggtaggctagaggcttctggcttcagggtcctgaagaacacattgaggtgccgtctgacactggaatagggtgcccttcattcctatgcctgagtccttaactatatttccaacctccagtgaggaggagaagattcggaaatgtgacaggagagcaaacaggacagtttgcatgtgtgtgtgcgcacacatacatgtgcgtgaaagattatcaataaaagtgcataaatttgttgatctggtaagagtttctagcaggaaggtcgagccacttactgtaggtcaagaagttgctagttgcggagttttttcttgcagttagactttacctagtggtagcagggccaccaaagctctgtgtcccagatggtgtatggcccataatccacccaacagcagcaaaggaccaggcaaaggagaacaggagcagaagcctcccagccactagccttttgggctcagtctctccaataatcctggagaggggcttcgttgggtctggacacctaccatgcattctgtgacctttccctagcttccaataaataactgtttgacgcccagagtacaggataccacaatgcactcttcctgcgtagagcacatgttcccatctgctcccattcctcaggaaccttgaattctagctctgctggcctttgagcccatg

SEQ ID NO: 102656 - DNA, 1069 bp, Homo sapiens
cctagtggcaatatggtcagctgaaaatggacaccagcaaagaaggggagaagcgcaaccgtagtctgcctcagctctacagcaggatttaagctctggagtcagactgagttgtaatcctagctctgccctcttgaacaagttacttaatcttgctgtgccttggtttcctcgttttacaaatagcgtcatctcatagagtttttctgagagggaaatgtgaaatgctgcctccagtgcctgcacagtgtctgctacatgtcagctcttaccctggggaaaaggctggtctgtgtgtttgctgcttagacagtggcagtcgtgttctctagaagagcctggagatcaggaagactgaactgctgcgtgctcgtttctggcaggtttggacatggcacctttctgctgtgcctggaaaccatttaccagaaagtgacgggcaaggagctgagatacgagggcctgatgggcaaacccagcatcctcacttaccagtatgccgaggacctgatcaggcgacaggcggagaggcggggctgggccgcccccatccggaagctctatgctgtggggtaggctctgctctccctcctttgtcccttttatgacatccccttctctccctcctcctctactctcacccccatttccctatatctaattcactcttctgccccgaaactcttctctgctccctttgctttgcaacattgatttagggttttttctcctttttccttttccggtgtggctgcccctgccagtgataaccctatgtctgacgtatacggcgccaacctgttccaccagtacctgcagaaggcaacgcatgatggggcgccagaactaggggccgggggcacacggcagcaacagccctcagcaagccagagctgcatctccatcctggtgtgtacaggcgtctacaatcccaggaacccacagtccacggagcctgtccttggaggaggggagcctccattccacgggcaccgagacttatgcttcagtccagggctcatggaggcctcccacgtggtgaatgacgtgaatgaggctgtgcagctgg

SEQ ID NO: 102657 - DNA, 1036 bp, Homo sapiens
gccctgtcctctctgtattgcttataattagctgggaacccgtttcagagccacagcatcccgtccaacaaggagttccagacttactggctggccttcccagtgctgcccaggagagctggccattgtgaagttagcaatcctgaggcccggcactgagctgccctcgggagaggtagcttgcttgcagaggaagcactggtcagtctgcacatctgcccaggtgccctgtgcgctgggctcatttttgagcactgactttgtcccctaactcatctgatcccttggtgatcctctgcagcatgactgccatctcttgaggtgcccgttggctcactttctcctcatcgcaccgtctgtgtatcacatagcccaggtcttgagtcagaccattctcacagtttgacgacatgcagttataaacagataacttactttttatttgctgatatagcttaagtccttcctcctccagcgctttctgatggaacagagcacttcctcccctgtgagggctttctccctgacctgtgcaagttctgtggagaaccagaatgtcagagttggaacagatctcggaatagctcagagacagccccacacaggggagtgacctgtcccgggtcacatagttgtttagtggcagagccaagactaccatggcctggggatggagtggaccctcgaggctggtcgagtgaagctgcctgctcaagaaccgacatgaggagaaatggcccatcaggcgtgatgccgccttcgtctccacggcctcaccttagctgcctgattttagactcttgcttggctatatcttgtgtcctctcccaccagagaaagacagctgaccacccttcctcctggtgacttcacccatggtgtcctgcctgttctgtggccccacctggccattgtcttttcgcctttcttgcatctttctcagtcctctccagctttcccttggcttgggcttgaccacgggtgtggggtctgtggagtgtgtctcccctcccctcccagcaccctggaggtgggg

SEQ ID NO: 102658 - DNA, 1253 bp, Homo sapiens
cacaggtgtggggcgtgtgcgatgacgtgtgatcgaaggcctgtaagctcacaggagtgtgccacaggtgtggagcgtgtgcgatggcgtgtgatcgaaggccggtaagctcacaggagggcgtcacaggtgtggggcgtgtgcgatgacgtgtgattgaaggccggtaagctcacaggagggcgccacaggtgtggagcgtgtgcgatggcgtgtgatcgaaggcctgtaagctcacaggagtgtgccacaggtgtggagcgtgtgcgatggcgtgtgatcgaaggccggtaagctcacaggagggcgtcacaggtgtggagcgtgtgcgatggcatgtgattgaaggccggtaagctcacaggagggcgccacaggtgtggaggggagggcttggagtatccctggggcaggagttgcctgtggcttcttggaggggtacagcggagccccaggagatggctaagctcctaagcaggggaagtaggaggttgggaatgggatagggagaggaaggaaagaacaggaagggtggtgccaggttgtcgggaaccttggaagtaaacttgaggagtctgaccgacttctcagggcagtggaaagcagggcacgctttattgctgatggggcaatctgatagaatcaggattttggggaaattcattttgagagtaatcaaaccatgtccagttaagattgcaagttggaattgaggataggaaaatggaggcagatcttagaggagataggctgaagctggcttgcccctccccaaggccgcctcttccttgatgatttgggttcatcctttaagattttagctccagccctacttctccatgactcctctggactccccagcccactgaggagtctcttctgaactcagcactgactagcagcactgttctcagagaacactggttttgatgggctctgaatgtgctagctccttggggacagagttttttgtttttttttgagacagggtcacactctgttgcccaagttggagtgcagtggtgcaatcatagctcactgtagccttgacctcctgggctcaaatgatcctcctgccccagcctcctgagtagacgacaggtgtgcaccaccatgcctagctgactttatttgtagagacaaggtctcactatgttgcccatgctggctggaactcctgggctcaagccatcctcctgcctcagcctcccaaagtgctgggatttcaggcatgagccactgcacccagctgg

SEQ ID NO: 102659 - DNA, 1467 bp, Homo sapiens
tcggtggctcacgcctaataatcctagcattaaatttaggaagctgaggcgagaggatcccttgagcccagtgggtcaaggctgcagtgagccgtgatcatgccactgtactccagtctgggcaacgggaagactctgtaaaagcgaatgattaaaaataagtgttgggattatattttctttggatttctctattttctatttaaagattgccctatcagaatcccatcttcatttttttgttctttctgacataggttttcaagggacatgagtgacccgaggatggtgttgagcctctctttgtaagggttgtttctttgttactcacgtactggtaattatcttaccatctctgcagagcccacccacctttgggttcctgttggacatcgatggagtgcttgtgcggggccacagagtgatccctgctgctctgaaagccttccgaaggctggtgaactcccaggggcagctgcgggtgcccgtggtttttgttacaaatgctgggaacatcttacaacacagcaaagcccaggagctgtcagccctgctggggtgcgaggtgagaaggcagccagaggcatggaagcccaaggacctggttcctaatggagccgctgccccagctccaagtccctttcccctgggttgggatatggaatcacctagtcctaggtcatggccacagctgaacacagaaatcctgcctgtgtatttggcagttgtagattatgtccttgtatctgtttcttttcttctgggcattgggggtgtgagtccctggaaagcaaaggtcacacacatgtctagaacttgcatagcaggaatagcaggtgtggctctggcgtcacaccttggctttcctgggtatgatgtgtgcacctgaaggagtgctgtcctcctcagccacctgcagccctgcaccatatcccaactttgatgcattcttgtttgttgagggtgaattcagcttttggaaagagtcctttggaaccaggagagtaaataaaatagctgattgattagatgatgctgctcaaagttgcatgtaaaatgtgacggaatcaaattggttccttgctgtgatttccagagagaattccaaaaaccttccaagtaaaggctgcattgttagggttagtataaatgttaagcagctaactcttagcaggaatgaaaatagaaagtaaaagaccagtttctgcgacagtgacagggagcacacatgaaccctatggcttccaagtgggggcttgggaaatccaaactgaacctgacggggtagcggtggcaagtggtcagaacccacatctgtggcatttctggtctcttgtgtggcaagaactaaatgagacaggttcttctcagatctgtttgggtgcctttcagaagtgctgctgggtgctagaaagggctttcctccccgttctttttctgagcgggttttttccttccctaggctaa

SEQ ID NO: 102660 - DNA, 1009 bp, Homo sapiens
aaaatgcttgtagtgtttaaaggggatttatggccatcctgaaatctatctgtgggcctaggttaggacccccattctagtgagatttcttggggaatagggaggggctccagggatccttgagggtacatgagtgtattgaggagagagaagaaatggaactcacagctgggagctggcaggaggtgggggaagcagtcctggggtcccctgttttctctgaggtgctgccgagttgccagctgaatttgagactgaatcctgaatccagcacttgtgaactgggtgacccttgctgagttctttttgaggttgatgccttatttgtccagtcaggtaatttagtgcctgtatattgaacaccttgtataaaccggcacattttgccaggcaaggccatttggagatgctgacacttcctcaaagggctgccaaaaagaatacataaaaatgcctttgttacatgtctggctgagtgcttgggacagtgacaggtctgggtgcaacagcataagcctgtgaagccaagggttagaggcaccatttgtccaggcatttcctgtgtggcgtgtggggcttggtcagttttctcttggcagctgttttttggtgttcaggtgtgatatcttgttggctcgagttgcttcctcctgtttttccagggtccctgccctcctcctgcttggctctgtagctgtcattgtccaagcttggagggctcatgtacaagctaacatggaggaggagctggaagattgcctctcccgggggtcttgcctgttcagtggaaagaagatgggatcattacagccactccagtccctgttttactggacccgagacatacctcagcttcctggaccccacacgctcttggttttcctccttgcactgtcttttgctggcaggtcttgtgtggtccattattaagtagtattgttcttcctggttctctgagaggcgagaccttccaaaattttcatctccaggacctgtccagtgctgatgt

SEQ ID NO: 102661 - DNA, 1014 bp, Homo sapiens
gtaatttaggttttccatctctactatctgtgataagactaggaaactgtgggaaaatgaactggtttagtgatagcagcaaagaggataattaaatgagctactttatctgggaaattctgcgattcatgagatatcaaggaggcgggtctcccagtaatgttaggagactaggagtgttgatttgtagttttcttgaccagctctgtgctcaacatgaaaagtcacctgaaacccttcatcctatctgagtcccttcatttcctgcgtgcgccctggccgcagagcctctccttcaagcctcagctgcttcctcagagttcagccttcacccacccatgcaccaagagcagtccttctccttctggatcgaggctgtttccacagggactaagaggaaggaaactacagatgctcacccatcatgtaacatgggcgtcttgcagctctgtgttttaccctgtggctccgtacgtgtgcctctgtcagcaatacgctgtttcatccacatgggatggtagctccacaaaacctggagcaatcttttttcctaccctggacccacataatatcaattggattattaatgaaatttatggcccattttgcgaagtggtgaccacagttgcctaccatgcagttttagatcattagggggagaaagtcacataaaagtaaagcattaacttacaaaacacttccctttacaaaaaaaactgtaaatactttcccttctgtggttttctgtgtcacatgaatccacttcaatccaaggtacgcagacccataaataccaggtatccataaagttctaggcaactacagcaactgaacctgacattgtaactttgattttaaataaaaataccatctttttttttcctgattagagtaactagtattgaatttgaccaaagtcaataaagtctttcttagaaaataaacacggtttctttgggtgccagggcctgttttcagtgttgctttatgcactgtacaaatggtatactttat

SEQ ID NO: 102662 - DNA, 1164 bp, Homo sapiens
cgggggtgcggcccgcgccccctgggtcctgcggatctgggcccgggggcgcgcgccccgcccctccccctccctggcggtgcagctgtccgggcgggggtggggcgggggccggggcccgcgtgggattaactaggaccggggcgggagtcgaccgcggccggcggggagggctagccccgctctggcgggcgggcgcgtggcaggggctcccggaggccccgagctcccgggaggcgctccggccaacttcgggccggtggggaccgggcctgggcgcggggctctgaaggtgtggaaggaaagtttgggactccgttattcttccacagcgtccttcctcccgtaatatccagcctctttatcgcggggctcgggagcccttggagttgatctcgccaccattatccccccgggcgagcgcggaggacgggctggccattctggccaggccggaggtgttttccagcccggggctttgtgataactgggccgaaacccgagggtcctggagcgcggcgggtggcgggagcttgcggagcgcggcgcactcggcggccaggcatcggccagcccagcggcagccccctttctcctatttttatttttatttttggaaggagctgagaattagtcgattggttggcaggttgaattgccttctcttctatggcaatatgtgtcgtgacttttcaccttttgcctttggacaaaggtgaatggcaactgcgttggtcagtttttgttttctgttctgcggatgggttcgccgacgcagtaatcaaaattagagccactcttttggaagagcaaatcgttgttgttgcctccccagccccacggatcttactttgtgccattttcgggttgattttaactcgtttatttcagagctctttgcctcacctttatttttagatttagtcgtgtttgctgaaatatcagttgcttcttctgtgaatgaagtgtgggaacttgctctcgtcgcagttaatgaaatcaggaaaataaaaagatcaaaagggttggggatgggagaatgaagaggaatgtagacagatagtctagggccactcactggcttttggcgattcttagttccttaagctgattaaaacaatgtgaggaaatgtgggcttctccactttttaggaagaggtaata

SEQ ID NO: 102663 - DNA, 1018 bp, Homo sapiens
ttcaaatagatttttattttggtttggggagcaaacggtattgtgagtgtgactcaagcagtctagtgcactgtgaagggctttgagcttcttggaagaaagataccatagaacttcaaggaaatgagatcacattatctgtggcttttgaagatgtttttcattgaatgtccatctccaagtccttcttttccatcttggggtattcaatccccacagagaccctgtgtcttgttttttattctttatctctttggctgggaactaaggtctgaccattgtttttttttgttttctcttctactcccttgtgctctactcatgccctagggtttgttctgggcatcagtggaggaggggtagaatttctggcttgcagcaaggtgttaaatccgagaatttgtgtaaataagttggtgtgaagtcaatcagttctacagccaaaagcagttttctcctctttagagggcagatgacccctctgaataattctctcatgtgttcttttttgtacttcgttagccatacactcatttaaactgtaatatggtttatgcaaaaatatatagaagatagtatttcattctcctttttaaagtccctgacctcatgtggcctttacaaaagacattggccggtttaaatgatgtcatatgcgtataagtttcacactggaatggtcagcttttagctttggttctacagcccagactctttatgagctaaatcaggtctactttttccctagggtgggtttgctggagtgacgtgtgacttggcattgtgtcactgaggcatgtggccacctgaattgaatgtgtgagtggctgtcagaacagactgtgtgtaccctcccttgctcctccccacccatcacctccaaaagtaagtgatgaaaatagaggaagccatggggccacaattaagctcactgcttcacgttttcaatgttgaactttaaatcacacccaattaataattcctgagaatggataagttcttagaattgaaaaatgct

SEQ ID NO: 102664 - DNA, 1034 bp, Homo sapiens
ttttattttgagaattttcagatgttcggtgaagttcaaagataagtgaacccctgcgtaccctttactctagatgtaccaattgttaacacttttgccacattggctgaaccatttgaaagtaagtcgactgtgtcatgagagtctaccccttcatagtttcacatgtacatgtacttcctatgaataaggactttctcttgtatgaccacaatgttatactcacatttaggaaaattaacagtaattctgtaataacatccagtaaacagttcacactgaaatatcctcagttgtccccacagtgtcttttatagatgtaccacacctccatcctggtttacacactggttggttggtaggggaattgtttttaggcaggctgaagccaacccagttatcctagatgtagggaaaccgggaaacattggtaaaatgatttaaatttcaagctgcagggctactagtgaagtaattacaacagagagttgattggaatcactctggctccggtccaggctttgcccaaggtctggacctgtcacttagccctgttgagcctcagcttgttcatctgcatcttggttgtctcgtgttccatagggctgtggtgaggttcgaatgagccaagcatgtgagggcctggcccaaatagatctcagcaactggtaattattgttacattttctttcattttagattttgattatggtaataatatggaaattataatcatttgggagaaaggaattaactgacaaataaattgaatgatcacatattattttgaaatcaaagtataatgaaataaaattgtaaaaatataccaatatagtgtgcttatgtggattaaagtgattgttgaatacagatgcttttgtttgtttgagacggagtctcacactcttacaggcgggagtacagtggcgcaatctccgctcactgtaacttccgtctcccaggttcaagcaattcccccgtctcagcttcccgagtaactgggattacaggcatgcgccaccacacccagctaa

SEQ ID NO: 102665 - DNA, 1028 bp, Homo sapiens
ctgtagtaagccatgatcataccactgcactctagcctgggcgacaagagtgagaccctttctcaaaaaaaaaaaaaaaaacaaggccaggcgctgtggctcacgcctgtaatcccagcactttgggaggccaaggcgggtggatcacctgagttcaggagtttgagaccagcctggccaatgtggcaaaaccccgtctctactacgaaatacaaaaattagctgggtgtggtggtgggtgcctgtaatcccagctacttgggaggctgaggcagggagaatcgcttgaacccgggaggcggaggttgcggtgagccgggattgcaccattgcactccagcctggcgacagagcgagactcttgtctcaaaaaacaaacaaactgtgcatcactttgttaaaaggaaattttatgtagaaactgaacatataaaatgggtaagagtgaagcactgtttgaaaattgctgtggtaatggcagttaaagtttaagcagggctgagtgatgtggttgagtgtttagaacattcctggtatataacctgtgtgcaataaatatttgctgagtgaatggagaagtaatctctgcagagtagaaagatcacttcactgttagtatagaatgaacagcccagaaccagaaggacaagttatgagggtaggtgagagatgacaggacgtgaagtagaaaggataacacatctaatgagagcatggatttgagagtaggagacagaattaactgcatgtggttggacaatggcttgtgagagaggaaaagcctagcacagtgcatcttcagggcagtgtcatcccgaggcagtgttgtgggaatctgtggcagttagtgggtgggacctgcatgctaggtgttatacagtgttacatacaatgcatgggacattctccacagtgaagaatttgctccctcctaaagagctttttttttttatttattttatttatttatttttgtgagacagattctggctctgtcgcccaggctgggttgcagtggcgtgatctca

SEQ ID NO: 102666 - DNA, 2963 bp, Homo sapiens
agtgcacagtacttacacaatggcggtaatttaatttttggtcattcattcttcaaagataactggaatatcttcataaagagaaacttatcaaacatttggttatcctggatacagttcaaacaggtaagataaaagcatgattatttccccccatatttcacaataaaagttttcaaaatattgagtttattcctagtgaaaaatactgtttctttttctttcttttttaaatttaaattaaatagagacatggtctccctatgttgcctgggctggtctcgaactcctgggctcgaatgatcctcttgactcagcctctgaaagtgctgggattacaggtgtgagctactgcacccagatgagaaaaataatgtttttatttgtgtgtgtgtgtgtgtgtgtgtgtgtgtatataaaggcagcagagtcatctgggaatgctcagggaataggcgtggtggggtaatgtgctcaagagagacaaatgtttggagtggcctctaggagaacaggagaggggttgtggagcttggttgatgatggagatagcttatagtggtaccagtgtacatgtgtgagtctattgtttttcatttttccagtgctcagataactgcctaggagaacatgtaaatgcaatcattgttcatcagggttgggattttgcatggaggcgtaaaagaaggattggtgggataggggagagtctggaatcatggggagaatgactgaagtgactgatcatggtggtggggggatggtctagggtggatatggagagaaatgcacagtgattggtacaaagaaggtcctcagtaaatatgtggtagaattaatagatgaagggaactaatagattggaagaaaatatagtattacaaggactagagattccaatgtagtcagaataggtattttggatatgaatgacatgtgacatagtaagataaaagacaggaggtgaggatttgagagcagggcatatgaagatctcacaagggagaccgggcgcggtggctcacacctgtaatcccagcactttgggaagccgaggtagtcggatcgcttgagcccaggagttcaagaccagcctggccagtagggcacaaccccatctctaccaaaaacaaaaacaaaaacaaagaaaagaaaagaaaaaagagatctcacaggacagcatctctggattagcttatacagagtaagttatatcaatgggggttgacttatggaagataaaaaggaactatacagcgttggatgagttctaagtaaggatttcacaaccatttaggttgatggtgggagggacagaaggagattacagcttattataaggaaatgggtaggttagtgaataacagggagaagcagagaactagagcttgattgcatgagcctcaaaagatgttttcattcatggtcagagtggcagtaagaagtcctatatggctggtggaagactaagccaccattagtgcagtctctagggaaggactttctccttaggagaaaaaatagtttagttacgacaaagaggagaatattgccaaattgctatgcatagaggttaaaccagtttagaccccccaccaacagtgtatgagagtattcgtttcctatatggggcattctttatttaccacagggttgatgatagttttcctttttattagatttataattggtacattggaacttgattcacatcatcctgtattcagtgatgtctggcttctgaaatgctgctgttatcattttatctgcattacttctttcataggtcaggcctcttacagttgtcaaacttcagtacagttctatatgaaaaatgcacataacctatacccgcatttgtttagcaaaatggtgtgcacgggttcctgatgaacattgcaaatgtgtatctatagaaagggccctacctttctgcaccctccctctcttcccacatgtcctttggccatccttccatctggcacacttattctaccccctaattcttcaagatgctctatcagccaatttattctccatcagcccttgtagttcatcacactcaattatctctaaccctctcccacctccactcccaccacacaccccagtgctcctgcctctcaggatgtgattgattttccttctccttctgccagctttctctctgggttagactgccctgtcagattgtagtgctgaggaaagaagggttcatcctaagcctgacttgtactctgtacagctggagttgtttctcagcatccagccaaggcttctttgaaaacactcactggggaaaagaacaaggttgcatcatccctttgggtcatggctgcagtgtctcttggtggttttaaaaacagctcactccttggctctcaaatgaccctggaaaccaattgcattggctacgtaagtcataatagttatagtcaaatcattgcctactatttatatatatataattatttcccatgattatgctaatgcacatcattaacccagattaactctgttagttttatttgatcacaacagtgcctcgtctgtgagtgccctgtctctatagttcttgtgcatgctgcatggtcgagtgctcacaacttaaagggaatcttggtgaacctgacagtgttgatgtttgagtattgatcataaccctgttcatccatacacattttgctagcttctgaatgctgtatctgtttttgctaaagctggggtaaaaaagaaaactctgaaatttgagtgcccatttaatcaggcatttaatatatcttatttcatttagctcttacaactctgatgtatgtaggattgctgtttcttttacaggtcaagaaactgaaacttacagtaattaattgaactggtcttgaggatatttggttttgagctatttcaaatgaagacaatactactcacctcacaaggttgatgggaggattatagtgtctgtg

SEQ ID NO: 102667 - DNA, 1059 bp, Homo sapiens
tcggcttcccaaagtgctgggattgcaggtgtgagccactgcacccggcctttagtttcttgatgtaccatttgctgttagcttaaattatgccaactacagcccaagcttaattcaacatttaaataaagttctatgcacaataatacaacacagcacttctattatagcaacaacattagctgtctctagttcctaaaataagaaactggagtgacggaagaaagacttgggttgcttgttcccacctttgacttgtaaacttccttaatggtctttcatcagatgcttaagctgccagagtatcccttatgaattaaccagctactctgtgggaaactgcttttgtactacttccaattctgacaacctttttctcaagttgagctgcctctgttcctacttctgaaatgcctgtgcaatgctgactgagtttgtcaccagtaagttctccccagacagggaagtcctgcgggaccagtatcagtcctcagtcaggaagaggttgtataaatagcgggtgctcacactctagaaaaaggggcggaggagaaggtaagtgttgagccccagatgtgaactcctatttttgtttcagggtaattaatgtttccttaagtgagctaagccttgggctcttgcgcctctggctttcaggcctgaatcagcaatctttaggcaggaactgggggtggggaaaaggattttgtatttcatgtcatccccaaatgaatgaagtaatatgagagcagcactttctgaagcttggccttgaggctggagaatgggttgtggaaggtgaaaactttccttttaaaatcctagtgacttggggagaactggcctctgacaagtctcttgctgcagtctgatgactgcagctctcagagatgctgttgggttgtctggtgtttgtttctagttctctgctcgagtgttagtgccattagatggtcttgcccctgtctgcggttctgccttccatgtcttccccttcccccttggcctcctaaattagatacattccccctctgctcccagacgtctccatctcctcat

SEQ ID NO: 102668 - DNA, 1033 bp, Homo sapiens
aattttccttgtccgtttttctccacctgcagttagttgcaaaaccctactgactgtgtgtctgaaactgttcttccataatttctttccatttccactgtcatttctagcactggccccgtcacctcttcccagactagaccagggttcttctcaccctccagtctctctccctaactaacagtgtgttctgcagaccacatccaaattaaccttccaagtttgattattctttcttttctttgttcaaaagtctttggtgactccccagtacttaacacaatttccaactaattcagcagtgatctcctagtagcaagagaatgatgactccaaacctcagaggcctggagctgtattccaaagcagctctgaacataaattctctaatgacatctcccattttatctgtaagagtcatgcaagtatttaaggtaaaaatatcatcccaaacaacaagcaacagcaatacaaagtcaaagtaaaactctaggaacctgtgccatttttaccctgtggctttttatattccagccacacaccgtggaacccagggaacactcacatcctaattggaaaattgggtctaagcgatgaagtccagatgattccatctggtatctgaggctgtctgtggtcagctgcgaacctgcttttccagattttgtctctggccatgcttgtccagtatactagtcacctagtataattgttctagtcacctaggaaattgtgttaggtactggaagacaccaaagacttttgaacaaagaaaggataatcaaaatggattaaacaaacctagagcatgttgcatagtttccaactttcgcagtgctcaggaattgttaatatgagtgtggggttttttattgttgttgttgtttgtttgtttgtttgattgtttctgagacactctggctctgtcgcccaggttagaatgcagtgggtgtgatctcggctcactgcaacctctgcctcccgggttcaggcgattctcctgcctcagcctccccggtagttgggattacag

SEQ ID NO: 102669 - DNA, 1388 bp, Homo sapiens
agattaatgaaaatttatacagggattagaaacacatcaaacaagaaaaggtacctgtaatgttatttaagaaaagttgtgttaaatgggttggtagggttacaataaaggcatttagcaatatcctgcatatgtcacttgactgtctccagtctggaaattatcttcgtgtattaggcaggcaggacttgccgaagtgcagaatggtaaactgcttttcttaagaggtatgtaaaggccctgtttcttctgcttgttcccgctgctgtgagaggttggggctagtccccttgctcacttctgagttgttttcccagcagccactgcacggctcgaaggatttgtcgttgagggtggagaaggtggaaggatgttgaacagacttttccctaatgagctgtgatgccagctgcaaaggcggcaaatcctgttactcccttcagctactctctgaagctgcagaggggcagtggtaactggtctccctgccctatgctgattagctgccttttctgctgtttttccccccttcctcttctgtcccagagcatcttggcaaagttcagatttctgtgctcacagctcaatgctcacagtgaaaaggaaatacaaaagaggaggagagaaagtgagaagaaaagagagaaaaggttggggtggaggtttttagtagagtcccttattgccttagtctaagacttaagctctgggttgaaaccttaagtggtaaagctttgtaagtagtaacctggatttccaaatagttcttgcagatagttttattggcacatgaacacagcaggccatatattaaaagcatttgaatttctatcgtttagaaacctccgaattttgaaaaggacacttcgcagtttttccacaaactatcattgtgaggaagatgaaataattgtaagataaatgttttcatgtggcatttactgtgtgccactgcttcatttaatcattacaacccttgaaaatagacacttttaatgtgaaaaataatttattgtagtaaacacattttaaagtggtcagttcagtaatattaagtagattcacattgttgtcaaagagatatccaaaactgtttcgtcttccaaatgccagccgcatatctgaaacaccatacccattaaaataatggggaaacattttaactgatcagccagcattttaactgtttggccatttcttttgttctgcaggattaaaaatagctctcctgtttctttccttggctgttttgatagaacattcttcctctgtatttcatcacaggatggtgagaccagggcttgtatttactgtgccttggtttatccatttggtactaactggggggggtttatagttactaaagggaaagagaaaaggctttactc

SEQ ID NO: 102670 - DNA, 1027 bp, Homo sapiens
caggatcgtctcgatctcccgacctcgtgatctgcccgcctcgacctcacaaagtgctgggattacaggcgtgagccaccgcgcctggccaagtatcagatatttttgttctaacgaattcagtctgttagggctgggaaacgatgcttgttgttaatgtgcaataaagttgtagacaaggtaagaaggagatgtaaatgctgtttttctcagggtggaagtctgcattctctaggggagagttattgctcgtgcactaagtataatgacttttccccctagaatacccaggttgtatttgtaaataaaaataaacataaaatataccttagaatattttcttccgttctctatttaggatgtagacttgggagtttgtaatttttaagcactgttgtattcgtaccttgtgtttaattccacattttcataacctggaattttttttcattatagcaatcagtttcttataaccacattttctaaatgtcattgtcaaataatccagtctggtagctgacaagttatgtctagcttttagctgttataaacatatataatgcatagctttgtacaaaattcaccaggttcctggaagtacatcactcagtcaaaagatatgcccatttaagatcttcattttaagcaaggcttaaaggcttttgccaggtttcccgtcacagaggtggttgtattttagccttaaatgatcagtgcgtgagagtgtctgcttggatgatccttgtgagccctctgtacacagactagtaggtactggcagcacaaacactcaccagatctcttagagttcacagttgtgacagggaggtccatgaatcattacagtaatgattatatagttgccagttatgtaattacaacagtaagtgcttagaaataaaaatacaacatattaacagagcatacaacctggggtaagaaagtgacttgtgaactgagccttcacatatgggctgttttctctcataggatattcctccgtggctgagttcatcctctaatttgt

SEQ ID NO: 102671 - DNA, 1047 bp, Homo sapiens
cctataatccctccactttgggaggctgaggcaggtggatcacgtggtcaggagatcaagaccatcctggctaacatggtgaaaccccatctcaagtgaaaatacaaaaaattagccgggcgtggtggcaggcgcctgtagttccagttacttgggagtcggaggcaggagaatggcgtgaacccgggaggcagagcttgcagtgagccaagatcgcaccactgcactccagcctaggcgacagagcgagactctatctcaaaaaaaaaaaaaaaaaagaaaaaaaagcttccctttatcagatgttaactctaaagaaacacatctctgaactgccccagtttctcttctctccagtaaattatccataagattgtctcctaaataccacaaattatataaattgttggacacaaaagttttaccattttgaatctcccttatgttttaacatttatgtatatccatgtgtattttacagataacaaaatcagcttttcgtgatataaagtccctagctaatattatttgttgaaaatactgaattcaatgaactgagagcaaagagcttatcttgcatgattgtgtactgaccggatgtgctcattggctcctcacaggagactcctgtgctgaccagaatagaaaaacaaaagcgcaaagaggaggaagaagagcgtcagattcttctagcagtgcagaagaaggagcaggagcagatgctaaaggaagagaggaaacgcgagttggaggagaaggtcaaggcagtggaaggtatgtgcagtgtccgcgtggtctggagaggtgcatgtctgtcgaccagccgtcctgtagccagagccaactcaagctaagtcctgccatgcatccaagttgtttccggcaatttcttttttttttttttttttttttttttttttttttttttttttttgagacggagtctcgctgtgtcgcccaggctggagtgcagtggcgtgatctcagctcactgcaagcttcacctcccgggttcacgccattctcctgcctcagcctcccaagtag

SEQ ID NO: 102672 - DNA, 1046 bp, Homo sapiens
ccattgcttgcatggatgccttcataaacgcagaacggcaagagctgggacgtgcgtttaaaatcctgtgtgtgtatggactgagagtctggtcctaaaaaaggatttgcggatgttgctttttttaagtaaaagatcagaatggcctcaagtaatccgagaagatagtcctcattcaaccttgtactttttcctttttcttcgactgccattcttctgttttcttctgccttgctccctcccctcctgcccaccctgtgcctgccctgccaccttcatctcccaccttgagctcagtgtgagtgaggaaacaggttcaattagtttacccttgtcttaaagcattccatctgtagaaacatcctaattaccaaaaagagggtggcacagggagcagaagttgcttcataatcctgctttggtggcctggttcttccttctctcacagtgatgaaggaacacgccatgtcagtgtctggagtgtgcttagctcactcagcctttgtgttcattgtagatcgagcgaagaggagaaagctcagggaagaaagggcatggctgctggctcaaggaaaggagctccctccagaactttcccatctggaccccaattcccccatgagagaggaaaaaaagactaaagacctgtgagtatttagtaacaacaacaacagcagtagcaactggtagcatttatgaagcattcaggcacttgccccatgtcatccttagaacagccctgttgggtaacatggtcaccatgtgtgagtgaacagggcgggccctgcacacacagacacgcctagctaccctggcctctgacactcttgctgccacactctgtgatacttaacactaagctcttctttcttcatcccctcaatttaatgaaatcagaatctgattattatgtaaattagctccttggaaatgtgaatagaagtttattctttttaaagtaattacttcccgtgacagtactaggtaccatttgtcttgactccttactaaactcaagaggcagatacacattcagtgttcctgag

SEQ ID NO: 102673 - DNA, 1261 bp, Homo sapiens
ggatcctcctccctcagtcccaagtagctgggactatcggcatgtgcgaccatacctggctaatgttttctttttggtagggacgggtgtctcactttcttgcccagtccagtcttggaactcctgggctcaagtgatcctcctgccttggcctcccaaagtgctgggatcacaggcataagttactgtgctcagcctggtttgacttaatagtcctagaggccctgtcccaaccatacaaccttgggcatcttacagatagaaaccacgtcttcttcatcttgcatccatagctctacaatataatgtgccctaaaggtgaattaaactcatagattacccaggttgcatcttctatttattagaattgtcttttgtgacctatagttctgtttctatagtttctataaactatagtttctataaacaatttctgtaaactatacctagaagtcaatcctcctgtcttcctatagagtataccaagatgtctgataatttagagaggtgtttccatcgggcaatgatgaaacattttcctggagaagatggagacacagatgaagaattttggattcgagaggatgaaaagcgggagaaaagacggagtcgggctgggcgaagtggtgggagccatgtttggacccgctccagggacccagaagggtccagcaggaaacagcagcccatggagaatggaggaaagtcgttgccccccacacgccgagcgccctcttctggggacgatcagagcagcagctccacacagcccccgcgggaggtgggcacttccaatggccgaggtttttctcatcccctgcattgtggtgggacacccagccaggcaccctttttaaaccagatggtaaggaatagagtggagactgttgcggtttctcctagtttgtgagttcatagtaatgtagaggccattcagttagtacttcctgcaaaatacttacgtgtatgtatggaatctttttccctgtgagtcctttgttcatgtgattttattttgtttactttttagtagagacacagtgttgctatgttgcctaggctggtctcaaactcttggcctcaaacagtccttctgcctcagcctcccaaagtgctgggattataggcatgagccactgtgtctagccattcctttattctaaatcctcctttttctcaatcacttgaattaggtattctcaatgtgggcaaaaattgggattaaaaaatatgtaatctggctgggcgcagtggcccactc

SEQ ID NO: 102674 - DNA, 1051 bp, Homo sapiens
aatacaaaaattagtcaggtgtggtggcgctactcagctactcaggaggctgaggcaaaagaattgcttgaacccaggaggcagagtttgcagtgagctgagatcgtgccactgcaccttagcctgggcaacactgtgagactccgtctcaaaaaaagaaaaaaaaatgtaatctttattgtataaagcacaggtatacatgtagtacatgaatgtacagtatatctgcaacattataagatttcatggtagcaggcaactggggagaaacggctaaaatggatccttgggaggaggagtaataaaaaagagattgagaaacactgatttaatcttgtatctcctggagagggaagttgcttcaggctcataggcaagccctgatgcgggtgagcacgtgtgttcacagtctccctgtctccagccgaggtttagtcgtctgttttattttagtagaacgttcatcttcaggaaaacccttgttgtcaacctaaagtctgtgcctttcctttttcctcttcttgctttgttcaatgtgctgcagaggccagcagtaccaggaacatttggccctctgcgaggatcagatcctgccaccttgtatggctcctctggagtcccggagccacaccccggggagcctgtgcagcagcgtcagcctttcaccatgcaggtaagcagcctactctggaggtgcaggtgcagggggtcccacaggtacgtttcagagaaaaagtctctttccaggttaaatgttgttcattgcgtcctttcccaaagagtctgttcccatagagaagcatggcacaaagtgtgccttattctgtgagtctgtaactgtgctgccttttctcgttgccagcctccagttggaattaacagcctccgaggacccaggctaggcacaccagaggagaagcaaatgtgcggggggctgacacacctttctaacatgggcccacaccctggatccttgcagcttgggcagataagtggcccaagtcaggatggaagcatgtatgctccagctcagttccagccaggattcatt

SEQ ID NO: 102675 - DNA, 2002 bp, Homo sapiens
tgttctttctggttgcatcccattttagagcttcccagcatggccagtgattctgatgacaaccatcccctcccagtgtgtttcacgtgcatctgcctagagtccgtgagccacaagccgtctctcagcctcttacgaatcgggcaacccacggttaaggacatttccattctccggcccactgtaagagtgaatgtagaggtgctaggttttacctttgtgtccgtgaaaggagtgaaaggaagtgtacagggaccccaatgtcctgccctctttcagggactcaaacaatttccaggtggggcttgaatcaccacacatccaccttaatctgactcaggcatgttcttcacattaatactgtcatttcagctactgagttattttttctcctcttttttttttttttttgcagcagagccgttgcctggccttgaagagaaaccaccaggtgttggtacttcagagggggtctacctcacacaactacctcaccccacacctcccctgcagactgactgcaccaggcagagctcaccacaagaaagggaaacagtgggcccggagctcaaaagcagctcctccgaatctgcggacaactgtaaagcaatgaagggcaagaatccctggccctcggatagcagctaccccggcccagccgcccaagggtgcgtgagagacctctccacggtggcagacaggggcgctctatccgagaacggagtcattggggaagcatctccttgtggatcggaggggaagggccttggtagcagtggttccgaaaagctgctctgccccagaggcagaacgttgcaggaaaccatgccatgcacgggacagaacgcagcgacaccgcccagcacagaccccggtttgacgggaggcactgtgagccagtttcccccgctgtatatgcctggcctagagtacccgaattcagctgcccattaccacatcagtccaggcctgcagggtgtgggccctgtgatgggagggaagtccccagcatcccatccccagcattttcccccaaggggctttcagtctaaccacccacattctggaggctttccccggtatcgccccccacaaggaatgaggtattcctaccacccaccgccacagccttcctaccaccactatcagcgaactccttactatgcctgtccacagagcttttctgactggcagagacctctccatccccagggaagcccaagcggacccccagccagtcagcctcccccaccaaggtccctcttctcagataagaatgccatggccagtctgcaaggctgtgagacactgaatgctgccttaacttctccaacccgtatggatgcagtggctgctaaagtcccaaatgacgggcagaatcctggtccagaggaagagaagctggatgaatctatggagaggccagagagtcccaaagaatttttagacctggacaaccataacgcagctaccaagcggcagagctcgttgtcagccagcgagtatctctatggaactcctccgcctctgagttcaggaatgggatttggttcatctgcatttccaccccacagtgtgatgctgcagacggggcctccctatacccctcagcggccggccagtcactttcagcccagggcttactcttcccctgtggctgccctcccacctcaccacccaggggccacccagcccaacggcctctctcaggagggtcccatctatcgctgccaggaagaaggcctgggtcactttcaagctgtgatgatggaacaaattggcactagaagtggaataagaggacctttccaggaaatgtacagaccatcagggtaagattgcattcaggcttttccccctaaagagagaacagatgtttattttatgtatttatttttgagacagagtctcactttgtcacccaggctggagtgcagtggtgtgatcatggctcacggcggcatcgacctcccaggctcaaggatcctcctgcatcagctgt

SEQ ID NO: 102676 - DNA, 1012 bp, Homo sapiens
tccaatgaaggctcatggatttgcatttggctgccgtgtctgtttagtctcttaatttatagcagttgtcatatctttgttttgttttccaaagagtccaggccagttatcatggagagtgttccagattccagattcatcacacagtctccttgtgtgtagatgaaactcttgtgccaggtgcagtggttcatacctataatcccagcactttcgggggctgaggcaggaggattgcttaagctcaggagttcgagaccagcctcggcaacatagtgagatcctgtctctagtgaaaataaagaacttagccaggcatggtagcacacactactcaggagggtgaggcaggaggagcacttgagcccagaagattgaggctgcagtaaaccatgatcctgccactacattctaacagggtgacagagcaagaccctgtctctaaaagaaaaaaaaaaatagattaaacacttttgtcaggagtgcagtaggtggtgcgtgtgcatgccacttactgccccagggggcacagaatgtcgagttgtcccagtatggatgattccaggcctgatcaccggggtgatgaaggcagtaccctcgtgactacagtgtcttgtttcttctgtcgttaacacgtcttcattaattcttcattgcttctttctcgtggctgtagaatgcagatgcacccggtccagtcgcaggcctcgttcccaaagacccccacagcagcaacatcacaggaggaggtgccgcctcataagcctccaacacttcccctggatcaggtaaggatcactaaaaattagagctgttcttcttcctccaggtggtaggaagtaagtatatgacaaccttgctgttctgaaaaaatgttttaaggtatcctgtggatacaggaactttgcctgtatcgtgcttccttggcacttggaaaaagagcaagaggcctcggaagtcacctctcacatgtctctttttcttattgtgatatggaatgcatacctatttg

SEQ ID NO: 102677 - DNA, 1897 bp, Homo sapiens
tgatgacttttccaaatcctgagacacttttcagggaaaatcactttaaacttgggggagggggtatactcaagaatggagtggtgcttttaaactttgatgagcagctaaactcaggtatatatttggggaagggactactcttagtattaatggttttggagctgggtccagtttacagaattttcatgttgccttttaaaataatttttgttggtggtgaatgtattgtacataaagtgggaagggtgggtggggatgcggaagaaatgggggtcctaactggtgggcacacagcactggagtgatttttatctgtttacaatcatgtcacactgaatacttatgggagccggagatgagggtaggaaaggtttgatcttgtaatgtgtcactgtgtttccttagtggccagccagccttcagaatagctaaaggccttccttccttccagtcagcctgagagagaacacctgtcccctaagcacctggtgtctccattggaggcagactgctctcaggagactactagaagcttcagcccggaagacaggctgctctctcatgctggtggcccaaattgagaaagtggtgtcccttcctgattttgccaccagccctaccgaatagttgtaaaccagtatcaggaattgggatcgctagagtgtttcacgtattagaagatgaatcgtcctcatcacagacctccctgtcaggactgtgatctagaaggcatcacacacagctttctggcacgaatcacattttgtggaagtgactactcaggtttgtatattttagtatcaataaagaattgcacaggtttgaataggaaaaatgtattctatagatttacagtttgaatttaggaatatttcagtatatatagtttttattcgttttaagtgaatcatagtaaaatcagtcatggtgatttaaaatagctatcaagaacaagttcttggaattatctgttgtatctgtgataggaaaccattttacagtattaaattactttattacagttgtagagttgaattacactggattctccctcgttagcattctgtatttgattttagctgaaaggtcaccaaagttaggacccatgttttaaacttttgaatattccacaaaagaaaaaactaaggaaaatactgaaattacaggtctttgtaaagaatagcatatttttaagcatgcttttgggatagtagaagagtctctatgaaatattaatctgccctagtttcttataaattcagctgtgggaggggccagtagagtgtttccctccaattccaggattcctagtgaagcatggaactgtcgtgtttacagtttgctaaacatatgctgtccgtggaaaaggaagctaatcggaagcatccatgatacagagaaatgaaagccaagacaccagttccaggatgatggaagttcatatccgtacgcaaatgctgaacctggtgctgctgcctagggctcaggcagatttgagagttgagtagggaacacaggtgcctctaaggtataatgcacaaaaatacagattttctctcagagaggttttaattttaaatttgatgtatttgcaagtggattgagttttgagcctgtgttctcactggatcctaattcttgttagaaacctatcactggcataacctggtttagaagagtgaagaggacagaaggattgtggatgggtctgccctttagctagtatccgctaacatggggcattactacttcagtttctgtgtttgtgcagaagcagggaggaggtaaaaagctagtttggagctggttagacctggtctaggcccagagaatttggccactgacagcctttctcttttcctggtaatgctggtttgaatcagaggcctctcac

SEQ ID NO: 102678 - DNA, 2275 bp, Homo sapiens
aggtaatcctgtctcctctctctcccagtgaccgccccaatcagctgttgctagagcgatgctgtgaacgatacaggaaaagtcagtaaatccctttatccttaatctcccttcttggttttcgacagaaaatattaaggaagagcaataggaaatagaactactgtattataacactgtgaacaagaacatcagcagcagcagaattgtcagccttcctgcgtcctgtgtgggaatgtgtccatgccttataggtactagtgcttcgtccattgtccagggagtgtcctgagctttcactggtctttgaagtgcagatctgctataagctgtctggagctgcaaggttgcaggaatccacaggagcgtgagctgctgtgaacccctagcccacccatccccaagcaggatcttcttctcaccttttcttcctcctctagcacttctctttccaagtgtcttaagcagatgcaatgtcttaaagcagatgcaaatgcatttgccatcttctccattaggaaaatgatggttatgtgatatgttatatttaggaagtagtgtgtaaggtatcctgaaaaggtttgctctcaagctagaaggacatttcaccctgtgggtcactgtcaccttgtcagcgtgccggctctcagtggtccccaggaggatggggatagctgagatcgtggagaatgggaaataccattgcatctctttgatttaacactcatggctcacctttagtagagttgttaataagttagaaacttgtgtccctaaggcccaagagaaaagatgagcttcttgggaggattctgggtttgttttcccctcagaattaaaaaatagtttttaattcagctactttttcccctcagttaaaaggtagcaggagctattggctgaaatttgttacagtgaatgaatgtggagaataaataagaacaaaccctgtaggattcttgttgacgtaactttccatcccacctctccgcctctccatcaccagccttcatcaggttggtttagtttacctggccgtacacacgagctgctcatcaacagttcgtatcttctcactgagcccgggccagatgctctcagaaggccttctcatgctcctcttcgttaggcttagtgaaaaccttaagacctgcagtttgtgcccctcagttcagtcagacctcagctttaaatgtcgatttactctgtcttgttccctgaaagtgtttcttgtgactaagcatttggtgtcattatcccatgccatttatctgctgtatagttactatattatttttgctgattcctactgctggcagatgccatcccaggcccacaaaatcccagtgttgcagtcaccacagctgtcagaaacaagtttgcaatccatacttcttagttcaatttttttttttaatggacattcaaatctgtaaatactacactgctcttaagacctgatttgaaatttcacaggaaggcctaatcctatagtcacaaggtaaggacagttgagtagtgtaagaaccccaccctgcttgcagagaaccttggttttcatagaaaggaaaggctaaaggttttctagcattgttgcccttctttgtctgtcagtcagttcaccctctgtgattctccatggacccgcattgcagaaaatcagtcccatatattagtgagccatgtactgcccaatccgggggctcctggggtgtggtgtgtccaccagtgactctccggacactagcttcagtaaggatacttcttatttcggttgagaatgcagaggcttttattcgtggactcacatcactgcataggcacaaagaatgtgattgccatttgctgcgtgagaaaaagctgggctccctatttcttttttgggttggactctgccgtgcagccataggacaccaagcctcacgcactctccccttgggacagtagtgtttgggtgaatgttactgcatcccgttttttttcttttctttttttttttttttttttttttgagacgaaatcttgctcttgtcccccagactggagtgcaatggcacgatctcggctcactgcaacctccacctcccaggttcaagggattcgtctgcctcggcctcccaagtagctgggactacaagcgcgcaccaccactcccagctaatttttgtatttttagtagaggcggggtttcaccatgttggccaggctggtctcaaactcctgacctcaggtgatccacccgccttggcctcccaacatgctgggattacaggcg

SEQ ID NO: 102679 - DNA, 1026 bp, Homo sapiens
gtttctccctcttgtcctgcacaagaggactaactgaactctaacgtcagaacggctgacgagcagttgattgtccttgcttgtgttgttgacaggggtgggtggggtgggagcaggggtatggatattgcataagttattgaaatgctgacccccgttcaggaaaccatgcagccccttcccttcccttcccttcccttcctttcccttccctagccagggctcaggtacctcactctcctgccttgtgcgtagctcctggggccccggtcagtccccagcagccttggcacacagtgtctggagcctctgctcctgctgcaaaagcagaaaccatgtgaaccttctggccagtactggaaaggggaatgctatttatttttatattgtgtatattttgtcgtggtctgctgattccctgtttcactgagagcgacacttacctcaatagttagttcaatattgtgtgttggataattttttaaaagaactttttaaaaagctttttgatccttggaggtctgtagatttatttccatatgaactggttattttgtataaagtacatgcttaaaatagcaaggctcctctgtgtgtgtggtgtgtctgtccatgtgtcatttccatatcagggcaaacccagacttccatcaggacgaaggcgtgaactaggccacaaggccaccagctgaaatgccacccctcgtccattctcatgcatccagaatccacggaggcggggcacgggtcctgtgcatgagacagaggaatatggttccagagaacttcaaaacagtcatgtactgactggcagttctaaaccatgtcagggataaaacgctcctcacagccgatccttgcgaagctggcccggccgtcagcatctcactggtaaaggcgtccgctttcagaaggttactacacctgaggtgcacgacttctctccttgcaggctttagggtgcctgggatgggaaaggagtataacagtggggcagcggggcagctccagcctggagcccgctgt

SEQ ID NO: 102680 - DNA, 1074 bp, Homo sapiens
aggaggcggaggttgcagtgagccaagatcacgccactgcactccagcctgggctactggaataggggtatttaacagatgccagagaaattagggacaccctaatcccagggccactccatagcatagctaacagatgtgataatgtttccacccacggagagcacttggctggagggtgagcctccctaccctgaggctgtaccaagctgctgcagttccagccccggaagttccctttcgcaggcctatgctaatcaaagcctatgacttgacaagattcctggcagcagtaaatgcattagtaacaggcaacaaaggcgaaaccattagccaggcaaggtatgaaaggagtcatagcaccatgaaaaccccaaacctggcaccagggccgataactgccccccaaggcaacccacaagcctaagtgttagtcacgctacagatatttgttgagtgattactgtatgccatttgcagttctaagcagcagggacacagctggggaacaaagcaaggccttgccctccacagaattgaattcctactggttccggcactgatgggaatagacttcttttttttttctttttttttttgagacggagtctcactctgtcgtccaggctggagtgcagtggtgcgatcttggctcactgtgtaacctccgcctcctgggttcaagctattctcctgcctcagcctcctgagtagctgggactacaggctcacaccaccacgaatggctaatttttgtatttttagtagagatggggtttcaccatgttggccaagatggtctccatctcctcacctcctgatctgcccgcctcagcctcccaaagtgctgggattacaggcttgagccaccatgcccggcctcctctaccttcttttctgaaggaatttagagggtgtagggggtattggggtagaaaagatcatctaagtgctgggatgcagaacaatgagaaaacacatctggaactctttggaaacaaagtgggaaaggactagaaaagcagccagctggaagacagaggctccctgtcaccgccttgggatgcagcatct

SEQ ID NO: 102681 - DNA, 1037 bp, Homo sapiens
gccagcagccaaacttctcttccctcccttctctccttacctacccccagcttctaacactctcagctgggggaataatgtatcttcctcctgctgatccatgtttcaaatgtaataactgcctctggtgtgtttaatcacctgccaagccctgttaaatcttgacagaaaccattcgcatctcttccctcctgtgtgcagactgtcatttctcctcagtggccgtgccgttttacattcccaccagcggtgcctctgttcttttacctgggataaatggaggtatccttgcttgtatagtctgttgagtttttggatacttgcttcatagttcctagtgacacctctcattgtgttctatacttccaggctgcagtgcagaaggcaattcctatgtacaaaattgccaccaaaaacgatgttgatgtccaaattgaccaggagtcctacctgcctgaagacatgtaaggagtattcctgctgctaacagctaccttctctccctgggagagtggcctttataccaggccttttttaaatggtattttcaccatttaaacgcactcttagacacaaggctagagctgtggtgtattctacttgcagccgttcctgttgttctcgcagtgctctcttgctctcccttgttggctggctaaatatactctaaaagtctagtttggccaggtgcggtggctcacgcctgtaatcccaacactttgggaggctgaggcaggtggatcacaaggtcaagagatcgagaccatccttaccaacatggcctagggagctagactccctatcataccagtccaccctctgctcatagtccagtcctgtctctactaaaaatacaaaaattagctgagcgtggtggcgcacgcctgtagtcccagctacccaggaggctgaggcaggagaattgcttgaatccaggaggtggaggttgtagcgagccaagaacacgccactcactggactccagtatggcgacagagcaagactgcatctcagaaaaaaaaaagtctggtttatgg

SEQ ID NO: 102682 - DNA, 1476 bp, Homo sapiens
ttaatagcttgcttttcaaagttacatcgcgcgcatctttccatgtcagtcacttgtgtcggtttctgaactgatggttacctgagctattctctgctaggccgtggactccctgggagcagagacggtgttacatgcttccttgtacccagcacagcccctgctttatctcagatctcagggaatgtgtgttgaatgaaaatccagcaataaaatgtgaggcagctgggcatgagccaggatcagcctcacagtgggttatgagccgactgcccagatgtgtagataacttttatcttttctaatctttgtaggacctactaaatgaagcaaaacagagactcagcaaggtggtaaaagatacaaccaggtaccaagtgctgctggatggactggttctccaggtaccctcatagaccagatctactgttgatagccacagttctgagaaaatttagaatgcctattagagaccagctctattttttcctgctttctcatttctctagtttttttcctttcaccctttttttttcttttagcttttttactttcactcttgaccatatctaaaatgtgtgctgcataggaaaatagtaaatctgtctgcttggataagacttccaggcctactactcaattatgtagtcttacatgacttaagggtcaaatttgcttgcaatggctagctttaaattcccttaatttgattttgccactaaaatacttgctttagatttaggattcagaccaaacactgtatatgttttaattgtttactgctgagctgtgaatccttattttacttatgttaattacaataatatttgtcctcagcttggttgatgtaatataagatgtctgcatgaattttgtttctatcaccaaaggtttgggttcatttatctggtttgggatagatagatctttccatggtcttatgtgatatatgccatctgttagtggaacttaccaggggaaatttttccaacctaaatgaaagaactgtagaagcatcttattttactgttgctttattttattttatttttatttttggagacagagtctcactctgtcagccaggcaggagtgcattgacatcatctctgtttacttcaacctccgtctcctgggttcaagccattctcttgcctcagcctcctgagtaatctgggattataggcacataccatcattccaggctaattttttgtatttttagtagagatggggttttgccttgttgcctaggctggtctcgaacttctgagctcaggcaatccgcccgccttggccttccaaagtgttaggattacagacctgagccactgtgcccgacctgtttctttattttatagtttgcattttctactgactgtatctactatttcttccagggtttgtaccagttgctggagccccgaatgattgttcgttgcaggaaacaagatttccctctggtaaaggtaaaga

SEQ ID NO: 102683 - DNA, 1073 bp, Homo sapiens
agtagagacagggtttcaccgtgttagccaggatgatctcgatctcctgacctcgtgatccacccgcctcggcctcccaaagtattgggattataggcgtgagccaccgcacccggccaggatcttctaaactttcaagttctgtgtcatatttattggcccaccagtaagctaatggattaagtttcgaacgtgtggtaatttttttcatgagcagaatattctacccaattatatcctttagtaacttgtcggttactgttacccttgacgaaatttttagtttcctagtacgtcatttataatgaaaattgctgatctttccttttgaataaattagaatccttgaaaatgaatcacaataaattttctgttttatatatgaaattagtgttcataagcaagtaacgcaggtcaccagctgtttaaaactgttaatcaaaacttgatgtaatgaattaatattgactaatttccctctaggcagaagaagagttcaacatagagaaaggtcggcttgtgcaaacccaaagactaaagattatggaatattatgagaagaaagagaaacagattgagcagcagaagaaaatgtaagtagatcctggttgcagtattaagctaagaagttttctgaagtcatgagcaggcgctttggagtcaggcatatataaattcaggtcttaactcgaccacctactactaatctgacaaattgtttaacttctctttcttcatttgtgaaaattaaagcctgacaggattattcaaagattaaactgcaggctgggcaaggtggctcacgcttgtaatcctggtgctttggggaggccaagggaggaggattgcttgagcccaggagttcgaattctttctctacagttttaagttgttactaatgctatttttcaataccgttttgcagtcagatgtccaatttgatgaatcaagcgagactcaaagtcctcagagcaagagatgaccttatcacagtgagtaattagcccctattagttataaaattattacatgtttattcatttccctgttgtaaattactagttaacattaat

SEQ ID NO: 102684 - DNA, 1014 bp, Homo sapiens
gtcaagcgatacacccgccttggtctcccaaagtctccggattgcaggcgtgagccaccacgcccggccaacaatcatgtacccctaagcccataaccctgtgtaattatgcgaaaaattccaataaaggcacattctccaatatacctaaccagtactcctcaaaacagcccgactaatttcagatagaggaactccttatcttttcttcctcctacccaagatcccagtttaggaaaaaaataccggtcaggtcacgagtcagcgacgtagaaggacccgaggacgcgcccacaggccgggacagggcgggacttcctgggcgtcgctctcttcccattggctgagaagggtcatgaggatgaactgtgcagtcacctggcaggaaccggaacccgcggttataaagtaaaggaacccgagatctgcgcaggggttccctttgccgatttctctcacctcacctttcaaacctaaactcgagcctactgttcaccggcctagcattgctctcgccatggctctcagcgatgctgacgtgcaaaagcaggtgaggggcttggttgggtcttacgaagccgcggcggcagtcccggggagtgggctggagcccgcctagggaaggccgcgggccttgagccgcccagatgccgcaggaaggtcccttgctccaagtcaccagatccaagaggtcggcctgaggacggagatttgccccgcagctcatgtgacttttgctcgggtcttgggcactgcccgcttgcctgcgcgctgccttcttgaacgccctggctctttgcctcccacctcagcattccctgttttccaagggtattcactgtgcctagtcggacagagatctgtgcaaggattgaaaacagccttgtggccaggggcagtggctcacgcctgtaatcccagtattttgggaggccgaggcggccggatcacctgaggtcaggagtccgagactagcctggccaaaatggtgaaaccccggtctctactaaaaat

SEQ ID NO: 102685 - DNA, 1055 bp, Homo sapiens
aatacataaaccagtaagtcatctagtattatcaagtattatgtactgcatgtaattgtatgtgcagtacttttttttttttttctttgagagggagtcttgctctgtcgccaggctggagtgcagtggcttgaacccaggaggcagaggttgtggtgagctgagattgcgccactgcactcctgcctgagcgacaagagcaagactctacctcaaaagagttgcacaagacattttggtgtgaaacaactgttaaagtggcatgtaataaactttaaactgaaaaaattacttttttgttcttaggttttacacatccataagtagacctttttggagcctcaccagccaattcaatggcgtcctcttctactgtgcctctgggatttcactatgaaacaaagtatgttgttctcagctacttgggactcctctctcaagagaagctgcaagagcaacatctttcctcaccccaaggtattatctttggcttatggtggttatagtaaattgtaataaggactttatatataaaagtatatgtatctaatttatatgtgtggttatcaaatagtactaataagcctgtaagaataacctgttagggctgggcgcggtggctcacacctgttatgccagcactttgggaggctgatgtgagcagatcacgaagtcaggagttcgagactagcctggccaacatggtgaaaccctgcctctactaataatacaaaaattatttgggcatggtggcatgcgcctgtagtccagctactcaggaggctgaggcaggagaatcgcttgaacccgggaggcagaggttgcagtgagctgagatcgcaccactgcgctccagcttgggcaatagagtgagactccatctcaaaaaaaaaaaaatatacacaaaaaagaataacccgttatgccattctttccatttccagaagcaaaaaacaaaagtattttttttcattttattctttttttttttttttttttttttttttttttttgggacagagtctcactctctctctaaggctggagtgcagtgg

SEQ ID NO: 102686 - DNA, 1036 bp, Homo sapiens
ctaggacttgggaatctataatttaatgtgttttataggtaatttaaatgtgtttccagtttggggaaccatagatttcgaaagtattttgctctgggagctctagtccattcaacttggctaaacttgttaatcttctattcactttgatagctctgaatgaattttagggctggaatataatgattactgactcacttgacttcatttgaaacaagtgggtgggacttagtgtgctaaagtctgtttatctttgaaatatttgtatcttggtttatagtccagaatttatgcagcattggccccactgcgtagctctgtgctttagaaaaactaggtggagaggattaattaaatgcaaatcactgaatctctctgtgtcactggtcagctaaataaatagcctttgtgtcctaacagcagcagacattttctggtttaggttttccacatggtttattatgaagtatgacaacttgtcatgtgtaatcagcatcacattagtctcaagagaataagctctcctttaatcagctgcttttctttaatctggtggggtgaggcatatggtaaccatgacatttttgtcatttgctttgtgggatggtggtggtattgatggtggtgtgattggatgtgtgtgggtgtatgtatgttttgggtatgtagattttccaaaaaggggcagatgacagatggcagataaagcattcatgtattccttgtcactgtgcgtcaaaaattatagtcgtatgtcctgggagtcaataataattctatttaccagaatatgtagtttctaatgttatttctctgttatttattagaacttgggctagtcattaaattctctgaagtctcatattctttatgtaatgaggatagacttgacagcctttacagactataaacctgtaaagttctatgattcagtcactgattaaactctcataagtatgcaagtaatagtggaggtcttattctttccattcctagttctcagtatctccatcgtgactcatcgccataaataaat

SEQ ID NO: 102687 - DNA, 1034 bp, Homo sapiens
atgttttgaagtccagaacatcccgggcctttaagttgatacacaggttagcaccactggttcataagccactccttacctgcttctacccgaggcaaaatataaacagttttttgtttgtttgtttaatagtgtaagttttcttattgaggaaatgcctaatggattcttctttatagccctatactactccatcattgttaagaaggagttttcaatatattttgggctggagtgcctttagaatgtcaagaagtaaagatattatgtgttcattgcatgcttcctttcagattttgatagagattcccccagggctgctttctcttcgtttctttagaagccaaggaatattagtttgaaatataaactcattgttttttgtttgtcctcctgcagaagtattttgtcgtccctcagttatttccttggcagtctactaacaagcaaatggaattggtttcatttccttttgcattccttttgcaggcatatggacctcttgatgttttaaacaaaagagattgcatgcagatggctacctgaatacttagtttttttcaatatgcatttttttttaagggaagacagggactctagttagtttctgttgtaatttttgacgacttttaagtattgagccacatggttattaggtatagattgtaatggcatcttttatgtttgacttttgatgagttttacaagatagctcttagtttttaaaagttcttattttcaaataataaaagcacatggtacaaaatgcaaaaaagtacagaaagatatgctttgaaaaataaaagttttctctcatccttgttgccagtcacctagttcccttccttttaggcaaccactattaccaatttcttgcgtatttttctggagaccctgtaggattatatagacatatatatatgtgtatatgtttttattacacaaatggtactgtatgtattcttctataacttgccttttttcacttaaagtaaattgtggtgattgggtagtaagcaatttaacaactatat

SEQ ID NO: 102688 - DNA, 1004 bp, Homo sapiens
cactctgcctttttacccggcgaatgatgaactgagaaaaggattagaaatcacaagatttgtttcttgccccagctctgccaaatactagccctgtgttttggaaggattcatttaacttctctgaacctcagtttcaactacaaaaagggaagaatagcttctctgtctcacaaaaataatgatgtgaaagtgttttgtgaaaatgtcacacttttacaaatgccaggttttcacatgcgtctctgaagagtgtggtttttttccctctccttaagtctgatcaccatttcctcttagtttcagttttgacttttatttgccctgcagcccggtgagggcacagactggttcatgtgctgtgattctccctgagtcatccttgctccctccctcctcattctcttttcatttcctgggcttgtgttgctacgttagaagtctgtctgtctcctggaaagggcagagcaagtccactgtggtaaggcttgtattttactttctccgtcgtcacatgataaatacttcttgtgaaagatttacttttagattccataaaagattactggagggaatgtcatctgtctattgtaatatttaagtattttgaataaaattaatctttgtcattttctcttgacatgaagcttctgattttagaataggtttttgtttgtttaatctaggatatttaaagactatctcttggaagcttttaggttaataatttgttagaatagttttcatattgtgggaggtgacacacagggatgatctgaaattaatgaagtgggttgcagctaaaatcaatttagtaagagtaagtactgttttgggaaaatctgcctgctgtatatgtgggtgtggatgtttactgtgttgtactctgaaatgtgttttttgtggatcttcctcatcaagttgggtggaaaattacttctctgtaatttcttcagcactctccattttcttattttaggttaataatgatctgagaggcgcat

SEQ ID NO: 102689 - DNA, 1034 bp, Homo sapiens
aagggtccaaagcagtgatctgtttccattttgcgacttcgaggcctcagaaatataaaactagctggttgatcccggctagttttatatttttgagccctcaaagttacaaaatgtcagtggagcctttgtgtgttttgtgtcagtggagccaaagagatggatactcccaacaatacaaatattttatatgaagaatgatttagattgtcagaatcgttctaagactacttgtagatgttattctaatgtaagttgtaactaacgtattatccaaaacagctctttttcttgacagatatatatataaagtctgagaagtaatgatagaggtttgttggcataaatcttaagggaaatgagtccttagaaaatttaccaacgtagatgggctttggaattttgccaaagcttcttcagatggaaaagttaagttcataggagctcagctcagcagcagctgtgtctcagaaggtaaaatattgcttgagggggcagaataatttgtaactgatgtgaccccctgcccccaccaaaaaaaaagtgaaacaaaaaaatacaatcaatatagacatcatgatgcagccaatttttgtaataggtctctgagcaattgtcaacctgatttttacttaggtctaccaccaaagtaaagttatgtttgtattttattttacatttattttgatacgttcctttacttagttttttacttagttcctaccaccaaagcaaagttatatttgtattttattttacatttattttgttatattccttttatctacttaggtttcttctctacttccctttttaattgaagagtttaatgcatgtatctgtgtgtttgcttgaaaaaaaacaccaagtataacatgttctatctatgaatacttctggccattaactcaaaaggtactatattacagacagaaaagcaccagaaagcaatcagggacttcatctaagaggtaggacagcatagttggtaaaaatacagaccctggaggcaaactgcctgggcttgaatccca

SEQ ID NO: 102690 - DNA, 1046 bp, Homo sapiens
tagatattttgatagtttgtgtggtccagactcagtgccgtctaggagttcaggaggaataagagaggaagattaagtacagtggaacttaagccagaccctgctggagccggatcagggtcttaaactggggtccatagatgtgcttcagggagtctaaaattccctctaaaatggtatgctgctttgtgtgaaagcacagttttaaggcagagaggtcttaatacctttcatcatatttgcaaaaccttttctgctcccctaaaatgttaataccagtatctatgtgaataaggagacagcgcttgggaatttagtatggcatttgtagggcacaatgagtaacctgccaggagaagcctcccctcccataggaaacacctagcacacaattacagagagatttgggtgaaatgatggccctagcgatagagaagaaagattgactttacctcctctaatgcccttcactgtgctgtagcctttcaaaaatttatgtttggtttcctaggaaaacattaatgtgctcaagaagggataatgtatcattctaaatattgtatgagtttgccggcttgctttttaactgagtcagaaaattataaatagacttcaaatgtagaactactttattttgtaacattcaaactgagcctttatgtaatggccggatggtaccttagattcatcttttctcctctaagtaattgatggtgtgtaagaggtgccatattgtgggacagggtcttgaattcatgtctcagcaagactgagggggaaacatgcaccttttatgagatagaggctgatagaggcaatgttttatatcaagaaaggtactgatattttacttctcgttcattggcctaatctttcctcctccagctccagctttgcctttcttcaccccctgtcctatgctttggcatacagaagagccagtagtctgcatatatgatgatacttttcagcaccatgtttttgtttatgcttttccttctgcctggaatatcttgctcatctttgatctgctggttttctctttc

SEQ ID NO: 102691 - DNA, 1134 bp, Homo sapiens
ggaagaggctgctgtggcttctgtggtcttgccagcgcgggagctgcaagaggcacttcctgaagccccagctcccttgcttccacatatcactgccacctccctgctggggacaagggaacctgacacagaagtgatcacagttgagaaatccagccctgctacatctctgtttgtagaacttgatgaagaagaggtgaaagcagcaacaactgaacctactgaagtggaggaggtggtccccgcactggaacccacagaaacgctgctgagtgagaaggagataaacgcaagggaagagagccttgtggaagagctgtcccctgccagcgagaagaagcccgtgccgccgtctgagggcaagtctagactgtcccccgccggtgagatgaagcccatgccgctgtctgagggcaagtctatactgctgtttggaggggctgctgctgttgccatcctggcagtggccatcggggtagccctggctctgagaaagaaataggaggcttttcagaagagaaagacagaaggatgtaaggttggagttgtattggctggaatttgaacctccagcagctgtctggacatttgtggaacactctgggataattggggacttctgctcaacatggcagtggcatgttaggcatgttagggcttgaggtggggcattcacattcatctgactgtaaatcccaagggcctccgctcatgctaaattgagaatcttaggggtaaagcaccccctccaggaccgggtttctcagccttggcactagtgctgttctgaccattctctgtgttggggctgtcctgtgtgtggtgggctccacccactagatgccagtggcaccccctcccagagatgacaaacgaaaatgtctctagacattgccaaatgtcccgtgtgaacatcccctattgagacccactgctttagcgagagagggtttacttaggaagaattgggatagaaattcccagctgagagaacttagctgtgggctcctcagctactgacttcttagctcttaatccccttagaatttcatctttctcgatgagcaggctctgcacccactctttttttgccccccgccctcatcctggagtgtgagggtgctcgcccgtact

SEQ ID NO: 102692 - DNA, 1018 bp, Homo sapiens
ttcaatgccagggtaataaaccaaaatagtcctaatcagtatatgctagttgagcatcggcataattttctttcctctggctgatcccagccctaaaggaagggtagacccgtgtctttccagccctaaaggaagggtagacccgtgtctttccagccctaaaggaagggcagacccgtgtctttccatgcccgagggccacgacgtcactatgcagggcacacgtggcttggtttaaaaaggtcatcttagatttatcttagtaaatgtaataaattattttttagatcttgaaatttataataaaaatactttacctaccctgatcaccaaaacctgatgttttaaatgtgctttctttttgaaatttatgttttcaaataaaatctccctaaagcaatatttaaaaattggtcaaaacaaggtctgggagtatgtttgtgtgtctttccagctttatcctgtagcgtgtctttgttctgtgttttagtgtcccatttagggagtgatgttttaagggtttttgtgtacttggattaagtaattagaggtgagtggggggaatgggattattgaggcaatgatttttttcttcatgggctctgatagttgcattgattgttctgtattctaattgctatatttgtgtttgcataggtgaagagcaaactggtgcgttatcttgatttttaaaaagtaataaatcctatgagttccagtattaacacttgccagttctggatcctcacacccattggctgagcgcattcaagcaccaatcgaagccaggttcatctctgagctgctgaaaggaggtgtgaggcttaggaaattggagcctgtgttgcccacgaaaggaaagaataaggaagaaatgtggtatggaagcggctacttgctgctttattttcccacctgttagacattcctccacagtgatttggccagttgtatttcacggtaatggaactagatagtgttttccattggctttctctggtagctcttggtcagctcc

SEQ ID NO: 102693 - DNA, 2515 bp, Homo sapiens
gataggccacaagttaaggggtggtatcttctcttcctggtcaggaggtaaacaaatggacaaggcatctattctggtggcccctggagaggggcagtagcccaagaaagagctgagttaaatgagcatgacctgagggcagggtgcagtttacaaattcacatttgtctcgtttaacaagacgggtttcctccaaggagacctagtacatagcaagtgccaaataaacattgagtggcaaaaaagagggaaagcaatgtaagtcatcctaagagagcacacagagcaggaggggtagaaaccagccccggggagggcaaggtccctgctggcgaggtcgctgacggggtgaacagggatggcaggacacgggaaagcgcaggccccaggaagggggacgccagggccccatggctgcaggcaaaccttgggcctggcttgggagtggaagttccggcagcatcttgctcggccctctttgcacatttgccccgtgtgattcctgcgggccagggtgggcgcggcactccctgcacccgacacaagcgttctctcggcaggcatgggcaagaaggacgaccccaagctgatgcaggagtggttcaagctagtgcaggagaagaacgccatggtgcgctacgagtcggagctgatgatcttgtgagtggccttgggtagggggcgtcagcgctatgcttgtcacagccggcatggaggtccttccagatttgggggtgaggggtggtccccagtcactgtggcttgtctccctcctgccctgcctcctcagtgcccgggagctggagctggaagaccggcagagtcgactgcagcaggagctccgggaacgcatggcagtggaaggtgagtggggtaaggcacccatggaggccagggtgggtgccacctccaggcccctcacctcatgccttcttctccttcaagatcaccttaagactgaggaggagctgtcagaagagaagcagattctcaatgagatgctggaggtggtggagcagagagactcactggtggcgctgctggaggagcagcggctccgggagagagaggaggacaaggacctggaggctgccatgctgtccaagggcttcagccttaactggtcctgagctcccacccaacgctccattttctgttggcatccgcctggccaggcagtggcatccaaaccacccggagccgcgatctgaggaggcctggcacctccttggagtttacgctcagatgcccgtgtgctgcttggaaagtggtcgagtcccgcgtgcagtggggagccccaggtgacagtggttatctgagacggctccacctcctgggaggaggcccacctggacctcccactcagaggagcagcacggcgtgtatggcatgacgcaggggaccaccccgcgcgctccctgaggatgtgctggctgtgccccttttttccactggcacatttggtaagagagggaagctgctccccgtcagaaccacagtgcgccgtgcgaggggcactgtcttcttcatgctccctggagcaccaccaaagaaacgtaaacaataccccacgaaagcagggtcaggggtcagggtgcgatcgagacccaggatgggggcgtccagtcatgcccaccccagcatcacaggagacatggaggtgcgggcaggctcctgaattattatgcaaattaggaggacgcaggaggggtctgccctccagccgaacaccacacactggaccctaagtggccaaatgcctgggccgcttgctggctgtggcctgaggcttgtgggttgctgcattttgcttgtagttcacaaccattttgacactggaaaatgctgactttgggggacaggatgaggccctacattctaagcccccagttggcagacaggcattgtccctgttccacatttatgtcgggacaggagatgaccttttcctccgtgtttttcctgtgtttgcacgttgaaatgaagctgacaacctggcaagacgctcagccgcttcaaaccctttttgtcaattaacttattttttaatacttgaaaagaagtaacttcgtttgtgtatctttactagaggaactgatcacctgcgcccgggtgcgggagccacagcggcatctggtgcgtcctacgcgacctggtccggggctgcccggtgctcctcacgtgcatctatttattagcctttctcttcgtatcactggcctggctggcatcagggagctgcccagaacccctgtgtgggtcctcctcacagctttctgtcccctcctccacccggtgcctgcctcaccctggcgctagaccatctggaccactcatgtgatgagggtgcatttccgttctgttttgggccaggccaacagcagagctgccactctcaccctcccagtgagaattccggctctgcagaactcgcccttgtctcagtttgggggccagggcatcaccttcctccgcacatatgttaaagaaggtttcaggatgggccctcatccac

SEQ ID NO: 102694 - DNA, 1067 bp, Homo sapiens
aaaattgtcctggctcagaatttgaaggagcgcaggtgtgagcgtcctggaggcccgtcaccggatggcgtgctgcccccacagactcagaggcccctccttgccctgcacttgtcaaggccagctttgcctcaggcacatacctgtggtgacatcttagaggattccacgtgggtctgggaggtgaccccaggttgtcacctgcaagcctggaagccatgttggccacttattgaatgcagtctgtctcagagccaggcagacctatccaggggctttgaggagggggcccaaggccccaaaggccccggtatgacaacccagatgccactgccctcctgataaggagtagaggcaggagggccctgtggcccgagtgctgccatcattgtgtagggaacacatcatccctcttggaggaatccacactgtggctctggccccccgccccctctgtgatgctgccagagctggatctgctctcgttcagttccgtgctgaaaaaaggacttaattcatttgtagactttgtttcccttgtttctgcttctccatttcttgtattattttcttttcctcctgttgttcctttctcactttttatgctttttgtcctctgcttgtttttattccaccttctccctgtccctctccacttccaaattcctgctcctctcctcctcttccttttttgtctttctccgtctcctcctcttccttgcttggtcccttttgaagttgagcccagtggcgggactccacgacgtagacctctctccttctgcccttgctgtgtccaggaaggtaacgtaacctcgccaaccccatccccactgcctcggagggggtgtagcaacactagtcaaacacagagccagaacccacctacctctctctctttctttctctctgaccctcaatagtcctgttacaaaatgtcatgagtctgtggcagtttctaaaggtacagtatccctttgactgtctatggggaggaccagggtgcagagtaaagccagagagcctccaggtctgggtccttcagggctgcagcattggctggccct

SEQ ID NO: 102695 - DNA, 1083 bp, Homo sapiens
attggagggaaaatcacccttttgagatctggagcctcatatgtaaaacctggttgcccttgcccctctgtgcctgcatccccaaaaggccaccccgaagccccatttctgtgccatagcacccgtctcatttctcccatgggcagagcaaagctccaagcagccctcggagcattgggaatgccacctcctgtccagaggggccgactcctacccctgccctgtgctctgtgtgtcacgctccaggctctttcagtggctctcagtgaactacctaaaggctctgaaagttccttttttcagccacagagtataaagaatgaagatttcccttcctcacatagctggactttgtgatttccaaagaaatcattaaaaagactcaaaacaacccttggaccagagaggaagggtccccaggtggccactccccttctttcttctgccctgggaccctgaacaggccggcccagcctgctttattgcactagaacagacagatgactggaaatctagaagaaaaccacatttcttctaaaactgattgaaaatacacacacataatttctagttttcggggacctcatctcttgatttatatgtctcaaaggaaatttaaagaacacaaaaggtttagaaatgtaacatgaaggactggaggtggcctcttgctgttgtgagatggaggtgcagggacgccagcccctgcccttctgagcagccgtcttcctgttctctctgcttctctgagtttcatgttgataggttcttggtttgcctgaccagtccaccatcagcttggttctgctttgcttaggaactttggaacctgcgaggtttcccaacgcgtgtgtgtgtgtgtgtgtgtgtgtgtgtgtgtgttttagagtgaggtttcccagcgcgcgtgtgtgtgtgtgtttgtgtgttttagattgtaattcttacatgcatttgtttggttttttgccttcacttttcctcccaacctggagctttatctctgcattaagtctgtgtagcaccaggtgtctcccagccccactatgtgtatgctagactgggcctgccggaccagcctca

SEQ ID NO: 102696 - DNA, 1051 bp, Homo sapiens
acaggttatagcagagagtggtggacatgaccaagccccggcatccagccagtacacacaagaactgtagttgctataagtgacaacatggttttttttatttggttggtttttggtttttttaacagcttacttggaaatctcaggatttctgcagtttaaatgatgtagacactagaagtttaaaatgaggcaagagcttttttttttttttttccacagttggatcacagcaaatctaacagcagttcctattcctcatgacaagcaagtctcaaacaagaggctcccaaacaaagtaaacaaaaacccagccatgctgtaataccgcagcaaaacgtgttacccacctacataaagggactcgctgacaggcgtgcgtgctgtcagtgagctgtagctctcccggacagaccctgaacggtggcaggtgagcactatgctgcaggccagaatttaaataaacaaatgaataaaatgtcctcttcactaacacatttacagggagttcagccacttacacacagagagaggcggaaacttgatcctgagggctccacaaaatcaagctcacctggcagcacaaattattgggttgatggtctccagtgggtgaaaagttggcatataaaacatttgggccgggcgcggtggctcacgcctgtaatcccaacactttgggaggccgaggtgggcggatcacctgaggccgggagtttgagaccagcctgaccaacatggagaaaccctgtctctactaaaaatacaaaaaattagcctggcatggtggtacatgcctgtaatcccagctactcgggaggctgaggcaggagaatcgcttgaacctgggaggtggaggttgcggtgagccgagatcacgccattgcagtccaacctgggcaacaagagcgaaactctgtctcaaaaacaaaaacatttgaaggtggtgtgtcttattttaataagggctcttgaaagagctacaagtatttgtacatcaggtatttgggagaccccttggaatgcctttggaagaaccttagggttccac

SEQ ID NO: 102697 - DNA, 1113 bp, Homo sapiens
gagccaggcgcatcccgctttgctgctgtcagttgtgacacctgtacttttcatctgaggatatgtgaagttctctgtggattaagaggttgtggactctttctccattgatgcaaaatggtaaaatgaacctgatcttgggtaaaccaagaattttctgtctttctctcatgtttctggtcaccgctgctctttcctcacttcgtaaaacgttctggtacttttcttagagtgtgtctggacgtgaatgtgtgttggcaggaagggggcgggaggggcatgtttggaagtgaaatgaagtcttgggaagagatttctgtccaggaggcctccacagtagcatcgtctccagccccaggctttaggtgtgacggtctgtgtcacacagtaggatgaagatgaaccttattctggcttttttaaataaaggaatagcaataagagaaggaccgtggagactgctgagggacgtggtggccgctgtgccatctttcctggcatgctgtcttccaaatacccaccctcggagtcacctctgctgtcacttctgtgcgtgcacattttcattcagcgccggtcacgggccacaccccctgccaggctctgagcatacaaaaggggcatttcctgccatcataaaacagcattaataagacgtttgttcctccctggccccaaatcttcacttgtaggcaagaccaacctccgtttccggcttgtggtggcaccatgagcacccgcatcactgggctggcctgtgagctggggagcgctctgcagccctgggccggcggtggccctaccttgggttttccctcttctcttctcatcctgattctccatcacacaggctaacatcagggctcgcaccccttgttggtgccagacaggcgtctgtcctgaatgccttctcactttctttctctttgggattttaaggatgaccttggctctcctcgttgggaacgcatattgctgtgtaactttgtatttgtcgtctgttttaaattcagtgcccgaccttccctccatacgccacgcggcggtgcaggcctggctggagacggtctccggaggtagtctggtgatgttcactctctccccactcaccgt

SEQ ID NO: 102698 - DNA, 1503 bp, Homo sapiens
tccatctaaaaaaaaaaaagaagaaaagggaaagctcaggtgtttcagggtcccagaatgtatgttgtagagaacagtcattagctcaggcccatggtaaccgcctctactgtgcactcgaccagtagaggcgatgatgacggcacttgattctcttgtgtgtaactcagccatcctccctagacccacgtcccaggaggcagggctggtaaagctatgactgggcagtgtttgacccagctgtgcttttactctgtgcctcctctttatattgtggcatttctctcttctcctttatgttctttttctttttatgccaaaattcttgctgttgccaaaacaaaaacaaaaaaacacacccacacccaattacaacctgcagttcaaagaaccactctaggtcggctttaaagtattgtctttctctggtaaccaaatctgtacctgctgcctaatttagtgtttgggggcattgtttacagtatttctgtttgtaatgtgcttttaatatagaaatcctcttttttgttcttaaatctatgaatgctgtgtttccaagcttatacttactactgcgtgttagtggtcctggcacagattttcttaccctggccttgtactgtccaccatgactttagaaaaagcttgaacaataggcagagaaaggaaatccccaaaagggattattttccccttggacatgagaagtttagttacaggtttcttgaattcgtttttgtccagaggaatcctctttttatctgatacggttgatgaccaaaaatgaagtagggaagccgaaggcatagccggaaaggaacagaagagctttttccccgagtgctcatcaccgggttcattaccggccagagatggacggggagaagcacgttagtttcctgtcatcttatggaaaagatgatctgaagttaaaaaatgaaggtcacaagtggcagttgcctgacccctgtccccagacattccttgcccgataaccatgaggttccatagttcggatcctgaatgggcctttaggaaatgcaggcctttcccacaccagctagaagggtagccaggcagtagaatttcattcaaccctagggttcccacctgacagagggaagttcggaagtcttactgcttcccacgtccccttcccttctaggcatttatggaaagctttttagtggagcaagagaattctacaatccagcttacctcccaccttaccccaagagccatagctgacggtgatgtgtgaatgtttatatataggtacacgtttgtatgtatatagatctaattgcacatatatgggtagatatttatttatatgttgcaccctaaattatagtaattataataattgtgaagctgtttctaaagctgcttgttcctggttctgagaaccacgggagcctcacactggggagccgtactccaggtcagggctttggggatgcacagcagcgtacgggcagcacgcctgtaaggaggtgagtg

SEQ ID NO: 102699 - DNA, 2699 bp, Homo sapiens
tatttgtctgtgaattttttccttccttatcctctttttaatgagggtggcttctccacctgtctttgtcgcggtgaacccagcagtctcttcagcatggttgccaccttgtcagcacgcctgcctgtcagtcccccttgagggcttctgttgcctgcagagggactggcaggaagaggtgcacctaggtggatctagactttgactccgggtgactcaggaggctgaggtgggaggattgcttgagcccaggaggtcggggctgcagtgagctatgatgatgccgctgcactccagcctgggtgccagcaaggccctgtctcttaaataaataaataaataaataaataaataaataaataaataaaatttaaaaccagcgtgtcagattgtcagtgcctctagggatttgaggatttgagtgcatcagtcagagtcactcttctttttctcatgaactttcctaggaggccaaaggacccctgcaggatggcgccaccacagatgcaaacggacgggccaacgccgtggccagctccactgagagaaccccaggtagcctcacttccttgtttggctgggtggcgcgtcactccctcggcctctgtgacaaggccaagggcatgagccagcacctccaaagcaacatttcttcattcgggcaacaagtggcccaaaaccctctggactcctttttcatgtgccagctgcttgcgttcggagtcccctttctctatggcctgtcggaggtgctggtgcaaatcagaggggagttccactggcaggctgtggcccagtgatggggccgtccggtgggcggcagagccgtgaagtgctgtccctcagccccgtcccgcaccatcacacctgagggcggcccaggtcctgtgtaggtagacaggagctcgcaggcgctcagacactgctcccatcacccgccctggtgaggccaaggccactcggccttcatgcagtttgcttccaagctcctctgacggcctggagctgtgttgattaagccccgtggtcttgttttgggttcaccttcacttaagattctgcgtcctgttccctgtcactgtgtgtggatgagctgtggctgctctcctgtctgccctgcaccgtgatgggacatgccctgtcctgaccccttggccactgggcttgtcatgaggtccaagccctcacctgtcccactttcatgaccacttccttgtgttgggaggtgaacagtaccatctctacctctacaaacacatttattcttgtcatagcatgacaggactcgcagggtttgtgggtaccaggcctgttgggaagaattatgtagattttccttaaaatggcctctctcagcaacttgtaaaacttgcctgtgagatgcgtccagagctccacaaactgctgggtgttctgaatgtcccacatacagctccaggtggttcacggcccagggtcactgtggcaagagggggccagcagggctgtgtttctgtctgtcacactttcctcttgttcaaaacacatgtatctcaagcagctatatacaaaactcataaaaattaaagatggtcagccagtgccaggaaatgtggaggaggagttggtcatagaatttccatggtgggacaagagaattacccatttggccttcaacgagaggttcccagagttgcatcctttcccttccctaacagctggttcatgtaggccttgtggtgctcattctgggagagggaagatgcgcccagaggctaggcggtgtgccctgggagccatgagaacccagccaagccaggtgaacgcagcttctgctactgcacgtgcccttattatcatctgagcaagttttttaagtaccctgcaggtgggaccaacattttatagccatgtttcaaccattaatgacttttaaaccttctacaatcttgaagatctttataatccatctttctcgtgaagtacccacaggcctttgcagctgacactctcagagcatgggcagaatcactggtagagaaaaataaccaaaggggtctagacagagactttggctttatgctatagaatgtacattcagttggagagagcaccaccttattagtctgggccctatttcatcagagatggattttgtgaggaacctgactactcagtagaacaactcaaaagaaactaaactttccatttcggtttggagtacagaacattttttaaaaagaattaaacacagtgaagtttaggttattcctgaatgacgccaggtttgctgactttcccatctggtcgaggttgccattcttgccatctaattgaaagtataatgggtttcaggtttttaggagttctaaagaattacgctttccatagagaataagaggaagaatgttctacatagtggggagagaggatgagggttggcagtgtggttaaagagcaaaaccaccaagaaagagtcagagccctgaggacgtctctgtccgcgtggttcttgattctgagccagaaggtgacttggtatagcacgggagttcaaaatgtggtgtcccaaaggaatcacagtgtggacctttacagttaatgacaggcactgtcccccagcttgggtggcaaaggccagtgagctcagggctgaggggcttaccctccggcagctcagagtccagaacatcttagtccggcagctcagaatcagggca

SEQ ID NO: 102700 - DNA, 1006 bp, Homo sapiens
tttgtctaagaagcactctctacaaatgaggaaaatgaaatgggattacttctgtttcaacagtttctatagtagggtttatcacttgagattcaaaagtcgtcagtcgctctttaagtgagagtaaaaaagagtcagaaaaaaatgactgcgtgggttaattccattaccagagtcatgggaaaagccaagttcagtggtgttcagatttttctgacgacaccccccacggggatgcacgttacattgagacccagacacagctgcaagttccaagaaataacgttttattctcatcatgccacagtacactctggattctattctattctattctatattctattctattctattctattctattctattctattctattctattctattctgttctgttctatgctgttcccttccatcctactcatagtccattgcagtattttttgtcttctaatgtcctttcctgctgatcctgaccctctgaggggactgggagggggtgagagatagggtgcgggagggggagcagcagagatgggcctgtcagagccaatgccaggcgatgccccacccctgcagcctccacgcctccaccctgcacttgtattcattcttggtttccccagcaatgctactcccagcgtttcatgtgaccacatctttgttcctcacacactgccactttgtttgctggccctgccacacaggcctcacatctttgctctgggcactgattgggtgatggctcaatggccttcacattcccaaaggaaaagacccccttcaggccaagggagaggagagctagaatcaaagtttacccggaggaactggcttctctggacaagaaagctgggcccagggaaggctgggtggcttgatggccttgtgaggctggaggagatggaaaggagtggctgagaccagggaggcacgttcaggatccgtgcctggctcatcgcctctgtccctgcctcttgctgtctgcaggtaaattctac

SEQ ID NO: 102701 - DNA, 2637 bp, Homo sapiens
cttccctaacctccctaacctccataacctccctaacctccataacctccctaacctccataacctccctaacctccataacctccctaacctccataacctccataacttccctaacctccataacctccctaacctccataacctccctaacctccataacctccataacctccataacctccctcacctccctaacctccctaacctccataacctccctaacctccataacctccataacctccctaacctccctaacctccataacctccctaacctccctaacctccataacctccctaacctccctaacctccctaacctccataacctccctaacctccctaacctccataacctccctaacctccctaacctccataacttccctaacctccctaacctccataacttccctaacctccttaacctccctaacctccataagctccctaacctccataacctccctaacctccataaccctgcatgtgtacttgccctctctgccccacctctacccagtcctacccagtcccccactcctccccttggctctgactgctctgccccccagggggctactgagtctccctcttgcttccttctgaggggcggtgcttacagccatcctctccagctccctctggggcctgtgttgctgagcccagggccaaggagctggctgagtgtctcaagcagagggtgttgaagtaccaggtaactgccagtctatgtcgccaccccacggagctatgaagtgcacgtggctgaggtagggagtgtgaccaatctggcttggagctggaggagcagagggctttctagcatcatgacttaatgctgtccttcccacctgtaaatagttcattctgaacctggtgggaaatgaagcagttattggttgccaaagctttcggtcactgcctcaatctctggggactgggttcctagctgcatgggcccacggctaagggagacccttgcccagttttgttacgtgtgctatgtgcagtctgcagaggatttgggctcaagtcttttctcctcatctttgcttgggattcagctggctctttggcaagcagagcctctctgagcactaagtggaaggaagagatgctgcattcctggcccttctgtagaaggagcgagcttcactctagatttgctgtctccgctgcctgctacttctaaggccaatggagtgatagggtggcgggagaatctttttgccctggagaaatcccagctcaggccgggggttgcttggcagagcacagagcatgtgagtcgacaagccatccccctgcccttcctgcaggctgccttacccattcagagggaggccgaggctgtgccgggcggcccacagctgcgggaccgcgttccagggtgtgctctgctgcaagcatgagggaaggacagttaaaagcaaaacggaagccttgcatgggccgcttatgcttctggagctactttttttttttttttttttttactatacatggtatttagataaaggtctagagtaaaaggctctacaaccatcttatgttcagaggtcagtgtgtgacttaatttaacatttcctttacttttgtttttctccatcttgtattttatagccagagcctgaacctcctcgtcgattttttgtcgaccagtgggagctttctcttagtctccgctcctctgcccgccccgcctctccctcctccgactccctccgacaggtagcatggcctaggactcactaaaactctgccctccgcagcctccactcacgtcactttcgcaagtgtcatgtaccccaggaggctgcagtgttcctcacttgggcccgtctcctgtagggagccagctgcatgtgttgctgtttgcctgtgtcggtctcgtgtgtgaggtctgtggcacactcctcagctaaagtggctgctggctttcatccaactgtatctgacacatccaggtctgttgatgtgaacccgctttgatcctatttcaactatatcaaataatgataaatgttttgcagccattggcttttttaacttcacatgtcttccaaaataatatgtgttaaaaagtaggaaccacaatgtaattaaatcacctcaatggaggggtgatgatgcggtattctggctgcctgttgtcatcatttgaggaatgtacgcggctgtcacctgaagtagcgctggtccagttgtagggagtttctagagagattggaaggtctctttgccactcctactggtatttcccatgcctgagttgacgccagacctcacgtcctatgtgcatggtagcatatgcacgcgtatggtgtgcggcgggatctgaagtagcactggttcagttgtagggagtttctagagagattggaaggtctctttgccgctcctactggtatttcccatgcctgggttgaggcctatgtgcatggtagcatatgcacacgtatggtgtgcggtgggatcgatcccgcaattgccacatttctgctattttttatgagtgatgagaaggaaaccatcgcttttcatgccagaaacaaatagaacttgagtcttcacctctcttgcagggatgcttgtcagtgttgccaacttgctgagaactgaatgtggc

SEQ ID NO: 102702 - DNA, 1283 bp, Homo sapiens
gctgtgtctccgtcagttctcacagtaaccctgtgaggcaggtgctgttactggctccgttttaccagggaggagactgaagtatagagtggagaggccatgtcacgtgtctgagccgcatagtaagcaatgcagccagactcgaatctggcttgtgggaccggggctacgctctggcctccctctgcccacagagacattatgctcacgggtgctagataggagcagccacgtcagaggccttggggctgtttttccacccgcacgtggctgtaaggtgaacccttagccagccagagagtaatgcgaggagccttccctggtcctgtgattgccgcttctggctcctcggatgagcaaggccatgtccctacctgcaggtctttaccctttcacatataccttcccgtccattcgccaaaaacacattcacttctccctttagtaaattatgctttggcccgatgctcctattcaggaaccacttcccactctggagtttcctctggactgctgtcttagtcatttattctagccaattcccacctccccacctttgctttctaaaatgtcttgttgtggaatgtgtcacccttttaacctgcctctccttctaaaccttccatttgatgcctctgatcttatgccactgtgtgaaagaaatatgcttgttccacctttgtactaaccatagttcttcattgatccgtgtagctggcctcgtcggaggccagtggggggtggaatggctgtgcagaaagtcggccttgtgtcatgggatttgatacagatgggattatggttacctggggatggggttagtaggggaaggcgatatgtgttgaactctgcatttctgcccctgaatttcccactgtcgtttagtaggtccaaatagagcgatatgcatggagcttaagtttctactttgttgccaacagacatacagggatcttgatgctgacaaccgtggcaagcagagcccccaccatgagagggtaaaagagcatgaacccgtggcatgggatgctgagagccaagcacacggggcacgctgtggtggtggggcagcgggaagggatatgggggacggccccctccccttgctttttgcacgctcttgtcacccagccaagagccagaattctttttgctagcagtgttgaccaatgcaaatagcattcactgtaaagcagtcacccatctggcattcagatgggatgctgatcctaaatgtgcgtattgtaaagggccttaatgacttcccatttctgcccactgtt

SEQ ID NO: 102703 - DNA, 1048 bp, Homo sapiens
cagccagcttccaacttttgaaaagcaaaagtgcgggttttggtaactgtagtagattgggaagaagagtcatttttgtttatgtggatgaacaaaagaaggttcaatgtccatacccaagtatgcatttcctccgtggcgtttcctactgagaccacatgcttgtcctggagctggtgaacctttagagccttctgaggctctgcgaaccatccacgagggagagtagttttggtcaggattttgcggcgccctcaagggctgtgcttgaacatcactggtttctattcccagacaccttggacctaaatgccgaggagaaagcagtcctgatagccagcaccagatcccctatctccttcctaagcaaacttggccagaccatctctcggaagcgttctcccaaggtatgtggaggagtctcttgatgggctgcaaagctaatggcaaggtatgtatggctagaataatgcagtttccctcctcccttggtacaggataaaaaggaaaaggacttggatggtgctgggaagaggagaaagaccagtcaatcagaggaggtgagattcacttggggaattgctagaatggtcatgtggaatagccccttttggttaaaattcttcatttccacattggtattgctaggtcttttcatattcatcctttatgagaatttctgttgggctttttcttttcttttttttattttcttttttttttttttttttttttttttttgagacaagagtctttctccattgcccaggctggagtatagtggcacgatctgggctcactgcaacctccacttcctggatttgggttcaagcaattctcctgcctcagcctcccaagtagctgggattgcaggcatgtgccaccacacccagctaatttttgtaatttttttttttttttttttgagacagagtctggctctcttacccaggctggagtgcagtagtgcaatctcggctcactgcaacctgcacctccagggttcaagcgattctcatgcctcagcctcccaagtagctgggattac

SEQ ID NO: 102704 - DNA, 1502 bp, Homo sapiens
ttaaaatgtgtttgtttttctcaaaccccaccttatttcataaaagatttaaaggtcatcatcctaacttctgtctgaactttacccagccttctatcccagactttcctttcagccattctgctcttaggtaggaatttgttacttgatatttgattttctttctgtttgactttgtaaatttctgccaggtgcgccatttatatgatactggcgaaacaaaagatattcacctggaaatggagagcctggtgaattcccgaaccacccccaaattgactcgcaatggtgagttctggtggtggctttttaaaatgcaggcagccccttcagagaagtctatactcattccctgagccacaaggtgcggtccgaggcagtggccgaagtactgtctgagacagtggctctcaacccagggtgattttgccctccaggggatacttggtagttgtctggggacatttttgatggtcatgattgggggtgggcaggagccagggatgctgctgaacatcccgcagtgcacgagacaggcctccaccacacggaattaccttggcctgaggtgttacgagagcacagagagaaaccaggtacagacgcggggcagaggggagagagggagagagtgtgagagctaaggtttcgggagaagactttgtggaaaaagtctttggctgggtcctgcaacatagccaggattcagtgacaggtgaggaccactccagattttgtatgtattgaaggccctgaatacttttttgaaagagaatgacatgagtacacctggtcagccacacgtgagaggggttggaggagggaagtaccagaggcagggagaccaggtagaaagacctcgccatagtcaggctgaaggtggtggaggcccagatctgggcctgatgctggggatgaagaagggaggaggcagtggaggagacctcagactttgggccaggtgcaactgggtcccaggccaagctttgctgctggtgaattgtgcggcctcgaagaggtgattgaatagctctgaacttcgatttccttgtctgtgaagtgggggcagcagtgtctacctcacattgtgatcatgagtgccgggcctgtggtggatggtcattgccattgttggttatgtgagagagaatggtaaggaggtgaagtcgatgggcaggggcaattgatcaccttgtggggcaagaggtaggtgtttgtagatggtgctacatcagcgtaggcaaggcagagggagggctgagagggttgagaggtttgagtcatttggacattgtgaatttgacgtgccattgggatgccagggtggatgtgaggaccagcaggcagttggaaacatttgcatttttctccactggagcgtcttctctttgaaagcagagagtgtatctttattcactgtttttattttagagcatggaatattgaagttgcctgttacatattggatggttggatatacacataggagacagatctgagta

SEQ ID NO: 102705 - DNA, 1095 bp, Homo sapiens
gtgccttcattctcttgttttctagaacttgatttcttttcattacatctattttttagattaattaaaaagtcagtagttcactctctgcttccaggcgtcaagttgtctatcctgttcttaagaatctaggagattcctccagcttccttgatgactgtcccaagaggcttaacccgataactaatccaagccctctttagaggttagcctcttttttttttgcttgtttcgtttttattcccgtaaaaacagttctgtttactgtcagtcatagtttttaggattgtttggggtgttgagtgaatacagagaaacaaaactccctgtatttccatgaactgatgatacaggacgtgagaatctgggcttagacacctttccctgcctggagcctcaggcccttgtctctgtaggcctgtgtgtaacctttcagcctgccctgatgcaccttcatctcagcaaacttacatgcacacgtttgtcttctggccccaggtattgacttggagaacatcgtttactacaaagatgacacacactatttcgttatgacagccaaaaagcagagtttgctggacaaaggagtgatactacatgtgagccacggatttccttcaaaactctttcttattgaagtggttaatatcaccaagagaaagaattgtctgatgggtttttcctgcaagggaatgaaaatgagcactgaatgcatcttctggtaacccctgatgttttccagtttagcgtgaacaactcttaactatggctaatttcaaatgtaaataaaaacggggggagaatagtgtaatgaaccctcacgtacctaccgtccagctttcacagttctcaacacgtggccagtgttctgtcagtaatatttctgtgcactccttcttcaccactggattcttgcaaagcaggtttcagacagcatttcatgcataaatactcagtttaattttaggtgatttggtttgtggttattgtgatttccatatctgactgatgattggttggttgaagagttatcttttgggagggggagcaacagagggaaaggagtttgaccaagaagcaataattggtgtttat

SEQ ID NO: 102706 - DNA, 2024 bp, Homo sapiens
agtcgctgccatgcctggtgcctgcaggtgctcatggacgtcgaataaatcaatcagtctcactatgaaaataagcaagattgtcagtcattctggcctcagtttccacagctatagaccaggaatgggagggggaatggtaggaggatctagttggattgcgatttcccttccttgccttataagaatgtgtgatgatcaaccagggaatgggctgaaagacgcctgtgggcggggaggtcatgcagcagctctgcatctgaccgtgggctgcaccctgtgggtgcacatctgcctcctagcaggattggagatgctgccaatatggcagccccaaattgggaagatggaaaggaacctcctgtaggccacagtcccatgttgtctccgagcttttgattgtttaaaacactgaacccgagacgtgggagtgtcctgtgtgttgctctagaacagctcttccactgggttatatttgcctttaagaaaggaagaagttacagagcgtggctttggaaggtctcctgctacagcaggctttgggaatctgaatgaagggggcgtaggtggcggggtgggagcctgagctgcgacacggatgggtacccccttctccatgtgttcccatcaacgtcatctctgtattctcccaggtatccgtcagctccaactaatacttttgaaagtagccttgatcctaggcattgaaatccacgtcaatgtggaattccaaggacttatacagcctcctgaggaccaagagaatgaacgtaagttatactggaggagtgaagaaggcgtgagagggtgttgatgggtgaggaagatgagattgagggagcaaaccaaaggctcctgagggctgcttccagagctagccaaagcctgtgcctttggggacttggcctggatgcagccttagatgtcgcaggcgcacatgtggtgggaagggccccgtgagccctctgcaaggcttctttccttctgtggtttgtccccactgctttttctttgttagatgagagtctcactctgtcgcctagcctggagtgcggtagctcaatcttggctcactgtgacctctgagcaattctcctgcgtaggtctccagagtagctgggattacaggcatgtgtcaccatgcctggctaatttttgtattttagtagagacagggtttcaccatgctggccagggtggtctcgaactcctggcctcaagtagtctgccagcctctgcctcgcatagtgctgggattagaggcacgagccaccgtgcacagcctctgtctccactgcttctacacatagtgtttttggcccagggttttgtgcagttcacatgactgggtatctagagatggtcctggctgtgaatgtggtctgggtggtgacccccatttatttggttttggttcacagggataggctggcgggcactggtgcaccccaagactcatcctgtgtcagagtatgaatttgaagtgatcatcggtggggatggtcggaggaacaccttggaaggtattggtctgtgctcctctgcctggctcatagcagagggaaagctgatgctatcctacctctggggcgagactgtgcgtgaccagcgtccacccttttgagagcctgaatgtgtgcttcctgccctgatggaatggcaggccccaccatcctctagccagctggcagtcaggctgctgcttttattttatttaattattttatttttgagacagggtctcgttcttttgcccaggctggagtgcagtatcatgatcacgctcactgcagcctcgatctccctggtctcaagcgagtctcccatctcagcctcctgagtagctgggactacaggcgcgtgccaccatacccagctaatttttgtattttttgtagagattgggttttcgccatgttgcatgggctggtctcaaactccttggctcaagcactctgctcgcctttcccaaggtgttgggattacaggcgtgaaccacctcacctggcccaggctgctgctta

SEQ ID NO: 102707 - DNA, 1082 bp, Homo sapiens
agggagctggccaaggaccctgctttctctctgggccagcgcccaaggtgccctattaatttagattttcatgtgcattagtggacgagggtgaaggagacgcaggccctcggctggcagtcgttttacaccaccaccggctaggctgaaatggggaaagaaatatggggattgggggcttccttatggagaaaggtaaaggctgaaatggtgtgtgagagaggacttgaggcttttttcctgggggtcagggagagttggagttgacagcactcagccctaataggtatagactgagtccagcctgaggtattagaccctatatttattggcttgatcttaattttacacctggtcatactgttgaaaaaaaaaaaaaaaaaggtcccccagtgcctgagtgcgaacttcatatttagtggcatttgatagtatatttattatttctagtaagtttgatgatctcagaggtgtgcagtgatgttcctggaagtgaatagtacagcggtccccaggaactgtggggagaaccctgctccgcctcagcctcttctcccatctgctgccgtggcctgctccaccctcagatagctgttggaggacccagcagcctgtgcttctcttaacatgtccagttgtaccctattttcagttaaaaatgcggtttctcccacctgctttcccctggagcggcacgtgaaagggtgtagtgcccttctcttgacacctgcctgtccccacagtcctatcgtcagtgggtgcgtgtgctcactgctgcctggcactgctgggttctcaggaggcctgcacaccgaaactttgcatggaatgttgcccttgtgccattagcaaagcggaggctgggtcggctctgctctccctgcctccgacttcattgttcgggacttaatgtaataatatgcttgaacaggcgggagatcacattagcttggctctgcagttgtaaacaatatttgctctgtgagcattctccttcaccccctgctctcctggaaccctgcgccctctcctactgccaccccctctctccttgcatattctaaccttggctaaacagcttc

SEQ ID NO: 102708 - DNA, 1073 bp, Homo sapiens
gatgcaaaaccagaatgagcagaattcactgttcagttcatgttggtaattctatctcagtggtgcgcacagaacacggtgaaggtgagagaaagctggactgcaaattggagtttggagcaaggcagacaccgaggtcttttcctctttccttaagggatttccttgtcccagttacctcttcatgaagggaaaacattgtctcattggcagtttggccatgctggggggcccactgtcctctgggtgtgtagaggctgtcttggcgggcacagtcttgctggcagggcccaggctgcaagatgaacgcgtgcagcggctgtaggctggcctgggagaacgaagtggggagagggggccaatccagccatgtggccttgcagcccggctctgatcttagatggacagcagatatttgatgtgctgcgtttctcttctgaagtctcactcctcctttctttgtgatttaaacaatttcttccctcccactttttgtccaaattcctcagtccatactctttgaaatctgaagtatggagaggcgatagcagggccctccccacccatcttccggcttggaaggggtatcatgtggttcagctgggccctttgctggagagcagagggaggggtgttccccagggaagagggcaggaaagaccagaggttaaaaataggcagcttgtaggaacttgcccaccactccctcaggtcctcctgtgatgtgcacacttggagtagaatggctttggagcagagaaggggaaaatagatcagccctcacttaaacatcacattagccattggcttttcctctatcttccacataagaggaactttccccaatcacctggtggttttggatttgtgtcccctggtactttggggatgtgtccacatgtgtgtgcagtgcctctgtctgcatgtgtgtggcgctaagatgactcagtgtcgcatgtgctgagacattccggggctgcaggtgggtgttctcacagaggctcgcctgagggatcttttgcacatacaaagatgtgtcccatttataagttagttccctacactaaatgaaa

SEQ ID NO: 102709 - DNA, 1025 bp, Homo sapiens
gcacagcatctctggccctacccaggcctgctggacccagattcgcattgtgccaggctccccagttgctttgtgtgcacacagggagtatctgcccctgcatcgtgtgttgtccttatcatgttttattaggggtcactacctggctgtttcgtcctctgctttacagatccgtcttttgtttggacccctttgtagcacctgacgcatccttggcattgagcaggcactacggtatttgagattgactgacagtccccatttatttgaaaacttgtcggatcatatagggaattgcaggagagatgtggcatgcacgcttataaaagtttatgacagagggcaagaaaaagtaagagagggcatagttaatacatttgaatccaccaggtaaggcaccgtttggggaggggcacaggtgttggaagcagcccacccttagcaaagcagttctccctgctttgtcgctcactgtgtgtgaacttcctgaaccttaatttagttgcctgatttctacagtgaggtaacattatactcataatgttgctcggaagataaaatgagataatgcaggtgaatcatgtcacagtgtttggccatgagtggtagctgggtgtatgtacttagccagagctaagtgttcagttacgttagttggattcttgttaatctttgagaaatcttgttatatttatttatttattttcgagataatttctcactctgtcacccaggcttgagtgcagtggcacgatcttggctcactacaaccgccacctcctgggctcaagccatcctcccacctcagcctcctgagtagctgagactacaggcacatgccaccatgtatggctaatttttgtatttttagcagagatggggtttcaccatgttgggcaggttggtctcgaacttcagacctcaagtgatccatccgccttggcctcccaaagggctgggattacaggcacgacccaccgtgctggccaattttttttttttttgaggcagcatctcactttgtc

SEQ ID NO: 102710 - DNA, 1066 bp, Homo sapiens
tgctgcagtcccgttcccatccttgcagttcattccaccctgggtgttcatgcatcacatagcagcccttgagttctaagtgatttggctcttgtggggcacttttaagaaattttacgcccggcacagtcgctcacgcctgtaatcccagcactttgggaggccgaggcgggcggatcacttgaggccaggagttcgagaccagcctggccaacatggggaaaccctgtctctactgaaaatacaaaaattaaccgggtgtggtggcgggcgcctgtaatcccagctactcagggggccaaggcaggagaatcccttgagcctgggaggcagaagttacagtgagccaagatcgcgccactgcactcaagcttggatgcctgagcgagaccctgtctcaaaaaaaaaaaaagaaagaaattttaaacactggttttctagaggcaagtagttaatagataattctctagttattccataatggaagactgtttgatttcatggcaaccctgagcagtcattttattcctcagcagtcatggatttggtgtttgacctgaacaaggtcatgtttgttctctgtgccctgagtttttcctttggcgaagcagggataatgaatactagatccgaacagcagcagagtgtgtcatgcgtcacacaggggctcttatctctcagaccctttatgatacttgccagtgtgtgaagtactttccattgctgaatttcaccgacaatagtaaggtagatggagcttgggtcatagtttgcattttgtaagcatgaagatggacgtggagaggttgtgtggctcactgaatgacggaccccgggtccagatccctgtctcctgatcctaatccagtgctcccggctgtaccaccctgcctattcacagtgggcacactgcagggttgcgggtgacctttccttacagtctgggcattcatttctggctgtggaggaacttgttgagtaagggcagtgccactttgagacagtggaggaagtggcccagccaggaagccaggccacatcaccagatgcccagttggagagagca

SEQ ID NO: 102711 - DNA, 1056 bp, Homo sapiens
tagctgggactacaggcatgcaccaccacacctggctaattttgtatttttagtagagacggggtttctccatgtttgtcaggctgatctcgaactcctgacctcaggaggcccgcctcggcctcccaaagtgcggggattatagccgtgagccaccatgcccggccggtagtgcatggatttctgtaggtaccatagcagtgtcagtgcaaagcttggcatacctgggaggttgctgcctctgtgtttctgggctcttctccccatcccctttctgcaactgtctgtttggaagttgtgatcttgacatgtggcccttctagccccatggcttagcactgtggggccccggaggagtgggctctggatgagcatgcagcacccttgaacatgttggattcagccagtgtggatgtcggcatgagacgctgacacaggcatgtgtgtgccctctgcagctcccttctgcagctgcctctcctataagaccaggaatttcagaggacactctctcaggagcccctcttcctggacattttcttcccttgtgctcataaacattcataaacaccgtttaatggtcgaagattttggtttatgactaaaaatctgaaattcctaaaatctctgtggattcaagtccttaggaaagctggagcaaacatgcagctgagtggggagtcggagatctctcagatcttttcccggtccaatcctcagcagttctgtgatgctggctggggcttctcaggcatgagatctatttccacctcccactctaggctggaagttgtccaggaaattgtcactgacatattgaggtgcatagcaaatgcagctggtagaagaaatgtggggttcatcttagaaaatgctgctccaaggatcggcttgagaaagtgttaatttgtaagaattaaatgaggatattatgggatgttggaaggtgggaataagtgtgtgagtgagtgtaggcatctcttggcttttcagtggttctcagccagggctctctctggatgcagtctgcttcccctgccacacacagcttcctcc

SEQ ID NO: 102712 - DNA, 1056 bp, Homo sapiens
ctccccgatgtgccttgctgtccctactcccgtacgtccgttcacctgttgcgtgtgcctggtccaccctcccaggtagcttagcctggttcgctccagatttcagtttctacttggagtcccaccctctttgggaaacccgttgtcaccaccttacctgggaattatttccccttccagtggaccatgtgacttgaacatttcatctggtgtttaatcagatactgcctcaggatatatattttcttgtctcaagatttttttgttttttgtttgagatgggatggtctggttccttttttctacaaaccaaattataaaatttgagggccaagattttaacagtaccttgcttattaaatagccactggtttgtaactgatttgctgaactgagcatgtgttcttagtgtttgccttgaggagcgcactgggcttgggaacaatgaaagatgtaggaaaaagcaaggtccttgcatccagattcgttaagaggccttgcctggccttgtgtggagtggcctgcctgccttgccatcctcctcttcctctctcactgagccctgagcccactggccggtggtcctggaaggccatgtgcattgtcgcctgtgccggtgcacgtgtgctgcttctgcccctggagcaagctcctcctttccctgggcatcctccctcccgggtcgggctggatacctcttcattaccacctgaagggccagggggccccttccgatgttctgtcttaggttctgctgttctttttctcacagtgtgtaagtatggatgtatctatatattgacgtttttacaccgatggctgtgtccaccactgtccttccatctctggggcacaggagacataggagttctgttcacattctgtgcttagccccaacacagtgtctggtgcctgtgtatgctagatgaatgctagatgtatgctagatgaatgctagatgaatgctagatgaatgcagtcaatgctagatgaatgatgaggttttttgtttgtttgttttgacatggagtcttgcactgtcgcccaggctggagt

SEQ ID NO: 102713 - DNA, 1032 bp, Homo sapiens
caggctggtctcaaactcccgacctcaggtgatcctcctgcctcggcctcccaaagtgctgggattacaggtgtgagccactgtgcctggccaggtgtatatttttatttctcttgagtatatacctaagagtgaaattgctgggtcatatggtaactctatgtttaactttttgaggagctgtcaaacttttccaaagttgcagcactattttactttcccaccagcaacataggagggttccagtttccccacatccttgtcaacacttgttattgtctgtctttttttttttttattatagtcttcctagtgggtatgaagtgatacctcatttgagggtttgatttgcatttccctaatggttgccgatgttgagcatcctttcatgtgcttattggcgtctttcttttcttgtgcttctgggtcttccttagataaatatctgtccaaatcctttggctgtttaaaaagttgggttacctttttattattgagttgtaagagttctttatgtcttctggatacaagttccctatccgttacctgatttgcagatatttttccctattctgtaggtgtgttttcactttctggatggtgtcttttatgctttgaagcatacacgtttttaattttggtgatgtcaaatttactctcgattcttgagtaaacctggatttgcacatcagttttctgtgctttcagatgtttctattgtagttaagtctctgccgggcgtggtggctcacgccgtaatcccagcactttgggaggcggaggtgggcggatcacaaggtcagatcgagatcatcctggctaacacggtgaaaccccgtctctactaaaaatacaaaaaattagccgggcatggtggcgggcgcctgtagtcccagcttcttgggaggctgaggcaggagaatggcgtgaacctgggaggcggagcttgcagtgagccgagatcacgccactgcactccagcctgggcgacagagcaagactccatctaaaaaaaaaaaaaaagaagaagtc

SEQ ID NO: 102714 - DNA, 1047 bp, Homo sapiens
ctcagaggcacaggtgctcctggctctgcctgcagcctcccaggcctgtcatctgggcctgttggtgcggcacatggatctaggtgctgtcacgggctgtcagttgtggcacgtcctggcagggcctggctggcccagcctctgctcatgcagtattcatctgcacgccaggagccgtgtggaccatctctgctgcgctgccccactcagctccgtgtgcagttgctttcctttaatgcttgtctccaggccatttttgtaagcttttatgaggtccaaatgcttaggcacaggcaggcaagaaaatccagcagggcatatagatcattcccagtagtaaaagaggtcaaggggtttggctaaaaacctcacttatattgggatatgggaaaagtgggagagaactgatttctcaggagtccgcttcataatatgtgtcatggcatgatcgccttcaatcctcatgacaatcttacagagttacccgtatgaggcccacttgaaagatgaggcgcagtgaggttagatgacttgcctgagatctctcacccggtaaatggtggagctaaatcagagtaagacactcaaactgtgttgtggttaagagtttggactctggaacccgactgtgctgtactataccggttactagagtgtgtgaccgggagtgtgttccttatcctcccgagactcagtttcctcatctgtgcaatgaagggcgtaacagtcctactcaccttgtatggtcacaagcatttagaatcctcccagcacgtggtaagcacccagtgagcaccccacgcatcagctggtactgtcactgactggtgctcatgaaacttggaatggaattctgaggcttggggcttcctgtcatccagagacagtcttcaggggagcatgctgggtccagactatccagtgagtcagcacaggtttctttgcggtgtttggatgggtgagaatgaacagtgccctccaagggggagttctttcctatcttgctggtcccctcctcatcccgcttgctcccgctctctaactgcc

SEQ ID NO: 102715 - DNA, 1021 bp, Homo sapiens
tttccctgtgaaaaaggaaaaaggaaatattttaactagtgacatgggcttgggtcagtttctttccaaaacagataggctttctcaaaaccacccttgcatgggtaggaaaaacaaataaactttctgcttttggtattctaagtacctttagacagtggggcctgtggacaattatataagaaagtcataacagtgatcgcttcgccttaccgtggccagactgcgcacacatcatttctagtcttcaggtagagtcctttcaccccattttacagcagggaagctgttccagtgaggtaaagggccataaacccaataatttgcatagctaatgactccaaatcccgtgagataaatgttcagggagcaaaaggaagaggaatggggcagaaaaagacagtatgaggcagggaagaaattcacaggtggtagcttgaattggcggcctccgggtttagtgagcaccgtgctaggccctagtgaggggtggggatacaaacaagcccctgggcctcaaccaccctcagggagccagggagcaggggggattcctacttcaggaatcctttacacactgacttttttcagcacatttattgagcatctgttgtatgtaagtgccacgtggtaagacagcctgtgtctgcaagaggttgatatttctaaggggttggatgcattgtcagccatgcaagtgcagtaacctggatttaactggccaggaagccctggacgtagagtgctaagcaaatttatgccaactagtaaaatattcttgatttggttttatttcttgcacataagattgagaatttctagaatttgcctaccccctgtgtctgctgtttgtggaatgtttgtgttttgcaaacaggatcattttgcaactccttcctgaggaccagccctgcactttggctgcaggaaaggctgggaccatttcccttgcctgcaggctgcccttgggcccgtcaccactttggagctggtgctctcaatgtgcttgtccttgcccagc

SEQ ID NO: 102716 - DNA, 1001 bp, Homo sapiens
ggctgggccaaggtaggagtattgcttgaggccaggagtttgagaccagcctgcgcaacatagtgagaccctgtctctacaaaaattttaaaaattagccgggcatggtggtgtacacctatagtcgcagctgctcagaaggctgaggtgggaggatcacttgaggccaggagtttgaggctgcagtgagctataatcacaccactgcattccagtctgggtgacagagtgagaccctgtctcttaaaagaaaaagggaggacagaaatcagattaaagaagagagaagaagtgagactgttggcttataccttgatgaaaggtggaagcggaagggcaagagcttctgctaagtagtgaggaccttggcaaggacaacagtatctttttcgtgttctgttaggccgtgtctctctagcgcccagctcagagtgcatgtgtgttatgtgtgagggaatctagtgaggagtcttcctgcattaggcacgtctgcaggtgtctgttgaattgtatatctgttgaaggattcagtctggttaactctggcaggagattcggtctggttaactctggcaggagagggatggacagcacagccttgtggttaactagtggcttttattgacttttcctgtgtaaaggcgaaataaaccttagtgggtcccaggcttctcttctctcctgcccatgcttctttttttttcttttttttttttgagacagagtcttactctgtggccccggctggagtggccccagctggagtggcatgatctcggctcactgcagccttgacctcctgggccaggccatcccccaacctcagcctcctgagtagctgggactacaggcccacaccaccacacccgactaatttttaaattttgtggagagacaagctctctctgtgttgcccagtctggtcttgaactgctgggctcaggtgatccctgcaaagtgctgggattacaggcaccccactgcacccagccctctgtctc

SEQ ID NO: 102717 - DNA, 1032 bp, Homo sapiens
cctttgctagaagcattcatctagccaggtggggggtcattactttagaaaaaataatcagagctgagaaaacgtctgcatttgcagagaatgaagtatttaataagaccagatgggccgggcgcagtggctcatgcctgtaataccaacactttgggaggttgaggtgggcagattgcttgagcccagtagtttgagagcagactgggcaacatagctaaaccccatctctacaaaaagtacaaaaattagctgggcgtggtggtgtgtacctgtggtcccagctactctggaggctgaggtgggaggattgcctgcgctcaggaggccgaggttgcagtgagctgagatcacaccactgcactccagcactccagcctgggtgacagagcaagactctgtctcaaaaaaaaaaaaaaaaaaaaaaagactagatggggagatgagggacagagagaatcaaagagaatcaaagtggtttgtggacagaggaaatgagtgatactctgacccagaggccatctttagtgtccaggccattttgcttgagctgctggtgaaactgtgaaactggaggcatggcacttgggctaaagtctgtgcggtgaataaggccctcagtttctgctttaggtggcagagctgaaaatctgattcctttttggtctttagcttccggtgtacttcaatgcagtacattgtgggcgtggtggggatgtggttcagaaatttacctaaactctgtggacttccccctctctccagccacgcactctgtcatctttggttccagtctttagaattcagctcggatcccctgggtgatgggtggtgtcagacactcaggtgcttggattgccccggtggagagaacagcatcctgcccccatgggcttcagttgtacgtgacttgctgttttcttggaggtgggctttagtcatctctagctataaagacacaaaaaaactgggaagaatgaccaggaaactgtcaccccaagccttgcagttgattgcatttttttttttttt

SEQ ID NO: 102718 - DNA, 1056 bp, Homo sapiens
ctgacgtgtaaactgcttccccagcctccaggcgagcccagcttttgcctcagataggccccttccttttccttctcggggaatcgacctcgggaaggggtgtgggcaaagagatgaggactctccctcttcgcccaggccaactcgggatatcccggagcctctggggaggcggtcactccgacgtctgaggacctgggccttggacccggactcgttatgaagagcgattcttcgacctctgcagcccccctcagggggctcgggggacccctgcgcagcagcgagccggtgcgcgcggtcccggcccgggcgccggccgtggaccttctggaggaggcggccgacctcctggtggtgcacctggacttccgggcggcgctggagacctgcgagcgggcctggcagagtctggccaaccacgccgtggcagaggaacccgcgggcacgtacgtgctgggctcggaaatgaaccgatttccgggcgctcttgtggtggggctcaaggtctcaggagttctgtccttcccagattgcccacaaggagctttacacctcgctttcatcagtggtttgtctccgagagggtggtcgctcatcgtgtgcccattctacagagaagggaagtcgtgtaacaaaaacttagtggggatcccacagccaattatttgctccttgttccaaggtacaatgacatgatgggaaggctgaatgtgtattaagtgctaagttctgtcagtaagcaggtggtaaaagtcctctcccaggtacctccgccctccccgccccgcccaaggttgtttattcctgaccttggctgatgatggggaatgggggtcatggcaggagcagcgttctggtccaattagaggactggattaaagaattaattcagggccgggagctggggcttacgcctgtaatcccagcactttgggaggccgaggcaggaggattgcttgagcccaggagttcgagaccagcctgggtaacataatgagccctcttctctaccaaaaagaagaaaaagaaaagaatccggagaaaaaaaccttg

SEQ ID NO: 102719 - DNA, 1019 bp, Homo sapiens
cacacctgcatggaaacagaaaccccgccacggagccccctcccatctccacagggcctctagagcgccatgtgcaaggacttcatgggcggggtggggtggggtcaggagcctgctgtgggctggccaggccctggccctccctgtcgcaccctgcgctgcctccatgcacctctcagggctgtcatggcttttcctgtggcttctgacaggtagagtcagcgatgacggcttcatagccattaagctcacagcactggggagaccccagtttctggtaagtgctagaaccttccacctgcagagtctggtgctgtgcgagatctcagggcagctgtgggcatccaccaaaaacacaggtgcccatgccttagaggcctgagctggccacaggggctgtgtgggggactggggtgggcaggggcgtgtgcagatggcattcaggcctgcgtttgcagctgcagttctcagaggtgctggccaagtggaggtgcttctttcaccaaatggctgtggagcaagggcaggcgggcctggctgccatggacaccaagctggaggtggcggtgctgcaggtggggcagccttccccttccccactcctgtggcttgtgagggggtgggcaccgtggggtcacacggggcatggtgggcagtggtcggaggtggttttgggaactcacccagggcatgtggctcactctgcagctgctggggttggcctggtggggaggaggaggtcagagggactctgaacagagaggggagatgctggcaggagggctggagacccagccctgcagggcgtgggcgtgcatcagcagcggggtgggaatagacctgtctatgcagtagaaacaaaccagacatggatcctgttcttactaacgatgtaataaagccagaaacagcaccagaggccaatgggtggggggaaggataaaatatgagtgaatggggctgatccaggccttctcacttctcaaggaaagtgtcgcaaagttgggcatcgcatccag

SEQ ID NO: 102720 - DNA, 1027 bp, Homo sapiens
acactgttttagccgcatcagcctaggggtactagagatgacggttatctccaggtgaccctgggaagagtttgcaaggttccgctttttggcgccagggtatctggtggtgttgatttctcaggtgagactgtacagaggtcgggggctgcacccctggcctcaacaggaggcgggggaaggcgggggacggtgtcagatgagaagcaccgagccacagttgagcttaggtgaggcctcggcgggtgcgaggtgagggcagggatccacgaactcagagtcagatgctgttggcccgaatcccatggggagcgccaaggtcagcctaggacccgtggtggcgggagtgcggaggatggtggaggaagaaggagctgaactggacagatggagggctctgggagggcattgctgtgtgtgcacacaaggatgtcttaaggtcaagttttggtcatagagagccccggccaaggagacaggagggcgagaagggacatcccaggtagaggaactggcaaggtgagggacggcgatgtggaggctttggggagtgcccacatctaaggggcatcccaaaagaggagccagtgctggtggtgctgcaataggaggaggaggcagcagggcagaaatgccaggggagggagtggccagccacaggtccctgcccagggcaaggacgggcatgctaggtggcagctggggccagtcgtgcagaagccatgcccaccttgtggccgggatggagtggggactaggaaggcaccaggtcaggtttctgtaggcacagccctaagcatggctgggatggggagggggctaggaaggcaccaggtcaggtttctgtaggcacagccctaaggtttcttgtctagattcaagacaagttgttgcacagagaagccagcagagctgggtgtggggtttggtgcccagtctgctgcggggaatgccaggtgctgttccgtgactgtgggaggaaactgttggctccgctgtcccttgggtgccttcttgaggcaagtgc

SEQ ID NO: 102721 - DNA, 1067 bp, Homo sapiens
cactgagccacgcacgcccctggcatcatgctcgccttgcggtgcagctggtgtggcgcagactctgagagtgagcaccaggactcttcctgtctggcctccaatctaccctcttgccatgctccaccaccccttaggtcttgccactgggagtggggagggactggggagagaaaatactgaggtaggggtgacaggagagaaggttcttcactggcctcccctggcctaaacccctgacctacttcattcttggaccccagctgatgggatggggcttggagagggcccagatgactggcctctcagctcagcctcctgcccactgtctctataggtgcctggtgctatgactcccaggacctcaagtatggtgaggacagagtgtcatgtgaggctgtgtcagatcagtctgtgtcctgggaccaccagagcatgtgccagtggtgcaagagtggccaagagacagtctgcaccctgcactctgtggcctttgcaggtttctgtctgtagtcgtctgccccagtagactgactgggcatcaggtgcaagtgcgtgactgtccccctgtgtgtgagtctgggcctgctgtgattgccggtcccgagtcagtcaaggctggtgtgcccgttactgtggccagcccaagtgtgtgcaggtgatagaggtcccagtgtgggtgtgcaactgtgtgccggagacccttccaccttcatctcaccatggggcagccaactgggagactagatggataggtcagatgcagggtacaagagaaggggggtgctgtgacctgttcaggtgtgggggaagcagggagctaggtttcctgaggctgggctatcctctgggtgtatgggggccactctctgctgcacccccaggctgcctccctgaccccccccccaccccaaaggccccagtccttgttccagcagtccccacccactggaagaagctggccccctgcctgtgggggcccaggccagtccctcatcaacattgactttcacagggtccggcggaactctaccctagggcccttcatcttccgaggctatgactca

SEQ ID NO: 102722 - DNA, 3308 bp, Homo sapiens
ttcaggggggccttcaggcaggaggagtgtctcctggttttgcctagctcccctgcatcccctgtgccaggcccgtacctgcctctgacacccctctgtctcttcctgcagacgatgatgcttttgagcctgtggaggtcagcctgccagcccctggggatggtgggagtgaaggtgcattactccggcgcctggagcagcctctgcccactgcgggggcctctctggcagacctggaagactctgccgacagcagcagcgccctgctcgtgccccctgaccctgcccagagcgggagcaccccagctgcagaggcactgccagggggtggccgccacagccgcagctccctcaatactgtggtgtagacggcctggcctgtaccccaacggtctgggagcacctgtctgttgtagaaaacaccggtccctggggagacttgaaaggcccctgtcccagcctggacgccacgcactgccgcacgtcactggcgggctcgcgtgtgtacatagagaccacagcccgccttctgccaaaagaagtgatggcctgcaccgagcttccttgagggcttcagaaacatgcatagctttggatcactgtcttctcctttataaatggcagaagagtgacaaaattcattcagaccgcacatgttagaggcagggaatgaagaaggtactgtgggccatggccacacctgatgcgtttttggtgggcttacttggtgcagtgtgctgtccagagagacctgctgacccagtctgggacaggcacagtgggagctgccacagtgccccttgctggccgccctcaggagggggcctctggaccgtcagtgtggcgtaggcagtgggtctgcttcagggaggcagcctcttgactttgtcacaacggttgcactgaagatggcccccacaagcccagttgtgaatatcaaggtgaccctgcccctggctgggagctcccctggggctctggaacctgaagccctgagaaggagagcttggaaggaggttgagctcttcactgtgtctttccatctgggctctgcagcccagctctgtggcaggaggcctgaccccaccccatcagtccctctcccagcattgctgtgcatggctccctcaggaagaagctctggagtggggccgaggccccagatgctctgctggggtctggggactgagctgcctcctgtctctccactctggagccctgggctcttgcctcctgttgaattgcccctgggcctgcccccggccccatttgtgccataaagggttgcttcattgcaggaggggtggctgaaaccaccatcctgggctgcatctatctccttaaagtccactccttacatcaccgccactactgcagctcagtgcccagcggccgcatgcacacctcccggcccctcctcagcagcgcaggggctgggggcccttcctggcacccttttgcctgacggaccctgttgcctgctcctgggcagtggttttgttgcctgacacagggcctttaacatttctgaggtttggagattaagcgggttctgtgcgatttttagcacatccatatcttttctacgttgaatgtctggatctttcctttgtatgtttgtgtctctgtgtgtgtatgtggccaagcgtctgcaggtgagggtggcacatggaacttcacgggtcactgggggcccactcttccagggtcatcgatgcatcctgggctgtgctgaggcagtgctgtctcgctcagtctttccagaccagcggggcagcacctgggaggcctgtctgaagcatgcagttctgtggtgctgctcggggatggactccatgcacagtccacttcttgacacattctcacactgtggctggagacccattttttccatcccatgtggaatgagaatcttgagttgcccacagacagacttgacctttgtgccagaactgtccagagctgtgagttttgttactgaattgcctgtccctgagcttggcctgctggagcatgatgctggaggctgtgtgcgggcaggcttgtgctccccttggagaagggctgctacttaacaaggaagtcctggccacaggagtcccctactggctgcagaggacgaagcaggaagcatgccgtggatcccacatgcactggggcagggcagccaggttccagagcagcaggcatgtgcattatgggtgccaggtggccagtgagggcccgaggaccacgcagcagagtcccccacgggcctgagcctgagagctcagaggattcctgccaggcctcagaactgtgtgtgcgggacagggtggctggcacgagatgtgtgggactgggacgcttcctttggggaccagaggaacattaggggccggtcagacacgtagggggcagtgaggaaacggggtaaagtggaccatgcaggctgcagagggtgggccttgggctggccggggttgctgggtggccccttccccatgggcctccacaagcactcaggccactggcacgttgggccaggcagaaggtccacatggcagggctgcctggaacaccgctgccactgtggctccaggaggcccttgggagcatgaggagagctggactcgctcatctgttcttgcaccaccatccagaatgccccctttgcaaggcctgctgcagtccccagtctgaccagcaagtcccggggtcacccttgctgaaccttgtgctccaggggtcctcctcctctaggaccagcttgccacggtttctcagagcccaggtgccctctgacctgccatgcggaggtgggatttgatactgtacattgtcttgatgcctgtttttttatgttttcattaagggtttttagtttttggttgggttgacactaacttttcttaagatgctgtgagaatcatttcatccaaatgccaaataaacttgtgttccggaagaggcatggttagtccttggtgtggcccccacggctgccacaggctaaggtggaagaggctgggtacccacctttcagcagaatgcacctagggtttgcagcccttgcaggcgtccatcaaaccccctgaggaccaggcagagctgagcctggagcccctaggtggagtgtgcagggagagcagcagccctgagctgcctacagctatcctgcagcacccagccctgcttggggcatcggctgctgccttggcaggtgttgctgacgtgcacaggatccacataaaggcaaggctgcttgacaccatctgggagctagcatgggacggggtggtagggcagggcttggaacctggccgtca

SEQ ID NO: 102723 - DNA, 1790 bp, Homo sapiens
gtgtgcagccctggcccctggaaaaggatgtgcacctctgcaggagggccgctccccagccacacctggggtacacagcacatgagcgcagcctcctaggagtgctagtcctaggacaggaaatcctagtttgctccggtgatggtcagaggggtgttggcacacagcagcctggggccatggtgagatgctcctcctgacctgggattcgctcttctgcttctgtgctgtcaccatgttcttgattttgagcggccttatttcacatgtatcctaaagatggttgggtgcagggagacactgtgtgccttgtccacacagcccgcctgggcaggaggacgacagcatccccagcgtagcacgagggtggcccccttctcagagcggccatttcctcccctccccctcagatggcaacagtctgtttgactccatggccagcgggatgcgcctggtcgtcagctgcatctcctccttcctcatcctgtcactgctgctcttcatggtccaccggctgcgccagcggcgccgggagcgcatcgagtccctgattggagcaaactgtaagtgccctctgagggccacaaccctggtccccatccccaccccaggtcaccccatgtctccatgagctccccagccctggacagagaggggcagaggcaggtttgaaggccacatgttgtggggtctgtgtcctcacctgtgggccaggaaagttcttgccaagaccctccttattcccattgagccacagggtgggcagaactcggaggcctctgagggtcagaggcccggatcacccttccagctggaggggtgtggtcagccagaggctgggtctgacagaagtgtcagcccagagggacaggttggtgtggtgagggtgagacatgccacggagcacaccaggggtctcatggggatgccgaatgtggccgaggggtaggcagcggggcacaggtgtgtgcactcagggacggcaggcccagcctgggggtggggggctcaggagccaggcagcctgcccccagtgacttgtctctgttcccgttgcacacttttgatggcccagtgcaccacttcaacctcggccgcaggatccctggctttgattacggcccagacgggtttggcacgggcctcacgccgctgcatctttctgacgacggagagggtgggactttccatttccacgaccctccacctccctacacggcatacaagtacccggacatcggccagcccgacgaccctccgccgccctacgaggcctccatccacccggacagtgtgttctatgaccctgcaggtgcctgactccccagggagagggaacaccttgtcaagtaacctggcacgtggggctgagcccagcactcttgcccagctgcagaggcctagggacctcacttctttccggctttgtctttggtttttcctttaaggcttctcctggggctgcccgtgcagaaggggtcctgatctccctgcctggccgcccttggcaatctgtgcagagagctctgagaaggcctgggacccctccctcctacctccctgccttctgtgagcacctgtcatctgggcagccctcagggccctcagcccagctctagagacctggggagcccgacagtggtggttgtgaagacagggctggcccagacccaggagccaatcacttgtctgtagacacatgagctagagacaccatggtgacagcccctcctgtcgtgtcaggaggcagctctgtgaggtgggaggaaagcgtggcttctgtgctactg

SEQ ID NO: 102724 - DNA, 1050 bp, Homo sapiens
tttgccctggctagatgtactttgttctaacagtgttgtagtgactgctcttggacagccactccctgtgccatgggccagagatccatggcattccagccctgggaagactctcagcacaatctggccaagtcttcagttgccttgttcgttccccaggcccaggtggggaaggtcagctcatgtcaagtggtgcagcagtgatggcagtgtttgctcacagagctgtcttagaggctttgatgccattactctagtgggcatgtctcacatgccccctccagctgcctccttcccattctaaggtaacaggtagcattcacaggcccacacggggaggctaccttttttggcagtgtggcccacacggggaggctaccttttttggcattgtatacatctgtacacaatgtatgctcattgcaggtcaaacatgtgttgacatcaaggacaacgtggtggatgaagggttctacttcacccctaagggggacgacccatgcctgagctgcacctgccatggaggggagcctgagatgtgtgtggctgctctctgtgagaggccccagggctgccaacagtaccgcaaggaccccaaagagtgctgcaagttcatgtgtctggacccaggtgagactcttgataggacgtcccaagtcagcctccctatttggggctggaggctgggcgtccctttgcttcctcagtggtgaggactcaggagagtttatggagcatcgcgcagcagcaatggcagcgtttgtcacagagatgtctcagagactttgatgccactactctagtgggcgtgtctgacacgacccctccagctgcctccttcccattctggggtgacaggcagcattcacaaatgaacttgaactcaagtgtggctgtttgttcacaagtcaccactgacagcttcaaacttgtcttcaaacttacgcctccagggtttaagccgttctcctgcctcagcctcaccagtagctggaactacaggcgcatgccaccatgcctggctagtttttgtatttttagtagagacgg

SEQ ID NO: 102725 - DNA, 1050 bp, Homo sapiens
ttgcccattcccctgtttgcattttaatccagtgtgccacaatccattactttgttattatgctgttgctctaactttaaatgccacccactaaccgtgatccagcaccctcttctggtgctcaggctggcacttactgctacccagggtttgtggcctgtgtgcttgcaggctccaaggagtggctcccgctaggcccagcacctggggtgactcccaggaggttggggagtcccgagtgaacacctggccacagtgaccaccagtacttggcggtccaggccctgtggttgatgatcctgtctgacgccatggtccccttgaggactgcacagcttgtcctctgatgtgatgttgtccagccccaccttttgtctccccaacaggctcttcagaggtgttcctgcccccagaccccatctttgcctcggccatgtctgagaacgacaacgtgttctgtgcccagcttcagtgcttccatttccccaccctgcggcaccacgacctccacagctggcacgccgagagctgctacgagaagtcttcatttctgtgtaaaagaagtaagcccccttgagctggcgttcttggggaatgtctgggcccttgtgtcactttgttggaccctgagttcaaggtttcggaggcagaacctgatttgcagtgttgcggtggacgccccttaccagctcacaccttgttcttggggcccatttgcagctctgtgaccagggcagctggtcagcatcttagagcccacggaagcatcttagagcccagcttcttttcccacggaagagacaatcatccctgtcctccctgttgcagtgttgttaagagagtaaatgggaatgaggacccaaggacttggcatctctggagcatctaaggctgtttgtcacctccccaccccccatttctgccatccttctctctgcttctctgcttctctgtttaccttgccagtctatggtgtgtgtgtttttttttttttattaaagccagctaactctattgcttttgggggacaggggtctcaggagctcttgg

SEQ ID NO: 102726 - DNA, 1105 bp, Homo sapiens
gggacagataggcagctcaggccccaggacaagggctgcagaggaaggttgcacacgtgggtctccttcatactgggagagaaggccctcaaggaaggggtaggggcagcctgggctctggagagaactctttcatgggccatccccatggggctggaactgctgagggattttaatttatgcaggaccctttgctgtgctagcaatgacctgttagaaaatgcaatgaagagggcctccatttcacaatagtaacttaaaaaacaaaaactgccacggcataattttaataagaagcacacgggacccatttgatgcgagcggcagtgtttcatagggctctaaagaaagcctgcattgccggactctgtgctacaggccccccctccggccttgcagccctgagtggtctgaaccatgctggccagggagactgcgactgcacaggcaggactcacagcacacatctccttttgctttcagaagtgaccggggaggtgcgtcctcatcatgggaaggaggctgtggatccgcggcaggggcgggccagaggaggcgacccttcgcacttccacgcggtgaacgtggcgcagcccgttcgcttcagcagtaagttgcagacctgccctgactgggacactggggagtgcaagcctgacatgacccctgcctttccagcactactgtgctgcgtgaggggtttctcaaagcagcccttggaggccagtgaggggaatgaatgaggctgcatgatgacccacccgcagtcacccagcgctggagtggtggtatgtgactcaaggccctaggaagtcaaccggctctgaggccaggctgcttgttctcacaaagtgactgcttttcagggccagaaggcactggcccttggaaattccaaagttgtattattcccttttataaatgaggaaaccagctctgagtttagatacagcaataaaatgggaaggctcgactccttatttatttatttatttatttatttatttatttatttagagacggagtctcacgcttgtcacccaggctggagtgcagtggcataatctcagcttactgaaacctctgccttccaggttaagtgatt

SEQ ID NO: 102727 - DNA, 2348 bp, Homo sapiens
agtcttttctgcagctactcagctcggctgctgtagcttgaaagcagccatagacaatacatatttgtggctgtgttctgataaaacctgattttaaaaacagatgggggccaggcacagtggtacatgcctgtaatcctggcacttcgggaggccgaggcaggcagatcacttgaggccaggagttcaagaccagcctggccaacatggcaaaaccccgtctctactaaaaatataaaaattagctaggcatgatgacacatgcttgtaattccagctactcaggaggctgagggacaagaattgcttgaacacggaaggtgaaggttgcagtgagctgagactgcaccactggcactccagcctgggtgacagaatgagactctgtctcaaaaacaaacaaacaaacaaatgggaagagattgatccagcccatgggctatggtttgctggcctactgccacttcctcaatggcctctcaccctttggtcccacagagctgcggtgcaaccctgggcagtttgcgtgtcgcagcggcaccatccagtgcatccccctcccctggcagtgtgacggctgggcgacttgcgaggatgagagcgacgaagccaactgtccaggtgagtgtgttgagtaggcggggtacacaccaccttgtctctttgttgtagctgggtgactgtgcctcttgtgaggggtggaggtgtgtgctgtcttaacacattggaaagttagtttgagccgaccccttcctctctctctgtctttctgtctttttaaaaaataagtgcccaacctaggcagatcccagaacttgcaagatggcagggctgtggggaggcccgtgagatgcccaggaggctccacttaaggaggcgctgcactccctggacttggatgatcttgagtgtgaacccctcctgaggggtggcaccttggccacctctctgaccttatccccatcctggctctggatgtgggtgcctcttgatcctgaatgtgctcttttagactggccttggcacgccctcccctcctgctcactcattcacctggaactttgcactcacaggttctctcctggccattatgtagtctcctaaagatgtatggaaaggccacaaaaaggctaaatcggagaaccaggttcttcacctggtttctgcctcagcaccctcaaggaatacagggcaccccatgaataacaatgttcactggatccgttgttctcaactttggttgggtgggaggtgtagtgagtacttgtgcatgtgtgtgtgaatgtgtgagacatacatatacatgtatccatgaattcgtttttaagactaggtggtgctgataaagccactaaggggaaagtgtgtcttaccccagcttgagaatcacaggcttaaatgctttggccagacatgcagactccttcacaagctggtttaggtctgctttgccaacctgatttatcactacttccccttcagtggctcagctgggctgtttcttgtgcccaccccattaataatcttgtagatgtgtgcttcctttatgttttcctggaattctcttgttctgtttctgcatagacaagccttaccatccttcaaggtgtagctcagatgttaccccagtgggagaatgtctgtggtccctcattttatagattggcttcttccagtcccccattcgtccctctcttatagcatcagaaccattggtaattctcaccattcctggtgcccaggcttgatttttccatccagaccatgagttcccagggggcagagacctttctccttccttagtgggacttggcctaggacatgaaaggtgtgctgtaattcctataggcttagtactgaaggaaaaccaattcattccaaccagggtattaggtaggggattaggtgacatttgaacttgtggtagttctttgagggggggttccaaaataagaagcagagatggtctggtcagattgtatttgcctgtaaagaatgctgtttaggcagggtgcgaaggctcacacctgtaacccaacactttgggaggctgaggtgggtggatcgctttaggccaggagtttgagatcagcttggccaacatagtgaaaccccgtttctaataaaaatacaaaaattggccaggtgtggtgctgcacacctataatcccagctactcaggaggctgaggcacaagaattgcttgaacctgggaggaggagattgcagtgagtcaagattgtgccactgcactttatcctgggctgcagaacaagactctgtctcaaaggcaaaaaaaaaaaaaaaaaagccaggtgcagtggctcatgccttataatcccaacact

SEQ ID NO: 102728 - DNA, 1123 bp, Homo sapiens
ggaggatgagagccttgtggcagtcctgcaaaaatgccttgggaggatgggatccgggggtaggggacatggctgtggagccagctggcctgggccccaccctggtaggagcttgcttctgtgatgggagctgagctgagaggtgagagcaagtgtggcttctcattaatgtggatcctcactgaagctcaccagctgcccagcctggggtggagggttgaggggctcccagagggagggaccccagcaagccggtgctgagggagctgcctctctgatggacttgctggcacctggctttgagaactggactgccctgtgtgaggatgtggctggaccttccctgggttgtttgcacagtgcagggcttgtttctggtcaagagctggctgggtgcatgggctgcatgggctgcacatgcttgcctcttggccttctcctcctcctctgcctgcggtagctgttgcttcagtcactctgagctggtcattgttcttagtgcccttgtcccctacaggtccctccctgtaggctgacttctggctgacctctggcaaaatggcagacagctatcagtttggttagcttgtcttccttggttagtctgtcatccttcagctgttggctgctactgttggacaggacagtactgaggacagtattctggtgggtatggtggactaagggtcccccaggtagaccctgccctcttccttgcctgggaagtctcattttctgggaaaccttccttaggagttcatagttgtggagaggattgtttgtggctggccagggcactggatgaggggcaggagtcacagcagagggacccagaaggtcaacacagggatgatcagcaggagactgaccacaggaccgggccagatgctccattgaaactaggtctgctgatgcagaggtctctccggtgccactggctgcttcttagggcctccaggtagattagtttacctacagaactctgtctatggtcttagaataagaggacctggaagagttagaggcttgttgggggccatggcaggcctttgctgcagttcttggaggtttcttggccactcctgacagtgggagcagctcttcggatttccccatctaccct

SEQ ID NO: 102729 - DNA, 1136 bp, Homo sapiens
ccagcgtcggagtcgggctggggacagtggctctcaggggcacctggtttcacagacgtcctcccagcagtggcctagtgccagcctctcagtcctggaaactcctcgcctggacagcggtggttgtggctgtcattcagtgagacgttgcgctaaggaagtcctcaggtcccaccgggcctagaggaggcaccaggagtcagcctagcgttgtgtggccggcgcgagcgtcccgggagcagagacctcgccactgtgcggggcccttagccgtgctgcgtgtatgtgatgaatgagtccgtgctttggaactcccctcggagctagtgtgttcttaagtctgtggtggggaatcagaaccgtggcaaccaggagacccttttctacctatttcggtgtacctccccttgaactgcaccaaaaaatcaaactccctaaatgcagggccgatgtatccatcaggcacaggaatcctggtatcacttgcccacggtacttttagtagccttcgaatgttattttatttttttttaaagtcagcagaaaaaaaatgaacttttaggtcaaataaaatgttttcgtatgtatattaatacagtcatctttatactaatacagtgaaaaagcatgactcttaatatttcttaatggaggaaaggtcccatgaaggcagaagtgccagggccatcttctctgatgacctgggtgtgggagcacggggtgtgtggccctctcctgtgccctagccaggctcccagcccagatacaccgcacctcttggctctgcgcttgtgtcatctatgtggaatgtctgcctcctccctagtgcctgcctggtggccaaggccctgaccggtgctcaacctggacagattcagtgatgcttctctggtctccccatgtagagctagttgctcactgcttttggctgctctctgggcagcgggatgactagttgtggggtggccttggtaagaacagaagccaggaaaagggctacctgtggaggagggtatcatataggctcttggaggtcagaaccaatgggtttgtggattcttgtgattaacttctttagaaaacatatatgtacgtgtagagaggtagaaggtcaccgttttctgattcttgagtcc

SEQ ID NO: 102730 - DNA, 1070 bp, Homo sapiens
ctcagggatcccccgcatttgctgccatgctggcagtaccatcctcctcagctcagagtgactgtgtctctgcccaggctcttcctgggagccaagggaggccctgctgccggcagctctcagcccacctaaccctgcctctctcacccattcctccaccccagcctcacccccaaaggcctgagcccagccatgtcgccagccctacagcgccttgtgagcaggacggccagcaagtacacagaccgggccctgcgggccagctacacaccatccccagcacgctccacccacctcaagaccccggccagtgggctgcagacccccacaagcacaccggcgcctggctctgccacacgcacccctctcacacaggacccggcctccatcacggacaacctgctgcagctccctgcccggcgcaaagcttcggacttcttttagagccaggcctgggctgggctcatagacgcttcacagagcctgcagggcagctgtacacccagcagaggactccagccttctcggggcccaggcctgggccagaagctgttgaccataccaggagtcactggagaaaggggctgtgctggggccagactggcacaaggcactcgtgcccacaccacaccccagggccttgccaagctgtttgctgtttaattggccccttgaactgtcattaaagaacacctaggtacagtctggggggttgcctctccatcttgctccccacacgagccctagccttgccctggggcctgcatcacgtctcaggactgcggggcttgaagcgaggggccccccaggtgaggaagctgcaggtggggcggctgtgggagcaccgggtgactggcgttgctttctgcggcactcggaacctgtgttctgagttgagctcacatcctgcagtgctttctgcttctctggggggatatgaaggagaaacggagcccttggaagttgtacccttaggttcccctgcggttctgggcccaggtctgcagcctccactctgggcttgccggctgtgaggtgcgctggttataggactgtgtgggggctgcata

SEQ ID NO: 102731 - DNA, 1037 bp, Homo sapiens
tctttgtctgcaggtgtgaacgagtccccgatgatgacctggggggaggttgagaacacacccttgagagttgaagggtcggaaacgccctacgtggacaggacacccggcccagcttttaaggtgggttgtggtgatgggggaactgtgtgcgaccggggtggacacctctggagccctgagtgcctgtggctcaggactgagcactgggatcggcccccagctgctgacgggcagagtgctggcttttctgaatgccagggtgctgaaggcaggtgtgggtgggtggacctgtcacagagggatttgggggtgtaagggctgagacaccaaggcagggagtggcttgggccctctggatcctggaggccgggtgctgttcatgaatgaggcaggatggtcacagacacgtgaggagctctgcaggcctgagggccataggacgaggctgtgtgcttgtagagaaggcccctggttacagaacacgattgggacacgctggattacacggctcaagcctggtgttgtaggagtggtcagggtggagtgtgtgaggcccggcacagaccaggggaggctcttcgtgggctgggtcagatacaacaggcctccccataccactgcgggcctttccccagaatacttagtacaggtaacccatgtccagacaaaacatggggagaggttctggttaccttggttctaaattgtctgggacacaaggataaccaaggcaaacgtgcgagagggataatgaagaggatgccgtgctgtccaatgtgagagcgcaaggcaagggctgaggtgcttctgaggtatgcctgccactgcttcccgagtctccaggccaacagtaaacagataaattctgaaacaaaccatgatccaagtcagaatttggggcccgataaagatggcaactcagattgcactgaatagcagagtatttagaaatgaagggagctgggtcctcaggatgtgtagcagcatacattgtggaaaggtgaaaaggttacatgtaaaaacaataaccataa

SEQ ID NO: 102732 - DNA, 1094 bp, Homo sapiens
gggtggattctgcccccgtggggagtccttggcagtgtgggctttcatgggcagaagccaggaccaggggagaggattccagccctgcatgttgggggctatgattcctgggcctgggtgtcctcctctttcctgactgcaaagggtgctgtgttcctcctcccgcaacccctaagcaggagaggctggagaggaggaggagaaggagccgctgcccagcctagatgtcttcctgagccgctacacgagtgaggacaatgcctccttccaggagatcatggaggtggccaaggagagaagccgggcacgccacgcttggctctaccaggctgaggaagagtttgagaaggtgtctctggggtctggggtgtcacataggcgtaggcaccctctgtggtggttggggagccccagggccatgggtacaatgcccaggggcatctctgaccatcacttttccccatgtgattgcagaggcagaaagataatctcgaactcccgtcagcagagcaccaggccatcgagagcagccaggccagtgtggagacctggaagtacaaggccaagaattccctcatgtactatccagagggtaagtggcgggcctcgcagccaaatggggaggtgttgggtagagctgtgtgtgtctggctgtgtttggagcagccttccaggtgtgtatggccgtgcccccttgcagtttgggcttctgatgggtactggtctgtctaagggtggacaggtctgtgtgaggtcagcagtgagtgagaccctctccagcggcactggggcctgcgttctgctcaatgcttttgttcatctgggagtgacttggccgagaagcgagctcctcatgctccttaggctgctgcccttctgacacctgctgctacctttgcttcgtctgccaggtgtccctgacgaggagcagctgtttaagaagccccggcaggtggtacataagaacacgcgcttccttagggaccccttcagccaagccctgagcaggtgccagctccagcaggcagccgccctcaatgcccaggtgagcaggcgggtcagcagggccgcatgggccaggttggacagggctg

SEQ ID NO: 102733 - DNA, 1111 bp, Homo sapiens
cagcctggctttggtttttcatcacaagacattttattttatttaatttcattttatttttaattttttgacacagagtctcgctctgtcacccaggctggagtaaaatggtgtgatcccggctcactgcaacctccacctcccaggttcaagcaattctccctgccttagcctcccaaatagctgggattacaggcgcctgccaccactcctggctaatttttgtattttgtagtagagacgaggttttgccatgttgtcccggctagtcttgaactcctgacctcaggtgatctgtctgcctcggccccccaaagtgctggtattacaggtgtgagccaccgcgcctggccaagacataacgttttaaaggcatttctgtttatggtctctttccctaattggcatcccttgcacaagagcagaagctttgttttgctttcatctgtatgctccgtgttgggaacagcacatgtggtgttgtgggccttgcacagatacacatggaacagatgaaagagttgtcatcttcagcatgtttgctgggacacacagctctatatggtaacatcgtgacttgatgggggagtcggtttaggaaagggcactccgagtcctgttgaatgcaagtgttctgcacgccatgggacttctgcgttgtcaggccctcttttcatcagtagtagaatgtcagtgcatgtatagacaaacgagacactctttcttatcagtttgtagactccactgtgctggagtagcacagatgtgttgtgtgtttgcacaaacatgcaaacatgatactttttgctttacaatccagctttttcggccattaacacagtccttgttgtccttgaagcttgattatctgttgaaatgtagcttgtgcatcacagggcaatttgtagatttttttcttctccttttttttttttttcctatagagatgaggtttcattatgttgcccaggctggttttaaacttctgagctcaagtgatcctcccaccttggcctcccgaagtgctaggattacaagtgtgagccatcatgcctagccagtttgcagattttcaatacctgtacacctacatgccagtaaatataggaat

SEQ ID NO: 102734 - DNA, 1076 bp, Homo sapiens
ttctagagccacagcttttccattggccaactattggaggcgcctgcgcaaatggtgcagtcccgccccctccaccctgtgacgcgcctgctgggcccgagctttttcctgggatagcgatggagacgccgggcgcatcagcgtcgtccttgttgcttcccgccgcgtccaggcccccgaggaagcgcgaggcgggagaggctggggctgcgacgagcaagcagcgggtcctggacgaggaagagtatatcgaggtacgacctcggtgcggacgccggcgacttctgggcccatcctctgcttcaagctcctctcaggttccctctctcgggtgttgacactccgtctcctcgtggaagtggaggagccgggtgtggacggtcccacgagtcaagtaaacagggcagaggaagacgtctgtggtggaagaggctgtagtagtgttgtcagggaaaagagagagcggctctctttgtatgggacgggggtcagggaaagaagattttctgttaaagtgtgagtaggagtttgacaaactggaaggatggtggcaaagagggctttctaaagagcggtggcagcaagtgtgaatgctggggttcctggaaagagaccgcagttgtgacagcatctcgagtgagtggacctgcgtcgccccaccacacgcacacagaaggaggagctgaaacggggattggcggaagtcagtttggttttagacctgtttaattcgggacaccttttgggatatgtagatggatggctttaacggacggttgggtgcccagatatgcagctcgggagcaaggtctggctggaggtgcagacttgggaatctcaacttgtggtagtgactggctgaagttactcaggaaaaaggtttatttttattttattttttgagacggagtctcgctcgtcgtccaggctggagtgcagtggcgcgatctcggcttactgtaaccaacctctgcctcctgggttcaagccattctcctgcctcagcctgccgagtagctgtgactacaggtgcccgccaccacgcccggctaatttttgtatttttagtagtggtg

SEQ ID NO: 102735 - DNA, 1086 bp, Homo sapiens
aaaagagcagcaaacataaagggagaggctgctcacagggctgccctgtgtcccagagcatggtccgtgtgggctgccctgtgtcccggggcatggtccgtgtgggcagcccagggcggccttggctgcactgcttcctggggaagagttcccagttccctccaccctggatgggccctgggcctgccagctagccaggacccacccaggtggcagccgagaacctgcgcctttgcttctctctctcaggtgaagttcatccacgaccagacctccccaaaccccaagtacagaggattcttccacggggttagggagattgtgcgggaacaaggtgagccactcgaccttcctgatagggctcagggacctgggccagggtgggaagggcctgcacctcccatcctgccttgggctttgtgcaacacccaccccccacacacaccaattcccaaccggggcctgagaggctgcagggtaaccccgtgcctgccttcccgcagggctgaaggggacgtaccagggcctcacagccactgtcctgaagcagggctcgaaccaggccatccgcttcttcgtcatgacctccctgcgcaactggtaccgaggtgtgtctgcatcacagggccccatctctgcacatggccagctcctctcctctccttggggccacccctgggtggcgggcacccaccttttgaagtgctgatccaggcccctcccggcaccctctgacccacctcacccctcctatatccaggggacaaccccaacaagcccatgaaccctctgatcactggggtcttcggagctattgcaggcgcagccagtgtctttggaaacactcctctggatgtgattaagacccggatgcaggtggtggggccgggaaggggaggggaaggggggaccaggccagagctagctgctgagcccctgcctgctgatgtcccccatagggcctggaggcgcacaaataccggaacacgtgggactgcggcttgcagatcctgaagaaggaggggctcaaggcgtgagtgggggaggggcagggctattgtccccacctcaaacctttcccggcct

SEQ ID NO: 102736 - DNA, 1042 bp, Homo sapiens
tcacagtttctcacctgcagaggaattgttctttccttctcccgtgagcagacacaaggttctctgccaggccaggaaagtccccacaatctaggtctcttcactgacacttgcactcagctgtcactctgtgtccacagggtctgcggaagagggagctgctgaaggagctgctaccagtcatcgggcagaacctccgattccagcgcctcttcaccgagtgtcaggaacagctcgacatcctgagggacaagtagcctgccccagcctgccctggctgcagcaagggcagggccacactctcgccgctgatgacatgcaggaccgcctctcacctgaccaggctgtagggggaggagacactggcaggagatgtgctgtcctgcaccagcgccagcccagctccctgggcagatgtgccctgtgtcctgggtctgacattgcctcaggagggggaagctcatccctccctccaagcccccgatgcggagctagggctggagctctgcccaggtgccctggggccagcaaggcagtcccaggcctgccgtctccagcacggccccaaggtggacactagcccctgctgctgcaggcaccatgctgcttcagcagtgacgattgagccatttgtgagagagaatccggaagcgttaggtattacagcagactgacctaagacctatgtaaaaggaaagctgttccaacacacggactatttttgtactagaatttgctaacttgtaatattgaatttcctttggccgataatcaggatttccctataagtcacttggacattggtcacttgtaggaaatttaaactctaattatgacagctacactgaaaaataattgtactgaaattaacttgtctatcttcatttggttttaatttttaaatgtttgtaaaaagagactgttttgggggaatggggcaaaggggtgggcgatttcttttgtaagtgtaaaataaatgaacacgcattgaataccaaaccctcctgatttctcttgccttttccttctaactttcatcctc

SEQ ID NO: 102737 - DNA, 1523 bp, Homo sapiens
aggggctctgggcttggttgtgaagacaaaagacggaaggtacttccctgccttcgtggagctcggtctggtagggatgcacacataaacagggaggcagttaggtcaacaaaatattttcagactagattcagactaagaaggaagtaagcagggtcttcagatgagagtgcctgggaaggagtgaccaggaaggccttgtgagaggacactgcggatgaaacccaaggagaagagtgagacagccatacagagacctggagaaagtgtttcctagtagaagtgagagtaaaagcaaggagtgcttgatctgtttggagccactgtggctggcacatagaaggcaaaaggagagggtggtgtgaaatgaggcaggaggtggaccacagagacctttacaggagctagcgttttcttcttggcagagttggcacagaggtgtcatgaactaaaatagaaaaacagtcagggagtatcttctgtaacagtcccaggaagagatgaaggtgacttggatcagtgtggtggccatggagaggggaaaggagacagattcaagatgtattttggaggcagaaccaataagatttgatgggtggttggatgtggaaggaaaaagcataatgaacatgtggcacctccaggttcagctgcaaaaaatggatgccagaaccattcattaaatcaagaaggtaacaggttggtgggggatgggagaaggtatggatctaagagttagctcacagcttcattcaatcattgagcaattactgatggggcacctcccctggccaggcatgttataggcatagggcaggcagcagtgaatggggcaggcagcagtgaataaggcagactgagtccctgcattcatggatctgctttcttatggagagagacagactaagcaaatgagaagaggtatctgtagtgtcttgagtggtgatggatgccatgggaaaaaaattaaaagggcagggagatatagaatactggcaggctgctatttcatgctgggcaattaagaaaggccaggctaagctttcagtgagccaagatcgcgccactgcactccagtctgggcaatagagcgagactccgtctcaaaaaaaaaaaaagaaaagaaaaaggaaaggccaaacaaacagataagcagagaccagaaaaggtgagggatgaaaccatgcatatatttgggagaagaacatccaggcagagggaaagtgcaaaggcctgaggtgggagagcttggagtttaaaaggaacagcccaacgggatggtagcagaagggtgaaaggagttgacatcaaaaggccagagggtcagccctcacaggccttggtgtgtacagaggcctaattttttattccattcttaaatttgactgtggtgtaccttaattgactaggtactttgaatcctgggttcaaagtcaaatccccttaagtccctgaaggcattgttccatagactttgcatccagtgttattgctaaaaaaatctattgtaaatctaatttcca

SEQ ID NO: 102738 - DNA, 1881 bp, Homo sapiens
atcctcctgccatccccgatctctactttgcattgcacaggctcctacgtcatggcgctcaccgctgcagccacactctctgtctggtgagaggcaggcacagggtggggtgggcttcagccagggcaggacagggctgtgtaggccccacctcactgcaggggcagggaaggcagtggacaaggctggccatcaggccccagaagaggccctgagcagttagtgatattgcttgtgttgggtgccctgggtaggctgagggctgaggggtagtgtgcaagggggatggaggcagcttgcctgctcgattatttccttactggagcagcccatgcgaccagttgcactgccagggtcctatgcaagattcatcagaaatggagtcttagctggcagaatgtggccatgttcctgatgtggctgctgtggcctggcttcccccaaagtggtgtgggcgctgagggttccccatggctctgttgcctgggctttgtgctgcagccttaatgcagagggagtgtagtggcacatggagagcagaagccactcgtagcccagagcccctctcactaggagaggccagggttagggtcgcatgcagtagggccagggtgtctgagcagccaaggcacactctgatgtgtttacctgggttggtgagtaaactgttccctgtctccctcctagggatgttcacagacaggtggttgtggtgaaagaagagtctctacactccatcctggcaggtaatgcaggcaacaggctgtccctactcttttgggggcccaagttcatgtctgatgctgcagaagggccccgctcagagagccaggctctggcctcagcccagggctctcagtgaggcaggaggtgtggttacgctgcaggagacacacactttttgggggcatgtttgaatgggtccccaagaggtgacaaaagcctggtgtgtggcaaggagaatggcttgccctccctatttgccaaggcagtgttgatgcatttgctgctgggactgtgggagcctagagtacagatttctcctttgatatgtttgaaaacacttgctgatcagagcacacccagaactcattcccatgctgtcctcaggaagtgatatgacggtatcacagatcttgctgacgcagcatggaatcccagtaatgaacctgtccgatgggaaggcgtactgctttaatccgtcactttccacatggtaagcaagctgacccccagtcctattccctggaagagtgtctgtctgctctagacagcagagcaaagggtcgtggcctacagggctgcctagccctgcttttcctgagagtcaggccctggagtgcaggctgcattgactatctgtgcatgctcccctgtcccagcaggacactgcagcctatggcctctgccctcagagcctgtgtgcaggagcactgtcctcctgcattattttcaggaggcactttttgaaaaagccccaaaatttttatggtttttgctgtggcccccttagccaccatgagcataggttagtgggctttacaggagccttaacaggactagtcaatttctgtgagcttagtaagcacttcagacttcctcagtgaattagtaaggatgcttatccacttacccaggcatgatggtctgtacttttcctctgtccactcaggaatttggagcccttttttgtacttgcaaaataatttatacatcagagctcttaacccagacacgtgaattatgtacgttgtgttccagccactccaagttcttttcttctgtctatacctttggtccttaagaaccaaagcttgctacctcctagccccttttctgttaagaactgccatgcagaagtctacattcacactgagactt

SEQ ID NO: 102739 - DNA, 1093 bp, Homo sapiens
ccttgtccagccagatccccaaagtctcgaattccacactgaggtgtgcctggctcaccttgacctgggctggttccttttttggatcccagatttccatccaagttggtcaggatggatttctgactgtccctgaagtccccatcccagcccatgccagattctgcactgtgagggggaccttgattcagtgattagtcacccagtatcttcccctgggttcctagaactgtacgtgagccctgtccctacctgtgttcaatgtggaaggggaaccaatgtttctcctcaggttcctgtctgatgtagcatcccagtcaggaccagatacagtcatcataattacacccttaatcatctgccatgaggtcccatgtaaatgcttttacttgtgtcaaagcacatggccttaggtcttagaccacaattctcgtgggccctgagtgagttttgtgtttttaggcctaggggaccccactgtttgttctgttcctccctcaaattccccctccagatgagccatttaaattcccagtcccaggcacctgtgtatcagatgcttccacaggctcccactctctgtccctcccctcaaggcaggtggcttgcccagctgagggctaaggggtgtcggcacagcctctcccacagtgacatggcagctgtggggcaagcctgctggaccacgtgggacctctcctcctgcttagtcctgcccagttcaggcccagcctgcagacctgttccccagtgttacagcccaaaaatgatggctttctttgcagtgggctggcttgagccaggctctgaccaccagagatgggcagatagaattcagtcacagtaccagcctggccaacatattgaaaccccatctctaccaaaaatacaaaaattagccaggcgtggtagcatgtgcctgtaatcccagctactcgggaggctaaggtaggagaatcgcttgaactggggaggcggaggttgcagtgagccgagatcacgccactacactccagcctgggcgacagaccgagactctgtctcagaaaaaataagaattcagtcacagcactgcagagagctccttgttgcc

SEQ ID NO: 102740 - DNA, 1049 bp, Homo sapiens
ggtggctgttatttgtttgaacagaaagttgtctctcagatcagttgggaatatgaaatacaaaagattctattttatgttcattgttttttttctctaacatcactcttcctttcttcatgcagatgtgagtttctggcctgcatcatttatcttctctctgaaagacttttaacatttcttgcaaggcaggtcttctggcaacagattccggtgtctctttgtttatttttgtctgacaaagtcattatttctcctttacttttgaggcataatttcactggacacagaattctaggttggcaagaggtttgtttaagcactttaaatatttcacttcactctttcttgcatgaatggtttctgaagggaagtgtgatgtaatgtttttgtgcaggttaaaagagcagaaccttgtgaaagagctgaggccccgagacctcctggagagcagcagtgacagcgatgagaaagtccctttggctaaggcttcctcactgtccaagcgaaaacttgagcttgaggtagagacagtagagaagaagaagaaagggcggcctcggaaggactctcgtctcatgcctgtgtctctgtctgtccaggtgaggccagtgggcccatcctgccttctttagcccacctttctgtacttagagcttgaaggccctgtgtgcatggtaagcctcagctgggtgggtcaccttgggaaccagctggcttagacatgcagcccctggaatgtagcatggaggccacgctctccctcagatgtgcccttgactcacccagggcccttgagcaggttccctggcatcaactggcttgtccatgaggttaggatccttgtagcattcccctctgcttcctccctcccagggtggaaatgctctggtcgcaggctcagcctcacttctgggtgacctgcctttaccaaatgctaccccgtagtgttagagcaaggctcaggaacgtttctggctcttccagtctccagctgccctaaccgcagagaaggaggccatgtgtctgtctgcaccagcacttgcact

SEQ ID NO: 102741 - DNA, 1176 bp, Homo sapiens
ccccagtatgaatgctacctctactcctgctgcattgtcaccttctgtgttaacgaccccgtccaagatcgaacccatgaaagcgtttgactcccggttcacagagcggtccaaagccacaccaggtgctcctgccctgaccagcatgactccgacagctgtggaaaggtaggtggtagctgcaggaccctgaaggaccaggcagggtgcaggcatgggtcaacagcacagtggcagtgttcccaccaagcaacctgccttcctgttggggaaaagactctagccactcaatacatgggagcaagactgcagagcccttagtgagccaccaggagaaagaggtggttccttgaagtgggaaggtggctggaaggagtcatgggggaggacgcggcaaaagaaccacaaggtcaaaggcacaaggattggtcagtgcagaggctgaactgagaataatggtgtttggatggagcccagagtttgcacggaagagagcatgagattagttggagaggtggaagactctgatattgatacatcatggaagtgacggccttccactcagaaactgaccagaggtagagagctgcaataaaaatgatgtaagtgaggtctttgtcaagtcagattggcttctgagctcttgtggacactatgctgcttatccattctctgggtctcccctcaaacacagctgtgacatcacgcaggttgtagttctttatttcttggagttttgcagtagtgcatcctcctgaggtggccagagcgaatgtctgcagcctctgccattggcactgaagttctctgcctcctgagagggcccctccctccaagcctagcttgacaaggagctaagttcacatcccagtgagtcagagcctaggagaggagaggcagatgtgggctggactttgggggcttaagagctgtcccttaagagttgcaccccactgcgaggtttatagggctcagcagccctgggcagacacaccctagcctgtgccaccatcagccaagtacaaggacactggtcagaaacttgcagtagccacacagccagcaggtgcccaatgaaaggagcatttgtatgtgacctgtccttgcagtagatggtgatttggagctaaagccacagcatgctacctctggggctttgcttatgaaaagccctgt

SEQ ID NO: 102742 - DNA, 1046 bp, Homo sapiens
gagggagaaggccaaggtgtctgtgctggatcaggtagtctgggcttttccccagagtggagacgtagaaggctttgagatctccattttaggaaagtgactctgttaggcggtggtgccccaaataggccactccctggcacatacagctgataccgtcagagcgattctccattggtggaatggagtcttgtgttactgcagccccctgcttctgggatacagctgataccgtcagagcaattctccattggtggaatggagtcttatgttacttcagcctcctacttctgggtgctagcaccatggctgtgaaggcatgcccaaacattaggtcactgccctggggggaccctgagagggtaggaagagaagactgagcagcaagaccagtgaggaagcaaagcatgccaggacgaagggagcctgggaaggacagaccatgccagatctgagaactctgtggggatggcccattctagtggccacagatcatggaggagaagaatggggctgtccagggtgactaccaggcatgtggtgtggtgtctgggcagataggagtggaaggtgttagcctgggtgtgcttaggaggaggtccagtggccatggtcccaaagcgtgtggtgtgggcttggacatgaaggatggaccaggcaggcttctgcctggcctctcctttctctgtggaatagaagatgaaagttgtgtgatgagcacttggagcataatgctaagaatgtgacactgtcacagggagatatgggaggggccgctcaggatggaggatgcctgactaagggtaaaagcagaccatggcttcaggaccccaggtgcaggcttatctcatgagactcattgtcaaagtgggaaaggtgagtggctggagtggtttggggtagaggtgctgtatttaagttgtggagatagggcagtgtgactagagaaaagggttgtaagaaccatgttctaggcctcattctacccgcaaaagctctcagaacagtgcaaagggggaaatgtgaatgcatttgctcacaacctt

SEQ ID NO: 102743 - DNA, 1065 bp, Homo sapiens
ttccctgtgggggacagagaagggggaagagactcattcaccacttgctgttgtcccagtgtatatagtgaagattgtttttgaattggttaatcttcccaaaatgatgtgtgttgattcaaaaaaaaaaaaaaaaagaaagaaaaatgataaagcactgtgtgaaagaaatagacccccactgtcaaggcagttcactctgggttttattctcattccgtctatctgctcagggcatttgtaagcccttcatggaggccacacactttaggcctctgcgttttgcagttgtccatccacgagctattccaaatcttccttggtgtctaaagaaaccttcactcgtacagtgtacagatccagtctcctcatgttagatgtgcaggctctgaggtccccacgagtagagcaagaaccaggtctgctggctccccacagagcactcattttcttttgactaagtctttttcctattgtgaccctgtagggggtaatgcccctacctaccttttattgagaccaagtgagacccagtgtgtggttgagctctgaacatactgggcctgtgggatggggaggtggtggtggtgatggtgacactttgttctgtggatccttccaggcgttacctggtgagaaggtgtaggtggcttcctaactggtctggggccaactttctgacataggatgcatatttctagcatcaggacctgatccttttggtattaaaagctttttgccctcctgattcccacgttctaacacgtagcaacaggataggtccttattagcttagctaatcaagaaagaagagaaaaagcataaatatacaaagtaggtataagtgagaaataatagacaaatcaaaaagatgagagacttctttgctgaactctgtgcaaataaatttgcacagaaagtggatggtttttgaagaaaataaaattactaaaagtgaaaaattattgtggaagaaatagaggacagagttaaccccaccaaagccaccggactaagatggcttcacagggaaacttcaggaacttttaaggaacaggtaactca

SEQ ID NO: 102744 - DNA, 2397 bp, Homo sapiens
ccccacagcctcccagaagctgcagcagcacctatgggagcccaccatcccgtgaggaagtgtgtttcttccctgcccattgtcctgcagttcagggccagccagcagggtagccaggcacttgtgcacaagtggaaaggcctaccatagttgtgggaacgtggagtcagagtgtatgccagcaattgagtgactcgatagagaatatgcacagtgcatgctatgcagtcatccagaagagacttttacaggatatttaatgacatacttattgtgtgttaaatgaaaaaacagacacaactatgaagaataaaataaattcttactttgaagaataaaataaatatttgcacaaaatagaagataataattcatcaaagtattaatagtcggtaactaggcccagattaagggcccaggtgtgtatttctgtactacctacacatagtgtagaatgagccttggataaatgtgtaccagagtcccttgggcccagggaagatgtgttgtgttctctctcagggtgcctcatcccctgtctaggctttggcatcgtgtctcctgctccatagaccctctcagaggtccaccctggggctgtccctctcctccgaccatagcccttcagaaacccactcccactctgccttctctgttgctagttatctgtgtataaagctatttcccctgtcagaccacagcaagccctggaggcagggtccactctaggtagcatgcacatttttggcaggctttggttcccacagtttgggatctctgcagctgcagtttgaatagagttgaagatgccttaaatatcagcagccactttgacccaggcttctaggttggttatgttaactgagctgaatacagaaggggatttcagtaatttcattaaccttgactgtgtctttccttccagctcacatgtctgaaacggccgctggtggtcatccatgaactgtttgacaaatccatcatggatatttcctggtaaggtggattctacttacaggaataggttaagaaaggagaagccacacattggaacatgaggccttctgggtgtgactagggtcaggtggccagtggcccctccccaggtgtcatagtagcgcagaccaagagtgctgtttgcacgtgatttgggaactggcagcggtgtacctgctgctgcgagaatgtcctgcctgtgtagaatttgccactggaaaatgccttttcaggatttgtctaagacgaggagaatgacgtgatcctagtatgttccactttactccgtcagtgcatgaaccaaagtcagaagcacactttctgcttctcagtgacctgatttatatgtatactttgtcaagttttttttattttaatagtttcaaaagtaagataagtaaaattgaaaattcttacagaacatatggtaaaggagatattttgtacacctgcttagagctaaagaacaccagggccctttgggatacaattgtcgccccctcccccccccgcccaggccaaagaagggaaccaggccacagaagggaaccaggagtttccagcatctccctagaacactgcccaccatcctcacaggccagctactgcggcacatgtgtctgcctggggctcttgctaccaggctgctgatggccatgtctttcaggactctgaatgggctgggcatcttggtatgctctatggacggctctgtggcattcctcgacttctcccaggatgagcttggcgatcccctgagcgaggaggagaaggtaggctgacggctcttgtgctgctgggtgctctgtggccattgccacaatagctctgagagacccctttgactacaccctcttcttgtgagatacacagacaagtcatttcttaacatgtaatggggtattcatcttttatatcttgtaatccttctttacaaaatagattaattaaaaaacgagtccccatttcagaaataagtcctggagttaagagtagaactattttaggcatctctttttgagctgataataggccatccactgggaggtttttgccctgggaaagagctgaagtgactcctcaggggcccctgctcatgtcactttcaccttcatggtagtaatattggtcatttcttagaacgcattgtctgccaggctctgggaatgtgttttgcacatatgatttcatttaaattgcacaaaacccttcaaggcaaggctcatccatttcgtggatatggaaactaagcctcagaaaatagcatggctctttgcccagactgtatgtgacccttaggtcagaagagtgaacaaggcctgctgcctctgggccaggctgcctcccctctgtgctctgctggggtgatggggtctctctgcccttctgccaggctttgag

SEQ ID NO: 102745 - DNA, 1066 bp, Homo sapiens
ccctgagatgaggcgatgtcttcagcttcttttttttttttttttttttttttttgagacagagtctccctctattgcccagcaggctggagtgcagtggtgcaatcttggcttcttgagtcactgcaacctctgcctcctgggttcgagcgagattctcctgcctcagcctcctgaatagctgggattacaggccaccacacccggttaatttttttgtaattttagtaaagatggggtttcaccatgttgtccaggctggtcacaaactcctgacctcaggtgatccgcccgccttggcctcccaaagtactgggattacaggtgtgagccaccacacccagcccgatgtgtcttcagtttcattgttcccctcaccttcctaactcagtgccctctacagagcaggttctcagcagatatactcaatggtagttggcgagtgagaacccaagggtaagaactgtggcggtttctaagtgagggctcctgaagggttaagtttctcactgccaggggctggtgtgctgtgacctgactgtgtggtaagagacacctccgcatgcagtgcagggagcagtcttggtgctgagcatcaaggtgccaatatatttaaagtttgataaagcaaagtgcacacacattaattttttttttttttcattttgtaaaaaagtgtccctataagcagagcaagttggaagttctgggtttgaaggttatcctctggctgcatttattagtttggtatagagaaatatattactgtgtgcgttgtgatttttttttttttttttaggccaagtattcacttaacacccattctggaacctgaaccacagtaccacagattgccgttcaggggaccttccctgtttcctcccagccagaggccctgtttgtggcgctgcaaccaaaacatcactgactgtgatgcccatatttcttagaatgctcaggttaggcagtcacacggcctgtagatttctgaggggtctgtaggcacatttatgagaggagggacaaggcagctttttctagaagtggaattaaggtggaggcgaga

SEQ ID NO: 102746 - DNA, 1134 bp, Homo sapiens
cagagattcacacccctcctgcccatccccttggcctcccttaggagatagggagtgagtaggtctttgtttctgaagcccccttgcaggctcagcttttctgcaggtcctagggctggccctgcctggccagagggaattgagaaggctagtttcagtagctacgcatcccttctacttggcaagctccagaaatggagagtttggtagctctagtttcaaatctgcatttcccagcttactcatttggtgcctccgcacatactttctgacctccctaagcttcctttccatcatcagccagatgcctcataggtggtcgggaagatgaaatgcatgctcagtgcctgggctcagagaatgtctgtgggagactcccttcagtgggctgggacttgggcacaggggacatgcctgatgcttgattaattatttttaacatctgttatttggctttagaaattcaacccaaaaatcttcaaaaagaagcagaagaatgggagttctgcgaagcctagctgcccgtactgctgctgtgctgttggcagcaaggaccgctcgctttctgtctgggtgagcctgctatcctgagcttttgttgcaggacgggaggtgtaggttggtaaagtagcaagtggaggaaagagacctgctttgggtgatgctaagagtgtatttctattctgcacctggggtcagcccctccttggaagctcacaggctctcctgctctcccagaaggaagtgctgaagactgggtctgtgcccagccaggagaggccaccttgacccccacctagaccagctcttgtgtccagactcaggcagcaccctcagtggtcaatgccatgagcagcatgttgggcttgcttcctattagaaaaatctttatatggctgggcgcggtggctcacgcctgtaatcccagcactttaggaggccgaggtgggcggatcacaaggtcaggagttcgagaccatcctggctaacacagtgaaaccccgtctctactaaaaatacaaaaaattagctgggcgtggtggtgggcgcctgtagtcccagctactcgggaggctgagacggagaatggcgtgaacctgggaggcagagcttgcagtgagctgagaccgcgcc

SEQ ID NO: 102747 - DNA, 1579 bp, Homo sapiens
cacagtggcctaggatttatgtgtcttgtcagtttttctttgtcagttacatttgtttaagctttaaaaagagattcatgcttaagaaaaatggtaactgagtgctagcatggcatgccacagatcaggagggtaatggatgggcagctgttgttggggaccctgatgctcctaaacctgctgtgtgcacccccaccactgggctctgggctcagctcagtcaccatctcctctgtgaaacccttgagcagatacgggctaacacaaacccagttttgcaaaagattgatttttcttattcattgtgtttaaagtcacaacagatggcataacctggcacagtgctgcagtttataactagtaaaattcttctcatatttcagctctgtatttgaagtatgctttccttatggatccaggtcattttaactctttgaaagccaccagcatgtgtggaaacactcagtctggctatggagagggaagctttagagaccggagtagcatttggattacagatctatatggggtaccgtcgtacacacctttgtcttcagccataacttataaaagactcagccacagtcaggccctttgagctagtaggcctcctccttatcagggagctaccagggaggctaacgtcagaagtgctggtgtcacagcccaggaagggcagccataggcagggccgctagatacagataagacctggatcagaactagccccttggtgcctgcctccttgatgctgtcatttcttcaattggcttttgccttggtggagatcaaatgaggaggcccttctgcttctgtctggtgtgggggctggccatggcagactgctgagtcccctctcttgcatatccatcccatggcccatggattgcaggtcatgtttccctcagacaacacctctccacattccttttttcttcacagaaattctagctactctgagaggtcattctggcttggtcaaagggttgacatgggaccctgttggtaaatacatagcttctcaagctgatgaccgcagcctaaaggtgtggaggacgctggactggcagttggagaccagcatcaccaagccttttgatgaggtaagtggggacagctcagggagctgagcccccgcagctgccccagcctcttcctgacttctgtgtacagagagggagctggccatgggccaggccacctggggaatgcacagagtccgggggcctgagcggattcaccaaggctctctggggtgggactctggccctaagagtcagataatacagaatccttcatttctgagacgctgtttaatttccaactttgaaataaaagggatttatagttttgttgttttttgctttgttttggcgacagagtttcgctcttgttgcccaggctagagtgcagtggcacgatctcagctcactgcaacctccgcctcctgggttcaagcgattctcctgcctcagcctcctgagtagctgggattacaggtgcccaccaccacacctagctaatttttgtatttttaacagagatgcggtttcgccatgttggccaggctggtctcgaa

SEQ ID NO: 102748 - DNA, 2122 bp, Homo sapiens
tgagagatagaaaatggcttcctaaattgaaaggctagatgaaatacattttttcccaaattaatatttacttgtccacataccaaacatttattgagtgcctgccatgttccaggcactgttcttctctcaaggagatttgttcttgtaaaagagacagacgagtgagtagtataggagatttgaagatgagcctagaaggcagagtcctgtaaggagttggaagatgagtgctgggggccagtgaggagatgacatttgagggaagactggacggcagtgaggggacagccagtgcgaaggccttggagcatggacatgtgcttactgtgcccagtgaacccctgggagctggggcgggggaggagggtgcgggaggcagtgtgcctttgagaccgtggcagaggctcttctctgagcaagaatatgaagtctccgcagggatctaggcagaggagttgagacctgtggcagcagtgtggattctaccatgggggtctcagggctgcactgggaagactagtaaaggagccgctccgaaaaacaagggagagacaatggtggtttggagtcataacacagaagtggtgagaagtgatcagaggcggatttcctggtgcattgaatatgggatgtgagataagcagaggagtcaggatggcttcccggactatggtccaaacagtggaaaggatgcagtggctgtaacctgaagcaggaagtctgcaggtgggacagaaatgtttgttaagggaagtgttttcagagtttggttttggatatgttaagtttgccagtgtaaatggacatactgtgtagacatttggaaatatgaatcttggaaatatgaggttctgggtatgagcagagtccaaggatgagcctagggattggagagctgaaaccagaaaaagaagctagaaggagaggccagttaagacagtgaaaagaagcgaggcatgaggatcacttgaggccagtagctcaacagcctgggcatcatagcgagaccctgtctcagcaacaacaacaaaacggacagtgaagagagtatttgaaggagaggggaacaggcagcgtattgcttattgctgaggggcaaagtgaagaccaaggatagactgctgggcttgacagcatggagggtgctgggggcctaggcaagtgcaatattcatgtggtgtcattgggccaaaggtgtcattggagagtactcaaaaaacactaggagaggagctgagctttgtcaggcgtgtaggaagatggaggagaagaaaagggggagtggtggtgggctctcagctggaggagagaggtaaggaccaggtggttggcaagtggtgaggggacggcagcatcagtagatcggagttcctggtggcgtgaaagtgctgttggagctgagggtgagctaggagcacggggctgatggttggcctgtgggaaggttggaattgagacagattgcagtgatttgtcatggaaggcctctggacatgaccgtggggtgaaagtagtggaagccacggtcatcagaagggaaggaggaatttaaggaaccaagagcctggagtgttagaagaatcatcctcttggagtcaccaagaatgatggtgagaacagtggccagaaatgtaaatctacaagtgaggggagggtctcctgtgtgtgtagatgcaccataaaaaggaggtgctatatagtctgaagacagaaactccaaactgggagtttaggagaaaattatgtcatgtatgtggatttactcagcagtgattctaaaggatcgtatctggaaggataagaatgttacggatgaaaacattcaaagttccagtgatagaaacatcatgggtttgagggtaaactcgtaacactgaaagaggctacagtatacctaagaagttggtgtgttgtgaaaggaggcatcgcttatcaaaatggattcttcctcacatggagcatagtaactgttaagcagttagtgaggagaaattaatttcaatcctcaccaaatacagcacacaccaaaccagatactaaagagagaaacattctaaataactacacaaggaaaaaatagaattgaatatttaccagacctctagcagagagaatattt

SEQ ID NO: 102749 - DNA, 1512 bp, Homo sapiens
agcataagtgagaaagtcttggtgtgaatggggatttggaggcatttcaccatggctggatctttatagacaaggcagggagcagcacaaagtgaggctggtcaggtatgccagagtcggatcatggaaagcttgtgctccctgttactgagggagtcccttgtcatggaagagatagggagccactaaaagctttgaagcacaacagagaggtcattgtgacagctcagtgaagtggaggttcttccagtcgtttagatggacactgtcagggcctgagctaggcctgtgataattgaggtagagaagaggagattgatttgggaatacttaggatagggcacagagaggtatgagatagattcttggctggatgcctagatagtcagaggtatcacctctgctgagaccctaaggacaacaggcttatggggacggataccagttcagaatggagttgcccctggcttgaggggtaggggaagaaatgtcaagaaaccttcaaattgagcctggagctctgggcgaggacagggcaggagtgagaggtgtgggaggtggcatcagctataatccattgttagtgtatgcttagcagattccctgtagactgttaaaaggagaacaaacccatcttggtggcggccatagattgagtccacatttgtgaaagctgaaacggttagtgttgtgttattgtttgataattaaattgtgtaattggcccttacttgtgtcacagtactaacagtgaagtctagttggacttttctggaacttggtgcacatgtctatgagggtgcccaagtgtggggtaggcctcaagtgaggacttttacaaggccctaaccagagccttgcattctctttcctacccaccgcccagtggggctcctttaccagacaagtagagttgaccaccttcagctggggacctgacactcattactcactggtcctggtagcaggtgcaggcagaaccattcaagaagaaaaatcaatgaaaagcagaagtaaatgaataagaaagaaccggatctttgaaaagcaaagtgtgagaaatatatacttggtatatttaattgggggttgggaagaaaaaacctagacaaaattagagtttaaagatctagaaaaacatttaacccagacagaaaaaaatcatcaaacagtacaatataatgtttgtactattaagctaaagaacaaaatactaaaaaataattttctagaaaataggaactttcataattgataccataggattaggaaaaactgaacagaatagtaaccaatgaagaaatgaaaggctgtcttcagaaatgcttcttggttctaaattagttgtaggtgcattgttttgagcttttaagaaaaattatacagaacaatagcaatatttataattgaaaggaagatataagccagggttattgtatctggaaaatacaagaaaacctaagaaaaataatgtaacaaaagcatagaataatatgaataaagatagaaaaa

SEQ ID NO: 102750 - DNA, 2950 bp, Homo sapiens
ccctggtggatccgtgttagaggccagatcagagctcagttccctcctgattgctagtctaaagttctttttgtaaagtcaggttgacttctgctgactgctaagtccgctccgtttcgtccccatgagtacttatcatcttttctgtaacttaaattagtaatttaaattcagtctccttagatctagttaattattgtttatggaagctaagtgaggacttctcctaatttaatttgacattaaatattaatatcaaatttctactccttgcacattcagccatttctgctcctttgttccagggcaggattctgggaaggttgtgatctggaatatgtctccagtcctccaggaggatgacgagaaggatgaaaatattcccaagatgctttgccagatggacaatcacttaggtattacagagtggccctttgcaggctttgcgtgttggcagagtgcccaaggttagcacatgtgtttgtaattagaaagataaggccccgtgcggcggtaactcccctcggcctgctgtctgaaggcacagatgttggctgcacacctgggtgagttattcagcagaagactcggcccgcccacagaaccatctttggacagtctgcaggtacctctggtgatttcctgctcatgagtcgttactgcctgattccatggggctttggggccagcgacctggacacagtagggttctggggaagggtgcgcaagagacaatttgccaaaacatctcaggttgttactgtgtcactctgaggctctctgccaggacccttttggccatcagacagtgtgatggtttcctttcctgctgtagtgccttagtttcccacccctgagatgcttaatgaacagtcactggcctttggacatcagctccttcctttcctctgtgtgttcttgtcctctcaacatgcctctcagtgtcttcagacctggagcatgttactcacgggccatgtgggggctacaactttgatagccatctttcaggtcttccaaaggccaagttgtgagtgctcttggaggctctggcccatcaggggcctgggggaatttctgctgatcttagcttataagcgcagagtcagtcaatctgcagtgctggcgagtttggaaaatccgaatgtgacagggctggctctgacagatgagatgaagtcagagttttatactgtaacagactgttcatctgaaaaatctagaaaaagcatctgaccctttttagcacgtactctttttttgagaataatctctactcagaaatgtgtctcattaatagatgacccttttgaaataatgagatttggttatcattttttgattttcttagaaagaagccttctattgactatgtcattcagcactaacgattctcagataatgtatatttttccccctccagactgttctggtaatttgtttttatagcacaagtaggttagtgcttaaactgaattgtttttctggggctctcacacagtagatgccttaaatagattagatagattagattttataaaccctttacatcttgccaaactctacataaagcaaatgggcatgactactggattttcatcaccttatttttttttcttcccagcatgtgtgaactgtgtgcggtggtcaaacagtgggatgtatttagcttctgggggagatgacaaactgattatggtgtggaagcgggctacgtaagcatcattttcctttcttcacattttatttttagaagctgctttgctggtctttatcaaagtcacctttccctaccctgtcactgaagttcccatagccctgacctcataagtagtggaaagtgcatgtaggtcaggagcaggtggagcctgaccaggaattcaggagacctggtcagctgccccctcacaggactgcaggctctcacctgaaaaggaaagtctgatctcttctagtgccgatgtgggtggggcttcgttgcttttgttttttcaagtgaaatttcacatggaagcccaatatacaaaatggttaaaagtcagggtgctctggttcttgcccaggatctggggcaggggatccagagtccagcctctttgccattactttattctctgttggtccccacctggggcagcctctgctctactctcaaaaggagctaaccatcacctggaaaactattgctcccaggtctctgggccagtcagtctggggcaccagaccctgcaccattgctcaccaagagtggccctgtggctgtggcttcaagagcagaggcagaggctgtctcttcagcctacttggctatctcagcacactctttctgtggatttgtgatgagctctacaagagcaaaaggtgttatcagaggctctgatcatcggtgtgtcagcactgcctccaccaggccccaggtgattgatgctcctctggctcctgtggtgggggctagtacctatagatcgcgtggtttctctgcctcagatgtcaaagccatttgattcattgtgagatgcttaaaaataaaatactgttgattttgcttctttaaatagccaacataagtaacatttagtatacaatttagaaaactaaaaatacaaaagaaaaaatatccctcatcacaccacctaaagaaagctacagttaatattttgacattttgggatgtgtgtccttctaatccattttccatgcatagatgctatccatgtcatgtggttttttttcctttacataagtgatatcatattgtatgtgatgtcctgtggcctgcttctttcacttattgtgaacgttttcccatgcaagatttgtaatggctgtgtagtatttcatcaagtgcatggatcataattcacctaaccagccccttttattcaacaacccagtgctttccagttcttgtttgtttttgctttgttctgtgtgccctgataagctggct

SEQ ID NO: 102751 - DNA, 1050 bp, Homo sapiens
tttccaggcaagccgattttttcagttgatattcaccctgacgggaccaagttcgcaactggaggacaaggtatgtttatggaataaagaaagggaaagcttaacagccctgccaccttgctcttctcctgctgtccatttagctgtagagggaatacttgctatttttcaggatggatgcaacgctgtttaaaatgtacagttataatgtgttatctgaatgaataaaatcaaaatccttttatggctttagtgtgctctctgtaagtattttggcagcggatgtatcattctaatttctgtttattgagttaatattaaaatcagtttgtatccccaaacttgtagagcatcgagagcggtaggtggtccagtgggcaaagcccagccccagagacaagggctctgtcagcatttttctcatctgaaaaaagggaatgagggtaatttaagcttctaaagcaatcgtgtagttattaggcccattttctcgtcaaaggaattcagttaggttaaagagaaagcacactgtgggcaagtaagaaagcccacaccatttgaaactgttattggtagtattgcccttatgcttcagccagcatcttttgcaatgttgcatggttctatttggaaagacagagctgttcttcatgccacaataccaagatgtatatatagtgacacaatgtagcattccacagagcccagccctctgtcatctttaccccagagcggggcctccctccaaccaggcctccccaggcagcacttagagagtgcctttgtgagctctaggtcctcaggccaggtgctgcagggtgggtttccagcagatgcttccacccagaatcaaggagctggaagggagtgtagggaagctgtgggcagggaagcctttctctccttccatgctgtggactgcacccgagaggaggaggtgcagcacatgagagagaacacatggacttagctgaaggaatcagagggttcgcacctgtacccagaagacacacattttgccaccttggtccagcagagatgttttggaaa

SEQ ID NO: 102752 - DNA, 1035 bp, Homo sapiens
tcagggtacttggacttctcacatgacaactaggtttctccagagagccaaagttgaactgctagactcttaaggcctacacctggaactggagcaacattacttctgtcatttccctttggttaaaacgggtcccaggtgtttcagataagggatactcaacctatactacatagtgaccagtaagaaggaaagtgtattttatctcaagttcatgcttgatttgactacatggctgcggctctccacagctgggtgctgcctgggtcccatgctgggcagtgccttttgggcaccagcatttaattttcacacttgcatgggagccctggcaggacttcacagttctcagacagccactgcctgcccacacactcctgatcccagtacttgctgagtgattctagggctggtgactctggtactgtgtccacattgcctcctcttgggtgacagagacagaacatgttcaattaagagactcttggcaacagcccatctatatcagcaattgttgatgctcagatcattgtcatgtatctcctttgtcaatgaacaaatattactgcgctactgtacactgggtactgtgctagaggctgaagatgtgatgaactcaacagcaactgacatgccacttgtagctcttaaacctttgtcctagaagcagggagctggacaaatgcccaccaggcgtgagtgccttctatggtctgctgggtttcaagctcctacagtgcttttgccggtctgatccacccacccagccagccagctagcttcatgggatcctagtgcaagcctaggcccatactgggctctttggggcttctaagaactaatagccacagtcctttctcctggaggaattgaacagctaatttaacatagagtacaaactgtgaaggaggttcagccagaggagatgctgagatggcagacggtatgggaacttcacagcacaaacaaaagagggctgtttggaagcagaagtatgacaagcgaagcaatgctccttggttgcagccagcgctg

SEQ ID NO: 102753 - DNA, 1141 bp, Homo sapiens
gaggcaggagaatggcgtgaacctgggagacggagcttgcagtgagtggagatcacgccactgcactctagcctgggcgacagagcgaaactctgtctataaataaataaataaataaataaataaataaatagtttcattcccactaatggaatgtgagtgactgctttccttgggatggaaaggcctagtgctgtaaggaggcggggagccagcactgcgctggtatctgtgtaggtcccctaccatatttcatctaatctgcatagcactaggaaaggaaacctggtgccaatgaaccaggcacgccttctcaaaataataaaaataaaataaaataaaatctcaaggctttgtagctgggtaagtggcagggctaaagattcagcccatgatgtttaatgccaaaacccaaacttgttgccagcctccatccctgccttcccctggagccttgaggcccccacccccattttccacactgctattgtggagccagaatgtgaatctgaccttggcattaccctgccttgaaagtacctttagagaaatgtctcagctccttactgatgcttgctgagccatctctgtctcctcttctttctcacactctctacctgcagtctgctctgcaacattacatcagcctatttcttgattccatgccgtgcgtcccctcagcctgaaaaccctctccttcacccgatcttctggctaactcttactcaacccttgggacccaattcagttattatttctgcaggaagcccgaggctgagtcaggtggctttctgcttgtgaagtgtccatcagtggacatcttactaggggagtttgtatgattatgtatctttactttctcattgcttagcctaatgcctggcacatagtagaaatctgcaaacagagactgagtgagaaaacatgcagttgatgctgtgagtgggcatgatctaaagcgcatgggctgtaattggttacttgtgcagctgagccctcagcacagcctggctcagcctgtacgtgctcttgggtagtcaggggaactgtgacttgcaggtaagggtttctggtgtgcttcttgaggggactgatgtaatacaatgtctcacagacttatggaactgaaaagcactccaag

SEQ ID NO: 102754 - DNA, 2087 bp, Homo sapiens
tgaaaactattttcactttatgagcagaatcatagttacacagctgggagggacttctgaggagcgtctggccttgaccactgaagccaagtaggagacctgcttccactgtgctgatcttgggtcctgtcggtgaccaggaagaggatgctctgtgtctggcttgacccctccctttccccagaggttgctagcatgttctgttcatccggggtgtttgcctatggactgcagaagtgtctagcacatgaaccagaggtatggaatgagccctggggaccaaaaatttatgcaaagcacattttatcatcctgccagagtcagcaacaacacctagaagtgagtgggattgtgaacattgtgcatattgtcaaatagcacaaagggagtgttgcaaatattgtagggttgcctgccttgttccttgttagcagaaccccaatttttttggtctgccttctgcaggccaacctgctgatagccctaagctgatgtgtgggtaaatgccaaggatttgttgaggaacagccatgtgatgccattttggcccttgagactaggaggggacgtctgctgggacctcctagggaattaaataagaggagatgcttgacaggctagtctcttctgctggactttactaggtctgcgtgtaaaagccagcttggaacagggccgacactgatgacaggagaggaagacagagggacacgtctctttaagttgctaaattaatgcaccctgaagctgacctatctcaggacttgttatatacgatagaagattaccctcgaaattctctatgacttgcagcattacagttcacagatggaaacttaggctgagtgagatgaggtgaccccctggcaccaagattccactagatgtgatggagatgtgttgagagtcacacttagactccagcccaagcccagacttactctttctaatttgctaagcactggtctttgtgctgaggctggccactccgtcctggagagcttcaggcccatttcctcctcagaaggacagctttcagaaaccacgtggtacagcatgggaccaggagtctggtccctggagcttgtcctctgactgcttctgtagccattctgagtgccttggggcttctaacctggtaggtttctcttgaaatgtgcttggtgagccttttctggcatttgattttcaagagttctctggttgtggggtatcgagaatgttttcagtgagaagcagaagggagaggtctgtgccccagccttggactttgggtcttccccattggctgattggtccaactaggtcatgtgccctctcttgcatcaatcatcgttgcctactggcttacataacgggcagagtggatatctgaataaaactggagttctattagacacctccctgggggagcatatgctcctggaaaacagactttgtctttgctcatgcccttttcccagggccaggaatggtacttggtacacaccatagtagtcactcagtaaatgttgaaggagtgctgagtgctggaagttggtgatggaaagtggctgatggatgggcagctaacagtgtctgttgtccttggctggtagagttgatgtactgcaaataaacttcttgttcatcctggctggctctttctagtggaatctgctggcaattccaatgatgaggggaaacattctgcccaagccttacccaaggagttcatttacatgattctgtcttctagagccttccattttaggaaaggaagtggatgaaacagatagcaaatggttttaaaacactcctggcaaaaagaaaacccatttagattaacatttgttgctcctaaaagcattgtctgcctcgatgcattaacaaacctagggtaggccaattccctgggaggctaccctggcaaaagccactgtggtgaagaccagacagaagggacagcaggccttatttgaggtccagggatagacctacgttggagcagactccaggtctgctgcatcctctaacagaaggtctcacatggaaaaaacagttgataaattcactgctgttttaagagctgaaaatatgtgtgtgtg

SEQ ID NO: 102755 - DNA, 1090 bp, Homo sapiens
gtggtgggaaaggaagttgccagctggaaaggcatgtggagaagcagggccttcctgatgggaaagaccaaggagccacctttgtgttttcagctggggttagggggaggcagaagagtgtggagcaggccaggaacatactagttaataaagatgctgtggcccccaagagggtgtgaggcctggctggggcagcggactctgtctcaagtgcttagtctagaatgtgaatgtattagtctgctcaggctgccattacaaattaccatagactgggtggcttaaacaaaataaatttattttctcacaattctgggggctagaactcctgagatcaaggtaccagcaggcttgttttctgagtctttctccttagcttgcagatggctgccttttccctcacatggtcgtcccaatctgtttcctaattttttatagacaccagttatactggaatagggcccacctaatgacctcattataactttaattatctctttaacgatgctacctccaaatacctccaaatacagtcacattctgaggtatggggttggggggagtgggagggtcgtatgggtaggacttcaccataggaactgtaggggacacaattcagcctgtcacagtacaagcccagtgtacgaatagagccattttccccagtggcttggatcacaacctcagaaaggattttttttttttttttttttttaccaccttagtgcaggtaaaccagggaaacatttcattggaataagaacttaggttgtcttcctagcgtgtggttcacttttttcccttttttaaaaattgtggtggccaggcaccgtggctcacgcctgtaatcccagcactttgggaggcctaggtgggcagatcatctgaggtcagaagttcgagaccagcctgaccaacatggtgaaaccccgtctctactaaaaatacaaaattagctaggtgtagtggcacatgcctgtaatcccagctactcgggaggctgaggaaggagaatcgcttgaatacgggaagtggaggtagtgagtcgagatcacgccactgcactccagcctgggcaagaaaagcgaaa

SEQ ID NO: 102756 - DNA, 2927 bp, Homo sapiens
ggaaatttggacataggaagggccatgtgaggacacagcaagaaggcagccatctgcaagccaaggaaaagggtgtcagaggaaaccaaacctgctgacaccttgatcctgcacttctagcctccaaaactatgaagaataaatttctgttgtttgagccaccctatctttggcattttatatggcagccctagcagactaacataccaaccagcctatcaatgaaatatgagattagaaaaaaggaactcacaagaagataatcctcatgcatcttttctcaggaagctcctaggaggtgttcctcactaaaatgaaggaataaggtagaaataagaaagtcatagaatccaggaaataaggagcccccactaacatgtacggcacctagagaaaggccagtccaggtacggcagggcgaaggcccaggagacacaggtttgtcaaaacagatgaactccatgcaatgcaggctgtgattgaatagaggaagaagccaaacacagctattgacaccaggatgaatggaaggctgtgcggcaaaggaagactaaatgcagctgtgactcaaatttacatgaatgtgaccacataaatactaaacagtgctctattgcaggtataacatgctacagttagtggggagccaggtgcagggatgtgtgttgaacattccagaatcctcttcttcctagggaaaagttgagataatgcctcagactgactagcaataaaagcatgtgaaaaaaaatatgtgcagttttcaaaggtttgggaaaaaacaatccctctttctgctgatggaaggatagcttagtggaatgtttctgagggctggttggtctctatatgttaaaagcattaaaagtgtgtacacactttgacccaggaatttgagctctaaaaaaaatcagagttgtgtgcaaatacattaagctgcttaccacaacaatgtccactggtagaaaactggccctcctacatcatggaattcttttttacagaattcagttctgtagccttgggagtatactagacaggaagtttattggcatgagatttcagaattaagtgggaaaacaattctttaagcatgtacagaaaagtgacctgaaatgtttttgggtgatgaacttacagacttttttttttttttttttttttgaggcagggtcttgctctgttgctctgccatccaggctggagcagtggcacaatcatagctcactatggccctggctcaaaccatcctcccgtctcagcctcccaagtagctgggatcataggcacataccacactgagctatttttggtagagatgggatctcactatgttgcccaggctggtcttgaactcctgggctcaagtgatcctcccacctaggcctcctaaagtgctgggattacaggtgtcagctatcgtgtccagcctgagatatttcttatgagtaatgtggatggtacgtgagtccatagagtaaggcatttattgtaaacctccagggagtttctgaaaatagtatcttctcttcaaacctaggatgaagctggaggcagattcgtcgctttctctggagaaggacagtcattgcgtaaaaagggaagaaagccctaagtgaggactgttggctgattggaaaataataaaagaatcatttgcaacatcttggcttttagttactggcactgacagggacgagcctcatcagagaatactctgttacttaagatttatttagagttacctaagaattattaagtttgacttggaagtggagcagcaggactttgtagttgtatgcttgatttggggaaagacaaagagctgtccctgagggcctgtagatagctgcctcctcacctcttcacgctttcagcttgaggggagctcccactgcctcagcaggagcaattctgcatccctaattctgtcaaaacctatgaaggtgactaaattgtctaacatgaagtgttctttctttttcttcatttatcctttcttttcctacatcaattgcataggtgtcagtctttggcctaaaaaaaggctttaaatagacatgtgttctataagtagtggctgtcccactactgtggctgcaatttaagtatttgacaaagaatgtttctatttttattttacatatttttttcaaaaacaccactcagaagaacctgatctgaatgagtttgcacttttattctcatttcatatggacataactggctccttagtgaacctgttcatagtgaaacaactccatggagaagcaaacatgtgaatgttagaatgaacaaatgctaaagagatgttcctctccttcttccctactccccaactcccaattttaatttattaaatcatccaagcttctgctggcctgtattttttatcagtatttatttggtcttagatcttcactttctataacgtgagatcttttgacatgctaatctgattattttaaatttgttcccatgagccactgtgcctggccccattgggaataattctaagccaagaatttcaagtaaaaacaggcaataactaaagcctaaatctaaatgtttgattaggtactaacacagactggtggttgggcctctgaccataactgaaggcctgttggcaggtgctccgtgttccatctcaccattagaaaagtgtccctctggggcttctcctggagaaagtaggaagaaacaaggctgcctgatccctaggtggcaatggctaagcccagcagggtcccccatgagccagggctaaccctgcttccagacatgggggtcctgccctggtcagggcccctccaacactccagagaggagagaatggtggccccagggtctatccacgtcttcagtgaagagtgtctatgagtgtcatgatgttcagtacttggcctgtggcacaaaccatcatc

SEQ ID NO: 102757 - DNA, 1094 bp, Homo sapiens
ccaagctgttggactgctttagaccaggaaactaattgaaccctttctcccctggaaagcctctttaggtagcctggagctggtttggggtgtgaagccatcaggccacctcttcccctgagctggccttccagctcctggcatgggcaggcgggtgacaggtataccccatctgctgtcttggagggcatgtgagccagtgctttttctgggctggctggtggactccatcccacccatgctcccaagcttcttcagggcgagccagcctggaataggtactggcctttttccttgtagccaaggcttcgtctgctgacctagatccgagccctggactagccgtttgtgacatgtgggtactcggctgcccgttgtgctgtatgctctaaaatgctgcatggggagggccaggcatcagctcctcctgcctgcttagtgctctcaggcctcttccagcagcccatttctcacctcaagccctagtctgacctctctgcctgtcctcctcacatcacctatggcagtgtcctgcctctggctgaggaagccaccccccatccctggccagccttccctcaggcttgcaattgcagcccagtatccttcccctcgctgacaaatttcccacaaaaatctacccagggacagtgcgcctggcctgcgactggctaactctgagccttagaatacttcctgttagaacatcactcctggggatgccagacccccgttaccaaagccagtcacctctgcatccttctgtgcctgcctgtggcatttggtagagtgaccaccctctatttctgcccttactagcctgacaagcagctgtcagcgtgagtgcatggggtcctctgcaagcctatccatagggcccaccactcaggcttcactcatggcctaggcacggcttcccaggcacagcctcggcctcagcatgcctctccctcctcatgagctccctctcatttgtgacacagccctcagcccccttttcccttggctgttaaagtcaccttctcactgccactcccgatgaaacattcttgaagggatgtgatacctgggatttgcttcagggcatctaatgt

SEQ ID NO: 102758 - DNA, 1029 bp, Homo sapiens
atctacagtgtctgtgcatcagaagtactgtagtgtctgtgacaacctaagctatccgattccaaccacaaggtggaggtagcccctgagccagcactggctgtggctatacccagtggaggcctcagctcaaccagtaggtcaacagagctatggagttcacagttctcacgaagaccctgtcattacagaggagagaacaggctccctaaaaaggtcttcctttcaagtcatgctgacccaggagccagacaccaggggtgacccttggcacaggtgtccagaagagactcaggggctgggtcattgaggtgtagctcagatcagtgttgttcaaatcttttaagtgatgggagaaactctttctgtctaaatcttataggaagtcctctaattcataaaatgaggttctctgctttttttggagaaagtgagggggtacagagggactgggagccccagggcactgggagcctctaagtcacaaaatgcagtttgagagtcagtggactgagggacattggagtctctttcacttgcaacaatctcagacccttggctgagcccagtccagtttactgtggaccagctgtatgtcagctccatggctgtgcagctgagaggtggaccgggacagaggtcctggcccctttactgccagtgtgagagtcacccttggtgataggagggagtgcccacccttactgtacctccatgctactctcagaggttctctgtagcttcctgcccaagcttttaacttgatttgctttattagaatttttagggagatctcaaatggaatctgcgttacttcctaacactaagtgtgatttttattggaatatttgtctgaactaacaagctaaattctgctttgatggttgaatccctggacttaagccagcagccttggtttgaatcctggcatcaccacttgtgtgctgtgaggtcttgtgtgctcaccacttgtgtgctgttacttaacctgtgggccttagtttccccatagataaaaggggataatga

SEQ ID NO: 102759 - DNA, 1103 bp, Homo sapiens
tcaaggacccgcaccagcttggtatttataaggaaagaaagtgctatagtgatagagtgtgataaaggacttaatatttaagtacccataaagtatttgctaaaaacttaaacctgtacgatgccattagcctggagaggcacgcagcatagtactgtgaggtctggagagacccaatcacgtgctcgaagtcttggtctgctcctcattagtttcttgagcctgtccacgagacttgggcttgctgagtctcagcgtgctcctggggaaaactgggagccccagggcccaccctgctgtgtcaccatgctaaagcacttagcatgccagcctggccattttttggagtcccttgccacgtgggcctcgccacatgtcagggactgagtgagtttaagcagaacaactcagaggcttagtgatgaaggaaaaggggcctcctcgatatagctactttacaatatcttcctttttttcagtttcattattttattctcataaactgtggagctaatgtagacctattggatattcttcaacctgatgaagacactatattctttgtgtgtgacacccataggccagtcaatgtcgtcaatgtatacaacgatacccaggtactttttgtgctatgccctcaaactgtctgtactttttatgccatgtacaatgtctcacctggtgttcttggtaaggtgtgtgtctgactaccctgtgggactgggaacagcctgaacacaagaacttggtctttgtcatcttttttttttttttttaaggagagtctggagtacactggcacaatcatggctcactgcagcctcaaactcctgggttcaactgacccttcctgcctcagcctccttagtaggtgggactacaggcacatgccaccacgcccagcaaatatttgtttttatttttgttgaaatggagtcttggctgggcgcggtggctcacgcctgtaatcccagcactttgggaggccgaggcaggcggattacgaggtcagaagattgagaccatcctggctaacatggtgaaaccccgtctctactaaaaatacaaaaaattagccaggcatagtgttggacgcttgtagt

SEQ ID NO: 102760 - DNA, 1063 bp, Homo sapiens
cgcatggtagaatataagaaatgttagctctcatccatcctgatgtggaagctggtacaaagtgggtgtgagcttaccttggatcccatagtgctgtgggtgacagcagctagggtggatgaacacagttttgcctggagcaggtgcttgggaagcccctactctttctgcccatggtgtctggagagctgggagccagaaggggtcacagccatcccttgcctccatgcctctcttccgtaggaacaggctgtgctcggggcactggtgtgaccgtgttctctctcaggggtctgggcctactgacttctgccaaattggaaccttcttgggctgtggggataaattcctggtgcatttgctccaccttttgttctctttgtccctgtatcaggagatagtggagcaaaccatgcggaggaggcagcggcgagagtgggaggcccggaggtgagtctgtgcttccagctgctcccagcaccagaagcccacttgcctgggggtctgtggtgccacccatacctctgacttcctgtctcaggataatttattgagtttagaacctttgggccagtggctctgggagtgaacctgtggccgctgcattggagaagagctccaggttgttcgccggtcccatgagtgacaggacagccccaaggtctcccaggtacatgccatccattagagaccatggccctggctctttatttttatcaagtttttccaatgtagatactttgatttacaaattatttataagaagtgctctaaaatgaaaatattggaaaggttattctagcttgaagtgagcatgcagcagcgcccttgaggtgggtcccgggggaagcccttgctggatctctcatggaaggtctcccaggccatccagctgatgttccccctgtttcagctgagggcatgcactcctgccgctgccacaggaggaaggctgccccctcggataaggacaacgtaagacaggtgtggtggctcatgcctgtattcccaacactttgggaggcccaggcaggagaatccaggagagttcaaggctgcagtg

SEQ ID NO: 102761 - DNA, 1079 bp, Homo sapiens
attctgctaaagagtcaataagtggccaggtgttgtggctcatgcctataatcccaatactttgggaagccaaggtggaaggactgcttgagcccaggagtttgagaccaacctggacaacatagtgagactttgtctctattaaaaaatttttttaaaattagctgggtgtagtggcacatgcctgtagccccatctacttaggaggctgagttaggaggatcacttgagcccaggatgtcaaggctgcagtgagctgtgatcacaccactgcacttcagcctgggagacatagcaagaacctgtctcaacaaaaaagaaaaaaccaagagtcaatatgtgaaaacaaatagtaccatgatttaatttgcatttcattgaatactgtcaagtttagcatttttccaaaatatttggcttcctgtactgctacttcctgttgaagacctgcattttatgtcattacagaagagacatcctctttgactacgagcagtatgaatatcatgggacatcggtaagtatgaataggtggaactcactataaagttctgactccaggggtcagtgtcctcaaatgtgaagaagaaacgtagattttagagccacaaaagcctggtttgaatctgagctccatgtcttccccctgtgtgaccttgggcaggtgttgcaagctctctgagccttaaacatctcctcctctgtaaagagaataatcctcatttcagaggtaattattaaaatggtcgtttgcacccaataggtgatcaaagaagagcagcgtttatttttgttcatcaaaaacacagaatgagtttgtaccagtctctgtgcgagaagataaaacgctatagacttataatggcccatcagtgtgtgtcttttacaaaacagaatttagtgtagaaaacctactatgtcaatagtgttgagcagagctcaaggccttaaggagccctagaaaataagtttcaataaaacatcctgtatttagtcttagaatttaatactgggaccttgaactctaagcaccgtatttccagtgtcccttttattgtcaaggttccattgtcctttga

SEQ ID NO: 102762 - DNA, 1073 bp, Homo sapiens
gaagagtaaaaatctatctgttgggtttgaggggatcccttgtccaacctccagcccttgcccaagcctcccctgtgtcagagtcctcctgggccttcaggatcttccctttgttggcttttagtttcctgtcttctgatacttgcacccgctccacctctcatttgcattactgtgggtttatacattttaaaaaattctttcctttcatgtgaaagacaactcaggagggaaagaagataaattcttacccccaaacctcttcctgaaccaggaaccaagcaaactatttgtgactttggtattttaccaagagttcctgacaagcaccaccaaagccatgtgtctgccctgttacaggagtaacctggacaagctgtaccatggcctggaactcgccaagaagcagctgcgagccacccagcagaccattgccagctgcctttgcaccaacctcgtcatctcccaggggcctttcctgtactgctctctcatggaggtcaggcttcccacagagcacaggcgcctggtcacagcaccagtggcttcgtctgaccatctgtctcgcctccgcagggcactccagatgtcatgctgttctctaggccggcatccctaagcctgctcagcaaacacctgctcaagtcctttgtgtgttcggtgaggggccaggcgggtgctgtgggtacaggagggcaggtgcttggagagctccctggatggggagttagatgctggccttggggtgcctgtggctgttgaccagctgcaaggtctaggcacatccattactttttctgagctgtctttttctcagctgacccctaggaaccttccagttctctcaagctctgattcatcactggctgtctaagtcactcagacaagtagggaggggcccttgcagagtgaacagggctggggcttgtgtcctattgttgcaggtcagggaaagcgggatggttgtagcaccgactggcttcccagcaacagcttgtccactaagctgatttcctgtgcctggctttgtcttctgtgtggcctaaccccctctttgcgttggcgtggaacac

SEQ ID NO: 102763 - DNA, 1381 bp, Homo sapiens
agataaactagggacagagcatgggccttgacgtcctctaggctgtgttcaaagatgagcctcctcatttgccagttgtgtgacgtgaggtagatgatctgacctgatcctcagtttcctcatccgtgaaatgggtgaacacatacccactttacaggatccattcatttaccagacatgtattgaacatccaccacctgcccggccctgttgtggagtgactgcccatcctggtgcacatcctgggacacccctcagtcctagacacaccaggaatactggtcacctgggctgtagggtgtgggtgcagcaggcacagcagagaaggaaaccctaaacctttatcctgaaggagcgtgccggcgggggggacgaggagtggcagctgcggttaagatgaggggatgtgctgccaggggatggagcaggatgaggcggggtgggctggggcctcctggagaaggtggcagctgctgcaggacctgaaggaggtgagggagaggatagcagggcaggctccttgcaacaaacagccaaggggcagtggggctaggctggtagacaaggaggctcggggacacagcatcacagccacagtaccatgctgtgggtacgggagggcaggtgtttggagagctccctggactgggagttagacactggccttgggcatctaacttggggtggctgggtggggaccaaggcgtctcctggtgacagcgtccctggaggctttggggagtggagtgactgggcgctgttgggctctgggctctgagtgttgagctggggcccaccataccctgacggagggtgctctccgactccatagacaaagaaccggcgctgcaaactgctgcccctggtgatggctgcccccctgagcatggagcatggcacagtgaccgtggtgggcatccccccagagaccgacagctcggacaggaagaagtgagcagcttccactcgtcctgggactggagggtcgggggtgttggggttatcagcttattagccctgctgagtagagtggtatttgcctctagtgtctgtcctggggcggggggtgggaagggtccattgcaggccgcctggcccccgacatgtcttgtgtgtcagcagcttttttgggagggcgtttgagaaggcagcggaaagcaccagctcccggatgctgcacaaccattttgacctctcaggtgagagtctcctgccactctgccacactttcccacctgaccctttgaggctattgcaggccctggaaccaagcaagttggcatggctggaggagcctggccagcagccctcttgaccttccagatctggccctgggacaggctactcctggtggctcagggagctctggtgaacctcaggc

SEQ ID NO: 102764 - DNA, 1051 bp, Homo sapiens
ctgatatagcggggccatttcacaaagtgggtgaggtctcttttgggctggatgtcctgtccgatgccaaaattcttaggccttttctcaaacaggggattcaccactttcttagcctcctgcttcttcatgacagcaggggccagagccaccttctttcccttggccttctttccttttggcatcttgggtggtgggagagagctcctttcattttttgaacatagttaaggagtttctttaaagtctttatctgatatgttcaacatctctgccattttggggtcagtttctattaactgctttttccccttgactatgggtcatatattcctgcttcttagcatgtctactaatttgctgtttgtgtgccagacatggtaaatgatacatgctgaatctctgggttctgttattttgctctgaagagtgtttgctttcattctggtatggagttcagttactgactgttcaccttgagcttgtgcaggcttggcttttggctttgttagggcaggtctgtggaaagttcattcccaggcttgtttagtggggtggacctcaacttccaaactctgcctctcctgcagaccttttcagggcttggtttctagttttgttctggtagatctagggtaggccatactctaagatagaatcctattcctgaagtgaagccgttctggtagctcagctggtctcaggctgtcacacagtcttcacattcaggctgactggacccccggcactgttgacctcttgaacttgttctgtttaactgtgcagctctggtaagccctgtggagtccaccgtgagcatgcgcagtccagccctcacacaagactcatagggaccccctcagacaatcttcagctccctctgttcctttgccttgccccatggatttcagccctctggctactgcagattatgatctctgcctcctcagcttaatgtgaccactatgttctgcctggacttcatgctcatggcattgtctccaggcagagagctgtgggggcatttgggaggcccacctcatcagctgcc

SEQ ID NO: 102765 - DNA, 2312 bp, Homo sapiens
cctgccagcaaattcctgtcaagagggccctgagcaggccccagtggcttccagtgaggcccatggcgtgtggcctgttgttccctctctaccactgacttagggcagaggtcacaggagagaaatgggtgacgatggcatcaaatcagcctcctgttcttcccagccgccagttccttccctgggccactgtgttctggtccctgagagctggggaggggctcctgggtctgcaagcacaggcggcgaaccccacacgcatgacaggtacatgccagcatcccctcacggccctgcgcagcaggtgctggacttgacggccccgcgcagcaggtgctggccttgacagcccctcagccgggtcacagggagccaagtggggaggtaggggctggtgtggagggaggggaggcagcgccaaggccgggtgctctggacactgaggccagcctgggcttgcggttgccaaccaatggctgtgtgtcgtgctgcagcacattcagctgcttgtgtgtgcacaggcaggataccgccgagacccccagagccaaggtctgccaggcaagagaggtagaggacaggcagagcgtctgggatgtgctgggactgtgctggttacagtgcgcggtgggaggggaggggccatgagaggggtcagggctgcaggccttggtaagtccgtgaaccagggggccccgggccctggagaggccttgaaagggcaggatgatgggcttgcaggggcttggccttgagagacaagctggtgttgaggtaggacggcgaggtggctgagggcatggcaaggcgcctacctcactggccaggagcctagagcagtgttgggggcgcaggcggtggtatcccaggccagggtgagggctgcgctagctgtgggttgtttggtggcatctcctcgccaggcgaggctcctcccacccctcctggggaaagaatctgggtcttgaatgggtgcctgatgtcactaaatgatctcactgcatctctccaactcatacaggttttcttcttgaatctgttcattgcattgttggagttttcttaaacattaaaacaactaaaatcctcagtctgtccctgaatctcagggaaaagtcttgaaatcaccgcctgcacccccaccccccctcccgtgtgtgacatgtgctccgcccactctgctgggctgggccagaactgcccagggccacagacggacctgggcctccctctcccaccacctgcctagtgacaggagccccaggctcagggagctggtggggagcgttccctcttctcccgatggatggacacatttgggcggtggaggtggggggtcgtgagtgactgtaggttggtcttcgcctgcaccattactgggcagttattttctctgcccaggttgttttctttgtggactaatttaggtttcctgatttggggaatttttctaggaatttgtctgtgggcatacaaatcctgaaggttgtattcctagtgaccttttttggactgcttgtgatgattgtttaaatttctgccgcattcaaagctccgtccctgctttattcctgatcagtcttgtatgcgtttgtccttgagcatttctatctttctgttcattgtttctgtccttgccatgctctccctccatcccatgtcccctgggttgcatctgctgccctgcctggggtcaggtgcacagcccatcggcactcagccttcccttgccagccccacatggagcctgtttccagaggtgactgtccagctgggctccctggtgcaagaagacattgtcttcctccccccacttccaggcagaccccatttttattattttttccccatattcctcatttgacacaaagaccccatttttatttgttctctggctgctgagttaattagaatgtttttatggttctgaatgtttgatttttttccccagttattttttagttttcaatttctaacttaattaacattgtggtctgggaacaaggtctgaatgatattagttctttgaaatgcggggccgtccagttttcataagcattgcacatgtgccagggaggcagtgctggttgtcagatgccccgctgcacacgtgggcgccaggcccgtgtgtccactgattcttagccctttaagtcatcctgcaggtcaccatggtccccagcaggcgcagagaggcctgtcctgttcccttttgctgggggcctgtctgtatttgctttatgcactttgaagctggcctgggaacatgccagtttaaaatggtgatttcctggtgaatgaggtcttttctt

SEQ ID NO: 102766 - DNA, 1064 bp, Homo sapiens
gttctgagcagctagaagctgagctgctctgggcgctgggaggcagagccactctgggtgctgggtctgcatgtctggaaggggcgtctcccttgcactccctccctcctcctcaagcctggcagggatcctgcagggctgcccccatggggtccagtgttcacttggcactggcttgtccttcaccagcctgacagcaaagcgctgaagacccagacagcttccctgagagcccccggagggctcttctctgcagtttccacctctgtgcccaggaccccaggaaggggccctcctgccgtcctggcccagatctgcctcgtctctcctggtgtgtttgggaaacagctgctggaacttaggactgtaatttatggggcatgttccagtccagagatgaacttgaccggattgatgaattgaaaagttaaagcaaaagggggaccaggtattaatgaattggaaagtgagagcagaagggagaaccaggaacagggagtggttggcgtggctgtggcgtgctgggcagggcatcggcccatggtgcacatcgaaggagaggcgtttcccctgctgagccctgtgttgcatgggccaggaggaggcctgggaggggacaggcgactccaggaacaggggacagggagccggagaggctgatgcgccaccctctgcccaatgtcacatcttaacgttgatcctagaggccctggagattgcaggttctgtaaagccccagcctcagggaaagcctgtgggggcgctttcggaggtgagctgcctgagagcgttcttgccacccgggagcaagcaaggtgaccgaaggtcctcagcacccacaggtgtcctcacccaccgcctgcactgtgactccttggctgagagccacgtgggcacggctgtgtccccctcacaccctcctgccgaagcctctgatgagcccagatcagtctccccccggcgggtgctgggagtagagacgcgaatgaggttcctggagcagagcatgggtaatcggaaccagatggtggcttcgccgcaccacgcattcctggcacctgagg

SEQ ID NO: 102767 - DNA, 1047 bp, Homo sapiens
ccaggcaggtggcatgtgggggccgggcttcggctggcaccgcccaaggccgccgtgctgtctgtgtgtgtgcttctctgtgctgtgtgtgcacatacgtgagtgcctgtgcctgagtgtctgagtctgcgtgtgtgtatgtgtatgtaggtatgagtgtgtgcctgtgtgtgtgcatgtgtgtgtgtgcacatatgggtgtgtgaacatgtatgtgtaggcatgtgtcctatgtgtgggttttgcatgtgtctgtgtgcaccatgtgcatgtgtgtgtatgtgtgagcatagcgtgtgtctaatgtgtgttcgtgcctggactgcacaggggagcctgtgtagaggtgacctgtcaggctctgcttcctggactggagtcatgggagggaccctccatcctggactcggtgctttcctgctaggtggaggtgcttttgccgggtctgcattctttggctcctcttggagctgggccctgccttcctgtccccctggctagcttgcctttcttacctggcaggcatagcacaaacaggcagtggcttctgagaactgtcctccaagccagcccgctgagggcagctgttccagcccccggcctggctgcgtcttcaggagtcttggagtcttccccatcacaggctggagcaggggccgtgggtcttgggagcagtgtggggtctggtccctctgcctcccctggaagccacccttaagtttgggcatgatcagttggctttcagccaaaggtgagagaggacgaaacctctctcatccccctcaaaaaagaaaaggaaaaatgggacttggcagttagtaaaggatatcccagggaactccgcattgtcttcggaaccccttgagagaggcagggttgggaggtagagtggctgcccgaggtctctcgccaggcagggtggacctgcgccctggagtcactgcccggcccctcccaggcctcctgccctcccccatgccgcccgcttgggcactggctgctgtccaccctccactctgcaggacaccttggcaggggcatttctca

SEQ ID NO: 102768 - DNA, 1034 bp, Homo sapiens
gacagatgatgaccaagctgctttcctgctgggggaaggaggcattccccctgggttgtttttctcttctggcccccacacactggcagacccgaaggcagggtgctcaggagctgcagagcctggcagggtttgctggacatgctcagggacgggccatggtgctggctctgctttctaatcatggtgtcagtccttcacttcccttggaaatacccagagattttatttcctgaagataggacatgatgggtgctgtgagatggtatttaaagtacctgtctgcaaggaaaactttaaaataggaagtactaaggataaggtcctatgggatattggaatattttataaagccacaatagttaaagcacttagatgtggacagatgagcagagaatagaggactttgaaacgggccaaataaatatggaaatttagtacaggctagaggtgtttccaattaacgagtaaaatggattattcagtaaaagcagttggccctctggaaaatagtaaagccatgtatgtgcctcactctttatgccagtacatattccagattaaagatttcaatgttacaattatgaaagtactagaggaaaatatgggtgaatttttttttttttttttttttgcctatgattccaggattttaaaagttttagatgcccagagttgtggaggtatggagaagtggaccttctcatactgttggtgggaatacacaataatataatttgaccacgtaacaattctaggcacatgcatgctgtgactacttgctaggtgcatgaaggctcttgccaggggtggtcatggttcggtaccactacatgggggtttagagcagggactggaggttggccttgcctcctcccctccccgcatgagctgagggtccttacctgacctttttgagctgtgaccagagtttttcctcatggggtggttagaagggttgaatgagaatgatgcccatgcagtgccttggctggggtctgggccctctaacacccacctcatgggtgtcactg

SEQ ID NO: 102769 - DNA, 1041 bp, Homo sapiens
gctgggatgctctgctgtggctgggatggggactgtggaaaggtggtgtttgtgggtgggggtggcattgcctgcaggtggcactcagttgtgagaggtgaatttggaaagcatgtggggtcaggagggagcagagaatagcaggctcactgctctgtcggggaagcaggtaggacctgctgtgtgcctggtgctgggatgtaaaagagcctaatgacgacgcggtctgtgcgttgttcagagtttttggggcggctagagcctactcagcagacaaatgtagtttataatcgcgtgctgtatagtagttaagcctctggtctctccagccagtttttgctgcttccaccacttatgggttagtgtgtggctgcagacaagttacttcaccactgtgtgcctcaaagacaatgctagtaccaacctcctgtgggggaggtggcacaaatggggcactcagtgaaaggttactactattgctatcctgaaattcctgacagttctgatctggccccttttcttctgaaattgacagcatctgtcattctgccttgcccttgcaatgtcataggcagcatttgcccacctcagacctcccaggccagccccctgggcccctccttccattcaaagctcctagttgggtaccagagggttgcccgcttgtagcctcttcccaccagtccagtgggtgatggttaggcctagttcctgctcttccccaccttgtctttggacagattgcctcggatgatggcctgcgactgacagtctctcagctcttctcagctctcctgaggctgcagctgtcagctccctgatcctcagcacttgcctggaccagtgcgggtctgccacgccctgttcagccatccctgtcctgttgtgtcgtgcaagccacatctgtccacacccccaccacccaccagtgctggctctcctctcttctcccctgtgctcccagcatgcctcgtggccggtgccgtcagcagggccctcgcattcccatctgggcagccgccaattatgccaacgcacatc

SEQ ID NO: 102770 - DNA, 1037 bp, Homo sapiens
ctgcatggcggttgctggggggcgggcggtgcagtcgtctgcactcagcttgctttaaggctttgggcaggttttgttcttggggctcctgggtctccccagagcagagaacggctccagcgttccaggtgctgcctttggccttgtgggggcaaacacacatgcgccgtggtacctgcccctttaggatagtgctgtccagtctagaagggccgaaagtcttctatgccaggcagtgtggggagaaaagtagggggaccaacagactgataggcgtgggagggctaaggttctcaaaatggtgagagtgcggcccagggttaggaaggctcaggcccaaagcaggcctggctggctggtgcagggaagccttctcccagactgcaggggacacaggtgcgcaggtgagtgggcagggtaggggactgggaagaagggaaggcagagatctgggtagcacactgtggctcccgggcatggggtgtggtcattgtgggcaacctggatacctaaccttggctggtggtgggagctgggccctggatcggggtcactgcttttttagagctcagtgagggactggactggactcgactcacgtccaggccttagtataatcctgcagtaaggtgggaagccagggtcatgggctgggctttcaggtgaagaccccccccccagaggggggtcagacctgagggattccagagtgtttgggtggtggaggtagggccagtggccctggcaggttctagtgctgcaggccaccctgggaggtacctggaggaactcaccctgaggggggatggccagcagataggagatgtgggatgaaggtgtgtgcaggccttgtgctcccagtgagccggtggcgtttgtgtgtggggtgaagcagagagtttcctggaggtcgtgagtgggcctccgtttgcagagagactggggagggggctagatagagttaggctgcagagtgtaagagccctacaggagggctccttgcactggaatagaactggctactggctctggagcct

SEQ ID NO: 102771 - DNA, 1037 bp, Homo sapiens; identical to SEQ ID NO: 102770

SEQ ID NO: 102772 - DNA, 1953 bp, Homo sapiens
acaggactgccagaggcacacacctgctctgtctacccgagggcaccagagggcacgagaaggctggctccctggcgctgacacgtcaggcaactgaggcacaaggctggcatttctgaaccttgcccctctgcaaacacaagggggcgatggtggcactccaagcaaaggggcgtgtgggtgctgcaggaggagcacagagcactggcgcccctcccctcccgccctgcagatgccggaggccccgcctctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcagcatgcggagcccgggaacgcacagagcgtgctggaggccattgacacctactgcgagcagaaggagtgggccatgaacgtgggcgacaagaaaggtggggtccgggccagcaggtgctcagctctgggacagggacccaggaccaggcatcaaagcccttacaggagaagctgttatcaccccatttccagggggctgggaaccctgggatatgcccagatagggctggggggctcctctggagtcccagggtgccagggtccctgatgacccctgcaggccctgctgcctgctgccccaggacaacaggcccccacactcacagggtctgacggtggtgcagttccccttgaactctgttctggccaccatgggacctgcctggggaccagtcagacaggttctcctgggcccgcctcccgcttgaacttcagcctggggcacaggatgtgttaccgggctcacggagtgactcagggaactagtgccgccccagggccccaaggtgggcggttcggtgattcagagagggcagctctgtgttaggacacactggggccagccaggaagggtggaaaagatagggaccagcgtgagcatagaggctaagggaccatgggagctccaagcgcgctcacagtggggaccaggtcctgggggctggggacaccagggaggtgaaatacccctccagcgggtagggagggtgggcagaggagggccagcggccaggcatttgggaggggctcctgctctttgggagaggtggggggccgtgcctggggatccaagttcccctctctccacctgtgctcacctctcctccgtccccaaccctgcacaggcaagatcgtggacgccgtgattcaggagcaccagccctccgtgctgctggagctgggggcctactgtggctactcagctgtgcgcatggcccgcctgctgtcaccaggggcgaggctcatcaccatcgagatcaaccccgactgtgccgccatcacccagcggatggtggatttcgctggcgtgaaggacaaggtgtgcatgcctgacccgttgtcagacctggaaaaagggccggctgtgggcagggagggcatgcgcactttgtcctccccaccaggtgttcacaccacgttcactgaaaacccactatcaccaggcccctcagtgcttcccagcctggggctgaggaaagacccccccagcagctcagtgagggtctcacagctctgggtaaactgccaaggtggcaccaggaggggcagggacagagtggggccttgtcatcccagaaccctaaagaaaactgatgaatgcttgtatgggtgtgtaaagatggcctcctgtctgtgtgggcgtgggcactgacaggcgctgttgtataggtgtgtagggatggcctcctgtctgtgaggacgtgggcactgacaggcgctgttccaggtcacccttgtggttggagcgtcccaggacatcatcccccagctgaagaagaagtatgatgtggacacactggacatggt

SEQ ID NO: 102773 - DNA, 1058 bp, Homo sapiens
accacgcctgtgcctagcccctggggccaggtttccactttctgcccagcgtgactcctgcaggaaaggactgtacaagacttgggtgccaccttcagaacatgggccccgtgaggacagggacctttctctcatcaactcctgtatccatctcaggagtatccatcccttagaacagcatgtggcacacagtaggtgctcaataaatgctagctgggtgagtggaaacaatggggccctcaacacccagtgccaggaactcaggcctatgagggagaggcacccaaggagaggggttgctggtatggtccctggagacaatattggcctgaccagggtgaccctgcagggctgaggtggggcagacctcccatcaacaagcctgccccttggggtcagttctggacatccccaagctcctgcatttgcagaccccccatcttcaccagtgcctgggccctgggaggacacagagttcctctgcctgggttctgtgcagaaggaaggagttgttactggacacgcagccatagggcatggcccgtggggtccactatcgggagaaacctcataggatgcttgcctatctatgctatcagaaaagggtttgcttacatcacataaacaagaaaccttgagaggaagtgtttgcctatggggaggaaggacctaccagggcaagggacaccccagtcaccttgtcttggaaatttgacttagtcaccaaacaaaagttaacaagcaatctcaaacatctaaagtataataaaatcaatttgcaggcaggtgccttgaaacactggtatccgaccccacatgcctctgggatgggcctggagagtcccacagggcttgcagctgtcctggtggtgggtggcggtcgtttccagcctgtatgctgcagagaaagcagggggctttcatgtgacagtatggacaccacacggctgcaaggtcagtgaggtcaggggacagccccaaggtccggagttgagcaggaagtaccaccatgaatcatgatgtgttttcatttagaaaaaaaaaaaaatgtcctagca

SEQ ID NO: 102774 - DNA, 1064 bp, Homo sapiens
ttggcctccagtccagcagcccagtggcccattcccggaaagaccaggcagaggtcagagagggagggtgctccctgggcccacagccctgtcccaggcactgtgggatcaggggcctgaggaaatgggaccagagtagggatgggcaccataccctccaacgcccttcggggaccagcaagtcaggatcagccctggtgccaagacccttggggtcagcccacaccacccagggcagatgcttctatccacatctccatccatgtagcctgtggagttggctgccctgccctgaggttacacgtggtcctgtgccactcagtggctgcagcgtccaccatcccctttccctctgcagggcccaggcccagcctcttgttcttagggcttggatcgtggaagaagggccaccctgagcagatcgtgccgtggagcttggagccccctggcggcaggggttggcagcgcctcgccccagccaagcctgactttggggacaccctcctgcccccccaccccactccccccatcctacctaactccctaggcctgagttagctgtttactgacatggtgctgtgtgtgagcgagtgacagaaggcccgaggaggccgactgggctgctggggcagggcccagggaggtggcagggaagggtgcctggctgggctttggggctggtgggataggagggtgcccctgggaacacagtgccccagtggtgcgggccaggtctggcgccaggggcaggcagctaggcagggagggggctgggaaagaacttggacttctaaaggcggagggtctccctgggcaccctgcaggcaggcagaccacggtgtggggggtgccccacaaggcccagccctgggcaaggaagctttggaagcagcaaggtgggggtcaggctacaggtgccccacctccccagagccctgcagtcacgtgaggcccctgtgcagtagagagcctttctccagcccatgctggctggggccggggctgccgcatctgcctggagcctgggcagcacctccgggactgaccttcggcagtggctgggg

SEQ ID NO: 102775 - DNA, 1048 bp, Homo sapiens
gattctgggtgaccgtgggtggcggttgccctgcacctaggctttgagctgctgtaccagcccgaggtggtacgtctctacctctccctcctcacggagagccggaacttcaacaccctggaggctgccgccggcgctctgcagaacctcagtgccggcaactggatggtgagggaccaggtcgggcagggtgggcaagtcctgagagagggaatcccaggcacctcactggtgcagctcctgcctcggctggcggggaaaggaggggccacaccaccaccccaggatccaagaggtgtatgggctgcgggcaatgcgtgcaccctggacggtgggaaaacctcggtggaggtgccgttgagcttttggggtagggctttgtcgggcacgggagcaggaaggtccagctggagagagcggtcagcgtctggaggtgggagagtgcctggcatgtatgtctgagcaaccctctccccgcctccgcagtgggccacgtacatccgcgccacagtgcgcaaagagcgcgggctgccggtgcttgtggaactgctgcagtctgagaccgacaaggtggtgcgcgccgtcgccatcgctctgcgcaacctctcgctggaccggcgcaacaaagacctcatcggtgaggacgcctgcaaagcccacgcctgggcaccgaactgtgcctgcagctttggggtcccatcggaggggcttggaggatgagtggtttgggagtccaggccccggccctctcgcttgggcgctgtcccaactggaggtagctccagtccccccggccctgtctctgaagctcagcgccctgctcacaggggctcctgtgaccgcctgcacacaggcggtctccaggggctctcctggcagtgcccctcgccctcgcgggatccctgctccttcctggagaggtggggcagaggtgtgttctgacacctagtcctgcccctcagggagctacgccatggctgagcttgtgcggaatgtgcgcaatgcacaggctccgccgcgaccgggggcctgcctggaggaagacacc

SEQ ID NO: 102776 - DNA, 1395 bp, Homo sapiens
caagggtcccatgagggtgagcagggcagggaccccaggtcatctggctccactctgctgccttctgaaggggtagaagcatcatctgacatggggagagtggttgacagtgggctcactgtcacagacgtgtgcaagccagggctacacaaatgttaggtgggctgctgtggggtttctcctggctagtagatcctgggacaatgtcctgaccccagctgggggagtttccccctagttctgccttactgtgtgacccaagtgagtcttgtcctggtcagccttcagtttcttggcttgtatccacctaccatccagccagggctcctggcttccctcagtctacatacctggcagttgcaagggagccaccgggagggtctgtggtacagctcccagcacctggtgggagatgagtcctaggggcagggctgggacatccccaggccccactgccaccaactcctacccctaggctaaactgtctgcccaaactctgacaacggtgctccactcccacaggtgcccaggcctggacatgggggtgccttttggggcctgggtaggagagaactgtgcccaactctcctgatacacccattccccatatggggtctgcctcacctcccaccacctttcccttccaggaaagaaggatggtgagatggaccggaactttgacacgctagacctgcccaagcgaactgaggccgccaaaggtgagtgggctgagatgaagccagctccactgggggatgtctgggctcaggattgccctggtagtgaagctttgagccatcaagcaggcctggagggcctcagggaacagatggggaaacaggcccctaggtgcaggatttcctggagggtgattcagcaccaggacacctgctgagggtttagaatgggaggaagtgccatgggtcatgtcaggcaaggttgggggagacaggcacagagaggccgagggcttgctcggcctcacggtgcgtaagaggtgggaaggtttggagggacgcctccagtggaggcagggcctcctgtgttagccacaaagctgagttatctgagggggctgggagccaggcgggcatgctcacatccaggttcagaggctgggccagacgaacacctgcagggacagggcagtgcctattgggctgtatgctgggatctggcttgagagagaggtctgtcctggtggggcctagccagttggaagagcctgcatgtcaccagggtggagggctccagccgcaggagggctgtgggggagtattacaggcagagcagggctgatgcagataccccagcggggagtgtgcttggagtgtgttggagcagaaagcccagcagggcaggagtagagggagcatggggcatgaggactggcga

SEQ ID NO: 102777 - DNA, 2233 bp, Homo sapiens
cctcctcccctttggggctccttcctagctggaaaccagtactgggtgtcccccggaaccactcacggcttttgttacttcctactgttctgcatgagctgggacatgaggagagtgggacaggtcctgagcgtggccacctggggaggtaggcaggcggtgcatatggtcagcacagattggccaatcgcaccccacaggcaccctgtggaacctgtcatcctatgagcccctgaagatggtcatcattgaccatggcctgcagacgctgacccacgaggtgatcgtgccccactcaggatgggagcgtgagcccaacgaggactccaagccacgggacgccgagtggacaactgtcttcaagaacacgtcgggctgcctgaggtgtggaccagacctggtgctaaagcccacatgcacaccaggccccgtcctcgtggtcccagatagtgtggaagatggcggcgagcttaggagcgccagagcttaggagcttcagagctgtggcacaagtcctgtggatgagaagtggggcctgatggagctgtcctcacccccaagtggtgtcccagtcttcccaggggcaccctctggaggggtctctgtggtaccgtagccctgcccagctctcacctaccttcccatcacttgacagccagagggggagctgggaccttcctgttcatctgcctgggaggctcatcccagccacctgtgacctctgcccttcccctcctacccctgggaggccctgctgaccccacagagtcctgggtccccacagtcctgcttgtccatcagggtgttcccgcgcagccctgcaggctcttgaccttggggtaaggtggggcccagagctgccattggggtggcgagggacccagaattgcccttgcacaggttcaggtctctctgagagtgcacctgtccctttccaggtcagctgggaggcagggaaaccctgtctttccctgcccagctatccccagccaagatagttgtctgccagggctcccctcctgaggcctgggggcagttagcttctcccccttcactgagctccagactgtggggtcctttcccattagtgctaggagggcagcagcagggcctattttgcagatgaagacaagcccacaaggccagggtggagccagggagtttctggtagccaggggtcacctggcctgctcttggccacacaggaatgtgagctccgatggtgctgaggcccggcggcgactccgggagtgtgaagggctggtggacgcgctcctgcatgccctgcagtcggctgtgggccggaaggacactgacaacaaggtgggcagggacggtcacagcctcataccaagggctggagagacgatcatgcaggtcccaggaggctggaactgtgggagcagcacaggggaatgggcttgtgggtctggggtggcgttctgggtgtggcccgcctcgcagtgaccacactgaagtgggcaccgtcctgcaggcagaaggtgtgccgtgagggcagaggcttcctcccatggacccttcctggcggttaccgcccttttgctcccctccactgaggactccctgttcctttgctcccggtgccctcatgcacaccagctgtggccagtctttcctgagggccagccctgtgcctagggtgccctgccccacccactcacctctccctgcagtcggtggagaactgcgtgtgcatcatgcggaacctgtcctaccacgtgcacaaggaggtgcccggggccgacaggtaccaggaggccgagcccgggcccctgggcagtgctgtaggctcccagcgccggaggcgggatgatgccagctgctttggaggcaagaaggccaaaggtgggtggggcggactggggtatcatctctaccatctcaactcctgccccagcggaaggctctctgtacacccacagcagcccatcatggaggctagaggacacctggtcagcccccaacaggcaggcagggaagccaggagtcaaggaggctggactgccctgggtcacatggttgatgggacccaggtccaaccttccccatctacactgtgggacccccagggagtacacaagggaaaccaaccaatgcccagacccagtctttctactccggggagagttccacttgcccatgagttgggaaggagccatggctgctgcctgctcactgttcacagaatagctgtagactgccaccaacctgt

SEQ ID NO: 102778 - DNA, 2226 bp, Homo sapiens
ggctgcggcggtcggtcggtgaggctttcccggctgtggtttggctgcgggcggcttgggcagcccgcgggcgcctcaggtaggtgcggggcgcgaggggcgcccgcgggcggttgggcgggcgccgcggcctgcgcgagggcgcgcccttccctcccgcctccctccgggaccgaggccgcgggcggggcgggggcgcggagcccggcctttgtgaggcaacatggccgcgggcggtggagagcgcggggtggggacgcctccggggctggggggcgggccccgggcccaggcgttgccgactctcgtcgctgtccgcccgggtaaagaggctcctctcccggagggcccgaagcctagcatcgccttcaggcgggaaaggtgtggacagggccagtgctcgcctgggaccctgccggctttaacacagtttgggaaatccaagaagtcgcctaagtctttttgtccacagaatgctcacgggttgagtgtcacgtagataattgggatacggttttattgtaacaatgagcatggcggaaataaatggaaggtggcaacctgttgacagtgatgcctgtctggtgtcaaccgatggacttgggtttcttgtggcaggagtctgatttgcctttttgcatgcttgcatgtaccttgttcctgcacggcagtcctgtctttggctgtcgactgttcgaggccaaccaccaggcgaggatccactgtttcctggccagactagactcccagctgtgggagtggcccaaaccctgctgcaggccttcactcacaaaagggagtgaatggccagcccggggtacccagtgttgcctctaagtgcgggatatgaggcctgttggaggatgacaaaaggaacggatgaggtcatactgccgctgggttgggcgggaggctgcagcgggagagacttgaccaaaaggcagcctccatggcgctggcactggtgctggcccgtcacagccagtgcctctgttagccaacacagcaagtgggctaggaggaagggtgctgtccaagtgtacgggttttctccccgtgccaagggtccaggggagcttgccgtgagcccgttcctgtccgatagtcctgttggcaaggcagggtttgcatgcggtgtttggtcagctggagcagtggggaggcctacgggcagagagctcccctttgagccctttgcggccaggcgctgtgtggagcacttcccaggggttgttttgtagtctcaccgtgaccttggggtaggaaatgtgcttctggctggcttgcccagtcttagactctcttgttgtagccctctcctttgtgatgtcacccagcctcctgactttaatgccagctttccttgacatcttcacagctccagccctggcctctcttctgatttccagcctggtgtttctggccacctcttccatatctccatgtgttactttggcgccaagtagccatatccaaaccaaactcaaatcttcacccatgccaaaacattccttggcctatctaaagtccctttgattcctctctttcttacaccttcatgcagtcctaaggaggccccgtcagctcacctatttctaagcacagaccatttctcaccaccttcaagttaacatcctggcccagcctacctggtgagcctctaattctctttactgtcaccttaggtcctcactccccatccaccatctatagtttttctggacacagagtgattcttctttctttctttttttttttttttgtttttttgagacagaatctcgctctgtcgcccagactggagtgcagtggcgtgatctcagctcactgcaacttctgcctcccgggttcaagcgattctcctgcctcagcctcccaagtagctgggactgcaggcgtccaccaccaccacgcccggctgatttttgtatttttagtagagacggggtttcaccatgttggccaggctggtctcgaactcctggcctcaaatgatctgcctgcctcagccttccagagcgctgggattacaggcgtgagccactgtgcctggccacagagtgattctttttatttttttgagacagagtctcgctttgttgctcaggctggagtgcagtggtgcgatctcccgctcactgtaagcttcgcctcctgggttcaagccattctcctgcctcagcctcccgagtagctgggactataggcgcccaccaccacactcgg

SEQ ID NO: 102779 - DNA, 4569 bp, Homo sapiens
tcctgaccccagccctctgcttttcctctcagtgtcacctggaacatcccctcctcccagccctgtaacccacctggctcactcctgccttcacgtggatgcaggccatgaggccttcttggatcccccttcctaaaactgcctccccttcttcaggcgctttccttgttttgtttttgcttgaatacttcttggcatgtgacagggtgcatgcttttcttagttgttagcggtccatctcccccactaaaatgtgagctctgtagggcagggttttgtccaccttgtgtctgtagcatctaggatggtgtgtgtgtgtgtgatgaatggagaaagcttatagaggggaggaaggaacttgcccaggactgcccaccactgaggtctggggctgggcaggtttcctgctttcctaaggagctcactcacttgtaaggcaccaggctttcctgctgtgcatttcttcagtgccgccgcttggccccattagcacctttgcttggaacgtctactctagctgcttcttcgccttctgtggtagcaggcttccccattccgtcccactgttggtctctaatcccctgctccttgtggcttcttcatgtagctttttgtgtcccagaatcatggattgactcaccagggtctctatgggactgccaggttctgaggtgtgtggccctggtcttccttgtaatctgtggcactgggcgcattgacccctcggtctgttttctctaatggtctttcttggttgccaggagactgacctcaccccgcttagtgttcctcatgcctgcctggttgctgcccacagcctcttgagcgtcttcagcactttatagtcagttgttagctctgtgctgtgtttcctggatcctcagcacctttgatggacacatctttgggaacatacggtgtgaaattcccattagattcagaaatgttaggacatcttagaatccaggaaatggggtgacagtgcagtggtcattgacctgccagtgtgtccaggccctgtgaccttgtctcttgtccatatagtgcgttcctcggagtagatggccagtggatagttgttaaatgtattgattaaacctaaactagtctctggttttcatgttgtgtccccttcgaagtacatccaccatgccttgtcccttgttaaatgtgtgatgtctgcatctcctgttctttccgggaatcttgggaggatgttaggtcatgcagtgcggtttgcatgtgtgcatctttactggtatgcacgcatgtgcatgcatgcgtgttcctgtgcacgttgtgggagtgtgcatgtgcgtgtgtctgcatgtgttccttctgctctgatgcagggttttctggctgccccctcagacccatcttccctgcttcatgttgtccctttcttcatgcttcctctgtagtaaggcttcctagagttgcatccttaaccctcatctctgggtggccttcctcctgtgggtttggcgactacctcctcagtgcgtcctggccttccgtatctggaccagtcatggctccagagttgtggcctcggcaccttcagagcctgcctggaggtcccctctgttctcctcgccaggctcctgcctgcatgctggaatttgggtgtccttccttgtctttagttccctcttttctctgctatccacctccgttgggtcaacaagtgcggtcagttctgtgacactgttcttggcccattgccagggcctctttcacacctttgtcctctggcctggaggactgtccccgtgccttggatgcagttgcttctgcctggcacagctgtgggtctcccctctcaagtaggaacctacttgtggcatgagagtcgcttcaccttcagtggctccttattgtccccagggcggaacgggctgcaggtggcacccaggcctctctgtgcctcggctccagctgtctcttgtggctccccaccccaaatcctggcaggtcccttccccacagccacccacccctctcctccatcgggaacagaactatgctgccacctctggtgacctcagcacgctgcatcactgtccccgtccacgtgctaccctgtgggcccaggagagccctggggtccctgggtagcagagcgcctggccatgcctctgaggcccctagtgccgcagagttgagctgagggtctcgcgctcgccctctgactgacccagcccttgcaggtgagtggattgctgtgctctggtggcctgagggaggccacgcgccttctgtgtgttccagaaagggtgcctcccactgcatgcttgcttatctgagttagaagaatgctgtggtggagtttagtgtaaatttttaaaatattttttgagccttatgattatatagtttttgtgtttctgaagtaggaattaaagtgggcattaacaaaatatttaactttggacttaagttataattcaggttctgaagaataaaagtaaggttagtttgttttgatgcctaaaaagtcctcttagggaatattattttgaagccctttactatgctgttaatagtgcttggcttttaacttggtaccagggaattggaaggtttctgtcattttgtgacgatatttttaaatttctttgcaggtagaagaagaaaggtgccactccggcatgaagacagactcgcttagtcgccagtcacttaagctgagtgcattgtgatttccaataattgaggcagtggttctaaaagctgtctacattaatgaaaagagcaatgtggccagcttgactaagccgccagcgcacagcgcggcaggacgcgcccgggtctcagcggacttgtgcatgttagctgtgtagatttatgtgagggcttgtaaaactctggtcttgtaaactagtcttaagcgcttttaatatggagacagatgagagcccctctccgctcccgtgtgggcccgcaggagaagcggtgatggagagccgagctcgccccttccaagcgctgccccgtgagcagtctccaccacctcccctgcaaacgtccagtggtgcagaggtaatggacgttggctctggtggtgatggacagtccgaactccctgctgaggaccccttcaacttctacggagcttctcttctctccaaaggatccttctctaagggccgcctcctcatagacccgaactgtagtggccacagcccgcgcaccgcccggcacgcacctgcggtccggaagttctcccctgaccttaagttgcttaaggatgtaaagattagcgtgagctttaccgagagctgcaggagtaaggacaggaaggtgctgtacacaggagcagagcgcgacgtgcgggcggagtgcggtctgctccttagccctgtcagtggggacgtgcatgcttgtccctttggcgggagtgttggtgacggggtaggcatagggggtgagagtgctgataagaaggatgaggagaatgagctggatcaggaaaagagagtggagtatgcagtgctcgatgagttagaagattttactgacaatttggagctagatgaagaaggagcaggcgggttcacggctaaagcaatcgttcagagagacagagtggatgaagaggccttgaatttcccctacgaggtatgttggcagcccctcctctagagggctcttagcaaaacccaaagagagatttgggaattgcagcatcttttgaaagcagggaaattaaaaaaaaaaaaaacaaaaaccaaaatcccctctgaggtggaataatgttaatgtggagaagagaaagatgtaaggagtccagatttttaaagtttcctaatgaaaagtttggcccatgggtaggccctgcatccctgatctagcgcgtggggcagcaggtgctgctgagttacgctccttggcagtgtgtgcccctggaccaggtgtgttggtgtcagctggtagcttcatcctgtttgtttttcagatgatcatgcaccctaagggcacatctaggccccctgagagcacctcctttctgtgtctgttctcaggaatgctgttgagctctcctgttgcaggagcatgagcgccaggggctctggtgtctgaacagcgtgttttgcaggatgactttgacaacgatgtggatgctctgctggaagaaggcctttgtgcccccaaaaagaggcgaacagaggaaaaatatggcggagacagcgaccatccgtccgatggagagacaagtgtgcagccgatgatgaccaagattaaaacagtgctcaaaagtacgtgtgtgggtcagaagcagtgggtgttccagggcagtggaggggtggttgcttccttagcagaaatgctttgagagagctctggtgccaggtagtgggctgggtggaggcatgtttgaggacaggacagaaatatctgaggagggaaacacaggatgggaggacgtcctgatgcatgacccagatgcggatcctggtgtgtgctatggaaaccacagagcagcaggcactgtgcagaggaatgggaggggacttctgagggggtcaggaggggatgttggtatatgccaggagccagcatgac

SEQ ID NO: 102780 - DNA, 2398 bp, Homo sapiens
ggacaagttagctatgccaggtgccacatgttgctgcctatgtcgtgttggtagcagttaagcaggagggcttttggtctagacggttgcaggcagggtaaacctggggcttcagcttctggggctgggggcaggagtcttgacctcggggcctctaggaggctggtttggtgctgcattttcaacaggctcattcagaaggtaaacccacattcgtcctgcacagctcactggtcagcagccattctggcctggatgcctggatgttcacagacggacagctgcatgtgacccccacctcaggtggctgggccaactttgtgaccactcactgtcacagaggagcagccccagcggacccgtggcccgtctcttgcttggctccgtattccctttgcttcttttcctgacttaacctaaagctggcaggaggcagctccatcttggcctgactctgtggggagagagcccacgcagtgtgcatgcacccctgacctttaacactccctccctgaatcatcacctgatggtggcctgggtacaggtgtcaggtccagggtcagggccacttggtgggtacctagccctgagagtcactggccctttttccccttatgtatattttttaaggtttcatttgctttcttctgttttttaattttttttttgaggcggggtcttgctgttacccaggttggagtagctcactacagcctcagcctcccaggctcaagtgatcctcccacctcagcttcccaagtagccaggactataggtgtatgccaccatgcctggataattttaaaaagttttttgtagagtcagggtcttgctgtgttgcctaggctggtctttctaagtttttaacttgttcccaatacctgtgagaaaattaagttttagttacatctttgccttacgctcttcccagcagtcaggcctggtggcaggtgtcaagttgataagtcgtaaacctcttcctcacaactgcctataaagcaaagaaggggttgggagtagtgtattaaaccaacttagaaacggaatcatttgaagcagtgttttgtatgctgctgagagtgcagctcagttacaataaagacttgtcacctggtcactgggagcagtggctgacagccatgcagtttattagcaaagctcatccagccccaaggcgcctctggccacaaccagacaggcagcaaaggagtccagtgtccacagtgcttaccagatgtggaggcaggagctgaggctgggacttatatcttgcacagacctgttctgtgctccttcatgtgctggtttgacacgtgtaaattcccacctcaggccacatgctatctgtcctaggcctggaggcatagcagtgagcaaggcagagaggaatttcgattatctgtgaagacccagttaaacacatgctagtacccaacaatttcttgtgcaggaggtgctgtggcaacaattccaagtgtttttacagtgattataggatgttcttgtcttcctgtgcaggtcgtggccgcccacctacagagccgctgcccgacgggtggatcatgacattccataactctggagtcccggtgtacctacacagagagtctcgggtggtcacctggtccaggccatacttcttgggaacgggaagcatacgggtaggggaggcatcagtcgtgactttaggcttgtaagttctcagaccaaaacgtgcacatccacacacatggcaccgcagccaagcagaggccggtgaaaggcatcagagtttcagactctcgggttgtccttgtaatccatattgcaatttcactatccacagaaacacgaccctcctctgagtagcatcccttgtctgcattataagaaaatgaaggacaacgaggaacgggagcaaagcagtgacctcacccctagtggggatgtgtcccccgtcaagcccctgagccgatctgcagagctggagtttcccctggatgagcctgactctatgggtgctgacccggggcccccggacgagaaagacccactaggggctgaggcagcccctggggccctggggcaggtgaaggccaaagtcgaggtgtgcaaagatgaatccgttggtgagtttttgaaggactcttcccttcttgcctcctgggacccatgagctttgtttttctaatgaaggccataattgttcatagttcctagttgtacttgtgagcaaggggctgtgcacctccactgttggtgtggctgaaaggcttgtcttcctgtccttgcaagaacctgcctgggtgcagcaccctaggctcctgtctgtgggctctgtggtgtctgcatggctgaggctgctggggagatggctgctggcactggcagtgggccgttttctctctggttgtttgta

SEQ ID NO: 102781 - DNA, 2458 bp, Homo sapiens
ttgctgaggatggggaagtggcccgggaggaaatgtgacaaatgcgaggccctgtgcagggagctgcctgggtgtgttgctgactacagaggtggccaggatggccagaaggaaaagagtgaggtggtcagagaggtggcgggcgcatggagcccgggtgctgctggcattcgggcacctgttttgatacagggaggaagtcccgaaggccatctgacttttttaagctgtcttttttccttttcatttttgtattcttcctgccccaaataaagtaaaagaacatctcagaaattcatccagaagggacctgccagaataatctgagctggtgtagggaggccttcattctttgcttccctcccctttgaaagggacggggaaaggaaatagtgtcatgtggcctgggcctgccccatgcactgggctgtgagaacctgactcctatgttggaagttaagtaatttgtttctctggtaaatctgggacagatctcgaggaatttcgaagctacctggagaagcgttttgactttgagcaagttactgtgaaaaaattcaggacttgggctgagcggcggcaattcaatcgggaaatgaagcggaagcaggcggagtccgagaggcccatcttgccagccaatcagaagctcattactttatcagtgcaagatgcacccacaaagaaaggtataagcctctgcattttaacatcagcagactggttatgctgttatttctaatgtgatgtgttgagggcatgttttatgagttgcatttcgttcaaagtttatgtttatcccatgaatgcaggggtctgccacattcacggtcgtgagcccctagttactgacatggtaacaggaagctgtgtgctagcttgtggcactgcttcacacttgctgagatggttctttttgtcacagagtttgttattaaccccaacgggaaatccgaggtctgcatcctgcacgagtacatgcagcgtgtcctcaaggtccgccctgtctataatttctttgaatgtggtaagtctaaccttccccatttcagtcctaaagaatcacaaggtgtaactttggtcagggctggggaggcaggcgctgaccgctagccctactctactggaacgggaggaaagggaagggtagagagcagcgtgctgcagatgggtggcttgtttcctggagccgcgccccatctgagtgggtggctctgcttttcccttccagtctgtcccctctccccaccttcctcttgtcctgccccatctgccttgctggtttctgatcctgcgttgtcatggacagccttattgcgagcaaggcctccccactgtgcactgggtcctttccctggtctcctggtgcccctgggtgtctgaagggttcttgggcatgcatttcccaccagctctgtcttccttgggtgccctcatcacacctttgtgaagaccagtctgtcttccccttggaagctggagcctgggggtcactcatcctttgaggtggtgtttctttggcaagccacatcttgtgctttcccattccggcagtcctgtgtccgtctttcgtagaccttggtccctgtcgtaggaggctctgcccccagcctcctgctgcccctctggctcaccatctcccacgtgcctcatttccctccactttcccagctgtgccctttgctgctgcttgtctgctgcccgtctccagtcccagggagccccaggtctctgcagtcaagcacaggcccactctctgcagggacagcccctgactgcgccttgtctgtcggtgtgggcagactgtgcacacgcttttgatgtcttgactcgtatgttttaaaacaagtaattttaattttaagagaacccaagtgagccttttggtgcctcggtgaccattgatggtgtgacttacggatctggaactgcaagcagcaaaaaacttgcgaagaataaagctggtaacgtgcttgcttgggtgtcaaagatacgtgctgcctgctgtgtctgcctcgctgcttggttagggaggggctgagcagtggtgacaagtgggggatgtgggtggggcatgtttattttatttatgtaatcatctactttgatttttaaaattacatgctcattggaaaagactcaaatagagcaaaatgtgagacttaaaagtagaaggcctcggccgggcgtggtgtctcatgcctgtaatcccagcactttgggaggctgaagtgggcagatcacgaggtcaggagatcgagaccatcctggctaacacggtgaaaccctctctctactaaaaatacaaaaaattagccgggtgtggtggcgggcacctgtagtctcagctactcgggaggctgaggcaggagaatggcgtgaacaagcgaggcagagcttgcagtgagctgagatcgtgccactgcactccagcctgggcgacagtgcaagactctgt

SEQ ID NO: 102782 - DNA, 1025 bp, Homo sapiens
ttggcctttggggagctgggccttttaaggccagcttttgggtctggctgactttccctctcctgtagtctcagttgtggcaatagtaaagcctctctgcaaaggtgctttatctttatagagttctgagaagggtgccttatggatcagaatcagatccaaataaggtgggcctggccagccagccatgtacctggggccctcttaggataccagactccatcccacagtgctcagggtggaagggtgctgtgggctctggagatgggcaactggacggtgaggtacggagcatgtcttgtacccggtgggttccttgcagagttgaggtatgaagtgctaggcgagctcacaagaacagacattaagcatctggggaaagccaaccgcaggcccagccatgaagaggccggtgggcctggtggggactcacaagcctctgctttgtgttgtagtattttaaccacatcagcatcgaggactcgcgggtctacgagctgaccagcaaggctgggctgttgtctccatatcagatcctccacgagtgccttaaaaggtagggtaggggggtgcctccccccatgagtcaggtcgggggagctcctctctggcgtctcatattcttgtggctgtttgtcccaaggcagaggcatggccaggtttccctgggtacacagcagccccttggccctggccaccagtcagtcccacaggcctgaatcgggcgtgtggagaattccctcctctggctgagatgcagtctggggagaggcttggtcatttcctaagggcttcccagagcaggcctcctcagaggcagctggctgctctgctcaggggacgccatctgttgtctgttttctcttaaagaaaccatgggatgggtgacacgtctatcaagtttgaagtggttcctgggaaaaaccagaagagtgaatacgtcatggcgtgtggcaagcacacagtgcgcgggtggtgtaaggactccttctctgctgcctggtggccgctgggcgggcggcccc

SEQ ID NO: 102783 - DNA, 1256 bp, Homo sapiens
agggccagctctccctgcttgaaggagagcgagtgtgtcagggtagctctccctggtaccagtgccggtccatctctaacagaagagcatatgtgtaccatctgtcttgtttctgctgttgtggccaacatcctgcagtgtaagccagtgcccactcctgaggggtggagggtaacatggggaggtgagtgtaatcattttcctcaaatgattacagaaactctctgggttcttgccctcctggtcattggaaggggaagtagttgtggaggggttaggcctgcaggtggggcagccctaggactgtgtggtgggtgggccctctgcccaagccagctgccaagagcagggcctgcctttaggtccctgagaccgaggcctcggcactgtccccgaagaggcctttactctggacatgataagggagggtgagggggctcacacgggccaccagggcatgttaaggaacttgagagagatttttgggaagcaagttgaaatgtaggtagcacttgcttctgcccttgctgtgcatggtccttggctgtgacggagggagagaaggcaagccccactctggcccgggggtgggaaacttccctgagcaggagggggaaaggtcccagccaggcacagccacagcttgggggagctctggcatcccgaggaaccacagcacccttggggctggcctaagacgggaaggggctgaggccagcctgatgctgctctgcattcatggagtgtgcagagagctcagtgcctgaggctgatgggctgggctgcagcgtgctgttcttactggctatggccacactctggtttcactccttgatgaggactctgggcaccacgagcacctcacctccctactctgcccatggcaggaggccatataagtggcgtggtgtgggcagaaaggcctggcagctatggactgcccctcgctctctgctgctgtcagtgggcctggcatcactgaggcgggccagtcagcatgcagttatgttgccacagctcctggctgtttcgtgtctgccagaccctgggcgcgcctgccttcagggtcccaggcacacagctgctgggcagcgggcaggccgtagagctacagcctgcagtcctgagcgtgaggtgctatacttcccaggagacatcggacaagagtgtgattgagctgcagcagtatgccaagaagaacaagcccaacctgcacatcctcagcaagctccaagaggagatgaagaggctagctg

SEQ ID NO: 102784 - DNA, 3524 bp, Homo sapiens
gctggcagtggtgtcttctgtcttcaggcatcgtctgcctggccacggcgtgacctgcccacctgggccttctgggtgggagctttcttaagtgtggcagtcccctggcctgggtgagagccccaggaggtatctgctgccgcccaggccagcaggtcccttgctgctccctggggtggggcttggcctcctggagccagtgggactgcctggtttgcccctggtcggaagaggggctgtggggctcaagggcagcaggtgcaggacatagtgctcctggctgggcctggggcaagcaaaagctgggcaagggaggaacacccaatggggaggcctggcctgtccctgtaactgcacccaaaattcttcacttcttggtacatgtcctgattgccagggaggctgcacatgttgtactctgatggcaatgcagggggcctctgcaatctcaggctggcctgccccaggccttccctgctcctcctagcctggcatcacaagcactggtgccgttggggctccagggcctcctggcatgatctgctgggctctccctccaccttgtgtcttcccgagcctctgccaagcccacctcactggtacccctgacctttgttgttctttcaggaggagactcgaaagaagcccaagatgtccattgtggcgtccgcccagcctggcggtgagcccctgtgcaccgtggacgtgtgagggaggtggcacgggccagggcgcgggggccgccagccgcacttctgaggagaccagcagtcatgcatcgtgcaccacagtgtcaggcctccaacccacgctccttccctgtggccaacctgtgggcccggccttagggtggaggctttagtgtacagggacagccatggccacacagcacacatgtggagcagcggctctccctggaaagctccaggcctgaatggatggactcagcgactgcaccagtggcagctggtgactgtggacagtggtggaccctgcttctgtgcacctgctgcaggctctttttatgaaggctttcatgaattttagtatgtaatacgcactgacgacacatgatgcttggatgacagatgagaggggatggctgagtcctgtggctggcccgtgatgccaggtggcccatgtgcccagggcgcctgcagggctgctacagggacctggtcaggaggtgcacatggtgccctgccctcacccaccctctgtgtttccccttctttgaaaaggtagaagagaaaggaatattttaaacctttttggcttaaacagaattttagcatcagaactagctttctgggattggaggcaaaccatcaaggtggtccctctccagtctggacacgatgccagcaaggatgacgtcctgccacctcctggagttaccctggcctcctagggtccctttttctgatgaagtcttaattccctaaaagcgcctctttggacactgaggccctctctgcctttcctggcctccggcaacagttttttacaaagattttttgcagtcgagtccatatgtccacccattgatttttaaagcttttgtgatattttagcattttgaaagactttcacagtgagagtagaaggtagatttggaatcatgcattttagcaagtggacttgttgaaacaggaagcaagggccttcagtgtagcccattcttgatccagagctgttgcctgtgacagcggtttctctggatgtcaaaggcagctgcctggtgcccagcttgcttctcgactggtggcccctatgggtgggtgtgcgatggaaatgtgttcctgccggagtctgaggcaccagggtgtgctcaaaggctggccctggtggtggactggcacctgtgcagagtgccgtgtgcttgtggtgcgccatctgaagcaagagtccagcgttctgccgtgtctgtcccccaccatgccccctacaggcggtactgatggcgcttttttttttttttctgtcaggaaaacaatgttggcctgtgggccgcccacaacatatccttccctcactacctgtgtgaccaaggttggcttctgttgacctttaaaaaagaaaccctcaactcaaattgctataattagacacttgcttctgtcttgcctcctgtctgcagctgtgaatagtcatttgactgtgactgttgcccttagccagccagatgcgcctgtgaaccaaagcttcgtgcacatgtgttcccctaaaggttggggagcctcgctgtgtcttgctgttcccaggcaccaccacagcaggtgctgccatactcttgtggtctctgtgcgccccccccccccccccacccgtctgccaagcatgggtatgaatcgtgcacacagccatgcttcaaggccggggcaggggagcctgtgctgatgccatccagggcactgggctgtgcctggaaggcgagccttgattgtctgaacacataaagcaaactgtccagaagggaatggctgatgtctttattctgagggtgagaggctggcaccctgtggacccttgactggccagatcccctcctggggcctccctgcaggctggaccctgcctttgtaacagctgagcagcaccccagcatggccccttccttggttgatgccctctctgctgggctgagggccaggctggccacagaggggccaactctgcccagtgttctccaccccatgcccccagctggtgcagttcccagacctctctctgcctctcctcaagtttaagtatcaaatcgaacattcttttttaaagtaagctctgccctgactcccccagccatgcagagaggcttgcagagctgcctaggcctagtttggccctttccctggcacccaggccctgtgttcagacccctggctctcatcacagaaacaccctttgttgagcagttgtttattctggccctcacagccttggctagtccacaaaggccctggggatgggcaacaggctacaggaacccacctgtcttcctggtcagggcccctggcccctagcagcaggccaatcctggtggggcacagggttctgtgccctttggctgcctacctctgaatatcctggccagcaagccatgccttccccgcccctggggccctgggagcccttcagctcctgtccccataatgggtcctgggcctaggatgaggggaaggtcccagtttcttgtagggtgttatctgggggtcctggtgtgggttgagctggagggctgtggggccccaagacccctgtgccattggggtgctccaccctctcaaacaggatgagcatctcacagtgcggggtctgcgggaacaggtccactgccacagccttgaccggccggaagggaatgcccttcacccggttagatggggctctgcagaggctgtggggggaaaaggggggcgctaaggtcagccgataggctaatcaggggctcctgtgggagctgggggcttggtagcaggcctagcccccacccaggcccctgcagacactcactccacaaagtt

SEQ ID NO: 102785 - DNA, 1478 bp, Homo sapiens
tcagcaaggctggtccaaggtggggtcagggaagacgttgggcaccaaggtggggagtgggcgccggaggtcccggcaggatggagggaccaggaatgtgggcgtcggggcaccagtggcaccacaggagaggagccactgacatcctgggcaccgcctgcccccaggtgaacacacccgcagccgaggtgctctacacagtcatccaggactgggcccaattggatgcggggagcatggtgctggacgtgtgctgtggcaccggcaccattggcctggccctggcccgggtgagccctcctgccctgctgagggcaccctctccccaccccaagacccccattgaccccagctcaaagtcaccacagctgactccatcatgccccaggcccagctcctctttgctgcccacagggccccatgtactcccctccctgggtggggcgacaccacgctttcctgtttcagaaggtaaagagggtcattggggtcgagctatgcccagaggctgtggaggacgcccgggtgaacgcccaggacaatggtgagtggcaaggccgtgggtgggggtggggatgggggcagccgccacccctgctgcaagcctcagccacagccagggcttgggggctgcccgacaggtagagcaagtgagcaagctctttggctaggggttccccagggctggccctgctgggagggcatgtggccctctgacaggccacggtgccatctcttcagagttgagtaatgtggagttccactgcgggagggccgaggacctggtgcccaccctggtgagcagactggcctcccagcacctcgtggccatcctggacccaccccgtgctggcttgcgtgagtggcttttgcttaaggaggtggcacgggaacgaggacacatggggtggctcaccatgttatgcactctctggctgtggggacccagctggtgtttgcctcctcagattccaaggtgatcctggccatccggagagctaagaacctcaggcggctgctgtacgtctcatgcaacccccgggcagccatgggcaactttgtggagtgagtgtctgcaggggcctgggtgggggctaggcctgctaccaagcccccagctcccacaggagcccctgattagcctatcggctgaccttagcgccccccttttccccccacagcctctgcagagccccatctaaccgggtgaagggcattcccttccggccggtcaaggctgtggcagtggacctgttcccgcagaccccgcactgtgagatgctcatcctgtttgagagggtggagcaccccaatggcacaggggtcttggggccccacagccctccagctcaacccacaccaggacccccagataacaccctacaagaaactgggaccttcccctcatcctaggcccaggacccattatggggacaggagctgaagggctcccagggccccaggggcggggaaggcat

SEQ ID NO: 102786 - DNA, 1889 bp, Homo sapiens
caggaaacctgccagagaataggtggggacgaggcaggtgcgataggggaggaaaggagacgggaatggggtcgggagggtagactgggggaggggcagggctgagtgcagagtgcaccgacggaggtctgggtgtcccataaggaagcttggggggccaggcccccagggcctagtcctcaccctagcaccccatctgtccccacacagggcccgaagcccatggagagctgtggccaggagagcagcagtgccctgagctgccctaccgtctcggtgccccctgcagccccggcagccctggaggaggtggagaaagagggcgctggggcggctacagggccggggcctcagcccgggctctacagctacatcagggatgacttgtttacctctgagatctttaaactggagctgcagaacgtgcctcgccacgccagcttcagcgacgtccggcgcttcctgggccgctttggtctgcagccccacaaaaccaaactctttgggcaaccaccctgcgcctttgtgacattccgcagcgctgcagagagggacaaggccctgcgcgttttgcatggtgccctctggaaaggccgcccactcagtgtgcgcctggcccggcccaaggccgaccccatggccaggaggaggcgacaggagggtgagagtgagccaccagtaacacgagtggccgacgtggtgacccctctatggacagtgccctatgctgagcagcttgagcggaagcagctggagtgcgagcaggtgctgcagaaacttgccaagtgagtgtgggcgcaagacgcccctcttggccagggctctgcccggcctgtgcttcctcagcctgtccatgcaccagttgggaggcccagcacaggatctggcggcccctttgggagctagccagcaagacacccacgtcacagtgggcacaatgacatcccaaaggaggggtcaggagcctggacatttggggagtggcctggcatgggtcgggggcagtaggtggagtccaaccaccgatctgctcctcttacagggaaatcgggagcaccaaccgtgccttgctgccctggctgctcgagcagaggcacaagcacaacaaggcctgctgcccgctggagggggtcaggccatcaccccagcaggtcagactagacttcggtggccacaaacccctatcctgggttttgaaaaactttgcttttgctcacccttcctgttgatctccctgctttgtgttttcttctggtaacatcacatagttgtcagctgttcctcttgtttgactgccagcccctgtggggaaatcagggtttccaggcccaagcgctgggcagccagggtaaggtgcagctctctctccctgcagactgagtatcgtaataagtgtgagtttctggttggcgtcggggtggatggggaggataacaccgtgggctgtcggctcggcaagtacaagggcgggacgtgtgctgtggcagccccgtttgacaccgtgcacatccccgaagccaccaagcaggtggtgaaggccttccaggagttcatccggtgaggacctgtgacggggctcccgggaagtcctatgcggtgtgggagcagagggtggtgatcctgccccgggaattctggagtgcctgccatttcagccagatgaaggaaggtgtggccagaggagagagcagggggactgcttgcccagttgtgggcacttgggccagctcgtgattcccacaggtccactccatactcggcatacgacccagagacgtacacaggccactggaagcagctgactgtgcgcaccagccgccgccaccaggccatggccattgcctacttccacccccaggtctcaacgggggccctgctgggggagggtg

SEQ ID NO: 102787 - DNA, 1359 bp, Homo sapiens
ggtggttggactccacctactgcccccgacccatgccaggccactccccaaatgtccaggctcctgacccctcctttgggatgtcattgtgcccactgtgacgtgggtgtcttgctggctagctcccaaaggggccgccagatcctgtgctgggcctcccaactggtgcatggacaggctgaggaagcacaggccgggcagagccctggccaagaggggcgtcttgcgcccacactcacttggcaagtttctgcagcacctgctcgcactccagctgcttccgctcaagctgctcagcatagggcactgtccatagaggggtcaccacgtcggccactcgtgttactggtggctcactctcaccctcctgtcgcctcctcctggccatggggtcggccttgggccgggccaggcgcacactgagtgggcggcctttccagagggcaccatgcaaaacgcgcagggccttgtccctctctgcagcgctgcggaatgtcacaaaggcgcagggtggttgcccaaagagtttggttttgtggggctgcagaccaaagcggcccaggaagcgccggacgtcgctgaagctggcgtggcgaggcacgttctgcagctccagtttaaagatctcagaggtaaacaagtcatccctgatgtagctgtagagcccgggctgaggccccggccctgtagccgccccagcgccctctttctccacctcctccagggctgccggggctgcagggggcaccgagacggtagggcagctcagggcactgctgctctcctggccacagctctccatgggcttcgggccctgtgtggggacagatggggtgctagggtgaggactaggccctgggggcctggccccccaagcttccttatgggacacccagacctccgtcggtgcactctgcactcagccctgcccctcccccagtctaccctcccgaccccattcccgtctcctttcctcccctatcgcacctgcctcgtccccacctattctctggcaggtttcctgacccaccccgcctcctcccaccccatccccgtctctacccagcgtctccccgcactctacctcgttgtcgaggttctcactcatcgcccaggcggttctccgcctagaccagggacgccatgggggccgcctggccacctcgtcctgggcctgtcacaagggaagtggcctgtcacaagggaagtgctcagaggggaggtgctcacagagccggtgcaacgccgcgaggtcgccgccacccccggcttcgccccaggcggggcgggactcgaacctgcgatgctcaggtccgggtctcaggcttggggctgtaccgcccgcccgccaggggcccg

SEQ ID NO: 102788 - DNA, 1775 bp, Homo sapiens
aggcctgggggctgcagggcccccgcgtgaccttggggtgggttggggagcggccgtcgccacgcgggacggccccagcctccaggaactggtgcgggcggcgggtttcctccggctcggcccacttggggctccccactagtacggtgcatttattctttccgtcgcccacgcagcacttcattcattcggttcttacgtctggaaccgccactggcctctgtggcagaagctcgcgttccagcgtggggcacaggtcctagatgcgccgacccaggcggcggctttgttggctgcggtgtctggttgagtgcgggccgctgcagagccgcagtgctgtggggaacagtgaagagcagcgaaaagcttatgttttcttttccagtttgagtctagtggtgaagtcttgggtctcttacggacttctgggtgaccaaggcatgtgttctggaagactcgaacctaaaatatgattattggtgctctcttatcctctaaattgggccaggatttcatgactttcaccggtacaatttatctagttattaacttagttttctgaactgtgaaaaaattgctggcagagctgtgaatccagtgtaaatactagcagtcctgtagcgacttttttcgttttactaagcaagagcacaactatttcctaattagtcaaaactgaaagagttacattttgctttaaagtaatatttcaaaatctatttcgacccatcattgtgtcctttgatcttcacacagcaggtatcatctgcattttatggatgaggaagaaactgatgctcaaagagatgaggcagtttctgccaggccactctctgcaagtgttggcggcttgtagggtcccccatcagtctgtgcacagatctgattgatgtctgtgaatctgggggaggggccccaagttctggtgtctcactctgtgctcacatggagctgggcataaacgcagagctttcctagtgtggaagagtgggcctaatttcttgctttggggttgggcccatccttgtatctgaagtcccttcattgtcggagggctgaccactgcaggcactggttgggctctggttgtgagccagatccataggccagcagtgtaacctctttgtatctccacaggacactcatgaggaccatgatacttccactgagaatacagacgagtccaaccatgaccctcagtttgagccaatagtttctcttcctgagcaagaaattaaaacactggaagaagatgaagaggaactttttaaaatgtaagtaggctgatgtcccagaaataggactctttaaggttgaggttacaacttttatgggtgtccaggttttggcctgacttttaatcagactgaggctgcttaaagaaagggcctaaagttggtgactaatcccatgtggaaatttaacccgttcctttcatgaatcttcaccagatgcccttgctgccctgcagccagttgcatgaagggcatcccatcttgctgctctgtccactggcatggcggccccactgcccttttttgccactggcttctgaggatccagggagtcccttggttgagcagggggttttaagtttttgcagcatagacttctttggcatcgtgaagcttataaatcccccacccggtgtctgttgttgttgttgttttgagatggagtctcgctctgtcgcccaggctggagtgcagtggtgcgatcttggctcattgcaagctccgcctcccaggttcacgccattctcctgcctcagctgg

SEQ ID NO: 102789 - DNA, 1047 bp, Homo sapiens
gtgcctcagcctcctgagtagctgggattacaggcgtgcatcaccacactcagatgatttttgtatttgtagtagagatggggtttcaccatgttggccaggctggttttgaactcctaacctcagatgacctgcccgcctcggcctccccgaatgctgggattacaaatgagccaccgcgcccggtcgtctaattctcttggttgtggaaccggaattcaagatgacctggagtttgttgggctgctgcgctttctggtggtgttgtgacgggcagttcttggagcctgaagaagggctggggcgttcgtggaggcatggggtcctgcagtgcagagttgtcctgtgtcctcctgcgcaggccctgcatgtgggctgcaggtctgcactcttaacctcacggcttttcttgcaggcgggcaaaactgttccgatttgcctctgagaacgatctcccagaatggaaggagcgaggcactggtgacgtcaagctcctgaagcacaaggagaaaggggccatccgcctcctcatgcggagggacaagaccctgaagatctgtgccaaccactacagtaggtggcatgaacgaccacctcgacagtccccagcagcttggcctgggacctttgggaagattcagggctgattgggaactggggagcgtgttatttcatggagtgcaagtttgtggtgtgtttgttgaatttaaaaccagaaatacgtttttcagacgtgcctctgaactcagagcaggcccgcagcgaagcttagagcacacgggggtgtggagtcagccagacgggccctgatgggaggacgcagcgcccaggctgggctcgggacgaggagtgagtgctgcagggcgagggggtgctgtgtgtgtgtgtgtgtgtgtgtgtgtgtgtgtgtgtgtggtgtctggggggtgggggttggtgtctggggggggttaatggggggtatgtgtagtatctagggggctgtggtgtctactggtggtggtgtataggggtgtgtggttcggtgtgtgtggtgtctggggcagg

SEQ ID NO: 102790 - DNA, 2577 bp, Homo sapiens
gtggccgagggctgggtgggctggcctttgcagtcatctcaccatcttcacgagcttctctctcttcagtcacgccgatgatggagctgaagcccaacgcaggtagcgaccgtgcctgggtctggaacacccacgctgacttcgccgacgagtgccccaagccagagctgctggccatccgcttcctgaatgctgagagtgagccaagggccctggggacctgcctgacttggggctcacctgcgtggcagcgtggcgggttatgtgcaacaaatgctgttgccttttggggagagggggcagtaactgggaagtgtgtcgtgtgggctgccctgccctgctgtttgggggccatgcccagactgaagccatgagcagcgccttcccccttaaactcaaagctgtgccaagtagctggtgaacagcagtgcccgctcagccgccttgtggctggcactttggtttgctctccaagctccggttcccattagttgttgcggagcctgaggcccaacccagggcttcctcccagtgctgatcctcgtgccaggcttctggttcactggggccaggggcccctcatggttgcctgggtgccagcaggggctgggcagagagatccacaggcccaggctgatctcttccctgctcagaggtctttccagtccagatcgtccaagctgcgtccagtggctcctggaggagtcagtgggtactgtggcctggcgcctggtagctggccgtttggtgccaagtgaccttgtccttgctgtgggcgtggctgccccagcagcctttccaacacggttgggagccgagcctgtggcaaagaggcccatgccccttggttgcctgagggtccgtgctctaccgctctgcccaaatgggtgcagtcagatgaaggagacagaaggccagggccgatgtcaggtggaccagtcctttcttaggtcagcaattaccatgaaatgggtcttctgtgaatcctgactcttcagacccggcagggcatgtctcttccactgctcacagctcttaggaagtcttcgctctcccttccacagatgcacagaaattcaaaacaaagtttgaagaatgcaggaaagagatcgaagagagagaaaagaaaggtgacgtggtgccatgggttggggggcttctttgcagactcactctgcatctgactatacttccaggcgggtgctttttctgtctgccagataaacattccagggtgctgtggccgcctcacgtatccagagtgatgcagctccctggggacacaggtgcttcctggggagccctgagcacttgtcagtgttgctggcctcagtccaattgggcaggcattggagtccgggcactgcctggagctcaccagaaggtgctttatgatggtcctcggtttgtctctcagagggcttggtcacctctgccatgaggctggactgcagctgtggtggcaagtgaccagatgtcactgagcagcctgaccatggtctaggcagtgcttgagtgcatccacctggcttcctttcgtcactgaatttcaagaagacagactccaggaggcggcttggccaggcaggagtctgtcccgagggcgggcaagccgctgtgggtgggtgacggcacttgggaccagcctggcgagggccatgtgcttgaatgcaccgtgcttctgttttctcactgtgctgcttgtgtttttagcaggatcaggcaaaaatgatcatgccgaaaaagtggcggaaaagctagaagctctctcggtgaaggaggagaccaaggaggatgctgaggagaagcaataaatcgtcttattttattttcttttcctctctttcctttcctttttttaaaaaattttaccctgcccctctttttcggtttgtttttattctttcatttttacaagggacgttatataaagaactgaactcaacattcaggttgttttttttttttgtttctaagtttttgccctattgaagatgacttcagaaaatccattccccagtcatgaaaatgtactgtgctaactttcttttccatagtggaaacacttatttatagtcatcaaaaatagtgaataaaaaacacatttggaacctgggccagatggcaggactgtgtgtgtacaggcccctgcgctgtgagcgccgctcgcctaagcctcccgggtgtatgtccaggcctgtccgcagcacaggtgggtgctgcacctcacggtagcctgggttcctgggagagacgccctggtgtctgaggtcgtgcatgtatcttgctgtgggccttgaagctgaggtgtctgagctggcgctggtgagggagcctggccaggggtgtctggtgccgggtgtggtactgatgcacgactgtgggctgggcagcgtgggctctgccgaggcaggctccactgtgccttatggcctgaacagctactgctttttttctatggtgaggaggggtgggctttctgtgttttgaggagagaaaggaagaccactggagtaccttggctttggagcagggaggcagtagccaactgagcagagtctctagcatcggccaagg

SEQ ID NO: 102791 - DNA, 1038 bp, Homo sapiens
tgacccctgtgccctggtgcaggtacgtggtggagccaccccggctgccgctcgcggtgagtttgaagccgcctttccttaggcctgaactcctggaccgagctgcaccgctcaaggtcaagcttagtgacaacgggctgaaggctggcctgggccgtagcaaggtgggcgcctgggcttagggatgggctggcagtcaggcccttggatggggaaacaggcaggttggtgggggcctagaagaggtggatggggcagacagagccgtagacagattcttgggagggggctaggtcccaggctgaatccctagtgaagccctgcccctcatccaagccccacacaccactgaccccgctccctcccagtccaagggcagcctggaccggctggatgagaagccactggacttggggccaccactgccccccaagatagaggctggcacgttcagcagtgacctgcagaccccgcgcccaggcagtgctggtgaggttggggcagccacgactagggagggatatgggttgaccctcctctgacctcagtctgacagtggtctgcatccccagagagtgccctgtcggtgcagaggaccagccccccgacacctgccatgtacaagtttaggccggctttccccacgggtcccaaggtgcccttctgtggaccaggcgagcaggtaaggaggcctagcctgccccctggcaggcctcgtcccccaggcccgcctctaggagctcgccccacagccttcaccccgtgaaggccccacctccagagccccatctctccagcagaggccacatcccctgaggccatgcccctcagggctctgcctgggtcaccaagggccttgtgtgactggtaggaccctgtctgtgtgcacccagagctgggacccacagaggggagcagggtgtcctgggaggggctggcgtgggccatccaggcttggcgtctgtcccttggccagcattgccctaggccaggtgggcggctgcccccaggagcactgtgtaccaggatgcctggaat

SEQ ID NO: 102792 - DNA, 1035 bp, Homo sapiens
gctctgctgagcccccgctcactgcagtgcggcccgagggctccgagccaccagggttccccacctcgggccctcgccggaggccaggctgttcacgcaagaaccgcacccgcagccactgccgtctgggccaggcaggcagcgggggtggcgggactggtgactcagaaggctcaggtgccctacccagcctcacctgcagcctcacccccctgggcctggcgctggtgctgtggacagtgcttgggccctgctgacccccagcggacacaagagcgtgctcagcagccaggtgtgtgtacatacggggtctctctccacgccgccaagccagccgggcggccgacccgtggggcaggccaggccaggtcctccctgatggacgcctgccgcccgccacccccatctccaccccatcatgtttacagggttcggcggcagcgtttgttccagaacgccgcctcccacccagatcgcggtatatagagatatgcattttattttacttgtgtaaaaatatcggacgacgtggaataaagagctcttttcttaagctgtggcctctcaggctagggtgctgtgggcggtgagaagcaggggtgggtgctggacgggcagcctctcccccatcacaaggcccccagaggaagggagttgcctggcaccacaggtgggacagccttggccaagggcagctccaatgtcaggtgcccctggccccccagccgcacagatggagcatgcttggtggctgacgtcgttgagcctggctgatggagcacatgccaggtccatgggtctggacatagcagcccctgtggggacagttgctctcgggccccccaccccaatcaggctgcccgggcagcccccaggaggaggctgaggatgagggaccctgttcctacccctggtgggtggcaggagaggaaggccctgaaggagagttgggcgggtcaggcctggcctcaaggcccagtgggggctgtatgcaccctcacaccgctgctggtggtcacactagaccccacatgc

SEQ ID NO: 102793 - DNA, 1021 bp, Homo sapiens
ccactgctgtcccacacctgcatggaaacacaaaccccaccacggagccccctctcatctctacagggcctccagagcgccatgtgcaagaacttcatgggcggggtggggtggggtcaggagcctgctgtgggctggccaggcatgaacaccaagctggaggtggcggtgctgcaggtggggcagccttccccttccccactcctgtggcttgtgagggggtgggcaccgtgggggcgcacagggggcatggtgggcagtggtcggaggtggttttgggaactcacccagggcacgtggctcactctgcagctgctggggttggcctggtggggaggaggaggtcggagggactctgaacagagaggggagatgctggcaggagggctggagacccagccctgcagggcgtgggcgtgcatcagcagcggggtgggaatagacctgtctatgcagtagaaacaaaccagacatggatcctgttcttactaacgatgtaataaagccagaaacagcaccagaggccaatgggtggggggaagaataaaatgtgagcgaatggggctgatccaggccttctcacttctcaaggaaagtgtcgcaaagatgggcatcgcatccagggctgagattgaggactggttcacggcagagaccctgggagtgtctgggtgagagcagcccccaggctgagaggacacgagcatcagccatggttccagccaagccccagtgacgtctcccagtcctggctgccctgcctgagagggtgggccttgggatgacagtgctgaaggaactgcttttcacacagcaggacttgatggcctcaggagtccctgaggctggggctgggctgggcaggggagacacagggccagcacagaccccatagagggctctttatagaattatctgggtccagagcaaaggtggcactctcagccctccctggagtccacgccggcaggtgaaggatcagagccccatgccccatccttggggccaggggctgggaccc

SEQ ID NO: 102794 - DNA, 1032 bp, Homo sapiens
tcctctatcccagtgacctgcatcaggctcctcctagtggttcccacaggacactgaccaggctgcggcaggcgcatacttgcactccgggccttctcccatgctctccagcccccagccccacaaagcaggctggatgtggtcctcatgccctggggcttggatgggggcccctgtacagatggcagtgacagcatcctgggaccagggctggggcaggaaaggctggagggtcccagtctccaggcagggggaggggtggtgggctgggcacacagcccaggaaggggcccccaggtagaggcctctgctgcaacagaggtgggggccctaccagggccccggttatggcagaacctgcagctatcacacaagccacatttgggccacactgaggcatctttatttctctgggtcacacagagcttgggcctgggagcctcttctgcatgggggctgcagctgccaagggagcggctgagaccagaacaagcgctcgggtgggccccagtgcaggttgggatgtgcccggtggagtaaggtgtgagaacccccagcctcactctctgcctggtcctgaagcagacagcagcaggctggcccagcctcccctttatgagactatcctagggtttgacagcaagtcccagatgaagggtgacaggcagctggggtccacctggtctctcctcagcagggggaaccccctgcgggcagctgggaaggcagtggccaaaggtcaagaagatgaactctgcccagacttctgctgcctgtggctatggtgggacagggctgcctttctggtcacactgggcagcaggcgactgccagggacctcccagtcccagggctgcattccctgcccggcagcccctctgctgcagctttcggatgagttccagcaggttcatctgcagcatcagctcctgggatacagaggggccccatgaaggccagagtgacccccaggcccctttcatcccggcccaagggtgccaggcagtgagcccacgggggcgaccatcctgt

SEQ ID NO: 102795 - DNA, 1033 bp, Homo sapiens
tgcatctctggaggccaggcctagggtgcagcttgctgagatgggctgagccaaagggcagccctgccactgcgcatttgggctcagaagtgctccaaggcttccttattcgcacaaggcagggcctaaaacagagcttggaggccttggtggcctgtcccagccaggtgtcttcttcagccccgtctcccacctttctggccttttctcaacacgtcagcccaaccttttccagctccctggatgcacacacttgccttgcaccttaacacatgttgtgcccatgtttcttttctgggttcacctctacccattctccagtcctggcccagtgtcactgtacctgttgagttgcctgtgccccctgcagtccaagaatagggctggtcttggtcaccccatcaacatttgtcacagcaggggctaatgagggcaccggctggggcagagtggacccctggcagctctgcctcatccttccccagtggcccaccacgacctggataacacactcaactgcagcttcctggagccaccctcagggctggagcagccctcaccatcctggtcctctcgggcctccttctcctcgtttgacaccactgatgaaggccctgtgtactgtgtaccccatgagggtaagtaaggccctacctgggcatcactccagcccagtgaaatgttcccatggaaaagctgtgttctgggtgggacacaggagaagggcaggcagcatggagaggaaggccttggccatgctggtacctgagggttgcccacagagctgaggccatagagctggactctgctgctcagtaccggagacaggtgtggggagatgggtaggccacagcccagggttgctcctgggggaaagtaggcagagagaagtttctgggcttaggtagggggtggcagaggagacaggaggaagggatccacagagtatgggagttggatccacacacagcctttgatccacagatagcagaaaggagcctgatggtctgggattctgccctgtctcctccct

SEQ ID NO: 102796 - DNA, 1821 bp, Homo sapiens
agtccatgtctctcaggcagcttcgtttcctggaggggagagaagcagtgccctcagacatggggaatgaccacatgctgatgggggcacagccacacactcgggggcagagactggcttagggccgggtggcctagaggaagggctgggctggagcaaagccagagagaataggatcattctaggggagggcccaaaagacagcctcctgcagactcggccatccctgggtgagaaagcagcagcctggcccatggacaggatgtttcaacactggccctgtgccatccttccagggggcctgacctgtcagaatggtgggtaactgttgccaccttggtcagtgggcttgtgggggagctggcagcctcgtcccagtgggtgctgggctttattctagccttggctttgcaggtggcctgctacagctgcacgtctggacagtggtcatctgtctgcccactccctgctgggcacggtgagcctggcattgctgtgctggacaacaggatctatgtgttaggtggccgctcacacaaccgcggcagccgcacaggctacgtgcacatttacgatgtggagaaggactgctgggaggaagggccccagctggacaactccatctcaggcctggcggcctgtgtgctcaccctgccccgctccctgctccttgagccgccccgcgggacccctgaccgcagccaggccgacccggactttgcctctgaggtgatgagtgtgtctgactgggaggagtttgacaactccagtgaggactaggctccctgtgcctggcatcagagggaagggaggctggggctgcagggcagtgaaacccacgcagcctaggccagagcactttactccaggcagggcccctgcccctgttggccacagcttatgggccctgccctctttcttcacaccagccccttggccagcctgccgcaggcatctcagggccatgcagatcccaggctgtggattacgtcactgcaggaactgcttctgaaaggctttggccttcctcagtgagccctggaggggttggccttctctcctccctgcctagatcagtccttctccaaaaggacctgggagctggcagcctgggcaggggggctgaggcacgtggtagccctctttctgtgaatggggtggggctgtgggggcagctggggttggaggatgagagctcctgaggggcagaggagcagagatgcatcagctcgcctgggactggctctgtgataaaaagacccctcccgctgggttttcagaccccatgttgttggtcaatgaaataaagcatcttacagaaggtgttaactgtttttctgtagccacagcctcagttcctttccacagtgcacccaagctgcgtccccaggaagcgtggcttctggggtcagagctgccatctgggagaggctgtggaagcccaggccagaagccaagtggcactgggaagaccctgcctgagagggaagcacagtaaactccacaagctaacagggcactcagtgggaaagctggaactcgccctggtctggtgacaggtggttgtgcagccacttgagtgtcttctctggtgtggaacttgtctcccaaccagggcagcacgcagagtttcagcccagctcgttaggagtctctcagcctgagggtcagggaaccagagcttcagcacctgggagcggggcagcatcagggggtcggtggggggggcccctctggcctgtgcccggctcctcccaacctcctgaagctgagtgtgctggggaggggagctgcatgtgctacaggtttgccaggtaaccc

SEQ ID NO: 102797 - DNA, 1066 bp, Homo sapiens
ttaaaagcagggtcagcaggcccggaggattgcatgtccagtgggagtgggggaggggtggaggccactgagggtgggtcagcggtccccagggttctgtggcttcttccagactggcttggaaaaaatgcttttattttcttggagttcccccatgcagatgttaactttaggagcaaaggaaagacaaaggctacatttcatttctgagtctatagatgtatccgctattgggaagaggttagaggtcaatgactaggacagtatgtcccatgagaatcgagggaggattcttgtctgtatgtgagtgggaagtggtgaagcctcacagcgttgtcaggcaggtgtggggtggtgattggccttgacagagtacccagccacccttcctcactgccctctcacgccatttctcctggtggctccacacaggtgtatgcccacgcaggcgcgacgctggaggggaagatgtatatcacctgcggccgcagaggggaggattacctgaaagagacacactgctacgatccaggcagcaacacttggcacacactggctgatgggcctgtgcggcgcgcctggcacggcatggcaaccctcctcaacaagctgtatgtgatcgggggcagcaacaacgatgccggatacaggagggacgtgcaccaggtgagtggggcccggggcagtccacacccgtcatcattcccaagcctctcagttgttattgatggaaaatgtaattgaatcatgtgccttttaaaaatagactattttttagagcagttttaggttcacagcaaaattaagtggaaggtacagtttccatacacccccttttccccccatacacatatagcctccccactgcagacctctcgctccagaggggtggatgtgtcacagttgttgaaactgcattgatgcatcaccatcaaccagagtccacagtgttcactcttggcacattctataggtttggacaaatgtcaccatgacagtatcacacacatacacatctacctttgcttattactcttaaaaacttttaggccggatgtggtggcac

SEQ ID NO: 102798 - DNA, 1029 bp, Homo sapiens
cctggcctccttctgctctttgaatgatacttggcatttggtaggaactccataaatatacattgaatgaaatgacttttattagtttcccattaattaattcattgctttgaaatgtgctctggagttgctactgctccgatccaggaactgcactgatgaacacagcagaagcaagctgcttgtggcctcacctcccgaagctcacatgggactccttgggcccatgaaaagggaaacaggacaatttccaggatggctgcccagacttcgtcaggatccttttgtgggatggctcatgcatgcacacagttcactcagagcacagagtgggtcagcccactaccagggccctgccaccagcgccaggttcttctctgaatgctgtcactcttggcaacatgggcttaagtccctgttggtataactccattttcttgtgtcttcactttgcagaggaatgtttgctgggggattgaaggagatggaacaggaagaggtcctgatccacggtgtgtcctacaatgctatgtgccaaatcctacatttcatatacacctccgagctggagctcagcctgagcaatgtacaagagacactggtggctgcctgccagcttcaggtgaggcatgtctcatctagcaaggcagacccacacccaggtggggttccctgagatgcccatgatgcctgccgggcactagcattggcttgaagatgggtcaggaatgtgaggagaccaagcagtgacgaaggccatgaagtggggaagactctggagttgttcctggagctcaagcagagccgctctagacaccccaggcctctgcctttgccctcttctctattgctggttgtttccccactgtctgagtctccctgtcattgaaagcatcctgcacataagcaggtaggctgacccgaggctgcatgtggacgtcctgtgtgctctggggtctggcaatggggagcatccaccagcattgctgccagggcccttcctgcctgtcccctcactgggccacttca

SEQ ID NO: 102799 - DNA, 1016 bp, Homo sapiens
ttgacacaaaactcagaggcaagtaaatggtaaatttgacaacattgaaaacgaagataggttggtccgaaggtagtgtgagttacctcagttgattgttcacagtcacagatccaactccaggttctactttttcaccttctcactactgcagttgactagacttgtttaaaaaaaaaaaaaaaaaagacaaatttctgcatggcaaaaaagcaatacaaaatcaaaagatcggggaaactcctcatcaaagaaagggcagatttcttcaaattgataagacagtctaacagaaaactgactaagaatctgaactgttcagaaaagaaaatggaaatggctctttaacatataaggagattttctgtaccttatgtgataaggtttttcccttttgtggtggtgagttagagctggtgtcttcctgggttgggggtagagggtgcaggcaccaggccctgctatcaggaatgatataaaaacagcaacttgacaatactatcaaagtataaatgtatgtaaacccttcgacccagcaactgtatttgtgggacttaatcctggcatatgcatactcagcatgttgtaagggtgaggatgttcatcatgtgaaataactggaaattacaagtaacctaaatatacccctgtagaaatgggttaaagaagtgagacagctggctgggcgcggtggctcatgcctgtaatcccagcactgtgggaggctgaggcgggtggatcacctgaggtcaggagtttgagaccagcctggccaacgtggtgaaaccccatctctactaaaaatacaaaaattagccgggcatggtggcgcaggactgtaatcccagctacccgggaggctgagtttggagaattgcttgaacccgggaggcggaggttgcagtgagccgagattgcaccattgctctccagcctgggcgacaagagcgaaactccatcttaaaaaaataaaataaaataaaaaaagtgagacagcctttgcaaagagtgaggca

SEQ ID NO: 102800 - DNA, 1018 bp, Homo sapiens
agttgggctccaacccaggtcagtctgtttcccaaaacccttctgtttgactttgccgctgaagaagatacaatgagatgaagagtcttgggcatgatggcacacaggtcatcaggaagaaggccatcaggaagttggactagaggtgggaggggagaaggaattaggggatttggaaatagagggaaaacaggtgagcctgagggaggcacaggagcaaggggagcaacagagctggccagtctgtgtgtggtggggctgatgcctgcctgctcacccctgtcccctgttttgccaactgtcaggccacagttgtaagggatcttgtggctgtcaggatggcagaggagcaggagttcacccagctctgcaagttgcctgcacagccctcacacccacactgcgtgaacaacacctaccgcagcgcacagcactcccaggctctgctccgagggctgctggctctccgggacagcggaatcctcttcgatgttgtgctggtggtggagggcagacacatcgaggcccatcgcatcctgctggctgcgtcctgcgattacttcaggtgagttcactagagctgtttgtaagaagaataacaaaggtaatcctggctctgctagtaaaggtactggcggtgacagtggctggtctcctgctcacctcagagcctcccctactccttgtggctatgacttagtcaacaagtgtgagagacagaagggggtcttagagttcatttttcattcagtgatcctgtttcttgggctttgcctcctcttctcttccctctcttctcttccttttcttttccttttctctctcttttcttttctcttttctttcctcctttctctcctcccctcccttaccattcctcccctccgtcagtaattattgctgtgtatgcatcaccttctggctcacacctctcatccctcaggtgttagcctctggccctcccagtgagctctgtggcccctctggggtttcttatggcctccttcgtgaccccatc

SEQ ID NO: 102801 - DNA, 1007 bp, Homo sapiens
cggccttcctggccgcgaccctccgcgctggagcgggcggccttgcaacaggcgggcgatttggggccggcctgacgagcctcagttccctcgatcgggcccggggactgcagccgtaggagcccagccttgccagctctcccggtttcctgagaggagccggagatcgcgctgtcagtgcaaaatcaccagagcgcgaagcgtcggctgccagttctgaccattttagatccggtgcgggccgagccgagtggatctggggcgggcagcggggcaccgccaccttccgcctgggctcctcactgggcgccctcgctccggccctccgcggggccgagtgcctccaagacggctccctgggagattcttccagagcgcaccctttggaaggctgccccgctgggaatcagcacccactccctctcctctaccgcagccgccccctttgcctttgtggccgaccttgcttcatgctgccaaggattgagtttctttgaggggatactgctcgttcgggggccctacagaaggctgagggtatctactcagtaaaatcgtaccgaactgaaagttcctctgaaatgattttgactctgccatccatcacttcataaaaattcatcttgtatccttcagtttgtagctatgtggcacattaagcttcctttcttctccccactgaaacttcgaacagtacaaaacggggaacttggcttgtgatgactaaaattggggatatgagactgggggcgggcgcggtggctcatgcctgtaatcccagcactttgggaggccaaggctggcagatcacctgaggtcaggagagactagcctggccaacatggtgaaaccccgtctctactaaaaatacaaaaattagctgggtgtggtgacacgtgcttgtaatcccagctactcgggaggctgaggtaggagaatcgcttgaacccaggagatgaaggctgcagtgagccaagaccctaccactgcactctagcctacaccat

SEQ ID NO: 102802 - DNA, 1034 bp, Homo sapiens
aggtaggaactccaagagtgcaggagtctcattctgtcgcccaggctggagtgcagtagtgccatcttggctcactgcaacctctgcctccagggttcaagcgattctcctgcctcagcctcccgagtagctgggaccacaggtgcctgccaccacacccgactaatttttgtatttttagtggagacagggtttcaccacgttagccaggctggtctcaaactcctgacctcaggtgatccacctgcctcggcctcccaaagtgctgggattacagacctgagccatcgtgcccagcccaagagtgctttttgaatctagcagggtggtaggtcaatgtcattttgtttttctttttacattaagacagatgtatgcacctctcagcattaaacctcctttctgtgatgtctttaagaatcacagtcatattgctgtagccccgtctgtacattccttcagtttcctgaggttggctggttgctgtttggagtggtcagaatgctttctagcacgagctggactgggcctattcaattcactcagaggcaaggccccagagccctgacatgtttgcttgtttcttttttcttttgctttctttcttttttttttttttgagacggagtctcgcactgttgcccaggctgaagtgcagtggcgcaatctccgctcactgccagctccgcctcccgggttcatgccattctcctgcctcagcctcccgagtagctgggactacaggcgcctgccaccatgcccagctaattttttgtatttttagtagagacagggtttcactgtgttagccaggatggtcgtgctcgcctgacctcgtgatctgcccgccttggcctcccaaagtgctgggactacaggcgtgagccaccgtgctcagcctgcttctttctttctttttttttttttttttttttttgagatggagtttcgctctgtcacccaggctggagtgcagtggcgcaatctcggctcactgcaacctccacctcccggttcaagcgattctcctgcct

SEQ ID NO: 102803 - DNA, 2025 bp, Homo sapiens
cagatgatccacccgcctcggcctcccaaagtgttgggattacaggcgtgtggcactgcacctggccacttgtttctttatcagcaagcccagggtgggaggccaggcaaggaagagacccatcccactggcaagaaggcaggcagtgagcacaccagagcagtccacccctgggagccacaggccaggcctttctaacagattcacacttgtttttgtctttctgtgtgtgagtgtgggaggtgggggtgggggtgggtggggcagcatgtgctgcattcgaggggtctccaccttaactgatgtacatggctctttatccccgtggagcagcagtgtgatgaaaaactcttcataggattctatctcttagtacaaaattgttggtaaatgggtttttaaagatatttttcacatttatgtggtctttctcttcttgtctctagctagaagtgaagttggagcttgtctctttgatcccacatataggacctgcattgtcccacatagggacagacccttgccttgggagggactgagagatgacttcatgtggccccttcattttataggagtaatcgagtctagaaccagggtgctaccatctggcagagttcatggggaacgcaggccactcagagagcaggaaatagaggccagctggccacccagtagtctaatgcgtacttccttgatcctgaactggttgtgagccatccctaggggcaacccctcccccgccccgtcccttcatgccagggctctctctttgcttcatggcgaccacctttcctgtcccttttttctgatcaccctgctcagtggcctgtcattgctctctgttgagtgccccttcccatatgcctctcctggacctcagccaggctggtgtgctggcgatagcaccttgtcaccaggggcagctgctatgcagggcctgttggccagggccctgcagcggtggagtcactggtgtgtgcaaacgtctcttctccttttgtgtttcagcgaggatgccatgaggaaagctggtgtggcacacagtaaatccagcaaggatatggagagccatgttttcctgaaggccaagacccgggtaaggccctagtaagtggagccactctggcagagagacttggagaggagagcatcacagactctggaacccctctgttgggtgtcctagggtgtaggggtggggtggttgctcatcgattgatcacaggcacagttggttttgcctgcagcagtctgggtcctcctgtgtgtccatggtacagggagggcacttgggttgcaggcccagcctctggccccagacctcactgccgtcaccttccatctgtggtcagcccctgtgaatcctacaggaagcttgctcaggcccctagctggtcctgtggaagggatcaatgccgtgagcaagaacctggtttgtcctcagcccctcctaggggtccttacctaagccctacagggccctgaggcatgggcccagaagcattcctgtccccttttgctaagtgaagaaggtgatgcttatctagaactcgccacaggtggagtggagaagaaggatttccactatatgtgggctttctccctgggtggggcaccacactgagggctttatgtgaccacctcctttaatctgtgtgtgctccctgggacagaaccgttttactagaaatgaacaaaacacatattcacttgtgtgcacgtgtgtgtgcaaggcagagctgcaagagcacagggactgaggtggggtagagtgggctctgtactatggacacgtgtgactgaagtgggatagagtgggctctgtattatggatacgtgtcactgaggtggggtagagtgggctctgtactacggatacgtttgataagctttttctttttctttaagagctttatacggttcaccctttaaagtttacatttcagtggtctttaggatattcacagagttgtgtggccatcaccaaaatctaattttggaacattcattaataaataaaaagag

SEQ ID NO: 102804 - DNA, 1058 bp, Homo sapiens
tcctaccctatcctgtgtcaggtttcctcttctttggggccataggcatcctcatttctacccactcctgctctggaatcttcctccatcccaagccaccttcccttctcataccttaattctcctcttacttcctgttgtctaactctcagcacgtgctggtttcctcatcctagaacaatctgcctggttcttcgtcccaagctctcattacctcactatttttagcacatcagataagtacaccagctgggtttagggaggacccacagaagtgccggctcaagttccttgtcacgttctactcttgtgtacttggtgcattttttttttaatcatgagcttatacttgataataaattgtttttaaatgtatgagtttagaatgctcacatgagttgccttgtcatcccacttcagagactttgtcttaaaccagttctttgtcagaagttcagtggtgaagcttgatatcctgcccacgccctccccagtctggccttggcccccacatcctgtttttagcttccaaggggactggtcttctgtgtggcactagttgaaagttacagtgggggctgggcacggtggctcacgcctgtaatcccagcactttgggaggctgaggcgggcggatcacgaggtcaggagatcgagaccatcctggctaacacggtgagaccccgtctctactaaaaatacaaaaaattagccgggcgtagtggtgggtgcctgtagtcccagctactcgggagactaaggcaggagaatggcatgaacctgggaggcggagcttgcagggggcgagatcgtgccactgcactccagcctgggcaacagagcgagactctgtctcaaaagaaaaaagaaaaagttacagtggattctctacttcaggatcttgttaccacctttgtcagaggccaactctccctgcccttcaccacttgcctccctggtctccctgaaactagtagtgttgtctgatgggcatttgataccccttcctgacacctttcccaaagactactgcatgattaaggccctttcagatcttc

SEQ ID NO: 102805 - DNA, 1038 bp, Homo sapiens
tcgacctccagctggtgttgcatgaggtgatggtgatgtcatgttagcagcactgcttctcagaagttgttcagcttcccatggtttccatagagagtctagacgtgttaaacatctgccctcacagcaggtcttggttgggagaggaaagccccaaagggccccaccaccctcccaccccttcaggcctcagctagctgggcttctctggatcttggcacccctctcccagagctgacagtgcatctgcagccacacttttccttctcctgctgacaagcagaccttgaccgtcaccgtgaggctcatgccactgacctataggggcaaagcaagcatcgttgcagaggcttcagaaatctgcagttgccccagcttttatcctagcttccatggagctgtacctattccttgtcatcttttgctgaagtttctaggtatgccctttgaaccatcctagtggaatggtagaccagagcccaggcacacacttggtgcctccccggtgtcaggaaggcagctggtgttggcctcggggggcccagagcctttctgtgggagatgtgcccctccccgtgtgagtgagaggtcagcctgtcagcccaggaaggccttttttttttttttttttttgagacttttttttgcctcttactctgttgcccaggctggagtgcagtggtgtgatctcggctcactgcaacctctgccccaccagtttaagtgattctcctgcctcagcctcccaagtagctgggattacaggtgtgagccaccatgcctggctaatttttgtattattagtagagacggggtttcgccaggttgtccaggctggtctcgaactcctgacctcaggtgatctgcccgcctcggcctcccaaagtgctgggattacaggcgtgagccactgcacccagccaggaaggctttcttgatggctctgcagatggccacctgggcttcctgaggcccagactgtcacagggaggagctggtgccacagaggcagatgagtgataaccgagtgctgcttgt

SEQ ID NO: 102806 - DNA, 1244 bp, Homo sapiens
gaggctgtgagttccacgacctgctcacatgctgctggtgtctccttgactagacccctttgggttctgcactcttgtctgctaaaactgcttctcctcctttcccatagcctctggcacagtatccactgggttcacagaatcaggttgggttgctgtatgtggaggaatgactttagtagcagcatgtaggactgatttttataaacacaaaaagtccccaatgttttcagtgtgcgatatgtgccaggccttgagctaagctctttgtgtacagagcctcactgtttcttgttgtagcaggtcatagtttgagcatttagccccttttacagactaagagtgcccccagggagccaccaagtcaggatcgagggctcaagtgaaacccttatgccttggcctctcagcaggattcttctggaaactcctcactccccttcctgctgggctgatgacctggcttctccttcttgtttactgggcactcctgggtgggctccctccatgcccccacaagaccaggctctgtcctgggctttggcttgcccatactctgttgtgggctggccactccccacacccagctgctggtgtttccacctagacttctcacaggcagcccctccctccctccctccctccttcccaccagttcccaaacccactcagtctttccctccccagccttccctggcccttagattaagtctgccctgagttatgccagctaataggtctctctctctctagaagcttccaacccccaaaggcaaggaggtaaggtggagcagaggaaggatagagaaatatatgatgaagctgaaaaagttattgccttggaataaatgccatggagaattctggtttgtcctcattgcactgtgtggggtgagagcgctctcatgggaagatgctggctaactgcacacagatttaatcaccaggccccgcccattcgcactggcagtgagaggcacacccctgaacctttggggttgttcactgaggacaaacgcggcagcatttagaaagtattcctcgtcccggcagtagacaaaagccacaggatttatggaaagaggaaggaaggcacagaactggggcaaggttctggttttgttctgttattttgttgtcattgttactgtttgtttttctttttttgagacagagtctcgcacttgtcccccaggcaggagtgcaatggcgcactcctggctcactgcaacctccacctccca

SEQ ID NO: 102807 - DNA, 1782 bp, Homo sapiens
ccctatagcctgggtttctagatcatcaacaggctgcaaaggtttgaaattgagtaccagggggacccggagctgcagcccctctggagttatgagattaccagcttggtctgagcatccttccggctgtcatctgccatcaaacacagagtgagtgggcaggagggctggcctggcctcttcagagagggttctgggtgctcctgcctggggtgcagtctcagggtggcctgtgggggtggggtgcagctgtcctgaggcctgtggtgccaccaccccatgcccccgtgccactgcctgcgcttcagtttgcagaccagatggcggctctgtgttcctgagatgacttccttgccagcttctgttgctaccacctcacagagcccacgctggccagcggccacaggctcaacctgcacttcctaggcagctacctgacactgccctggctactgctggctttcttcatggcctctctgttctgcatcaggcccctcacctgtgcactgctgttcaccctgggctacgccctctactccttggccatgatgttgctgaccaggtggggaagctgcaccagccctgatggcattggaggtgggaggccactccaggtgggaacatggttatctttgggctcctggtgggggcaggggggttcctgcagtcgtggatgcatctaggggaaatgggactaaaaagggaagaaggtagcttcaataaaatctagtgcttaaagacacagcaactgttcgatgatattgaagtattcaaaatatatgacaactacagattcactgacagaaaccaccacggggtatctcacaccttcattcaccccacagatgacacaccagggagaacagcgtctcggtggtgatttttttttttttttttttgagacagagtcttgctctgtagcccaggctgcagtgcggcggtgcgatcatggctcactgcaacctccgcctcccaggttcaagtgattctcctgcctcagcctcccgaatagctgggattacaggcatgcgccaccatgcccagctaatttttgtatttttagtagagatggggtttcaccatgttagtcaggctggtttcaaattcctgacctcatgttagccacccacctcagcctcccaaagtgctgggcttacaggtgtgagccagcgcgcccggccagtgctttgtatttttatgtaaactcagaatacaggtattttagggcctgtgaccaaaaaccaaaccaagcttgtaactccaccagggatctgaataaacctgcccttgcttttgagttttccgccgcctaggctcagtatccaggcggttcacccatacagggtccctgaccacgtgggggctgtggaaacaactgctgggcaccctgttggcccctcaccccagtgtccacgggcctggccctctggtttcctttgctttccttgcccaggggcacagtagactcggcagcagcaaaaccaaggcgcatattaacactgaagtgcctgagacagaaaggggctgggccggagccatgtgaattttgccttctactcaatatcaacgttgagtagattggcctgtaatcccagaagtttgagaaaccaaggcagggaggatcacttgagtccaggagtttaagcccagcctgggcaacacagcaagaccccatccctacaaaagattcaaaaagttggctgggcgcgtggcccacgcctgtaatcccagcactttgggaggtcaagacaggcagatcacctgaggtcaggagttcaagat

SEQ ID NO: 102808 - DNA, 1046 bp, Homo sapiens
attttcatggtgacccccaaactgttccttaacccttccttaccagcacagagcagaccagtggccaccttcccctcatctcctgcttgatcctcacagcagacccccccaggcttccatggcacctggcgtggccactgacctctcctttccttgcccgaggccttcccctttggaccctctgggggatcctccctcagccccctcaggctctgggctggcctctgccatggtggcttcagtcctcttggaaaggggcctcaggcctgctaaggatgcagcaacctcagagggcctgggtctcacctgcctgtgtcctgccctccctgcctgccaacagtctcctgagctgtcatccataacactgcacagttaaggctgagaccggctggaccctgcctgccctgcagccaccaggcaccaggcactgggtggaagaccgcaggtatacccacagagggggtctgcacagaccaagctgcgggcccatggcaccacagtttctccctggcaactcgtggcagcatccttgggaggcggtcttggtctctggcatgcgtttgtcttggctgggttggacattggcttctgtcactcctcctggtgtttgccctcctgcagacactgtcgggggctctgtgagccaccagctccctcatttgccctccccatgtcggccacctgctacatgggagacactgctgggcaggacctcaggaggacacccctgggtcatggctccccagatacctcggaggcatcctgaaaacctgtgggcagcaaccaggttctctgtgcccccggaagtgggcgctaggttcgtctcctgccttccagttcgagcagctgttcccggagccggagctcgtcatccccctaccgccagcaccgactcttcacagcctgcacattcgccagcagcatcctgtcatagtggccaccagtggtcactgatgcctccttcaatgtgaagagtcacatctatggcctggagggccaggactgcaagtacacccgatgttcgggcccgaggcttacaccctggt

SEQ ID NO: 102809 - DNA, 2725 bp, Homo sapiens
cgaggtgcatgcttgctccctggtggccccgtgggccataaagatggccaatggccccacaagccaccgtgttccttaggcaagggcagagacgcactggagaactgtgtgtctgtttcctgcctgagccctaggtctggcacagaggaaggctgtgaagggcaacatctctctgccctgctccttcccgccctgctctgcgtgttgtgacatctagcaggtgtgttctgatgtctcctgtgtggagcccagtggtcgtgctacttgggcaggaggcatggcgctcacggggcaggatatgcaccaggccagctctggctatgctgggccgaaggggtgcttcggaggctgcagcgctgcagggtggtagattggagggtcctggctgggggccagcttagcctcagtttcctgttgcctctgggtgtgtgtggctgtggccaggtcctcgggggctcctgcccttgggagccctccatatctggagggtgggagttcctgatgcggtaggagaggttgcctcctggagtcagagctgatgcacacaccacctcggctgacctccaggctgggggagtgcggagggcagggcctgggggcctgagcctgtgctacccttggggacctgtcctcatcctcagctctcagagagatccactcatggaggggacattgattgggttttagacataggaattgatcatgtcatatacaaatttgataaatttctcaaaacaacccagggaaatccagtcaattacatatgtgtcttctctaggcagagtcctcctcctagaacatgctttgccagtttattttctgggcctcaggatcttgaggccttggtggctgacagcatgtcccagagagaaggccctgggtacttgaagggctgtggtgtgcacatggcacacacggtgtggcctcagagtcactggggagagcgggtcccatctggaagggcagtgagttgggcccttccaatgagctggagaggcctttaggccccagcgacattgagaggccacccaggtgacctggagggtctatccgcccccagcctccaaggctgaggagagtgctgtcacagctctggcctggctgccgaggagggtgctgcgctggtcacagctgctgggactgcagttgtttggatggtcactgaccatgcttttgttgtttttttctcctcacttctgggctcgttctcattgctttctttctccacttccccctcccatgtccggtaccatgtctctccttcaccaccctgtcctctcatgcttttctcttctgcctcttccggcttctctctgttcactctctcagctggaggtgctgcactaccgactctgtgtctccagtgcccaccacagcccccggcagcccaacctccaggccctccacacctaccaagtactggctgtgctcgttcattcccttcccctgcccggagtgcgtgtctgcgcctggcaaagcaaggggctggctgggcccagctgcaggtgactcagaggctagtttcaggcagagtgaagcccctgtgttgagggaggcagagatcagcctccagcctggcctggcccctggctttgcagactagcctggcttgtgggagtggggtgtggctgtgtgtcagaatgaggcatgtggcctgggctggccagactccccaccagtggtggaggtgtcacaagttctctggtgttggaggctctgtgctcggccctggtttgaagagctggagtcgtgaggcctctgcagtggcccggttcacccccactctgcagggcccagtgctaaggaaggagctgaagacacagaggcctgggacttacggtaatgtgggtgctgccctgttcagaactgtcatccagcttggaggttccatgacccagactgtgtgtgaggcaagggggttggggaggacctggggcttggccctatagctcacagaggctgtcagtccttcacctagggagccctggccactcgtagacacctgtggaggtggatgagaataggtagtgacctcatagaggttgtggtctgcctaggcacaaatgacaagcgtatggatggatttgaggtcagtgaagcagagttcaggcccatgggggatttcggggacgacagagttagtgagtctgtgagagcccggggagacgagctgtgcccacagccaggggtctgtcccgttcaccctgcgaaggagcacacgtgattgaatgggaatttgagcgcaagatgaaaaaaacatgtgggccccaagtgccggtgggttgggatggcaaccactgcatgtgatggcgtccctgttccgcaggagccactggagaagagggacatgagggcttgggccagggcagtgtccaggaagcatctagcaacccccatggcaggacaggtgaccagggagaccctggaggagtgagctgaggtgctgtgaggctgggcccagtgggaaatgcggggctttgggtacacatctttgagaagcaagcaggtgtgactgtggccagggactacacatgggaatgtggcccaggaggggtacagagctgagggaaaagtttggctcagcaaatctgtgggaaaatagcctgagaggctttcatgtgactgctgggggcaggggcagacactggcccctccagaccctctggaaggaccaggtgatgttgggtaagtgaacctgcaggggaaggcaggttcccagttccta

SEQ ID NO: 102810 - DNA, 1007 bp, Homo sapiens
ggacaggtacctgtcatggttcctgcccaccaaaggcagcctgccaccaccctcactgtcctccagcccaggatgggccagtccctcacctgctcccaggtaaggctaccctgattgtgaagacctggcccttccataagggagtggcctggtcagttgaatcacccaccaggacaatggtgccaccctttgtccagggttcccaaatttgtcttatgcctcattccccacctccagctttcttagcacagactggagggtgggggtgaggagggtgatctgtcctttagttttcgatgtctgtggccatcactgaagctatcaggtctctggaggcctccacggcctgcatgggaatgggctgtgttctgcatgaagcagccctccccacatgcagtgtctgaggtggtgagcatggcagaaggcttgttctatgggggaaaaaaaaatggaaatctctctgggccccaggaccaggtcttgaaggggaggccctgggccaaagagcctgtgtgtcagtccaaacaagctgagcctgttggtgactgcacaggtgggaagtgtgaaccaggggctcttgtgcctagctgtgctggggtctcagtgggccctaacccagggcctcttggctgacttcccaggagaccctctggggacctcccaggagaccctctgcacaggcagcagctgcctgtgctcctctgaccctccttaatcttgctgccccatcgccttccctgggaggctgcgtgcaggccccttcctgcagatgctggcccaccccagatctgctggcatgtgcaagccaggacaggcctctacctacaattcacatgtgtggacagatgccccagagggtggaggggagaaagggagcagcaaggaggagaggctgcctgggtggcggcagtggtcagtgaccctgaaatgttgctgatgctgtggaggacttggaggtgaggtggattcacaccctctcagatgtacaattcagttgccaagtggtt

SEQ ID NO: 102811 - DNA, 1158 bp, Homo sapiens
tctgggaagggtgttgctttcctttctaatagagcatccttcgcatccatcagaagtttctgacattaaaaaaaaaatcttttggtgtggtggctcatgcctgtaatctcaacactttgggaggctgaggtgggaggatcacttaaggccaggagtttgagaccagtctgggcaacatactgggaccctatctctacaagaaatctaaaaattagctgagcgtggtggtgtgtgcccacagtcccagctactcaggaggctaaggcaggaggattgcttgaggccaggaggccaaggctgcagtgagctgtgcattgcgccagtgtactccagacagggcaacagaatgagaccctgtctcaaaagaataggtattttgtttattttattttatttttcattttttcatttttttgttttttttttcccttaatttaggcttttatcacacacaaaaaatgtattttgatcagaggctgacttacttaactggcccacgtctaaagcagcactgcttggtaagccacgtaccccagtgaaagaacccaaagctgctcttctcattggcatcaccgcaccagggttcctttgagcgcagggctgatcccatgggtctcagccagggagtggcctcctcagagggagctgggcagcaggtggtgcaggcctggagctggggcaggagtgggtgctggtcctgcctgcagcctcaccgcacactgtttcaggagctgcacgccatctccccatggctggtagcattttcggcagcctggatggtgtccttgtgggctggaacctgcgctgcttacagaggcgcgtgaatcctgtgaagtacagcatggtgatggaatttctcgaccctgggaaggtaggtttgacacccgagagaggcagggtgcttcctcatggtgattccacttttaagtcactctcaatttcttaaggttaagatacaatcaaagcaagataatttgcagttcatataccctgtttttgtttgttcaatttcatgttcagcggcccaatgatgaagttggtttataagcttcaagctgaagacttaagtttgactttcccatctcctacctgcccataagtaaaccacagtggtgagagtggtgctcgggcagtggaccttgcacagcccagtggtga

SEQ ID NO: 102812 - DNA, 1046 bp, Homo sapiens
catgaggtcaagagatcgagaccatcctgaccaacatggtgaaaccccatctctactaaaagtaaaaaaattaactgggcatggtggtgggcacctgtagtcccagctactcgggaggctgaggcaggagaatctcttgaacccaggaggcagaggttgcagtgagccaagatcatgccactgcactccagcctggcgacagagcgagactccatttaaaaaaaaaacaccagggcatctgtaagccactttgggagtcaaaagaatgtagggctgggttggactccttagaagaaagttaagttctgagtgtgggaggaagtgcctgcacgcccacttccacagagagcccctgtcactcctgctaccgaagactggcttgctgattcgggctctgcttccacagtgggggtacagagccagggagagtgcccacaggcccagggatcctgggtgtgggaccagggagaatgcccacaggccccagggcctttttgagcccagggcgctctctgcacaggcccgctacaacttcatccgaagcatggccgcctacagcctcctgctgttcctgctgcagatcaaggacagacacaacggcaacattatgctggacaagaagggtcatatcatccacatcggtcagccagccacagcgccaccctcctctcccttcacccctggcacccaggggtggatagggatccccaccccacagagaggagaatgcccaggaccaccctgccaggagtgtcagggtccagctctgaggtccgaactgtcggccaccaagctgttctgctgtagagggtgcctggccccggccccagggagctagggcgagagccgccattgctctgagtcagaagctggagctgggcggagtggggctggtccaggttcagtgccccagcttggctccttcctccacttcctcccttctctttctctgcctgctgccccaccacccaccccatcactgtctccaagaaaacacaacctgcctgttgggggtggagggggtgctcctgttgcagtccttttcc

SEQ ID NO: 102813 - DNA, 1061 bp, Homo sapiens
ttagtagagatggggtttcaccatgttggtcaggatggtctcgatctcttgacctcatgatctgcccatcttggcctcccaaagtgctggcattacaggcgtgagcactgcgcccggccaggtgccctggtttttttgtgtttttttttttttgagatggagtctcactctgttgcccaggctggagtgcagtggcgcaatcttggctcacagcaacctctgcctcctgggttcaagcgattctcctgcctcagcctcctgagtagctgggactgcaggcgcgtgccactatgcccagctaatttttgtatttttagtagagacagggttcaccattttggccaggatggttttgatctcttgacctcgtgatctgcccgcctcggcctcccaaagtgctaggattacaggtgtgagccaccgtgcccggcccaggtgccctggttttaacccttaacaaaggatgactgaggagagcagggtgtgggtggaggctgggtatgggtggctggggtggggtggagcacacacgacctcccccggcctgtggccaccctggctacctgctggaaggccagagtggactcatccccgtactggcgtgtgaagtagtcgtacatgccgaagtctgtctggcggcccagctggtcccgggaggtgcagtcggggatgcactcgatcaccccgcactaggaggaaaggccagttctgaggcccgctgggtgcgaggtgcccagggctgccctactggctccactcagggaacttaccccaggggcagtggccaccacgcggtagggaaaaacaaagaggtccaggccgaccagctggaagatgttcttgaagaggtcgatgatctgcagggccagcatgtcctgggaagccgggaggcgcaggatgcggtcagttggcgtccttgcaccccagcagctcttctggctcatgcagggcaaaagccaagcacccagagatggagtgaggtggggagaccacagccgagcaagagtctggaaggccttcctttctgaccaccgggggctggactcaggctgctgggacca

SEQ ID NO: 102814 - DNA, 1034 bp, Homo sapiens
tttcattgcttcacctgtgacattcataaatgacacgggcttttttctccctgcgtgtgcagcagtgaggattctatgccctgtgacattcataaatgacacgggcttttttcttcctgcgtgtgtagcgtgtgcagcagtgaggattccacgtccacttgtgcgcttggcccctgccttgagctccgcttaggcaccagcttagcttcccagcagcgtcagctgtgtcaacacagcaaaaggggcacacggcagctgttatggtctcaccaagcctgcagagcatactctgggcactgccagtctggggcctgggaaacagggctggtattcctgaggggcctctgccacagccacagagacttaagcctctttgcttccttggcagctgacatcggcgacctcctggatcagttggtagaggagatcacaggctccttgtccggcccagcgaaggacttttaccagcgggagtttgatttctttaacaagatcaccaacgtgtcggctatcatcaagtaagtgcagtgcttcagaaaccaccttctgggatctccttccagtccctgcagcttaacagaattgcctgggaagctttaaaaatacccgtgcctggccccaaccagatgaatgagagtctctagcagcggggccgctggtggttctgatggacagccagggtgggtggggaagcactgcttggggtgagccagggctcttgaaggtatggcagaatgcacggccacgccagtttcaggaaacacagcttagtttcattcctgaggtttgtggaatttagcacatggctccacaatttgaggccaccctgccctctccacactttgaaggatcgatcctcatggtgtcaggaaaaccagactgcctttgcaggtcctgtcatcgttttcctagaccttccattcatgtggacctgacaccatccttggatgttgatggctttgtgcattcataagggatgaaaccctggagtcatcaatgctgggcacgctggctgggctgtctccagtgcttac

SEQ ID NO: 102815 - DNA, 1033 bp, Homo sapiens
aaaaatgtttagccaggtgacggctaaatgttctattatgccactaactagtaggtctgaacattagtgttttttaaaaagaggattataatctgctgtgatgaaatgctggaactttcttaaagaaacaggaatttttctacacttaactgtttaaagggcttcctttcaccatccttgtcttaaaacccctgcctcttactccttttcctaccatatcctctcctgactctccacagctgctcatccagtgagtcagtgtctcagtcaacagtccaggggccacaaggcacctggtccatgaaggggcagctactggtttccaggtgttcccacctcaggctaatgcaaggcggatgtcccatgagcactgtgctttgagacaatgcagagctgcgctgcgatcctattccagaggatcaaagtagggctggagagaggatgcagtacattggcaagtctgggctcacaatggagaatcacccaccctggacacattcacaggaggctgtggaccatctggtgggattctaaacagggactctgcagtccctctcagccaccatcggtctgaagttctgtccccataagagctgccacagagagatcacaggaatgtcactgctgtctgcagcatgtgcctcctccaaatactctgccactgaaaggtgacatccaggaacaaacccaaaccctccccaaggcggttccggcagccacctgccaggagtgacagcctccacatgcttcctatccggcaggaatcagatcttggctctgaattcaccctgctgctacctccctaggctccagctgctgcagcaccccaggcaggcatctgaaaagatcacgagggttgctgggttatctctgcacagaagggctcggggagtgtcctggggctcgaggactagactacttcctgactatccttgaaaggggctgcagggcactcctgagaactcatgacccagctggcaagcaccctgcgctggacctctggtgaggcctgtgtcaggctgtggtgcccggg

SEQ ID NO: 102816 - DNA, 1038 bp, Homo sapiens
tccgctcactgcaagctccgcctcccgggttcacaccattctcctgcttcagcctcccaagtagctgggactacaggcgctcgctaccacacctggctaattttttgtatttttagtagagatggggtttcaccgtgttagccaggatggtctcgatttcctgacctcgtgatctgcccacctcggcctcccaaagtgctaggattacaggcgtgagccaccgtgcccggccaatttttttattttttagtagagacagggcttcaccatattggccaggctggtctcaaactcctgaccttctgatccgcccgcctcagcctcctgaagtgctgggattacaggtgtgggccacattgcctggctgagaccttctgatccgcccgcctcagcctcctaaagtgctgggattacaggtgtgggccacattgcctggctgagatggttttctttagcagacccacggctgacaacctaactagcaggaaaaggaaagaaaaaagcagatgcagtgactttctaaggcagctttctggctccacttagaagagggcaaacagtccttacagtctgcccccacaggccctcaagttgtcaccgtactaaaggactatacgttgccggtgatcagataactgccatcttttatcaagaaaattatgatatttgttttattctattttattttctacttttttttagaaatgcagtctcattctgtcgcgcaggctagagtgcaatagtgtaatcatagctcactgcagcctcaaactcctgggtgcaagcaattctcccaccccagcctcacaagcagctaagactacagacacatgccaggtcccctggctaatttttattgttgttgtagagatagggcgtcttgccttgttgtccaggctggcctcgatctcctggcgtctagcaatccacctgcctcagcctcccaaagtgctgggattacaggcatgagccactgtgctcagcctattctattttaaaggctagaagaagtccaggtgtagtgactcacgcctgtaa

SEQ ID NO: 102817 - DNA, 1037 bp, Homo sapiens
gcgcagcatagggatttggggagacatagttcagcccatgacagtcactacggcagctcagatgaactgacctcgggttgttgagaagcagcttcaccctcttccagagcattgtgaaggacttcgctgcacgctgtgggatgatcctccaggaggccatgaagtgggcacctaccgtcaccaagtcccacctgcaggtacttgaaaccatcaaaaggcaattgccataagctccttcaaactcccaaaaaagctttacagagacatgaagaactcaaaatccaaatagcactagtgtgaatggagactggaagcatcagtctagggcctgagaataatagatgcctcagaggctgctctgtgtgttaggagcgcctgtggggccagtgctggccagggcacaaggagggcatctgacggctcacaccaggtgaggtgccaggtctgtggcaagacttgggggctgctcacgagaggaagggcttgtgtggtggatgtgggaggctgccagatggcagcatctctaagtgccaagtgcattgctggcacctgtgcccaaaggcaggggcctgaccaaggctggtggagcagaggcagagttggggacttgtgtcccattaaagctccacataagctgcacatgtaggtgcatgggagtctttcagacaaaaacactggtttggaaactcagatggccacgaagtaaaccatgtaatgccacagggtgtgagaggaaagaattgccttaaaaggaatcaaagatgagaaaaatacctctggaaggaatctgtgttagcagagagtgggtgtgctgagaggaactcttgtgaggtttaccctggcagcactttaaagatgaaacaggctcaaaagtgtttctggttgtggagtccaggaaggatagagcagccagctccaagagccctgagagctgtgtggaaacgcagtggcaagaaactatttccctttgttcatttacagcaaaagggcctcaggtcccaaggctgtctgtcgtctgaagaggggaggccccctct

SEQ ID NO: 102818 - DNA, 1029 bp, Homo sapiens
cagcctgggcaacagaacgagattcaatctcaaaaaaaagagaaagaaaaaagaaagggcacatccactctatggagttctccctcaaatcctgtaaccctagtcttatcatggacaagcatcagacaaacctaaattaggggacattcaacaaaataactgttcttcaaaagtgtcaaagtcacaaaagacattgacagactgaggagtcaccacatattggacaggagtaggagacacagattaaatgccacctggtgtcctgggttggatgctggaacagaagcggggcatgtgtgggagacctgggaaatccagacgaagtctgaagtttaggtaataggattatatcaatatctgactcagttttgacacatcagcctggttactgcagatgttaaaatccagggaagctaggtgaagggtatatgggagctctgtgctgtctttgccactctctgtaagtctaaaatcatttcaaaagaaaatgattgaaagttgctaggattctctctctgttgctgcaccttatccatggaaaccttctcgtttcagggatgatgcagtgtgtgattgcagtcgcggacaaagtattcgatgccttcctgaacatgatggcggataaagtaagcctctccagcatgaatgcgtgtctgtctgctggaggcatctggggcactgcggtacctgtttcttttgcatctctaggccaagaccaaggagaacgaggaggagctggagcggcacgctcagttcctgttggtgaacttcaaccacatccacaagaggataaggagggtggcagacaagtatctatctggtctggtggataagtaagctcattttcctgctaatgttttgtgtgtatgtatataaacttctgtgatttcaaatgctgggaaaaatcatccttatattattaatctaggaaaaaatggagtcagaatgaaaactcctaagggtgatgcagcctccctccaatgtctgtgagtttcctgcagagtctgaattttggtgcagaaacttctg

SEQ ID NO: 102819 - DNA, 1100 bp, Homo sapiens
ctccttgggagaggtaaggaattagtcacaccactcatttctgtgcttggtattcagatgaggggcctggtggagaaaggcttgagtgacagagtcaggtgtgcaaggatggggtcaccggagcgggaggtgcttaggacgcgctgctcaggtttgctgtgaagagtggggaggtgagaccctctaggtaacagcagacacactacagttacagtgacttctatgagcttacagcatgggctattgtgcagaattgattccaacaagcctctcttcttggtcgtttctaagctcctctcatatgggcctcgaattcagattggtagcgtaaactacgtaaatgatgccagaacatctctgttctcgttgttggaatggaaacaaaatgagggtgcccccaaggcacttcagacacctagacctccacctctaggacctgctggggttggccactcttcccatgaagagcaggcagctggtgcgatgctcgtagatgaggaaaagaaaggggcggtcgacagtgaagcggacttgggtggacagcggcatgaaccccaccgtggtcacagtggtggcttgggtgccttcctcgttcactgtgatcgtgccttggtgcttgaactgtttggaaaggaaagttgtcagattctggaggtcagcacacagagggctagagttcccagcacaatctcatatcattcagggaaaggatccaaagacaacatgtaaggtggaaatcacagctggtcagagtcactcttgaaaatatctgtcaccacctgtcaggggcagccgttgcacttagaggccggctaggttcatgttccctcttggcagtgcctgtggtctgagggtcgtgggggctggtgcaggacagccaccccagctccagctccccacactgctgcgcacttctccgggatggggaactgggtctgctgcactgtttggactggtgttctctctcttttgctgagcgcccgattggtttaagttaagtatgtgtatagtgcggtgtttaatggctctttcatgatttggctgggggtagctatttcccagaccgcagcacatgtctcccctgtctctggtgtcagcgg

SEQ ID NO: 102820 - DNA, 1047 bp, Homo sapiens
tagacattaatttgattaatcctcacagcaatccctcaaggtaagtgctgctggtctccccattttacagatgaggatactgaggcacagaacctgctactagagtttcatagctactagatggcagagccaggattcaaaccaggcagcctggctcagagcctgtgttctgaatgagtactctcctgctttgagtaacagatgggctagtttctgtaagaggggatctgagagattctgagtgggtgtacatgaacaaaaggcattgaaacgggggtgtctggatgctcaagagtgtggaggactccacaccggctgtagcagagagggcgctgggtgagcagaagtgaccactgcctttctgggtatgggacagacatggcaaaggactaaaagggttttttgagattattacatttagaaatgagaagagccaaaaggaagctgcagcaagatgagaaatataggacaggcaccagaaaagaagagtggtgaagcaggttggagaatgacagaaaagaagagtggtgaagcagtttggagaatgacagaaaagaagaggggtgaagcagattggagaatgaattgaaggagtgggccatccgcagcatcagggttcaccaggaagccgagaggatggcttggggcaattcatccagcccctgcaccatctgctctcagcagagtaaggaggcagagcccagtgtgggaagtcaggaagggagcaggggaaagcagggctgcagggtccccctgcctgggtgtggattcaggcctcaggcagaggccttcccttctgtgagctgaaattgcttctgcagctgtaaaaaggaggggtaacagtgccagccccctagggattgagggtaaggagactctgtgagataacccacaggcatgcctacaaagggcagtgacgttccccttccgtccctactcccttttaccactcttcttactggtattggtctcatggggtcagaagcctgtgacaggactccttgtgtggtccctggagtccagccaacctgcacttgaacccagccc

SEQ ID NO: 102821 - DNA, 1041 bp, Homo sapiens
gagtatcagcccactgcagcctggacctctggagctcaagcaatcttcccacctcagccttccaagtagctgggactacaggtgcacatcaccattctcagctactttttctatttttttgtagagatagggttttgccatgttgcccaggcttgtctcgaacttctgagctcaagtgatctgccccacttcagcctcccttagtgctgggattacaggcgtgaaccaccatgcctggccccattggttgatttttcaaaacagaaattttcccactgtgtagctaatgttgagtagtgtatgcttgtgtgtttaaagtgctgttgtatgtgggccttttatgtggcctggagggaaaagtaaggggcatgaagcccaagccactctgttggcagcaggctctgcaggagagcaagttttaggcagatagggaggatgcttagggcaacactaaaatcagtgagttccaggatctttgaccatcagaacttgatgacctgtattcttgtgaactttcaaatatgttgagcagttgtcatttagagcttaatatatgcatagtggaaatctgtcgggcactttgcactttagggaagcagtgagtggtgaggttggttgaaattacacaaatttgagggtcacagggttccaggttggactcctggtcctacatgtgggatcgtgtgtgagcctgcgcctctccgggctgctggggtgggtggtacaggcagaactgttatctgtgatagcttagcacatgctcatttaaatactcccctgatgtgacctcttacatgagaagaataagtgtatttttagtgaaagttaatggttatattatggaggaggaaacaaatatttgattttattgctcaacaaagagcacagagatcatgggtccttgcatttactttatggttaccccttggaccttctggaagaaactaatttccagaggtggttttttttgttgtgtgtgtgtgtgtgtgtgtgtgtgtgtgtgtgtgtgtgtgtttgttttttttaaatttttttattttt

SEQ ID NO: 102822 - DNA, 1049 bp, Homo sapiens
aaggaggtgccatgagctccaaggactggctgtgagggtgtccttgatgtctgggaggggattgcaagaggatgtcacacaactgtgcctgttaaccatgagtgggtgaaatggcagcaaggcctgaggtctgcacatcctggaaacagaaatctcaggtcaacaaatctgagggagtttggcctttttcctttgtttttatgtcattgctatctaaggtagaaaagcagtcccaagtgacttcagaattaaaggcattttgtgcatatagtttgatacatagccataatttgtatttattggcctttatctgcatcacatttttcaccatgtgagtttgtcatgggttttcggtagaaggagctagcattcctgtctctgtgtatgtcagttgcttcatgaggttctgtttccttggtaggtgaagaagatcgttgaggaggctgttctcaaatctttggatgccattgtagccagtgtgatggaggtatgtcgcttctgagggcattaccatgagatcagcctgacttaaacgtgtgtagagaaagcaggaagagtttgagcgggggctggagtggaaggggttttgcagtgttttcactttccttgttcatgtggtaacaatccacctgccgcggagggcttggtctgtggtaggtaccgttgcatgctcttttaaatacgtcacctcagggtgcctctgactggtggcattacagacagaagatagagttttagtgagaactcactaacgtgcccacatcacatagttactgtgggagctgggagtctggcctgggtctctcctactcttttatcttcctcactcctttggtgcttccaaagctgctcctctgggctcagagctacacttttctaggcgtatgcaagtcctggtttttaagtgtaaggggtgcgtaactagggaactttttttttttttttgagatggagtctcgctctgtcgcccaggctggagtgcagtggcgcaatctcggctcactgcaagctctgcctcccaggttcacgccattctcctacctccgctt

SEQ ID NO: 102823 - DNA, 1039 bp, Homo sapiens
agagagtgagggttttgtccctggaaagtcagctggttggccacttggcacagtcgttgtggagggatgtatcatatatggggttggttaagataatgtctgaagtgccttctaattctgacttagtttcgtgatatttacctaattttgtttatgttttttttttcttgtttccttgactgttacagattttagaggtgcttttgcaggttttgcatgtcctcttggggatgtgccaggccttggagattcaagacaaaggtacgagtatccttaaggtttttcttaaaatggttttgtggttactctttcccttgcttttctccagtcttttctgttgttgggtacctaatatatatgatgggagaaaaccttcctattttagtttgatttgttgtgtgttagtatcctcagaggccacatggggtcatgtgcattgctctgctacatagacgctgggtcaccttggacaagtaacttcacccttctgggccccagtttcttcacctgtaacatctgtgggtagattagttgacttccaaaggtcattttttctgtgttgtgaggctaccaatatgctcctaagaggaataaatgtataaggtacttgataatatggcctagctattttattgatttgggtgtgccatgaatagatgaagaccttccaagcagggcagctgggtgtattgaagtcatagtctgaagttgttaatgacaggttgaagatatcacttgtcagcccttggggtggaccccattattgtggcttattgtgaaccttcacagttattagtgggtgggttgtgaaatcttagtcaatgttacaagttagtacttactatatgactctatcaggatactttcttatattgtaacgttttcacttgatcttctagaatacctttgcaagtatgctatcccatgcctgataggaatctcgcgagcatttgggcgttacagcaacatggaagagtctctcctctcaaagctctttcccaaaatccctcctcattccctccgtgtcctggaagagctt

SEQ ID NO: 102824 - DNA, 1050 bp, Homo sapiens
ctgcttacaaagttggcctttggctggcatctgggaaataagcacttgaatgctttcctcaatcctgtaactattagtaataaagatggttcactatgcctagatcctttttacaaactatgatttatgttgaatacctgctttccttctgggaatctgatggctaggctggtggtgcataaattaaaaacttagggtgctgattctctaatggactttcctgggcacaaactgcacacatgtattgaatattttgctgctgtagcaaggagcaagcttgatgtatatcctcacaggagggagagaacataaggaagcctgtgcatgggtttctacaggcagccctgacatgcttttagtgacacttgaggtcctttcctattgctgatatccattcactgtaaaaaatttagccatgagtacaactatatacatgtgggcagtctggggacccctgaagcaccttatttcatagaggaggcttctgtaagtggctgaccccattaaatatatgtgaattcctctcatccttatctaagatcttgcgacttgattatgctagggatcattgttaatatgtagtccctggcacatgtatacatatgtaacaaacctgcatgttgtgcacatgtacccttgaacttaaagtataataaaaatatatatatataaaatatgtagtcctataatatgtgttttactacattcctccttttgaagcaattgacaaaaagcccttagcattcccaaggaaaagtttcttgttcttttttttttttttttgagacagtttcactcttgttgcccaggctggagtgcagtggcatgatctcggttcactgcaacctccacctcccgggttcaagcgattctcctgcctcagtctcctgagtagctgggactacaggcacctgccaccacacccagctaatttttgtatttttagtagagatggggtttcgccgtgttggccaggctggtctcaaactcctgacctcaggtgatccgcccacctcggcctcccaaagtgccaggattgcaggcgtgagc

SEQ ID NO: 102825 - DNA, 1046 bp, Homo sapiens
gggatctagcgggggaaggaggccctagtgggaggggctggtgaagagagagggaccgtgggggaagggtcggcggggcctgcagggccgctgcaggtgggtggttgtgggatgggggtgggggatgtgagctgctggcccagggagcatcttgtgacatcgcggaggtggaggctggatcgtgggcggctgtgcggagcagtgggatgagccgaggaccaggggtcaagacctggggttctgcttccgatttcacctgctttttattccgcgaccttgggaagatggctttcttgtaaaatggggatgcttttatctgctttgccggcttcaccggactgtggtgaccaggagacgaaacactgtcttgaaagtgctttgtgactgtaaaccaactgcgcagtgttattctacgaggctgggggcgttaggttgggtaaaagattgtgcgtttgcagaagggacagtggcagggaaaggagagtgaactgtcagtgggcagagaagtgaacttggaattgcttcagaagagaaaggtgaagtcatgccagagcaatcctcatcttgggagaaaggtgaaaggcaactcagtggtgtgccttgagatctggaaagagacagattttagagtgggacctgaatttgttccctgcactggcacttacttaccatgtcctcttgggtaaatttaactcttagagcctctgtatccttatctgtaaaatgaggttgttcttgagaattaaatgagttctagcataaagcatcttgcacaggtcaaggcacagagtgggtgagcagtaaatgtcaactttctttgcccacccgtgtgcgatgagactcagcacagtgtttagctctgaaaggatggaattattttcccactcaactttttggcacatggagagaggatgttttccgacaagataagacagtggtgaccggagaccagcctgctgcagttgggagtggttttgtggctgtctgctgatggatgaagctgaaaggctgttttaggcacttttggcagagtgacctggtccttg

SEQ ID NO: 102826 - DNA, 1011 bp, Homo sapiens
gtcccacattttcctagggttaacacctcaccaagttcttccagcaaaatgcttattagagtttttgtctgagcacagtagcctggccctgcatatcttgggcgtttgattaccatgctggaataagaagagttgcatttctcattttaatgagcatatggaaagatgggaacagaatttcagtcttgcagccatgagcctctatttctcattcctaagccttaccatgagtcagagtgttaagggggcctgtgaaccagtcgtttggtggaggagggtccttcccacacctttgtttaggagtcatcattcacacacacacacacacacacacacacacacacacacacacacactctctgagcacattatctgtgattctttcatcctcccagaaaggatcagtgttagaatgggaaatagagtgtgccatcttgctcttttgttggcagatgtccccgcttccctccagccccccatccttggcatgtatattagtaggagggcttcacaccagcactgctcactgcgactcctggaaatgtgtggggaattgggtgagcccctcttccccacgtgctcccatctgtaactctccatctgtgatttgcaacaggtcttccactggctcgaggctgcgaggctgaccgacaggggcgcccaatagagtttgtgggaatggagtattgcacagatgcagctgcacaatggtcttcctccacccctctgggaatcaccattaggcaggcctcagtagggcaaaatgtttatttggtaccgggggtctcctgacctgtctagcattcccacccactcttctgcacttcttgcaaggtaacttgaatcatcacttatttctctgccacctggttttaggactggcactctataaatgacgctgactttgtatagaaggattttgctaagggggcaaaaagcccagataccattttaactggcccagttcattttctcctttcattttacaaaagaaatcatgcagaagcatca

SEQ ID NO: 102827 - DNA, 2234 bp, Homo sapiens
ggtcactggataagaggatgcgttttttttttttccctctcacgaggctgtttctcaatgtgaagaggatgcgttttgaatgtttaacggtggttgcatagttaaaatgcacgctttttgcctttcgtgactttctctgggtgtaatactgatgcagggatttgttggtttttctaaaaacctcttttttttttttttttttgagacggagtctcgctgtgtcgccaggctggagtgcagtggtgcgatctcggctcactgcaacctccgcctcccgggttcaagcgattctcctgccttagcctcccgagtagctgggactactggctcacgccaccacacccagctaatttttgtatttttagtagagacggtgtttcaccatgttggcctggatggtctcgatctcttgccctcgtgatccgcctgcctcggtctcccaaaatgctgggattacaggcgtgagccaccacacccggccaaaaaccgtttttaagccatagacttctttgagaatctgaagatagccgagcactcaccaccccacccccacccccacccccacccctccccgccaaaggcacgtacacacaagtttgcacaccatcccgggtgcttgtactccctccagatctctgaactccaggttaagaactccaggactgcagcctttggaacagtcaaaaaaatgaaaatgctttagcgtttagaaacaaaaaaacctttaaccaaaatatcagaactgtatattgatactgtggtgccaagtttgaagcaggccagacaccaccacttttatagtacgttaattacaaagataagagaaggtgcattggcttcagcgaggatattttttggaaaatttattgcatattttctccccgaggaccattagtaggccagagatcagtctggttaatttccaaggtggaattaggctagaatgttattaaggaaaatttttgaatgacacttagttgtatcctagttcaatttcagacatgctttttgtgttaagtctaatgattttgtatttcttattttaaaattaacgcaaagtgaccaagcattctcttttccaagtgaaatacgttattttaattgattagttgctttaatttgccttaagcgttttagcagagatttgcttttattgttgtgtttgccctgtaacactgattttatcagaggtttcttttatttaaattatcccaaatttgagttgaaaagttgcctagaatttttaaagtaacaaactggccagttcgtttcttaaacatctattttaaaaggactgggtgttgatacagtttttccagggttagatgtttatgactttatggatttgtcgaccgggtattactctaaactttaaacattaaaagctattataattgaggacaccaactgtttgcatagtgggatagagatagaaaaaaaaaagccatgacagtataatgactacaagattaactactgaactaaatggactttaaaagtggggagaaagtgattataaatcaaatactgtataacaaagaccaggacaccaagaatctgattggtgaaacctgcggttcctggcagatgctggtagttgcagtcaactttgagcacaatataattccaatttaaggagttgagaatcttagaacccactgtagtgagatttgtaatatgactgaataaattcttcctctcgtttgtgagcgtgaattatataattaataccaggcattcattaagccatgcatatgcttatgttgaggtcatgagtactaataatacagctgtttcaaaaagcaagttaatgggcgggtgtggtagctcacgccagtaatcccagcactttgggaagccaagccgggcgaatcacgaggtcaggagttcaagaccatcttggccaacatggtgaaaccccgtctctgctaaaaatacaaaaaattagctgggcgtagtggtgggtgcctgtaatcccagctactcgggaggctgaggcaggagaatcgctcgaacccgggaggcggaggttgcagtgagccgagatcgcgccactgcacagcccgggtgacagagtgagactctgtctcaaaaaaaaaaaaggaaaaagttaatgacttgagtctccttctagaggaaggaaaagaagtatgccgcttctctctatccacagaatcgcctccagattttccgtacatgcatgcatcttcttagagaacaagcatgtaattctg

SEQ ID NO: 102828 - DNA, 1048 bp, Homo sapiens
cagcctgggcgacaagagcaaaacttgtctcataaaaaaggaaaataatttattatagaggagagtggtatattaagaagtttgacaggcactggcttagagtaagatttttctcttagagtaattttctttctctcttaaggtatccaagcccaccaatgggatctgtctcagcacccaacctgcctacagcagaagataacctggaatatgtacggactctgtatgattttcctgggaatgatgccgaagacctgccctttaaaaagggtgagatcctagtgataatagagaagcctgaagaacagtggtggagtgcccggaacaaggatggccgggttgggatgattcctgtcccttatgtcgaaaagcttgtgagatcctcaccacacggaaagcatggaaataggaattccaacagttatgggatcccagaacctgctcatgcatacgctcaacctcagaccacaactcctctacctgcagtttccggttctcctggggcagcaatcacccctttgccatccacacagaatggacctgtctttgcgaaagcaatccagaaaagagtaccctgtgcttatgacaagactgccttggcattagaggtaaaatctgttcagattagctttttgggtcctttgacatttggttttaatttttagttttagtttagtttctgctcatttaagcttatattcatggaattagagcactggatgattttggaagatacgcactgttagcgtttcattttaaaatttttttatagagacgaggtctctaattttaaaagagttgtttgcccaggctgatttcgaggtcctggcctcaagcaatcctcctacctcgacctcccaaagtactgggattacagatgtgagccaccatgcctggcccattattagtgtttcacagcttgttttgttctgtcctattccttgtttgccccaaattctcagccttcttgctctttcttgttcccaaagcctaacagatttagttttgcagttgttggtttttcttccagtaaggaaagataatgatt

SEQ ID NO: 102829 - DNA, 1352 bp, Homo sapiens
ttgttgttctgcctgtcctagtctcctttgaagtgggaaagcattttctctcataggcaagtcacactgcattgccgaagtccagctttctgcagactggcagtcgcacacacatttggaatgcacacagcggctgcctcctgatgtttgtatcatagtcgtattgtcaaagagtagccgattttagagttcttttggatcataaactggaaatactgatggaagcacacaagtggagagaagttgacatggaaagggtcttccttctcattgctgcccgtttgtacatgggactgattctgttgtgttcaccagagaaagcttgaggccatggcgagatactgcatgtttgctgttccacaaagcagtggcttagctgccatcttgcttttctttggacaacaggaagtgaaccttaaggaagagagaattctgttctaaaactccaaaatctggcttttttttttcttttgttttggtttggttttggaaaactaattaattagacttgtgtgggggtttttttttgttttgttttgtttgttttgttttgtttttttgagacggtgtctcgctgcatcacccaggctggagtgcagtggcgcaatctcgccttcctgcagtctccgcctcctgagttcaagcgattctcctgcctcagcctcccaagtagctgggactgcaggcgcgcacaccacgcccagctaatttttgtatttttagtagagacggggtttcatcatgttgaccaggctggtctcaaactcctgacttcaggtgatccacccgccttcagcctcccaacgtgctgggattacagccgtgagccgccgcgcctggcctagacttgtgtgttctaaacaggttaagtagcaggttgggtttttatgatagtgcaaggaatgactcatgcctctgagcttctaaactgaagctgctgtaactaaaggaatctgaaaagaacaaccctgaagcagaggcctttattgtcttggttgccagtagtaccttgttttgccatgtagcagacaacacacaaaataatgcagttgtggtgtgccatgctatgtgcacagccccttggattactttgttttaaaaagcatcagagttgggggtactttagggaaacctttgcttaccttgttttgccagtgataagagcagtgggttggagggcacttggccagttttctgttcagcttttcagtgaatgtacccctttaaggttcagacttaaacttccttaaaaagtggcgttgttcatagaatcgttggactcattaatgaatcgttcaactccactcactgaagcccagacctccgtgcccaggcccaatctcgtcaggctg

SEQ ID NO: 102830 - DNA, 2009 bp, Homo sapiens
ttggcttattttgggttcaggcctggcgtagcacccacaagtggcagacatatcacaagagtccccagactctgcctagaaacagtgtttgccctttggccagtgacgtggttcatcccggcccatgttgagccatgagtggagtttccaacagagggaggaatgtgtgccttgttcaaggagggcacgacccttaggcctttttcaaccagatttagctgaagggcttgacacctttgaattacagcagttgactcagagtgcaagaagtctggccattttggaaagcaaggtttcctttcagccctgtctactgaccaataccccgactcaccttgtgtggcgcacttcagaatcagatatacctagagtatacctgtggtttggttttataattaatcagctcgttacttcagcccatgaaaatggcatccagggctgccaggagattcagagctcaaaacaaggcgagcttgagttctgcactccagatatgtgccaaaactagtaaaacttaacggacttacaaccttgtcagtttttttaatgaggcagggatactctgtttttcacactaaacatatgaatgcagcactgctgcctcagctcagcttcgtgcctgggttccccactggtctgggaagactgttgtgctccatagagcagtgcacatctgacccagagggtgggtgttcataactgctacttgctctgctctaccatgtttaaagaaatatttggatgttaaattaactcactatggtttttcacctgggaaggaaacaaattacgtactagagggcattgactggttaaaaacttgtgtatcccgggaaggacctgcggtacaggagtcagccatgtctgtgctgtgtggaaccacctgatgacatggttaacgaggaagacgatgtgttgaccggctgccgtttgaggactttggtcacccagactagacaccttctgtgctcatgtttggaaagctgaaagggaaggacagctgtgccctcctgggagctcatgtgtccctggcgctgtgctagctttcctttacagctgtttacagacaaggcaggcctgaggcagatggccactgctcttgtgatgtttgctcagaggaatatgaacattttatttttgaaaagggatgatgtggttttttgccaggtgtttataattaatcctttaatattatggttattaacctcttaaacatgaatgaattcttgattgttttaacacagtacctaagactaatgctttctgtggacaccactgagctctgcctcaactccaccctctgcgaccggaggactatgcccctagtaactgctgtcggtgtggacgctgtgctggttctgttttctaaaggagcagaaggacaggtctctgagacaggatcgttgtccctacaggaggaacagtggccttgcttcttagacggtcttcactgtgtgttttaaaacaacaacaacaacaacaacaacaacataaaactcttttgacctgtaacttaaagatcataaacttcaggcaataatattttctgtgtaagcttttaaaattatttttggggatcatagcttgttttattttgtgctataaaattaacagtattaaatgacttatattcttagaatacatcgagtgtcttttcttaacagattagtgcctttttatttttgtattccgttttacgttactggtcccagcatcaaaacccttgtttccatggcctgtttgtatattgtctcaataaaacttgcatcagccggtggtggcggcagcttcggtgtttcagtgtctcctcagtccgcccccactagcctcctggcagttcatcagtggtgaaatctctgatgcttctcagagacccttagtgctgctgctgaccaagagctagaatgaagtcttggcatccgcccattccaacactcgggcacccagaggagagcacctggggtctccctccaaaagagaaatctgcctcccagagtgtctgtcttgta

SEQ ID NO: 102831 - DNA, 1045 bp, Homo sapiens
ctctccactgatagtggagattgtgcggcggaagcagcagccgccccctcgcactcccttggaccagccagtggacattggtagggagccccgttccccttccctgggggctgggagggatggtgttcatctgcggtaggagattgggagccatggagagcacctgccaggccctcggggtgggggtgggtgccatgggaccccagagtgctctcctgggtacagggaggaaacagatgaaggcagaagcccccgacccatggggcttgccacagtgggctgtgtcctggtgacctgggatttcctgagccaatttctgggggtggacatggggcacctctttcgggctaggatgtcaggtctgatggcccagggtcacggtgatcagtctctggacttctctttgcttgtaatgtcacaggccccttcattcccccagctctccctggggcttgtgctgaccccggttgctggctcttggtgatgtctgcaggcaccagaggccatgcagtgggcctggagggggcttgatcatgaggtcagcgagggggtacagcaagctgggtggaagatgagacgctgggtggtgggctgtgcgtggggcatagtgcttgagtcggccagggcgccgagggaggacagaatgtggctgatggtacctcagggcgagtgaggccttctgcctgggtgaagttttgttcagggcagcaacatgggcagatatgcaggaaggtagtgccgtggggccccaaggccagaatcccaggctgtacctgctcagggaccctcctacccccaggcacatctctgatccaggacatgaaggcatacctggagggagcgggcgcggaattctgtgacatcactctgttgcttgacgggcacccacggccagcccacaaggctatcctggccgcccgctccaggtgggtgggggctggacaggaggggagggtgggcctggatggtgtcttcgttctgctgacggccaggtgcctaccgctcgttgtctgcagctactttgaagccatgttccggtccttca

SEQ ID NO: 102832 - DNA, 1026 bp, Homo sapiens
tgcccattgtgaagaatcgccgtgcctgcctgccctgcctactgagaagactaccggctatgcgcatgcctatggcagtgggtgcacctgccaggccaagggtcagggtgcccagagcctccaaagagagctgaggggatgtggggccccaaactcattaattcactgaagacacaggtcccacagggagcggatgatgaagcagaccccctcctgtcatcaccctctcctggtgtagtgtggatgcgaggccacggctcagtgatgggctcaccacccagaagtggggagagactttgggcctcccacccagtggggcttggcctggcttctgtggcctgggcgtgttgtggactcaggcactggggcctgtcaccaaggctcctccaacatgcgggaggaggcttagcagacttgcgctgcaccagcgaatctgcctgggctgctcctgtcccacccaccctcactgagatccatgtaaggggctcctcttcccacctggaacttgtgagtggggacccatgatgtatgggtctcacctgacttgaggtgaattttggagtgaagggccctgaggtcagctcccaggtcggtcgtgctgggccaggcctggttttcacaggggctgaaggatcccagtccacctgtgtgcatgtcagggctcggccgggaagaagccagcaaagtcccccgtgtcccttgctgagtattctgtcacagacaagcctccattaaagccacagcagtgctacccaccacacacaccttgctggcccggccaccactgctggcttcagccccttgagcagcccatggcttagcagacccccagatgtaggtcagtggccttacctgtctctatccatgctgtcaactcctgcctccacctggggtcacccagtcacattgggaagggctgtgaaggcctccaggctggccccttccaggggaatcctggaggcctggggtgggctcctgccccttctgccctgccttgcccctgcactatgctcttggctcctgtgg

SEQ ID NO: 102833 - DNA, 1057 bp, Homo sapiens
ccacaacaagaaaggggtcctggaatcctgttcccagtaagggagcgctggctcccagcactagagtggatccacatggggccctcactagggcaagagggcagccctccttccacaggagccaagagcatagtgcaggggcaaggcagggcagaaggggcaggagcccaccccaggcctccaggattcccctggaaggggccagcctggaggccttcacagcccttcccaatgtgactgggtgaccccaggtggaggcaggagttgacagcatggatagagacaggtaaggccactgacctacatctgggggtctgctaagccatgggctgctcaaggggctgaagccagcagtggtggccgggccagcaaggtgtgtgtggtgggtagcactgctgtggctttaatggaggcttgtctgtgacagaatactcagcaagggacacgggggactttgctggcttcttcccggccgagccctgacatgcacacaggtggactgggatccttcagcccctgtgaaaaccaggcctggcccagcacgaccgacctgggagctgacctcagggcccttcactccaaaattcacctcaagtcaggtgagacccatacatcatgggtccccactcacaagttccaggtgggaagaggagccccttacatggatctcagtgagggtgggtgggacaggagcagcccaggcagattcgctggtgcagcgcaagtctgctaagcctcctcccgcatgttggaggagccttggtgacaggccccagtgcctgagtccacaacacgcccaggccacagaagccaggccaagccccactgggtgggaggcccaaagtctctccccacttctgggtggtgagcccatcactgagccgtggcctcgcatccacactacaccaggagagggtgatgacaggagggggtctgcttcatcatccgctccctgtgggacctgtgtcttcagtgaattaatgagtttggggccccacatcccctcagctctctttggaggctctgggcaccctgacccttggcctggcaggtgcac

SEQ ID NO: 102834 - DNA, 1043 bp, Homo sapiens
tgtggaccagttccaacactgtgttttaagaattgcttctatattttttggcattatctgttatctatcgacaattaatatcctttgacgacttttttttttcttttcttctccttcttcctccttctcctccttctttgttgttgttgttgagacagggtctagctctgttgcccaggctggagtgcagtggtgcaatctcggctcactgcaacctttgtctcccaggttcaagcaattctcctacctcagcgtcctgagtagctgggattatgggcatgtaagatggagcccggaagacggagatttcagtgagctgagatttcgccactgcactccagcctgggctacagagcgagactctgtctcagaaaaaaaaaaaaattattacccatattacccatacagtaaaacacatgaaaaagaatgagaaccctgtcttgggatataaatacatccaaggtatattgtatactttgtaaaaagaaaagtgagttgaagtctatgtatttatgtgtaaaaaaatccatgtaataacatacacaggctagaaccttgggcagctagggtagcatcatgccggaggaggacaaacgcctgctgaggtggtgaccctgccttgccctgccaagcacgtagcagttagcaccaactagatacagacatactccacaggagttggaaggggcagagagaagggttcgtaccctgatcagggagtgtcctcccacaactctaaggccaagcctatcagcccttccaagtgggagtgctgccagctttctgtttactgtgaccacctgtgtgcagcaattgggtctgtcacctacaggaaagggacatacatatctgctggccactgtcaacatcacctgtataacaagagattaatatgccttgaatatgtacagaatgtttttcaaaggacagaagcagctctggggaagaagaggacttcagcttttcagtcttctgcattctttcagtattttgccacatatcaggttttgttttgtttttgagacagggtctcactctgtcac

SEQ ID NO: 102835 - DNA, 1046 bp, Homo sapiens
caggaaggccacgcgctcaggagccccccccgccgctggctgctgctcacatggtgtctgggcccttggcactccggtgaggcgcaggggaggggggaccgccactggcccctttccccggagtttctgggtggcacacagccccacagctcggcctctatctgtctgacccgtggtcctttgtgtgcacacagcactgggcagtgtggagggagcctggaggccactgccctcttccagtccccttgccagtctcggggtaccaggtgtctgggtgctggcagagccggcactgatgttttctgggggctaggttactggggccaagtgtggaagccacaccttgggggctctttgtccctgcctggtgggttgaggcgggcagggagtggaggaggattggttcacgaagtctccagcccatgagcaccctcctgaactgctgtgggctgggctgctaggcagagagccgctggcgggtgcttgctgcctcttgctgttaggctctgagtgccagcggtgttccaggctgtgttgcacccttgcgtgttcacattgagctctggcaccttcaggggcctgtgaatgttagggtttttctttgtctttgcaaacaagggtaggcatgaggctggggagagtttctgtcatgagaaggttgggtagggtgggaccctttccaggcctctgctctgggaggcagggctggacactctgggaggggcagtagatcccagagggcggtgggctcagagtagttcagctgctgagagactggaccctgaactgcgaggctcagagctgcctgtgggccccgctgctcggttgtccgtcagccatgaggaaagttcatgttttcactggccccctgccctgtggaagcctgtgagcctatccggggcacaggtggccacctggacactggcatgccttccccagcaccctcctgctgagccattctctgagggactctggtaggggtgagaggatggagctgggagtactgcgttttgtactggggagttgggcttagggctgaggatggc

SEQ ID NO: 102836 - DNA, 4108 bp, Homo sapiens
ctacctttcctccttggcagctggaagcccaggctggggcagcacttggcgcccgcccagagtgcgaggcagcccagggccttggggagaggcagggctggctgcaggctgactgcagcatctgggaggcagcaacatgactgctggcagtttgatttgggccctgccgtatttcaaaaggaaccaccatttagttttgggggatttttgccagctttcaagacaagctcctctcacggagtcctctgcttcccgaagtttaaagccatctggtcatttttgggtccccttctggtccctgagggttgacttcatttagtgtagagacagtagcccgggctgtgaaaccaaatgcaaatcccagtttctctatttgtcccctcatcaccctccacctccattttctcattagtgcaaatggggcaggggcctctgtcccttctcagtttgagtcctcagtgaggtgacacgtgtactgcgcctgcatgtggtgggcattgtgggcttatgtgccgtgtactgtgccgcaggggctcctgccctatgtggggtcagttctgaggccctttgcctcgtcgagccccaccctgccccagagccctggtccgagtgtgccagtcatctgacgcatgcgtgcctgttcttgcccacaggtggtgcgcgtgggcagggcgcggggacatggggcccgacatggagctgcccagccactcgaagcagctcctgctgcagctgaaccagcagaggaccaagggcttcctgtgtgacgtcatcatcatggtggagaactccatcttccgggcccacaagaacgtcctagccgccagcagcatctatttcaagtccctggtcctgcacgacaacctcatcaacctggacacagacatggtcagctccacagtgttccagcagatcttggacttcatctacacaggcaagctgctgcccagcgaccagccagccgagcccaacttcagcaccctcctcactgccgccagctacctccagctgcccgagttggcagccctctgccgccgcaaactcaagcgagccggcaagccctttggctctgggagggcggggtccactggcatggggcggcccccccgcagccagcggctgtccacggcctctgtcatccaagctcggtatcaggggctcgtggatgggcgcaagggggcccacgccccccaggagctcccccaagccaaaggctcagacgatgaactctttcttggtggctctaaccaggatagcgtgcaaggtctgggccgggctgtctgcccagctggcggggaggcgggtctggggggctgcagcagcagcaccaacgggagcagcgggggctgcgagcaggagctgggcttggacctgtccaagaaaagcccacccttgccccctgccaccccaggtccccacctcactcccgatgacgcagcccagctgagcgacagccaacatggctcgccccctgcggcctctgctcctcccgttgccaacagtgcctcttattctgagctggggggcacccctgatgagcccatggatctggagggggccgaggacaaccacctgagcctgctggaggcgcctggtgggcagcctcggaagagcctccggcactccactcggaagaaggagtggggcaagaaggagcctgtggctggctccccctttgagcggagagaagcagggcccaagggtccctgcccgggagaggagggtgagggggtcggggacagggttcccaatggcatcctggctagtggggctggccctagcgggccctatggggagcccccctacccctgcaaggaggaggaggagaacggcaaggatgcaagtgaagacagtgcgcagagcgggagcgaggggggcagcggccatgccagcgcccactacatgtaccggcaggagggctacgagacggtgtcctacggggacaacttgtatgtgtgcattccctgcgccaagggcttccccagctctgagcagctcaatgcgcacgtggagactcacacggaggaagagctgttcatcaaggaagagggggcctacgagacaggcagtgggggtgccgaggaggaggccgaggacctgtcagcacccagtgcggcctacacggctgagccccggcccttcaagtgttcggtctgcgagaagacctacaaggacccagccacgctgcggcagcacgagaagacgcactggctgacacggcccttcccctgcaacatctgtggcaaaatgttcacgcagcgcggcaccatgacgcgtcacatgcggagccacctgggcctgaagcccttcgcctgcgatgagtgtggcatgcgcttcacccgtcagtaccgcctcacggagcacatgcgtgtgcactcgggcgagaaaccttacgagtgccagctgtgcgggggcaagttcacccagcagcgcaacctcatcagccacctgcgcatgcacacctccccctcctagaagccaaagacccgcgggcgccctctgccaccttgctccccgggaacccatggaaggagaagcgaggtgatgcagcagcaggggcaagaccctgggtccagtggaggctccgggtggcccctctggcccccactgcccacacccagagctttaatggacagtccgtaccaagcagagccgagaggagggaagccaggggtcccagcccgtctacctccccatcccacccaggcccccagctccccgcgggggccaccgcagggcctgtgggctgggtcacgtgggtctcgctgggacctggtccctttgttgcaggcggcttggagaaagggcagtgggacgctggccacggccagggtggtgtcgggagcaggcctcaccccgctggccgtgtctgtgtgtgtgcacgtgtgcttgtgtctgtgcgggcgcgtgcagccctggttctgcagggaacaggtgctgggggtgcagatccctccctccttgagccagggtggcactgttcactggcgctgggacagtcagggtgaccccaccgcctacctctctacatctaaagagccctctgggcctgtgttgctgttattcctactgatctgttcctctgtttttctttttgatttttgttttttaaaccaaaacagacaatagcttattttctttccgccccctccggggctgagcctgggtctgaagactgaatgtaacaggggccgctggcactcctgcgcgtcccccggctctggcgctgcaggggtgtcggcgcgccacctctccaggccccagaagcccttcttgcccaaaggcttccctggtccctgagccctgcctcggctgcctcaggggagagtgcttttcctgtagtttccaaggaatattctttgtttagaggtacttgttttttattaagagaaaaaccagtgtaacgtttatgtgactgtttgaactggaaggtctggggttccggggggtggggggaggctagactcaatgccggggccgtcggtactcttgttttcatttgtgtgtgcgtgcgtgtgtgtgtgtgtatgtgcgtatgtgtgtgtctatgtgtggtgtgtgccgtatgcatgggcagatgtttcgctttccctccttcctcgctgaacaaggtggagacttctgaccttttgctacctcttgaattcatgacaacgatatgttggtgactggcagtggaagcccttgacactcttgttttccttcgcttagcacctaggaagtcgtgtgcaggagccagcagggcgccaagtggcccagtgcctgcagctcacctgtgggttttccctttgagcctttggccacatccacctcgaggggaccctggcaccccgggcacacaaacctctgtggtataggtgaggggtgtgaggccccagcctggagccaggcactgggtgctgacaggggaaccatgaggagggtggcaggtctttgcagctcccggccagggtgaggcggaagtgagccctcatcctgccactcctatcctccattcctgcaagagttttaagcttgagagagctgaccacagggccccccggggaacagggatggcacttccctgagcagtcctggcccccggccactgtctcggggcccacctctc

SEQ ID NO: 102837 - DNA, 1064 bp, Homo sapiens
agacctcactggggcagggaggatccccagggctcccaccctccacttggcgggccccgtggggccaggtgctgaggggagcctctctaccccacccatcactagcttccctctgccctctcccaccccgggggggacccaggttgggcactggctcatttctcgcaaatacctcgaaggggaggggggagggatggggttatagctgttttgtttaattggaactggaagagggatcatgttttgttttatgcccttcccagaaggggggagggacaccgggatcgcactcctgtactggccaccgccgctgtcacttgtcacattgagttcatgtcccttgagagtttgtataaattcaggtcagagctgcagctacacagctgcccagtgtcatagaaaagcaattcaccaacgactgatctctccattcagaagtgtgcagtcttaaatgtacagcgataagaaactgttattttatgatcttttcattaaaagcttgattgaaaactctggtgtgggacctccatattctgctttggctgttctctctagcaaagtgacacggcttctaagtcttagaagggtggggtctgggatgggcatctgcctgccactgttcagtggtgcttggtgggtcctgggggtgtgcaccgtgccagggaactagcactttggggtcagcatcctcttgggcagtgttggcctgagttagctgaggctgtctgggaagcagcgatgtgtgtgcagttacagcagcatggacctggtgactggggagaggaggatggctgcccagtgcctgggacccctcattggagtggctcagttgggactgaggaagggctggggcaaggcgagggctgctcccttctgcccactgctgcttcctggtgcttggcctgaggggaggggagggaggaaggaaaaggggtaatgttaatccccagggaccacccggaatggggatcctcgtgtgaagacctaggaggaggagcaggggtggagggtgattgccactttagacctctggcatggactgcagacatctggtggctcctggc

SEQ ID NO: 102838 - DNA, 1041 bp, Homo sapiens
tctacccagtttttcgactgctcccgccagtgtttcagtggcccctgccctactggcctcatcccagcattagcccactgggcccaacccttgctaactgtggacgcccttgggcttcctaccaacagagctgattctgctgccctctgggcctttggtggggtcctggaccagccatgcaccccctcccctcacaccccccacccagaggggagctgcactaggggctggagagacagctggccagctgcagcctaggcctcccagctctgggccggcaccccgggtctggtcacattcctgagggacctgctgagcctccctggccctgggggtggagtgggggaaggggaaacggggacgggccgctgcacgccccttccccgaccccggctctattccgtgggggcccaggctggcaggtgtggggtgcaaggacccaccacctcaggatcccccctcctgcaggacccagagctctgggggtgggagggaacccctcgtttcctggcggcagctgcccaaggctttggtgggccggtattgaaagcccaggcctgcagcttgggtgagcccttaggcagtgaaacctctggagagggaaggccatgtggtcaggccaagcgggctagggggctgggccctctgggcagggaggcggtgagagcagatcaggaagggaaggaacgggggagccaaaagcggttgagactggttcttataaatagcccttgcacaagtggctccaattttgaccttttgttatgtaaatgtggccagcttgggaagggccctgcccaggcctcctgctaccacacccgcaggccaagaattgtgtgtctgccaccagcgccccctggcctaggtggcccctgggtgtccttaatctcctgtgtgtgttagaggggcaggcattgcacccaccgaactccctagacctgttcgctggtccttactcttcctggctgtcagatccaactaccaggctctgtggccacagtctcctgctgggctgcccctggtgccccagccagagacccc

SEQ ID NO: 102839 - DNA, 1460 bp, Homo sapiens
tcacttgaggccaggagttggagaccagcctggccaacatggtgaaaccccatctctacgaaaaatacaaaaattatctgcgggtggtggcgcactgcacttctgtaatcccagctactcgggaggctgaggcaggagaattgcttgaacctgggaggcgaaggttgcagtgagccatctcgccactgcactccagcttgggtgacagagcaagactctctctcaaaaaaataaaaaattataaagtatgtgagacttctggttgccttactgcctggccaacatttggtgttacctttttcctgatgggctttgacgttcttattgtttctggaacagtcctggtcttgtttaaaaacatccccattttcctttcatccctgggagatactcttttagtctttgtttggctagtcaaaatcccgtctttagtatctgttgttgaatttttgtgtttttgttttttctgattccctttcagcatgtcatctcagtcttgtcccagcccgggggtcaggcggtgttgcgtacagacggtgcagtggctccttcatgctggttgcctcagagcctttgccaggcctggagaactgcataggtgcaggactgccagtagttcttcctgctctttgatcattgaaatgttttcttttgtgaagtaatgatggtagaagatgatagggtttctgtttgtttctaattctagtctttacttggcattaagaaattgttagctgctagggttgattttgaaattgtgaagttggagagtccctcctggagctgtgggttggatggctgcagctctgtgactcagctgtgctgggtgcctccctttggggctcagttacctccttttaaggtgtccctagggtgagagagatgatcacgatagtcccttccacctgggcggcccaggctttcctcgcccatttagtgcctttcatgtagaatttccacctgttgtctgctgtgctgccactgcttgtcctccctccctgccacacagagctgtgttctctgcctgccactcacgcctacttctctgatcagggtttgtggaaccctccagcgtggtcaccattctggtacctgtggtaacacgctcagccttggtgtggcacattctaggtctaccgtttgtattcaccagcctgtgagcttgtgtacatgggacatgtatcttcgttttgggggctttctccttccacttgatgcccatcccttgagcgtttactacttgtggagcgcttggctttcaggccgtagagagctttccaatcagtggtgtccaggtaaaaacaaaagaaggaaaaaaagcttctaacctaacccttctcagacttgactgtgtgtttgagcccccagggttctggtggttagggctggatggagtctgagcctctgcgtgtctaacaagatccctggtggtgctgctgctgtttcttgggtcatggcca

SEQ ID NO: 102840 - DNA, 1303 bp, Homo sapiens
ccctccttctaactattcaatttattttttatggtaatgttagtgggtggagagtgggagtgcagcctcggtgttagaacagggggacttgggggtccttctaatggtgagagggcacagggatgggtcagctaggtgtctcttacctagaggcaccggttttttgtgaggtgggcagcgcatcgtaggatcttaggtgcatgttttctgtttaagggtgatcacacatgggttgtggtgaggagggagtatgtggagtccccagccttcttgtggcagttcccagtgtgactaaaagaaggcagggattgggtttggttaggtgggtgcttccaggtgagagttggcctgctgtggaaatggaagagctcctggctctggcaggggtgtggctgctgtacagacttgtcccctgccgtcccgggctgttgccctgcggcttgggcttcggcttcattccaccgggtgggtgggttctctgacaagtgtgggaaggggccgctcccattaccacactgaggcctgagcccctttgagggggaggatctgttgcatggcctttgcaagccctcacccctgctgcgggtcgggcggtgaggccgcagcactcggaagacggtaaactgttggtgagctctcattcacaaagtaaatgagaagggagagtggggactgggacttcggtggcctgtccttgtgtggacacagtggggctcttctgggtgatgagtgcaggccgcacattcacccagcacacgttgcccatgctgcctggcagaggcctgcctgctggtgctctggttctcaccttgagctatacctgtctctggggtgggcccaaggcactagcttttcctgaagcttttgaagtgaacctgatgtgcagccaagtttgagaaccgctcttctagcaggtgatgcatctttgttgataatagaatccacaggcggagggatgagtagcccgcgcttttacctgcggttctcactaactgctttactccgagggcctggtggggtcagcggttacccagtgaatgagttggcagaatcagtcatgcctgttcctgggtagttactgggcacagagggtgaacagcaggaggaacctagcccatgtgcactgttggcttctcctgggaggtcctctggagagctgcctatagccctcagctgtaggcgggtcctactgaccccgtagcacgggcttttggagtctgcctggcctggtttcctggctgcattcttgggctctcgttggcctgtatgtagtctggcgggacctcacatagtgcagtttggg

SEQ ID NO: 102841 - DNA, 1001 bp, Homo sapiens
ctgcctggtttctacaatgggaacagaactggagtttacattcatgtatcgctgttttctggagctcagcctagggaaggcagacactcaacaaatgattataagatggggtgataagggctggcatctagcggagcgcagagggcatagcggtggcgtgggaggagccggccgtgggctggctgagaaccctggatgccatgtgggttggggttggcctggaggggaggggttttaaccaggaagtgactgctactgggttttaaaaggcagtggtagggtagagggtggcagtggagacagctggagagcactgaggacgcggacccacgggtactgtgtgagctgtgaagcccgcttgggagaccccactgccagccaggcatgtatgcggctctttttcaagctttttattcattccgccacattttctgagcgcaaagtcagtgcctggcccccttggtttagaccaagtcatgttggcccctgctttctggtgctcacagacttgcctgggcggggtgatagaggcgcttgcagttcagcacgcggcccgttctcctctggaggagggaaggagctgcttttggaagttaagtagcttgctgggggctggagggtaaatgcctttgactccaccgcctgtggaggcccatatagtgtggtgtctggagagatctgagatcgcactagggaggagtggggctgaaagccccctccctaagagaggtcctggctcccatttaggggcttctgaaccagcccttccagtttgactctgcctggcaccgccagggttcgcttcctgctgggaggggccttgccctaagggttagggacctgggctgggggagggctctgaggaggggctgggccccgagggactgagggactgcaggcttgcttgccttgagcccagttttagctgggagtggcaaagcgagaaaagctggtggggatgggagctctgtgtgggcccccagtgagcttgataagggagg

SEQ ID NO: 102842 - DNA, 1032 bp, Homo sapiens
catctgccagtgtctggactccctgggccttcaggcaggcattttcaggagcacaggccatgtggttggtctggagccctgtgtcaaggagagtgtgcgtgcttggtggagcagggttgctggagtagtgtgaaaaaaagcagatgagctggcctctggagacaaagctgtgtggcaagactgctggtttagtgggctctgaacaccaagaacagggccgggagtctgatacttgggggctgaactgagtcctgtggcccaggattgttgcctggaagtgaacgttccgtcttgtgccattgagactgtgaagatctctgggtcccacaggacgagcagtagacttggaaggctgggaagaggctccccagctgcctgccttgggaggtcagagctctcaggtgggtcggcaggccagtgtcgggctgggggagggaggttgtagtagagtgcctgtggcccagcttctctggtcagttggctctgagtgctgctgtgtgcccagcaacctctccctgcggtgtttttctgccagttgttggaacttgtagattagtcactgagtttttacgaccgattcctgaaaagaaaaatctccctctggttgctgcctctgtgtagaggaagaagcagcccgagggagtcaggcctttaattaaagcaaaaccgaaatgattgtcgaagttgctggaaggagaagagaaggcgcaggtggggcaggggtgatgagtcctgttgtgctgcatgatacctgctctggggacaggtaggcacgatcccatcctcgatccttggtcttggccagcagcccagccttctccacaagctgcagtcgcggattaatcctcacgtagtgttttctttccgtagatcagatttctcattttgttaataagcgcagcctcccatccacttgaagtcagctgttgtggacgaggagcaacagggttttgcattattgagctgatagcctgccgcctcccctcaagtccttattgtttgcggggtcagatctgaggggtggggaagtgc

SEQ ID NO: 102843 - DNA, 1344 bp, Homo sapiens
ccttttggtgaggaacacatgctaaattggcttagtacttttgccagtggatttgccaaggtcctctgtagcccaccccgccagcatctgtgagtcggcggctgggtagtgctgccggcctgcaacgggccggaaattaaaaaaaggcccaggagccagtttcctgaggggagataaagagctggggttcgttctaggcggagcagtgcttggtagagctagacattgaacttggagccacagtctctgagcattccctccgtccctgggaacgtttcctttcttttgttccctaagggctagagaggacattaactttataaaactggagtggaagtgggcacaaaagaacagtcagaggacttcagacctctcctcatctcttaagctagtgacaccaccattcaccagataaggggtcggttaatggctttctttcctaccctactcccaggtgcagtcgtccattaacccttgtggatttaaatttagaaagatttctggagtgcaggccgggcgcgatggctcacgcctgtaatcccagcactcctgggaggccgaggcgggcggatcacttgaggtcaggagttcaagaccagcctggccaacatggtgaaaccctgtctctactaaaaatataaaaattagctgggcgtggttgcatttgcctgtaatctcagctacccgggaggctgaggtggaagagtcgcttgaacccggcaggtggaggttgcagtgagccaagtttgcaccactgcactccagccagggcgacagagtgagactccatgtcaaaaaaaaaaaaaaaaaaaagatttctggagtgcatgccttgctttctaatgttactgaaattactctgaatctatatcctcatctctcaggtgccctcccaagtgctctcctccccagactacccctgacggacaccagagttcttttaaagcagataactcaattctttcactcctgttaaaaacctctatggtgttattgtcctcagcagttaatcctaacctcttacttggcatgcaggacctttctgagactggctgaaagcaatcccttgagcctcacctcctgccctttggtttcccacagttcttgcacctaatcacagtagctactatttttccagcttttacttcgtgctttatatgcatgatcatgtttaatccttcctgtgaagtagacattgtgatttccattttgtcgatgagaaaagattctttggcttgcccagggttacctagctagggagagtgagttgtgatcgaattcggttctttctccaaagcaaagtctcctgctcttacttgctgtctgatgtccctttgcacgtgt

SEQ ID NO: 102844 - DNA, 1006 bp, Homo sapiens
tgcccttagtgctcctcactgactgcttcctctcctttttcttgagcaagatacagtttttcactctcatgttacagttgagttccatcttgccatatttttataattcttgtgaaatttaccttgtgtttatcatccctactttatttttttatttttttattttttcgagacagagtttcgctcttttcgcccaagctggagtgcagtggtgcgatcttagttcactgcaacctctgcctcccgggttcgagcgattctcctgcctcagcctcccgagtagctgggattacaagcgcccaccaccacacccggctgatttttgtgtttttagtagagatggggtttcgccatgttggccaggcttgtctcgaactcctgacctcaggtgatccacccaccttggcttcccaaagtgttgggattacaggcgtgagccaacgcactcagccatcacccatactttatactgttggagtgtggatttctgaaaccataaagtatatttacagatgattttaaaatttgttttgtcccataaatgttagatatcttcactgttgtttcttctttttttagttgtctagtttcaaagttctgtgtggcatatttttttcctatctgtatttggtttaaaacattttgtttgctaggactccagccttaagggacgtgcatggtataccctgtccttagccaagaatcttactctagtatcttgagccaaggtcaaaaaagccaaacacagcattggaactgtatttatagaaaatccttcccaccccagattcctttttcctcccaaagccccagcttcccatccacccaccaacctggtcattaagcacatgtttgagcaccactgtgagccaggcgctggcaggaccagggcttcctgatccctgcccttgttgagcttacattctatttggagagtggaaggaggtggcagtgtgggtgtgagatctcttcccctttctgagtctgcccaggcttcataatcccc

SEQ ID NO: 102845 - DNA, 1150 bp, Homo sapiens
ggtgctttcccctatttgacacccctttatgctttgtcaatcaacaggagcttgaagaaatccgcaaatgtgggatgaaaaacttccgtaacatccaggttgatgaagctaatttattgacttggcaagggcttattgttcctgtgagtattgaacacttccacttcctaccagattattctttaaggtgatgtgtgtgctgttgggcttgtttttctgctccttagtaggctcttagtctaggcagccagcagatgcacagaagtggctgtcgctctagggtgataaggtagggagtgtagccttgggtcctgagtagagtcacatcttggcactcgttttgtcaaattcagggagtcctgagctttgcagatctgtagacacagagaaaaggagtgtgtctgtgctcctgctctttcctgacttccctgcgcctggcctgatggatcagcaggaccttcttctctgagctcctcaggaggggacaagcattcccctctagatattttgctttctctcttggttttgcattcatgtctctaaccctttggatacctgtatttcgggctttattcctggtcccctccaacctgtgccttccatttgtctcaagtcccttttcctaattgcccacatgttcccctcaccccatgtcttttctggggcttatgcctccagtgtctgcccccacagcccagctcccccatctcacagtcttctgccttctgatgggctcaaggccctcctaacgatggctttccttagcaccctcttagtgcctactcttttctgcatcctttgatcccctccccttcaagaggcttgtcttataattaactccagtttgcaatcccccttcctctcactctcctgaaaccacgtcacacccagcccacaggctgcccccactgttgtcacacctctagctcggcagtgctggcatcatggcccttgcttgcctcctgagcttttggagcacgggcagcattccagcccccagtcctgtgaccagcctgccactcgctcctgttctgccactccttcctcctcactcttaaacatgactcttgttggtctcctgctgttctcctgttctgttttgtctcgggaccctactactttcggcatcatagatgattatgccagacat

SEQ ID NO: 102846 - DNA, 1002 bp, Homo sapiens
agctccacgggtagattgctgctgggcatgctctgccccaactcatgcaaaggcctccctctggtttcacgctggcaggggctatggagcagtgggctaagatcttactagggcaaaggtggaggctggctggtagaatccaagtgtgcttgggctgaggctctggggagctatccaggccaaagtttcaccttggagacggtaagcaacagccagggctgctcttgtccctgtgtataccacttcttctcggtcctctcccttgctttcttccagggcccctgggtttgtatgaggaatgtttcaatgaagtcttcttccttctccagagcagttaaggcattgttgacatctgacatccccagggtccacacttgtaccccaacctgggctttaggtcttcctgcattggacgggctgggccagcatgggaatctactatacaaactcacctgaggtctgcccagttggggtaaaagtagagccaggccgatgaaggcatggcagcccagccctggtccttagtggagagtggtgctgtccttgggtagccacctagcgattgccctggtcgtagtgcacagaggagggcaggtgggagggaaggctggggaggtacttcctagagacttcattgttgccaacgcaactctggtctattccctttaaacatttgtttttctgtaattttttttcatctaagatgctaaggtaacgtctaaggaagaaaatattacccataatcacatcatcaagaaattcagttacattttgtgtactgccctttaggaactagaggtgtggtagtcacccttcttgaagcttctagcccagtgaatgtgtttactcttaaccttcagcatacttcctctcagccttttttcatgcagtttcttttttttctttttaattgagttggagtctcgctctgtcgctatgcagtggcacgatctcggctcactgcaacctccgcctcccgggttcaagcgattctcctgcctc

SEQ ID NO: 102847 - DNA, 1410 bp, Homo sapiens
cccttctcagtttagcagatagcttgctctagaaatacttttgggtggctgggttgtcctgaaggtggcagggcttcagttgatacttgaatcccttgaaataaattgatttttcagataaacaattaaaacattcctgtcttggccataggtttatgaaccatggtgtgttcattttgatctctctttccttccaggacaaccctccatatgataagggagccttcagaatcgaaatcaactttccagcagagtacccattcaaaccaccgaagatcacatttaaaacaaagatctatcacccaaacatcgacgaaaaggggcaggtctgtctgccagtaattagtgccgaaaactggaagccagcaaccaaaaccgaccaaggtaagacatgtgcctgtgtcttcctcggagggggtctttgggggtgctgctctggggtgggggcttctggtaccagatcagacagaatccagagaatctttcaggtacacgaaaaatgtagctgaggtcctgtcagaccttgtgggaatggctcatctcagctgaacttttgacctgtatagggtttgaggaggcctttccagtgctcagccctgggctgccatccacagtgggaacacacatggacagacaagcccagtggcttgctgctggtgcagagaggtgcaggcactggtccctggaagggatgaaggactgtggggctgcctacaaggggaagggagagtgggatttaaggtggcctcatgcagtagttagtgcctgaactcagacttgaaggaggaaaggaggttggagagggccttccaggctataggaagggcatgggctagagcctagttgctcgggtgatgtgaggggagggacagaggcagatgtaagggcagtattcccagatgaaggcacgtagttggctttagtgggcctgggattccctggagttggatgtggctgtgcgtggtgcacatgtctgtgtgtggctgtgtgaacataaacatgctcattcttctgggaagaatatttgagtcagtattgtggttgtcctcccttttgtcccctagaagtgactagtttgttatggactgtgtctggttttcatttaattctagactttcttttgaagtcctaatctcatattttgatggcttccttttaagtacctaaaccagtataaagtctgtttagattagagtggatgaagctggcacttgagaggctgcaagtggagggtttcttttaggggtgctgctctagggtaggggctcatgggtccttcctgatgccagatcagacggagtccagagaactcctaccttaccaggtgcacgcaaagtatggctgaggtgccaccagtccctgtgggaataactcagctgaacttttgacctgcacagggattgaggaggt

SEQ ID NO: 102848 - DNA, 1045 bp, Homo sapiens
tacacccaggagtttgagggtaccgtgcagtaaagtatgattgagccactgcactccagtctgagtgacagcaagactgtctaaaaaaaataagaaggaatttgtggcatcagcagttcggagaagaggggcactgttttacagtgggaaggaacattctgagggtgctggtcctgacagggtcagggggcaactgtggcaaagtatgtgaggaggtgtgggtagcagctgcttctgattccccactatccttccaccctggggcacgtctgggctacggcacctagggggagtactgtggcacccatcagagccatcagcgtgacatctgcctgtggtcttgacaatgtgatgcgatggcggttgtcagcttcccattggctggccccagtgaccctttctagagggttcagaaactcctaagggtcttccagagttgggtcattgcgcattgacaagtgcagcgccatcacatacccttctctctagtgcccactcagtcaccttaaccgaaacttccctgagccgagcatggtgctgggtgctgggctgatgcagggaagttctacccggtcctgccctgaagaaagtgaccctgtgtgcatgcatgagagtgagcagtcagttcaatactaggcctcctatctccagagtacacaagaggactggattagccgggcatggtggtgcacgactgtagtcctggctacttgggggactgaggctggaggattgcttgaggtcaacccaggaggttgaggctgcagtgagccaagatggtgccactgcactgcagcctaggtgacagagtgagaccctgtccctcctccccaaccccccgccaagaaaaaagggctgggagtgactgagggctaagacctccccaggtgttaggtcaggaaggcttcctggaggcggaagcacatcactgtgaacaattatccactgtagtgttagctatttgttgtccatcagtgtcttctaatcacagaggaaagatgagttttctggcagtcagaattttggataaataggaggcagcttt

SEQ ID NO: 102849 - DNA, 1062 bp, Homo sapiens
cttaaaagcacattagctgtaaatcagttgtaaagccagagttttgttcccggattagctgcctcttgcctgtgccatttctgagactgtgttaaccccccatgccttgtccttctcttggcagtaatccagtccctcatagcactggtgaatgacccccagcctgagcacccgcttcgggctgacctagctgaagaatactctaaggaccgtaaaaaattctgtaagaatgctgaagagtttacaaagaaatatggggaaaagcgacctgtggactaaaatctgccacgattggttccagcaagtgtgagcagagaccccgtgcagtgcattcagacaccccgcaaagcaggactctgtggaaattgacacgtgccaccgcctggcgttcgcttgtggcagttactaactttctacagttttcttaatcaaaagtggtctaggtaacctgtaaagaaaggattaaaaatttaagatgttctagttctgctctctttgttttaaaaatcactgcttcaatctacttcaaaagaatggtgtttcttttcttgtccaattttatccaaaatcttcaagttacatttaacccataaggtttaaaaaaaaggaaaaaaaacggttgtggttccctttcttccctacccttgccactcccactttctggcaccgagtttatttttcacttacttacttccccagaccccgggctcgcctccacaaaggagaaaagactgccctggcggtcctggtggcttttcttagcatgtgtggcactgttgcccagtgtgggagttggtttaaattctcctgactccagtttataacatccttttaaaaaatttaaaaacaaacagccacacccctcctccagtccttctcctcagttcttgtgtgaaactccagctgatgttaccacagtaacatcagttaattgggcaagccctgatgtcagtgtgtgtaactgacctctggcctggcctgcacagagaagccctataatcacaggtctgtggtggccccgaaatggggggcctgctagtcaggaggatgctgtgcacactg

SEQ ID NO: 102850 - DNA, 1070 bp, Homo sapiens
ggagattgtcctcaccaggctgctttggaagaggcataatactataatctcagtattgatttaagaagtcacctgtaggctgagtgtggtggctcacacctgtaatcccagcactttgggaggccgaggcgggcagatcacctgaggtcaggagtgcgagaccagtctgaccaacatggagaaaccccatctctactaaaaatacaaaattagctgggcattggtggtgcatgtctgtaatcccagctactggagaggctgaggcaggagaatcgcttgaacccgggaggcggaggttgtggtgagccgaggtcgcgcccctgcactccagcctgggtaacgagcgaaattccatctcaaaaacaaaagtcatctgtttagatgtaagccattctacgggataggcgtgaggagaccctgcaaccctgtgggaatacatttaaatttttctaggaggagcagtcttcccgggaaatgggataccatggttcctaacttctggcaatgtagggatgccctgtggactggggccgcatgtggcttagctgaaagctcctgaggtgcaggagcagatggggaaggcagtgcgagtcctctagagcacagagtccttctgcaccactccgcaggatggaaaggcagatggaataccatgtggtccttgtctcatttcatgaaatagcatctatgaggcaggcaccgatgtccccattttacaggggtagaggcaggagtggcagagcagggctttgaaactactcattcatttatttaatgtgcactgggccctagcctgggccaaacatggaatcaggggccaagagagctctcatccagcctaggcagcttggagagacgtgtggctttctgaagggtgagtgtgggatgtcgctcctccttcctgcttctacccactcatggccccatccccttgactgtggcttcagtccctttttctggctccacactcgtcttccatcttgaccttcactagacttggactctcccatctgcagcacttttcctgctttcttgcacccatgcttgtgagctggaatcactgtacagtt

SEQ ID NO: 102851 - DNA, 1001 bp, Homo sapiens
gcaggcgaaggcacgcgcgggggcctccagccaagtgcagccacccacaccgcgctccagcggcagtcgcgtaaagcgcaccccataggcctgcagcgcctcggcgaacacctggcacacgcctgcgggcggagcgggtcagggaggagcacgtcctttcacctgggggcatcgaacttcccctactcccccagccccgcctgggagtaacgccctccaaactgggatcactaaccacgcacctgggagcacgtgcacgtgctggtgcccgtccgcgtgcgtgggggccctgcccagcagctcccggaagcagcttagttgggcctcgagctcctcccgcacctagagggcgagcgagagacaccttgagcgaccgggagtagctgccgaggataccctcctcgtgcttccgtgtgatggctccagtgtttgaatgcggaagtcatccaccgccagctcctaacggcctcacagtaccctccgggcggagctctgggggtcctcgcgagcatcctcctgtagctgcggctccgcacctgaggcaaatccacgtctccggccgccaccgcctcccggaatcccatcttgccaaggaagaagccttccgggccgagcagcgatgaggcgccacggcgggccggacccacggggcggccctcggacaggttggcgtggaggcccgtggggatgctgtgcctgagggcggagcgcgagctggagcactagcggccgcggagccgcgcgccccaagccgatcgccgccctgctagaggccctcccctcacctgcgggccagctccgccgcgctctccgtggccgcaccgttgaccagcagggacacgctggtcacagccccggccagaaaggcctccacgataccctcatcgcgtcgcgggcagtaaccaaagtcgtccgcggtgaccaccaggcgcatgcgagggcgggacatggccgcctgggtccaccgctcgcgctcccaggggagtgggccggacagccca

SEQ ID NO: 102852 - DNA, 1704 bp, Homo sapiens
cgaatccccgcgccagcgccggccaatgagcgcagcgctatgctaaggagtcgggggcccggcccctccgactgtcagcgggttaaagatggagccggcaggcgaggggccgccacgaggtgcagggtcgtctggacggggacccgggggcagacgatggccgggatcctcttccgtctaaccctccgcgtcctgaccgggccctgggcggaagggatgtctgcgtgagtcagctgtgtctgaggaggggatcctgggctgggctgggcggccctactcggcgggtcaggcggaggggcgcggccgggatcccgggggccctctttggagcagggaactctagaagggcggggagcccccatcctctgctccactctgggcctccaggcagaagaatatgttagaaaagaatccagagtgtatctagtgcagggcaaggggccagggatggagtcgtcagctagaaggggcgcgtcgtcccggggtggggccgccctttttctcctggagccgcgggccgagtcagggcgcagggtcgtcgggctgtacccaccccgctccgggcgctagccggctttggactgcggctgagtgcgggttcgtctttgtgtgtgcgccccctcccctgcgtggcccgtcagctcctgctccgggattggaacaaccccctagtctggggtttctcctccacctcaatccggagcgttctgggaaaggcctgggtgtcctgggttctgaagaccccagggacgcaccccgctgcggtctccttccctgcccggatggactggacgggggctctgccccacccacccatccatggttgagcttcccgccctgcgtgtattgggggtggtggggtcccccctgctggccgcaggtgctctgacgaggttgcactactgtgctctgagaagcagtgcaatgatattgtcaaagcatctgggaccagccttggggatctccctccctataaccctcacctcccactccccaggcagggccccttgggcttgcaggccctcccctcccccctacccaattcgctcccttctccatggaaacttgagattctagacaggcctgggcctctggggtcagagggcaccctttccccccgggcagaggccccgccccagccagcctgcattccaggtctcagatccctgcagaccaccctgggggaggcactggcaggcctgcccgacactctttccctgttgcactactataggccgctgggaagcagtgcaatgatgaaagggcatcggtcaggtccagcctgctaccctgggagggggaaagggagcttgctgcctcactccactttccagttgagaaggttgaggtgcccagagggtaagtgtttccactgattaggcacagatgtgaagctggactggaccctccatcagaggatcaggtgggtgcagagctggagaatcatccctaaactctccatcctgtcatggctggacaggtgcaggagcagacctccccagcttctgaaaagctcttgtttgaaggtctttccacattgggtccctggggtaagactggaactccaggcctggtcagggtcttaggggaaatacacgcccagtcttttgcatggaagatcattctaggcctggcttgggcccagtccttgctggaagcttgaacagggccaggctctggagagaatgttcttctgggtggcag

SEQ ID NO: 102853 - DNA, 1012 bp, Homo sapiens
tttcagggagaagaagctgtgcgtgaatgtggacatgttcagcatgagatgcccaagaatcgtccccagtggtcatttggatgtgggtctggagctgaagggtgagacacagtgggtgtgtttttcagtcagttatgggttctaatcaggaacaagaagtgtgtaagatcgtcccagatgagacggtgaagccaggaccttcagaaacgcattcgaggggcaagaggaaaaggacagcgaggtggagcaggaggaacaggacactgaggaggggccggagatgcagcgagtacagagcaaacaagtggctgtaaaggggaggagagcgcagaatctggggaggccaatggagagtgaaggagagggaggagggtgaaaagtccgaactagaggggttaggggcagagtgaagttctcggggcgttgcctggatgaggcccgggaggctacagacagcgaggaggggcgcccgtcggaggggactaggggcctgccgagaggtggggaccttaaagaagttgctgaccaaccacgtcctcggcgcagccaagagcccgacccgggtcaaaggcccgatggcccctgcggaactgggccaggacccgcgcagccgcgttcgccccctcgaggtcgtgagcgcgcgtgcccagagcaacgggcattgtcgcctgaggcaggcgactggggattggccccgcccccggcttccgcgcggattggctggggcggggcggcgcggctgcagtaggctagagagtccgcacctgcgccgcggccgtggggagagagggtgcgtcccggcagtcccgcacgacgggccccgcctcccctggtgaccccacgctccggcctcggggggagtggcggtcggcgcgccgagaccctcgggagccccgcccagacgcctgctccgcttccaggccacccgggctctccagccgcgctcgctcgtagagatcctagacaagttcgacagcgaggtcccgcagagcaagacctgccagcagatctc

SEQ ID NO: 102854 - DNA, 1070 bp, Homo sapiens
gcctgcacctcttgactccccacttagcctgtgtgactcattcaggtctggcctccacctccaggcagtcctccatcccccaggctgggttcagacctccttagttcccagcgtgcccgaccccatctcctgtacccctaaccaagctcaaggtgggcacaagagatggtcccaatgtatctgctgagtgaatgaaagccacgtcattcttatggctcttctataaggtacttttcttcaaatgaggccaacaaacttatcctgagatttcctttctatcctccaggtgaagaatttggacatttcaagatctgaagtgaaattaaactggaatggcctgtcacgaaacccaaggaggtcgaaggggtttactctgggcttgagggaaatgaaaaaggagcatcttggggagtgtcccatgtgccagcctaggtcaccatttcttctcagtctgttagtgaatcctcacaaccatcctgagtgcttattctcattttacagtggaggggtctgggctcagaggttggctctgtgtaggcagtgcctgtgcccgtgctgtagaactgcacatgaggtgtggaggggcctggggctgacgtcccctctctgccctgtcttgcagccacatggttgatctgactggttgatctgactcccttggttctcaaccctggaggcttccatttctcatatgtggctggaaacagcctgcccaagctccattgccctggctccccctggtaagcatgcctccgcacctccctggggccagacaccatcctggctctaacccagtgcactgcaggcagagggtagcatggggagccatgcccacagggagaggcaggagtggggctggagatgtgggaggggccccctggttttccacctgtcctttgggagccccaggatcctgtctggtctacactatgcctacggtctttggtcccttccctccactgccctgcaagtcggtcagtgggagcctcccccactccaggcagtcctgggtgccccctgctcagaacaatcccaggggctctcctgggcctgtagccgtggatctcagc

SEQ ID NO: 102855 - DNA, 1060 bp, Homo sapiens
cgtggtggctcacgcctgtaatcccggaactttggaaggccaaggcaggcgaatcaggaggtcaggagatcgagaccatcctggctaacatggtgaaaccccgtctctactaaacacacacacacacacacacacacacacacacacaaagtgctgggattacaggcgtgagccaccacgcccatccagacatgttacatttcagatcagtggttacccaagtggagatcaggaacctggagtgctggtgacttagtactgggagtcatgggatacaaatggcatttaaaattaggagcctaggcaagattaccctgggcctgagtgtagctaggggcccaaggtactgatctgacccaagggaagggtctggcagaagagacggaagggatcaggtagggctttggacctctaggcttgatggccacctgctgctgggcctccgaggggcctggaggcggtggggaccgaatatgcagagagaatgagaagtgagcgagtagaacgagagtggtacatggctttgaaggcatctgccacggaggcgggaagggatggggtggaggctcatgagacttgaagctctaggaggacgttgaaaaagacctgagcgctggccgggcgcgaagcctcaggcctgtaatcccagcactttgggaggccaaggcgggaggactgcttgagctcaagagctccagaccagcctgggcaacattgtaagagcctgtctctacaaaaaattaacaaattagccgggtgtggtggtgcgtgcccgtagctactcgggaggctgaggtgggagaatcgcttgagcctgggaggtcgaggcagtagtgagctgtgattgtgccactgcactccaacctgggcgacagagcgagaccctgtctcgaaaataaataaataagacctgagaacccagtatgggaatggccctgagccgtggctaggggggtagacaaggcggtccagacagacccctcaagaagatggggcttcgaggctgagggagctcggccccgaaaagacgcctgcgggagatggcacacctagctaggac

SEQ ID NO: 102856 - DNA, 1965 bp, Homo sapiens
gcctgggcaacatggtgagaacctgtgtctacaaaaaagtgcaaaaattagccagccatggtggtgtgcacctgtagtcccagctacttggaagctgaggtgggaggatcgcttgagcccaggggttggaggctgcagtgagccatgactgaaacactgcactccagcctgagtgacaaggcgaaaccttgtctcaaagaaaaaaaacccaaaccatttacttactcattttcacctgtagtttttgttgtttatacataactacagtaataactctgaacatattttgaaacctatgtatccacaaatatcccccaacttcctgagacaagatgaggagctcttcctctcctaaagtgaagcaagaccccttcacaggcctctaacctggaagcagccctgcaagaccacagtgttgttaccaggtggcgcctaagcaccctggtgatgctttctgttctgtcttcccttcaggaacattgttccatggcttaagaagtacgggaccaaccccagcaatggagaggtaggtggctgtgcaggagtttcagtgatgctagtgaatgctatcctctcacttctccttttgttctggtggttttcatgaacacaggaacatgggagagaaccgttcatggggcccagtgaggagggacagtcttcccctcctctccccacacccattcttttccagaaatgcttccggcctgtgcacgtgtatatatgtgcatgtcttttcttgggccatagctgtgacctcgtcttaacttgattctatctgcaaagaccctatataaacctttgattatatccaagtcaggccacattcacaggttcccagtgagcatcagttttgtggggacattatgcagcctggttccgagggagatctagtgtattttaccagtgaccttgcccttcctgttggaattacttgcatgtattcctccacctctttcctatggcctggggcaagagctcaaactgtgcgagacggagggtcgggactccggtgggctccctgtgctggagccgctgggagggagctccctggacaatatgaccctccctaccgggccagcaggagaagctggcagcccatctgtctcagctcttctggcccttgtggtgttctgggggctgcagggttctggggactctttgtagatggagttggtgctcctccaaggcttccctgctctccagtacaaggggaacttggccagggggctggtttttgagtgttcttggaccagcgactaaagcccgtggcttttctctttcaaatgcttgggtagggggcttgtggcctcacctccttagggagggcactcttcttccttggtctttgtcacttgaagactgtttctgtgatgtctgctgctgggagccacattggatcccaggggcttcccccaaggtccgtgccccagtctgggaagtcattctctgttgctcttctcagcagaggtccctgctgcctgcctgtgccctgtgtggctgggtgtcggcctcagggagcagcctggtggcaaggtgggggtaggtggggttttcctgtccacagctgccctcatggcccctgctgtcccagtggattctgtcatttggttgcagctgggatgcattttgctactttgggtgttttgcttcacaggtactctttggggttcccaaacttgtcgattgtgctggcccccacacccacaaagtctgatctggcagttagccacgctgttagggcttacatcagggaggtgtggccatttctttgttccaggcatcatgttggggtgagtctgcaggagcgccctacacgtctttatcctgtgcctgcgcctctcccttggcctgctctggaagggaccttgctgtgtgcttgcttggccagacctatgggtgtcagcagagccttgctagccaaacctctgaggagagttcctgggccaagggctggctggccca

SEQ ID NO: 102857 - DNA, 1176 bp, Homo sapiens
ctccagcctgggtgacagagcgagactccatctcaaaaaaaaaaaaaaaaaaaaaaaacagagcaaaacaaaaaaaagacagtaggcaggcaaggggatgggcggttctgaaggaagagctgaccagggggctggcggaggatgtgggtgagaggaggtagagctgtcagggctggaacatgggttgtttcctgccgagggccaacttcagtaggaggaggaggctagcatggtgatcacccaggggtgggctggaggatctgaggaagacgatgccgggattgggtcttgcaggatgaataggagtttcctaacggtgtggaagggcttgagggggtgagcagctgtccccatggttccctgctctggcagctgacatggggttccacctcctcccatcgctgactttggagttctgtcctgccctggccctctgcggtcctcactgggatgttcacagcccacagaggtgactggcctccctgtgtgtgccttctctctagggaagtaccactgcccagtgctgtttaccgtgttcaccaacaacacccacatcgtggctgtgaggacgaccggcaacgtctacgcctatgaggtgtgtcctcgctccggggcgtggagacagcggtggggagatctctgctgtgtgttcctagtatacactggctgggctgtgtgctacgtgtacggcctgtcctcgtggggtttacagtcacagccacaggcatggtcatctagcaaagctctggcagtgcagcctccccattttcaggcaggtcaaaaaaagggttgggggaggtgcatccttcggaatccaggcagtcctggctgcccagcagggacccttaaaccccaagaggtccttccgcgtcttcagcaaagcccaggtgctgggaaggcacccatgttttgaggacaggcctctagggctgtgaggggagtgctcgccccggatctggatggagtcacttgcccccaggagggagctgtcccctggaggagttctggcagggagtgggtgtagggagaggggagacagccgtgttcacacatgggtcctcctcttgggtgaggcggggcaggccccacatggcgggaaagccgacctttgcgccgttgtcaatcctgcacctggacgtttgtggggtgtaggtggccagcgctgctccaggggcc

SEQ ID NO: 102858 - DNA, 1763 bp, Homo sapiens
ggcgtgtggttggcttctaggcaagcgacacgtccccacccaactgcctcccatggcactgctgaggtgccaccctggtttccttggcaggcccactattccacagggaaggtcagcgcttccttcacctccaccgcgatggtcccggagaccacacatgaagcaggtagccaccttggcctctgtagccacctgccatgtgacccaaaagtggcagggggtgggtgtgctccccgactcccactttattggtctgtcaggggctcccactgtcacctgagcccctagtcctccccctcttagctgctgaacccctgccagccccatgaggctggggtgagcctgtgcgtggcctaagcagaccctcggcctccagctcccctgctctccccagagctggagcctagtccccgcctgtgtgtctgaggtcggtgctgcctggcatggtggggctgccccagggtgagggcaggggctgagctgggaccttggcttgtagctgccatcgacgaggatgtgctgcgctaccagtttgtgaagaagaagggctacgtgcggctgcacaccaacaagggcgacctcaacctggagctgcactgcgacctggtgggtgtggaggccagccactccccatgccccaaggtcatctctgggtcatctgacagccatgtcttaaatatagggctgccactggtatgtgcttgttgtaggaaattcagcctgtcactaggcgggacccgcagcagtgccctgtgtccttcctagggggccgcgttggcagcatggcctgcgcacaggtgccagtgtctcagagaaggggccaagccgcacctgctgctctgcccacacttctcccatgcgctgtactctgggccgtgcggctgcacgggtcctgttgcttaatgttgtgggtccatccgtgcccagtgtggctgggcagctgactctgctacatgttaaagaccagcctggccaacatggggaaacccgtctctactaaaactacaaaaattagccaggcatggtggcgcatgcctgtagtcctggctactcgggaggctgaggcaggagaatgtcttgaacctaggaggcggaggttgcagtgagccaagatcgcgccacagcactccagcctgggcaacagcaagactccacctcaaaaaaaaaaaaaaaaaaaaagcctcctgtggctgtggtgagctgcctttggcagctctctgcttcatacaagtattggggctatgttgcagacaccaaaaacctgcgaaaacttcatcaggctttgcaagaagcattattacgatggcaccatcttccacagatccatccggaactttgtggtgagtgacgagagtcactggctgcacagatgagcttggtgggacatcgggggctgggtgggcttgtccctgccccatcccagggccctggcccatcccacggtggccaggatgagtccagttggtgatcctctgttggggaacccatagactgacccttgaggccccagcccatccagaactgggttcacaaagggaggtggctgggagggcccctcattatcaccaagagcccagcccctgtgtggagccatctggcaggaggggtgtccttcagtcaggcaggcggtgggcctcgggtctcagagtgtgacttgctcactggcttttgttttcacagatccaagggggcgaccccacaggcacaggcacgggtaggtactggtgctgggcccctctctgggcactttggctgctccgtgg

SEQ ID NO: 102859 - DNA, 1037 bp, Homo sapiens
cccttgtggcactcacgtatttccacccgagcgtggtcttgcagttctcgcagtagatgtcggcaaccgcatgcagcccggtgagaaggaccctctcctctgcagggccgcagcccacgttcaccctgcggggacagaggggccactgcgctgcaggcccggcccgcccctgaccaggccctgccccctcagcgggccccaccccatcctcctaagagttcccccaaaacagggaaactcccagagagcagtgccgtgcctctcccccagccctgcccgccaccaccatcaatgggaaagatcagtgatgggacaggctagggggcaagatccttagcgcgtttcagaaactcccggcggggggatggtgggttctttcaggacccctaaagacccaggtgattctacacagggcactgtgtaggtgccatccaggccgtcccagggcccgtgccgctccccccgggctgaaccagggtactcacacggaattgaagaggtaggcgcgtccctggctcccctgaaaggactgaaagaagaaggtcccgtgagattggctgcgagtgctttctggaacgaagcggtgctgcccagaaccaggggagtccagccccgcggctgttagctgcgccgggacgcgtcaccgggagcagacaccggcgtcccccctccagaactccacttctaataacagccacttaacggagctgcaagctgtttttcattgtagacaggagtggctgattctgctgcgtcaacattctgcaagtgactattattgggaatcatggcaagatcagtttttaaatggtgagcttcatatgtctggacaactttaccttagaggagttctgagaggggatcacgaatgattttctctacccgaaaacccacagatcctcaaaatgctctcctcgccgcctcttctgcagcagttcagatgtgctcacgctgccagatattagggggtagggggaggtgtccatattttcccactgaaatgttttaaaagtcacagcatggctgagtatggcggc

SEQ ID NO: 102860 - DNA, 1022 bp, Homo sapiens
tgagcactgttccttccccgctctccctggcattctgtccacctggcacaccagccccttcatcgccacgcccagcagacgccccagttctcctccagctttgcagcctctgaccctgacgcactggcttccgtatctgcctgaggcctcctttccatctcgggacaccctggagggctccccggggaagtaatggggatgggacccacactcacctgccaggtggtggcagtgccagggggtaggtggagcagcctggggattgaggggaacaggctgtcctctacacaggtgccccagggatggggcgacgacccagtggggtggttgaaaaagtgaagggggcaccccagtctgcactccatcccatgaagtgtcagaagctgcttggttttgtttgcttcctcagtgtgtttgtctttagaagtgtgctaccggcaccatatggacatgggcctgattcacattctcttaaaataattttacaggcttattttaggagagaaatttctggattccagaaaattgtttttgctctaaaaacataccccacattaatgtctatttggggggatggatggcagctgccctccaaacgtggggacacacagtgtccgagagtggagatgattttcctggtgaattgcccagcattttcctttcagttacttacttcagggtggttccttatttgccaatagatcttgtaaaagcccatttacattggttgtttccaaacttggccatgggttccccagtgcaacagtggatctgtcatttaaagccaagttaaaacttaacatgacatgcctctcagtgaccacaaatacagccctggccactactgccaggacccctttgagggctagtgacaagggttgccatcaggactgagaccacatgaagcgcacgggaggcatctgtgcagtgaccagactcaaggcaggagacagggacagggacttgggggacatttgggacccagggcagcaggctcttcaggtaagattgccttgggggcg

SEQ ID NO: 102861 - DNA, 3657 bp, Homo sapiens
ctccaagtccacagtttggctatagttagcccattcttcttgccccacctcctgagtggcagatggaaaccacagctctgaaagtgctctgtgaaatagtaagtgatactctgctagattttcatgcactagtgttggatatcttacggtaaataaaggacatcttaggaacactgcagtcagcgtaggctgggggagtggcgtctttcctatgagtgttgtggaaaccacctcagaactgtctgagaggaggtgcctgtggagtgagggctgaccctggccccttcagaactgccatgtgttatccttgcccaaatgtgtccaaagaaatggccattttgcaggagtcttttttcccttttctgttttcataatgctattgctgctgctgctgttttaatgtggttcactgttgtcacttttgtgttttgtgatgctgatgatgatgctgttttcacatggctcactcttaactcagtggtctgtttgtgtttctataggacaagggctcagaggactggacgtgctcagacatcggtgttcttcttcccagttcttgacccctggtcctgtctccagcccgtcttggcttatccactttgactcctttgagccgtttggaggggcggtttctggtagttgtggcttttatgctttcaaagaatttcttcagtccagagaattcctcctggcagccctgtgtgtgtcacccattggtgacctgcggcagtatgtacttcagtgcacctactgcttactgttgctttagtcactaattgctttctggtttgaaagatgcagtggttcctccctctcctgaatccttttctacatgatgccctgctgaccatgcagccgcaccagagagagattcttccccaattggctctagtcactggcatctcactttatgatagggaaggctactacctagggcactttaagtcagtgacagccccttatttgcacttcaccttttgaccataactgtttccccagagcaggagcttgtggaaataccttggctgatgttgcagcctgcagcaagtgcttccgtctccggaatccttggggagcacttgtccacgtcttttctcatatcatggtagtcactaacatatataaggtatgtgctattggcccagcttttagaaaatgcagtcatttttctaaataaaaaggaagtactgcacccagcagtgtcactctgtagttactgtggtcacttgtaccatatagaggtgtaacacttgtcaagaagcgttatgtgcagtacttaatgtttgtaagacttacaaaaaaagatttaaagtggcagcttcactcgacatttggtgagagaagtacaaaggttgcagtgctgagctgtgggcggtttctggggatgtcccagggtggaactccacatgctggtgcatatacgcccttgagctacttcaaatgtgggtgtttcagtaaccacgttccatgcctgaggatttagcagagaggaacactgcgtctttaaatgagaaagtatacaattctttttccttctacagcatgtcagcatctcaagttcatttttcaacctacagtataacaatttgtaataaagcctccaggagctcatgacgtgaagcactgttctgtcctcaagtactcaaatatttctgatactgctgagtcagactgtcagaaaaagctagcactaactcgtgtttggagctctatccatattttactgatctctttaagtatttgttcctgccactgtgtactgtggagttgactcggtgttctgtcccagtgcggtgcctcctcttgacttccccactgctctctgtggtgagaaatttgccttgttcaataattactgtaccctcgcatgactgttacagctttctgtgcagagatgactgtccaagtgccacatgcctacgattgaaatgaaaactctattgttacctctgagttgtgttccacggaaaatgctatccagcagatcatttaggaaaaataattctatttttagcttttcatttctcagctgtccttttttcttgtttgatttttgacagcaatggagaatgggttatataaagactgcctgctaatatgaacagaaatgcatttgtaattcatgaaaataaatgtacatcttctatcttcacattcatgttaagattcagtgttgctttcctctggatcagcgtgtctgaatggacagtcaggttcaggttgtgctgaacacagaaatgctcacaggcctcactttgccgcccaggcactggcccagcacttggatttacataagatgagttagaaaggtacttctgtagggtcctttttacctctgctcggcagagaatcgatgctgtcatgttcctttattcacaatcttaggtctcaaatattctgtcaaaccctaacaaagaagccccgacatctcaggttggattccctggttctctctaaagagggcctgcccttgtgccccagaggtgctgctgggcacagccaagagttgggaagggccgccccacagtacgcagtcctcaccacccagcccagggtgctcacgctcaccactcctgtggctgaggaaggatagctggctcatcctcggaaaacagacccacatctctattcttgccctgaaatacgcgcttttcacttgcgtgctcagagctgccgtctgaaggtccacacagcattgacgggacacagaaatgtgactgttaccggataacactgattagtcagttttcatttataaaaaagcattgacagttttattactcttgtttctttttaaatggaaagttactattataaggttaatttggagtcctcttctaaatagaaaaccatatccttggctactaacatctggagactgtgagctccttcccattccccttcctggtactgtggagtcagattggcatgaaaccactaacttcattctagaatcattgtagccataagttgtgtgctttttattaatcatgccaaacataatgtaactgggcagagaatggtcctaaccaaggtacctatgaaaagcgctagctatcatgtgtagtagatgcatcattttggctcttcttacatttgtaaaaatgtacagattaggtcatcttaattcatattagtgacacggaacagcacctccactatttgtatgttcaaataagctttcagactaatagcttttttggtgtctaaaatgtaagcaaaaaattcctgctgaaacattccagtcctttcatttagtataaaagaaatactgaacaagccagtgggatggaattgaaagaactaatcatgaggactctgtcctgacacaggtcctcaaagctagcagagatacgcagacattgtggcatctgggtagaagaatactgtattgtgtgtgcagtgcacagtgtgtggtgtgtgcacactcattccttctgctcttgggcacaggcagtgggtgtagaggtaaccagtagctttgagaagctacatgtagctcaccagtggttttctctaaggaatcacaaaagtaaactacccaaccacatgccacgtaatatttcagccattcagaggaaactgttttctctttatttgcttatatgttaatatggtttttaaattggtaacttttatatagtatggtaacagtat

SEQ ID NO: 102862 - DNA, 1064 bp, Homo sapiens
ctcctgaagccagctttgcaaggcgggggaccagtatccctctcaggtccaccaccactctgagagtcccggcgtggcaaggacagtcacctctgtgcgttgttcatttgctccagacacagaagacacacagatgctccctatgtgcttatagcatgattttttttcccaacattcttttagtgacagttttcaactattctgaaaagttgaaggaatttaaagtagacacccatattcccaccacctagattatacagttaacattaacatcttacttgttttctcatagatctgtccatctgttcctctatccacccatcaacccatcgcattttatccattcattgcaaaggacgttgccaacgtctagactgacttacaatttagtcatctagaatatcacatgaatccaggggaagctggggctgggttggctgattaaactatgggataggttctttcataaacatttcattttggtgatcacaacagaattttgggaagtcagcatgcatccatgtttataattgaggaaactgaagacaggagcctttgagcacttcgctcaaaattgtacatcaagtggcaaaactaggcagagaatccaggtattttggacccagaatgtcattttcttgaaatgtttgccagcatgaaacagtggcaggctgcacactgcctgtgattagccttgctccttgggaaagttctcaggactcattcacaatactaaggagcattgtctctgagttcccagcccacacactggagatcaggagctctgaattggagagctcaggaggtaaaggtgtaataaaacatgggaacactgggagggcacggttgaccgtttggctgcagcaagaaaggcttagaaacatacaccccaggaccacagagcacagctgtggggcccctttggtagaggaagcaatgaagtgatatttgtagtggtggccgaaaggtcttaaaaaagggtcaaattatattcattgtattttgcttaagggggtcagttttagaaatgtttccatgggcaagtttaaaagctgatcatgcct

SEQ ID NO: 102863 - DNA, 1017 bp, Homo sapiens
gagtgtgggcacaactctcagtctctctctgtcacccagactggagtgcagtggcacgatctcagctcactgcaacctctgcctcctgggttcaagcgattctcctgcctcagcctcctgagtagctgagattataggcgtgcaccaccacactcggctaattttttgtatttttggtagagatggggtttcaccatgttgggccaggctggtctcgaactcctgacctcaagtgatccgcctgcctcagcctcccaaaatgctgggattacaggtgtgagccaccgcgcccggccatcaactcttaagtttttatgagacatcagtcctgttgtaaattcagaatctgagcagtggtcattttatgaatcagtaaattactgccttacccataacaactttgactgttaaatgttttgttttcttttaaagcccatcgccgaagcaccattcaagttcgacatggaattggatgacttgcctaaggaaaagctcaaagaactaatttttgaagagactgctagattccagccaggatacagatcttaaatttgtcaggtacctggagtttaatacagtgagctctagcaagggaggcgctgccttttgtttctagaatattatgttcctcaaggtccattattttgtattcttttccaagctccttattggaaggtatttttttaaatttagaattaaaaattatttagaaagttacatatattctcctaggaatctctctctcgtttattagaaactccaagtacctcctttactctcaagggtagtgaatgtgattatttggaaacaactttttcatattccagattgttcatctttgggttctcatcctttccttgctgcctgtccagagcagtttcacagttacatgagcatctctctggaaagggttcgcctcaggactccctcccatggaaagcagagccaccagttaaataaatttagtattagagtcctctgtgcctgccccttcagaaactcctagctgggacctgg

SEQ ID NO: 102864 - DNA, 1078 bp, Homo sapiens
gtgaaaccccatctctactaaaaatacaaaaaattagccgggtgtggtggcgggcgcctgtagtcccagctactcaggaggctgaggcaggagaatggcatgaacccgggaggcggagcttgcagtgagccgagattgcaccactgcactccagcctgggcgacagagcgagactccgtctcaaaaaaaaaaaaaaaaaaaaaaaaaagaaatgatcattgtcagaaaagacgcttcattaagtagtgccagtgtttttgtttgcggtctgcaattgtcagatggtcggtccctatgttcacagtctcgggaggcttggagatatagtcagcaccctttgtgctggctgctctctctgtagtcatgcttagctcagttgttttgtgggtaagttacttaaacaggaaattgaagtatttctgtgactacttctgctctcactactgcaaaacctttctctttatagctctggacttattggacaaaatgttgacattcaacccacacaagaggattgaagtagaacaggctctggcccacccatatctggagcagtattacgacccgagtgacgaggtaagagctcatgttcctggctgctgcttcagggacatagatcagccagcagtggaccaaccatatcttgcttagattttcctgagatatacctgctgccatacccggttcttccaacaagcccacctttgccttgaggacgagtgctgtggggcacagcttgaaatccctccccccgtaactctgtctatctcagaagacttcctccaggccacctgcaacaggtaggggcggggtaaacgcatgtataaaggggacagctgcaccagtatggagcacagagggcatgggtctgagactggaggccattgtcatggtgtgacaggaagagacacctgaagtgaagtgctggccctgaggatggccggggtggagaggaggtgggcagcctgctgacagggacagcacacagagtggggagggaagtcaacttggacagtttccactgtggcttggcgactccatgtcgggtgtgctattccctagagacaaggacacgaga

SEQ ID NO: 102865 - DNA, 1010 bp, Homo sapiens
gagcccaggagttcaaggctgcagtaagctatgatcatgccactgcactccagcctgggccatagaacaaaatccaaactctgttttaaaaaacacagaaagagaaaatgtagtattctggaaggcactagggaaagtcaggatttgtggtcaggagtaatactagcctcaaagggacttccagtcttttaggggaaataaaacctgtatccaagtaagcatccacacaggcagccatgattcacaccatctgagtgttaccaatgaatgcccatgtggcgtgggaggagggagtccggacattcttgactgtgggatccgcacctgccagctgcttcccggttctctccttttctccttctgtagctatgaataatgtagaaatagcacttgcagtaacagaaggctggagatctagctacttttcaagtagcaaatctttttttaaaaagctgtcttctttgaaatttatgcctggaggtttaagggcctagaatttatttaactttaaggaactaatggatctgttttagaaatgcttaagctgcaaaacatccagttggcttggagtgcctgtctacttaatacgaacaagtttgagtaggacccttctgcccccagtggtttagaagtaatactgttagaatcttattgtggtccaggccttctggacttttcttagcacagacagtatctaattgggtgaaaagccaaatgacttaatctagtttcaagaaagtccttgagaaaatgtctgtgagttctatgtggggagggctggttgggagcaggaagcaaagtgggatttattacctatattatagaccacaggaatctttttttttttttttttttttttttgagacggagtctcgctctgtcgcccaggctggagtgcagtggcgcaatctcggctcactgcaagctccgcctctcgggttcacgccattctcctgcctcagcctccgaagtagctgggactacaggcgcccaccaccatgcccggctaa

SEQ ID NO: 102866 - DNA, 1026 bp, Homo sapiens
caaagctttccagaagctgttgagggccttgatgaggctgaaaatcttgagtttttgtagaacggtagttactgatagtgtgctccttaaacacctgagatccccaggatcctttcagggtgtccacaaggttaaagctgttttaataatcttcttaaagagttactcacactgctctctatgttgccatcagcacttgtggcacaggagcaatgatgagcagagtccccagcaccacaggcaggtcaaggcagtggaactagagaggttactgagctctgcactgccacacccccactgctcaaaaccagtgccagtaaaaagtactcaccatattaaatccatccttaatacatgtcttcacgatgtctgtgtgacaaacacgtatagcatttctgctgcatactgaatgcagtggttttctcagggaaaagcacttatgtaactatttgagctatgagcagaattaactggtttttaaatcgtccctcagttttgatgagtataaagagttctgagatcagaaagtttgagaagcactgtcgcactggcacactttgcacagttcagtcttttctctggccccgcacagaaacatgagttgaggatggaagtgacaggttgcagcattgattcagggtcagagtttcacgaggcaggcaagatagacatgaagaggcactgtggagagccagtcaatggctttccccaggtccaggacagggcaagaaggaaaaaaggatgatggattagaagaaagggttggaatcaggttgttacatactatttgaagttaaagagaagggccaggctggccaggcgcggtgggtcacacctgtaatcccagcactttgggaggccaaggcgggtggatcacgaggccaggagtttgagaacacgctggccaacatggtgaaacccccgtctctactaaaaatacaaaaaattagcctggcgtggtggcaggcacctgtaatcccagctactcgggaggctgaggcaggagaatcgcttgaacccaggagg

SEQ ID NO: 102867 - DNA, 1013 bp, Homo sapiens
gacggggtttcaccatgttggccaggctggtctcgaactcttgacctcgtgatctgcccaccttggcctcccaaggtgctgggattacaggcgtgagcaccgcacccagcactgttatttttcttttcttttttttctttttttttttttgagagggagtctcactctgtcacccaggctggaatgcagtggtgcaatctcggctcactgcagcctctgcctcccaggttcaagcaattctcctgcctcagcctccctagtagctggggctacaggcgcgcaccgccacacctggctaattttttgtatttttagccaagatattggccatgttggccaggatggtcttgatcccgtgacctcgggatccacccgccttggcctccaaaagtgctgggattacaggcatgagccaccacatctagccagttgtttttatatttttaagaaaacatacataaattcattcattcagtggatagatttgagtgtctgtttggtgccatcaaggcttctaaggccctggacatacatagtaccagcaataagagggattaagaacctgtttggagatgggaagtctgaggactcattaaaaaaaaaagagagagagagctttcttacagaactgatagtctagatttgtcaggaaatgaatggaagacctcagggaactcaagagattaaaaaacttacaagctagaatttttaatgagagttcacagaaaaggaagatgaaacagctcttaaatatataaaaggtactcatgtttactcattatacaagatacaaacattgaaaagtcagtaattcttttttttttttaacgccctcctcaacagagtagcagacatcaaagtttgacaccctactgtgtggtcaaggctgtggggaaaagggtgttttcggagagagctggtggagtgtaaactggttgagtctctgtagaggacagtctggcaattctgtcacatgtcttttgttccagcaattctgggtattgaacttttag

SEQ ID NO: 102868 - DNA, 1612 bp, Homo sapiens
ttcaaaaaaggacggatgtatactttggaaattctaatttaataagttaatcaactttgtgggtttgttgttgttttgagacagagtctcgctctgtcacccaggctggagtgcagtggcacgatcttggctcactgcaacctctgcctcctgggttcaagcaattctcctgcctcagcctcccacgtagctgggattacgggcacccactaccatgcccggctaatttttttgtatttttagtagagatggggtttcaccatgttggccaggctagtctcaaactcctggcctcaagtgatccgcccgcctcggcctcccaaagtgctgggattacaggcattagccactgtgcccagcccaagttaatcaactatgaagagaaaaataaaatcacataatcttggttgttcagcctctcataagaaagccaaattgttttttgcttttccatgttgtttacttgtatttctgaattgtagagtcaaaggagaagttcagagtcccatcagcaatgcacctgtcatacaggaagatctcatcatgtcctgtaacaccagataccattttcagtcttttctctctttctcctgcagggctacaccaagtccattgatatttggtctgtaggctgcattctggcagaaatgctttctaacaggcccatctttccagggaagcattatcttgaccagctgaaccacattttgggtaaggttcccgagcccttcaggagctagatttactcaagtttgtacagcttacatcaaagtcacttcattaaattaagaagagttctaatatactctttaacctgtggtaggtgtgaatttttaaccttctctgatttaaaatgttaaggacttttgtgtaaaaacataagaaaggtaaacatcaggagtggtgataagcaacggctcatatcaattatcagggttcattccgactcagagttgatggtgtgtagtcatttaccttggtcctgataactaatagctaatttttttatctgataggtattcttggatccccatcacaagaagacctgaattgtataataaatttaaaagctaggaactatttgctttctcttccacacaaaaataaggtgccatggaacaggctgttcccaaatgctgactccaaaggtaaatgttatttcgttgattagttttttcttaggcttagcttcgcgtttatttgttaaattgttaggtcactagcctgaaaaatgagcctatggctattggataatgctttctttagtgctcactctgaattgttgtcttccccctttttttttttggaaacagtggcagtgcagtaagggaacctggtaatgacggtctagttctccaccttttggtttctttgctaattttaatttgcattaaggtcactttttttttgtttttgtttgagacagtgtctcactctgtcgcccaggctggagtgtagtggcccgatctcggctcactgcaacctcctcctcccgggttcaagcgattcttctgcctcagcctcccaagtaactgggactacagacgcgtaccaccacgcctggctcatttttgtatttttagtagagacagggtttcaccatgctggccag

SEQ ID NO: 102869 - DNA, 2919 bp, Homo sapiens
aagactctgatagatacaaatgaaacacgtctttggggcatcctttgtttttgaaaatctgaatttacacagcccaaaaggtatattttcttgtaccatatccttatttattttcctttgtatggaattatactgagtactactgcttttttattttgtagccttggcattgtattgattagtgtcatgtaaatttggttagtctttgattttatagtgttgacagaccttaaaaaaaaatcatggccaggcatggtggctcacacctgtaatcccaacactttgggaggctgaggtggttgaatcacctgaggtgaggagttcgagaccagcctggccaacgtggtgaaaccccatctctactaaaaatagaaaataagccacaccatgatattggagggccagatgatgaaaggccagtagatgcttgagaccggagaaaatgagaaactatgtattttttaaaaataaaatattcttaagtatatgaaactttaaaaaaaaaaagctttgggagtaggtttgactacctagaagaaggaagtgggaagaatctttggaaatacttatatttatagactaagtagaagactagcagaaagtagagtctgagaatagaaggccagtgcagatcttcacagcagtcctgagagctccagcaggacaggctgagaaaagggtactggttggttttggtgactactcagaacagtttttgtcaattcacctattgagattgctttgtgctaagcagataatgaaaggtagggatgcttcttaaagtgtgctctgtaaagacttcttcagcctgcatcctggtctctaacatgttgattgcttttcaggttgttgggaaaattaaataatgattttctagaatgcccagaaagtatctgccacttagtagcattattattcctattgccttttttatttttgtgatgttttgatatgaaaggttagaatttctaagaagttatcctgttttttttctctcttagatctgtgactttggcctggcccgtgttgcagatccagaccatgatcacacagggttcctgacagaatatgtggccacacgttggtacagggctccagaaattatgttgaattccaaggtaaggatgaagtttgcataaaaagaaatccagtaagtaagagaactttctgaatgcattgcagtaagccgtaagtctccctctgcgttgagagtttgcctgtctggccagagacaaggtgctgtcttttttgagacagggtgttactctgtcacccaggctggagtgcagtggcaccatcacggcttaccagtctcaacctcctgggctcaagtgaccctcctcacctcagtctccggagttgctgggactacagagtgcaccgctacacctggctaatttttttttttttttgagatggagtctcactctgttgcccaggcagagtgcagtagcacaatctcagctcactgcaagctccgcctcctgggttcacaccattctcctgcctcggcctcccaagtagatgggactacaggctcccgccaccatgcccggctaattttttgtattttttagtagagacggggtttcaccgtgttagccgggatggtctctatctcctgaccttatgatccgcccacctcagcctcccaaagtgctgggattacaggcgtgagccactgtgcctggccacatctggctaatttttaaattttttttgtaaaagtagggcgtcttcctatgtcgcatgttgcccaggctggtcttgaactcctgagcttaagggatccacccacctcagcaccccccacgccccccgcaaagtgctgggattacagggatgagccaccacacctggccccaaggtgctgtctaaattttgttcggcattgaacttctgggccctagggctcagcctctctacctcagctgatatagtgctgacggttgtagagtaggagggggtgtgcctctccagtcactgttaccataagtggtctgtgtttcactccttggacagctgtcctgaagtcctacctatcgctgtcactgttaggtgcaggctgggtttgttgtagaggttattcagtaatgtgtatttctgtgaacatgggccagggctattctataaaggtcaaatttatctgataatgaagaatgtctcttcggcagaattatattgtaatttgttgtacttgaagaaaacataaatgtggacagagtaggaactgccgtggattcttttgaaattacgtgatttcctgcttccaaatgaagtgctttcctctgcatctgtgagtggctatagagagtgcatccaggtctcatccacactctactagcaaggtctgtgtcttggtcataagaaatggttgaataagtttacaaaagcccagaaaagtgaagtctgacattttttgttgggtttatgagccaggaggcaaaaattgagggctgctatggagattgagattcagtatttttctgttatttgcaaataatatatgaataaggtgtgaaaattgagtagttaagtaggcctgacatactacctgtatctagtatctcaggattataagattcttaaacacagttccctctgctgtcatgtaaagatacttgaagaaaagcaataaaaatagacattggatcttgtatctagggcccaggaaccagaaatagtcctgagaggcttagtggaaatgaaagaacaggtctaattagcttatagtcttctttttcttcctccatcctttattactagtacagataagctattagattttttcataaggaaatggaatttgtttaaagcatttagtttttcttgatatcctacatttgttcagtttagttataaaagtaaaatctcattaacataaattccattataaagaaggatttggtgtaacagatg

SEQ ID NO: 102870 - DNA, 1164 bp, Homo sapiens
tgtttggcttttgaggagcttgggagaggaggggagcggcaacaagaagtaaaaagaatagtgacattacaggttactggaccaaacagaggagggagtatctgctacttacaggctaacagtgtttccagcaaaccttggagggggttcgttgatggtggacaatttagagagcaaagaggttgagacttcaagattgaccagaatttccctaacagcctgtttcagatctcagtctaggcccatagccgcatcagtcagatgtaatgctggaatgcctgccatctcacaggacctaaaaggagttaacgacttcagattctttccatgaaggaaaccaagttttcctcagtttcttctttcctttaagggcttcatggtgtaatgatggactgtttgggaagagagtcaagagaggatgcatttttgttttcaatgctttgctaaatgtgaccagctaattggtgttttaccttaacctgtgcaaacagatatatagtacaggacctcatggaaacagatctttacaagctcttgaagacacaacacctcagcaatgaccatatctgctattttctctaccagatcctcagagggttaaaatatatccattcagctaacgttctgcaccgtgacctcaagccttccaacctgctgctcaacaccacctgtgatctcaaggtcagccaggttatttactattaaggtgatatatattgaaaaaccctttcactgaagcatagttatatttgtcattattcatattttaaattacaccagaaatacccaaaaacatgtttatggcaaaaatgctaataaagtgtggtagtcctcttcttcttccttatcccattgctcctttctccccagagataccttttttttttttttcttaaagacagagtcttagtatgttgcccaggccggtctggaactcctgggctcaagcagtcctcctttcttggcctcccaaagtgctgggattatgtatgtgggccacagcaccaggccgtgataactaactactataacaaattggtggccagttgcggtggctcacgcctgtaatcctagcaccttgggaggccaaggtgggccttatcacctgaggtcaggagttcaagaccagcctggccaacatggcgaaaccccatctctactaaa

SEQ ID NO: 102871 - DNA, 1892 bp, Homo sapiens
actgcacccggccctagaagcataaattttagaataaagttattttactgctttctattctagcacttaccccaaggaaacaagaaatgttgtcttactgcctgtcaatgttatttgattgctttggtcagtgggccagatgttgacatttattaatatgaaaatttcttatacacaagattgtaatagaatgtttatcataaagatagtagtaatactcaagattcaaattcataaaattgaaggtataatttttattattgcttttgcttataattctggtttatcagacattaaggacaactaggaaagaactgggccccatgttattgccacaaatatgttttttgaagaatacttttctaggttttgttataaaactacccaaacatcttgattcagtttcttgggggaagaaatggtcatgttgttttgcaagtgagagaaacaaagttaatagaagtaatcaaggtgttctcttgggtccatttttgttagggataaagatgtacagttgtaggttatttgaatgtttcttctgtgtcagaggaatttgatacaacagtaagaaggtgtttcagagacagaagtgattactctcaccagaatgcagttgctgtttaagacaatgggagaatgcttgtttgtgtatttctgggtttataaaggcaagactttcacccagttaacagggctaggttctctgttagttttgagagtcactgtgtgctctctcatgtcagttgcatccatcctccctagcttgaggcctttttgtggataatatacatgctgccttcacgggtatgaaacaggtgtttacacagtgttaaaaatataatactttaccaacttgccttcttcaaatattctgagggctgtttttaatgccatctctctctctcttttttaagctctgcttatgataatgtcaacaaagttcgagtagctatcaagaaaatcagcccctttgagcaccagacctactgccagagaaccctgagggagataaaaatcttactgcgcttcagacatgagaacatcattggaatcaatgacattattcgagcaccaaccatcgagcaaatgaaagatgtgtatcctttttaggcaactggccaattccactgcttggtaaccttgttgagtaaatagaacttgaaatttcctgaacttaaaggaaaagtgcattaaacatgctaaagggaaaatcgtaatctgtttgctatttactccctaagtctagtcatggaaaatcttggttaactctgtttgcagtcatgtttcttctgtccaagggatggtttgttgtgatgatgaaaaggtaaagggaagatcagtagtagactaagaaagagggtgccctggctatctacctggtgaaatcaggactgtcctgatcttaagagtcaggttaccactttaggtctcagtttccccacctttaaaatgaaggaactggtcgtcatgatctttaaggtcaactgaggtctgaaattatgtgattaactctgaccaacatttagaaatctggactgaacagatctagaggatgctgcctgggtaaaggctccatttgaaagatagagaggttaagtatactgaagaggatctgccagaagggaaagggttatacagcactcctaccagtttacccaatttgtattccgcccctccagggtgcgggagctcgctgtttctaggcagccctttccatttttaaacagctctgttaataagttgtagtgatatttgaagtgaaatgcctcctgccactaccacctgttggtcctgctttactttttgccatgaaaataagcctctctcagatgacagatttttaaatcatgtttcctttgaatcccatgctgcgcctcctatagcataaatct

SEQ ID NO: 102872 - DNA, 1072 bp, Homo sapiens
gctcactgcagcctcaacctccctggctcaagtgatcctcttgcctagtcccccaaatagctgggactacaggcgagtgccaccatgcccagctaatttttgtattttttgtagagacagggtttcatcatgttgtccacactgatctcgaacacctggattcaagtgatctgccctcctcaccctcccaaagtgctgggattacaagcgtgcatcaccatgcccacaccaggcctaatataccttcttaatgacctggaaggttgggttcaaatagaaaatactcaggctccttagagttctatgtcagtagttccggcagagcagaccttcagcatagtgctcttcccttcccagccacagcactatccatgtgttgtgagcttgagcacgtgtgtggcctcctgcctgcacaatgtaggtgcaatacacgccagcaagcagctgcccctttgaccaccacctcaagtgcacctgctgggtacagactacacttttccagatgcagggaattcccgggcacctgaggagcattttccccgaccccaataaccttctctcatgggcatgggcatgtctgggtgagggttagtggccagtgaccacagatgtctcagtctcttacctcgcctcctgtttcctctttcttttctttgcggtcttgcttttctgtcagaagcctactcatccttcaggataaggcttttgcgggcctcatcttcttttaatccttcccttagtatttgaagttaacccagctcctccttgggtttcagaagtgctttaatgtgataaaaggcaaagtatgttctctgttcctgtctccttctctcacaaaattgcaagtttcttaagagcaggatcattatttgtttttgccaccagtcctaacatgaagcctcacaaatgggaagttcttgacaagcgtggcttgaattcaccagaactctgtcttcatttcgtgttgttgtggtaaccctatcaaaacaggaaataaagctagtttagcatgacttgttcataattgactcatgctggttccctttccttccctaagcaatcataaaacatc

SEQ ID NO: 102873 - DNA, 1053 bp, Homo sapiens
aagacatgagctatttagaacatacagttgtgtccttgaggaatttcatctaattggatggagactgcttgaacaggaccctgctgggacatgtgaggtttgtgaaataagcacccatttcttgtgagcctgctctttgcccatttatccagagctgtggctccccttcattctgagttggctgaaagggctccttgcctccgggtgacccagtgcaccatcctccccattccattctttcaacaaactgctacctgaggaaaagttataaaaatataaatgttgccatgcttaaagtctgtgcttagcatcctttggtggcttcccaggataaaattacgaaaatataaatatggcctggctcttgctcaccctccagcttcccctgtcatgtccctgtgtgtccgcctctctgcaggcactctgtcgccccaggttcccacaggcctctgcaccactgccccacatctcctctgcctggaatttactctcccttctcttccccctggttagccattggagccttctctttcaccctacccggtcctgcagccttcagcctcccctcccccagcccccgaccatggctttcataacatcctgtgcctctcagtttttcacctggatttaagtttttttcgttatccttgccttatgatcactctttaaaaagtagtcggctgtactctttctgctcctctccccatcctctccatttccttacttgaaccaaagttaccacacatcgtctggttgcatgcagattcagtgaatgctttccagttcttacttttctcagtctctcctgtttgaaatgccttccttctttgtcttgggaaacaccacccttttctggttctgctacatggttaagcagaactacatggcctctggagttggacaacaaaggttcttttttttttgagactagtctcactctttcacccaggctggagtgcagtggcacaattttggctcactgcaagctctgcctcctgggttcaccccattctcctgcctcagcctcccaagtagcgccagccaccatgcccg

SEQ ID NO: 102874 - DNA, 1077 bp, Homo sapiens
ctttccaagagttacctctttttttttttttttttttgatacagtcgcaatttgtcgcccaggctggagtgcaatggtgcaatctctgcttcctaggttcaagtgattctcctgcctcagcctcccaagtagctgggattacaggcacgccccaccacaccctaggctcactgcaacctctgcttcctaggttcaagtgattctcctgcctcagcctcccaagtagctgggattacaggcacgccccaccacgcccagctaatttttgtatttttagagacgggatttcaccatgttggctaggctggtctcgaactcctgacctcagcctcggcctcccaaagtgctgggattacaggcgtgagccactgcgcccggccgaattacagctattttaaagatcatcttcagtaactagtaactgggtcactgtggatatgtggatatgttgtctcttttttctcgtttctgtttccttgtatgcttggtaacgttcaagtgaatgctggatactgtgtatgaaaattgttgatgctctaggtgacatttttctccagagagagctctccctaatcactgataggcagatacagtggtgacagataaccataattcagtgagagattgagctgattcgagggttggttgcagttttttttttttttttgtattacacaccttttaatttgaattaattaggcatgatcattattgaaaattggtaaagtgtagattgataacaaccaaaacaggggaaaacattcatttaaaactttcccaaataaatgctccatgtataggcctctattaaaataataacaataaacattttttgaaccactttatatattttaagatttgtttagggctttttcatttgcacgtgaaaatattcctttttttttttttttttttttagtatttattgatcattcttgggtgtttctcggagagggggatttggcagggtcataggacaatagtggagggaaggtcagtagataaacatgtgaacaaaggtctctggttttcctaggcagaggaggaccctgcggccttcctcagtgttcgtgtccc

SEQ ID NO: 102875 - DNA, 1020 bp, Homo sapiens
gtttacttaacttttttaatcaagaagtctcctctacacttttggagctcaaagatgcaaggacagcagcttacatgagtaacagaagaatctagtgtttctgagcagagtttagagtaaaaggataagtcaaaacaaaattaatttttatattaatagcatccctaatgatgtattcctggtagttagctataaccattacaccattcccataatctgatttgtgtaaattcaagttgacttttccccaaaactgtatgtaatttattcctcaccttgctcacaatttatatacctattaattgaaaaacacctcattccccaacaaacatctagagctccttgcctccggcctactccacccaccctcttgcctaatcctgagatgctattttgctcccctttagatttgctttttttctttcacttcttgaggctcccacactgaaaggtgcctaggagctcatccagtagctgcgctgtctctgctccctctaggaaaggccacctgcctgagctttgaaatggcccacaccgtaccagaaggaagaagagagattccaggaggattcagacgttacccaggctttctggaaactgagcagaaccacaggaggagaaagctataggcagctgaacaaaatttatgtgtttctatttcccctgctataacatgaaaggactgggctctgtctgtggttttcaaatctcctcctctcttaggggcttcaggcctcaccccaaatagggaaacttcacatacagcattctctcccctaatccctgttttttctattctttgctcttctcttatctacctccttcccctcccgtttcccttcttcctctgcccttagtcttttttctttttcttaatttccttttagtcattatcatcttcagttcacataggtagtaactattagggttagcagggcaagatcccatttggaaaaaggatttgattgctttgaaaatgatgttgggcaacccacaggatagatggtctccaaggtccct

SEQ ID NO: 102876 - DNA, 5413 bp, Homo sapiens
gacggttttttttttccccccgagacggggtctcgctctgtctccaggctgaagtgcagtggcgtgacctcggttcacttcaacctccgcctcctgggttcaagcgattcttcttcctcagcttcccgagtagctgggactacaggcgcgcgacaccacacccggcccatttttgtattttttagtagagacagggtttcaccatgttggccaggatggtatcgatgtattgatctcgtgatccgcccgcctcggcctcccaaagtgctgggattacaggcgtgagccaccgcgcccggctgatggtagtttttattagagcaaactagcgatagcattttgtgctggtgaggacttgtggaaatagatttccttaaatctgaatcttgtgaatgtgtcttttgtgttgactgaagaaagtaaactaataatttattgaacccttcgtggcaggtactgtgctacatatattatttcattttatttgagcagccacattgagggaggaaaagatggtgttattccttttttcaggtgagaaagtatttcgaggtgaagccaattcttgaggtcatagaactagagttattaagattgtagactgagattctactagacacactgtagctcttttcagctgtttttaggaaaacactctgcgttccttagtgtaattaatacttgcagaattttctgtatcttactgttataaagtaaatataagtctgtttcggaaatgtattcaaatttcaatcataattttagaaatgccatagaaggtatgttttaccaagtattgtagctagatagaaagattagttaaaattctttttaaagagattttaattgaatctttaatgttttcactttgtttaggagcaaaatgctgaatacaactgtgaaaattaatgtgaactcacaggcttaggagccaagacagaatttaaattaggtcgagcctgaaagaaataaggccctaaaaagtaatggagagaaagtattgccagtagcatcatttctccaccacacatcgcattgctgttgcactcactgggaagtgtgccagtgaacatgtctcattatgagaggctcagaatttcccatcacatcctttggcccttttaacaagattagcttatctaaaatgtggactgaaaaaagtattttacgtttaggacatgtcaattgaaaagatacccccatctgataagatttctcctgtctgataaggtttttactagtctgaagttgtttagatgtgggaactacttctgtcactgctgtaggcttgtttgaccttctgactctccatttgaaatgctaagtcccctttttgtgattgtcgtttcctaagtgaaatacaaatgtaattggaatttgaatccaagatccagattatagccttttatcaggttgatgaaataccctgctgttaaccttctccattgcacattattagcatttaataaatattggctaacagtgctggatttatggagggctcgttgaaatattcactaatatttgaatggtgatcttttaaaaaatgcttccaaaaggatttatggatttctagccattttttagatttacccccttctgtttccttatcagttcattaggaattgtgactattttgtttagagtcctttcctaatgattatgtagaggatgtaaagatgaagagtgggatttgagttgggcctttaagagtgggtgtgattttgatatgcagataataggaacaagtgacagcttgagctgtggaatctaatcttggaaatgtacttaggtggcaaactgtagaggactccaaaggcaaaactaagtttgactgtatatttgttcagtggaggaagcatcttatttatttatttatttgtttatttttttttttgaggtggagtctcactcttgttgcctaggctgtagtgcagtggcatgacctcggctcactgcaacctctgcctcctaggttcaagcgattctcctgcctcagcctcctgagtagctgggactacaggcgcgtgccaccatgctcagctaattttttttttgtatttttgtagagacagcgttttgccatgttggccaagatggtctcaaactcctgacctcaggtggtccccctgacttcagcctcccaaagtgctgtgattacaggctttagtcaccgtgcccggcctttttttgaaagaggcagtcatacatggtcaattttgaaattttttgggaagacaaatcaacactagtgggaatgaaggaagaagaaccggagtggaggaataaattaggaaagcctaaccacctagaggtgcagtaataaagtggcagcggaaggtagcagatggaggtgaggagttttgtattgacagaaatagtaacagggacccttgtgggaagagtggtaaaaagacttttaatcatggcaagtctgagtggaatcaaaggattatgagaccttaaagggtaagagaccaagagaggtgggatttggatttggagggatttctgagatagaacaaggcttgctggttgattggctatgggcggttgttcattctgaggcctctaggttgggagcctgggagatggtggtgccattatccaagtaaaggaatactgttagagcagatttgtcagggggaaatagttctggtttgaacttaagtttgtaatgcctgtaggccattcaggctatatccagaaaccatcttaaaatttgtaagaggggagcaggagctggagatgaaaatttgtgtaaatggtagttaaaatcttgagtggatgagcacagattcttatctgggtcattggttaggtgaaattgcaatcatggccaggcgcggtggctcacgcctataatcccagcactttgggaggcccaggtgggcggatcacgaggttaggagatcgagaccatcctggctaacatggtgaaaccctatctctactaaaaatacaaaaaaaaaaagtagccggccgtggcggtgtgcgcctgtagtctcagctgctggggaggctgaggcaggagaatggtgtgaacccgggaggcagagcttgcagtgagccaagatcgcgccactgtactccagcctgggtgacagagcaagactgggtctcaaaaaaaaaaaaaaaagaaattgtaattatatgttttctatatttatctttttggttaaaaaatacatagcatttgatagattttcaaatgagtccattatcctggaaacattaagaaccactgaagtagaacagaggaccaaccaggtaactctggcaaagaagaggaaactgatgactggtcagatgtataagggaacagtgtagacggggaggagggagaggaggagagattgaaacactcttagtatgcttggtcatcttagactaagatagcaagtgtctattttggtttaattgagtttgaaatgctgtttctgaatgcgacaagagagctcatggggtcatcttcatagagatattaattgaagccttaagagtggataagacatctgagaactaagccaaaggagtgcctgcctttactgtgtcaataaaggtcaagttatggaagaggacagaggaaatgtggccagagagaccaaagaactgggagtgcacgttatcaaaggagccaagggagatggtactcattaagggattggtattgagtactataggagggaaacagaatgcagctgacaagccattatatttgttgactttcagctctttttttttttgagacagagtcttgttctgtcgcccaggctggagtgcagttgcacaatctcggctcactgcaacctccgcctcctgggttcaagtgattctcttgcctcagcctcccgagtagctaggattacaggtgtgtgccaccacacccggctaatttttttatttttagtagagacggggtattgccatgttggccaggctggtctcaaactcctgacctcaggtgatccccctgcttcagcctcccaaagtgctaggattacagtgtgaaccactgtgcctggcctcttttttttttttttttaaagcggggatgttcaacttgggaaagctgaatgaataaaagaaaaaagagggggatggtttcaactaaaatttcattgtgatcacattcctgatggtacaatgtcctcctgtcttgttaaggttattgtgattatagcagactagtagaactaccactttttcagcactcttgttttgtattttacatacattaatgctaagccatataactgtacagcaaaagtggtaacttctgtttgttttttaccccacaagtgaagaaacttgaggcacacagaggttagttaacttgcccaatgacacacagctaggaagtgatgaagcaaccccagtttttctggttcctaagtagtgctccaccaaagatcagagttgagaaaatagattatttcagtaacaagaaatatctgttgtctgcttttgcttgtatcactttttagcctttaaaacctttcatgtagagttatttactcagaaaatgtttattgaactcttcatccaaataatgggatggaattggggaataatacagagaagataccagtgttacccaggagtttgtgaagtgctgagaggaagagaagagctgagtgacttggggctgtctttctttggcttcccagacttctgagctaggtgttgatgtgtgagtaggagtttgccttgagaaatgccttctaggcaaagcgaagtgtgcatgtaaaggcacagaccgtgaacacagtgcatcaggtcaggaaaaccacaaattacttgggaaggctggagtgtagggtgccttagtaagaaggtgggagttgagacagctgggggtaggcagggccaaatcctgaagggcattatttggtaaggactttggacttgatcttgtgggtgacggagtcattaaaggatggccctgtttctgtctgccagttccactcccactttatctcttatgctttctgcccattttgcctacttacttactttttttttgagacagagttttgcttggaggctcactgcaaccttgcctcctgggttcaagcaattctgcctcagcctcctgagtggctgggattacaggtgtgtgctaccatgcctggctaatttttgtatttttagtagagacaggatttcgccatgttgtccaggctggtctcaaactcctgacctcaggtgatccacctgcctcggcctcccaaagtgctgggattacaggcgtgagccattgcacctggccgcattgtgcctactttatctcgtggtactcagtgggggtgattttacctccctgctacagaggcatttggaaatgtataggggggcggctttttgttgtgttgtcacgttgattagggggtgttattggccgtcagtaggc

SEQ ID NO: 102877 - DNA, 1048 bp, Homo sapiens
tgagccaggaccccagaggatggccatgccccgtgcctggcagaggtctggtgccagcactgggagctgctccgcccttgccttggggccgagggagccctcgtccacccctgcacagcagctgggcacagaggagcgctcttccatcttgaccaggactgcaccaagaagcaccaggtgtcttcagcctccaacctccggggcgaccttctcttccagccacagtcccatgagggcccctagccagggacactggtctgtaaattgtaatcctttctccagcccagctctccacttgttccttgtgtgagctgagcaggcagtgcacctctgagtgtcccttttgtaaggcccaggggttgcactgagtctgcagaggccgcgacctcctagaacgctgtgggtgcaggtgagccggcgtgtcctggggagatgctgccagcacacaggggccctcctgctgccagcaggttggggtggttaagtcttattagtgtctattcttaaaattaagtgggctggagaagaatggagctccacatgccagcaccgtatatggaatacaaaagctggggaagcagggcctgccttacaggtgtggctgactctgagcccaggcctgcaggggtggagggcagtccctcagaatcccagaggcagtcccagcctcagaacccaggataggaaatgggtgtgtttagtggggaaagggacggggtgcagacggcagggccagtatggggccccctccctctcctctcctctcctatggtgagcccagcgtgggcaccgggccgtctcagccgtgttcccagggctgggaggacagctctggcccttcttaggcctagcctcgtcccaagctaaatgtaagccagttgggctgtgttaaaggaagcagtgtttttggttcgattctgcctctgtagctcaaggggggcagcccccagagtcctgtgcattctgccaaggctccatagctttgccaaatgcacggagctctgccattccggtgcagtgcaggccttgcgaagggtttatctgcgtt

SEQ ID NO: 102878 - DNA, 1030 bp, Homo sapiens
cagcccagcctgaatgacagagcaagactctgtctctaaataaataaataaataaataaataaacatctttattgagatacaattgacaggtagtaagtggtgcatatttgaagtccacaatttggcaagttttggcttatacacatatacacctgtggattcctcaccacagtaacggaagtattcatcacccccggaagcttcatcctgccccgtgtcatcctctgcccttccctacctcctctcaactctcatgggccctctctccctgcagcggctgcagagcggcaccacaggtgtgtgtgcgctcattgcaggagcgaccctgcacgtcgcctggctcggggattcccaggtcattttggtacagcagggacaggtggtgaagctgatggagccacacagaccagaacggcaggtaaggggatccctgcgcccaggcccaggatattcctggcctccatcatgctgggcccataggggaaccccacccagcctgggaacttcaggtagtagtaatcctggcacctttcaagagggagggctccctgcctgatttgagtggccgggggtcccacgtgagcccttcctgagagctctgtgggtcacagctatatggagcccagagctccgggggagagcagagccctctgcactgacaggcatcccagtgcagtcagtgcagcccagtgcagaccagagcccatcatacacacggacaaggaggccacaggctgtgggtgaggaaggcctcagggaggtgatgctgccccgaggctggagggaacctggcttggggctgtactgactagaggctgcctgggaccctggcactcaggtcatcacctggacatgaggatgacagtcccactcagacctcttctcagaagactgtctcatccatgtgtctcctgaggttggattgcgagcattcagatatcatggaatgactgtttatccctcaaaccccacttttcccacgtgctgttctccaccagctatgtttgattaaccatgcacatggtggat

SEQ ID NO: 102879 - DNA, 1034 bp, Homo sapiens
tacaggcatgagccatggcgcccagcctgtttgtttttaagagacaaggtctctttatgttatccaggctggtcttgaactcctgacctcaagcagtcctcccacctcagcctctcaaagtgctgggattacaggcatgagccactatgcctgggctagttttttttaattaaactttttgttttgagataatcatagctgcacatgcagttgtaataaataatacaaagagattccatgtatactttacccagtttcctccaatggtaacattttgcaaaactataataaaatatcaccaccaggatcctaacatggtcaaaatacagagcagttccatcaccaggatccctcctgtcacccttttaaggccacccttatacccccacccctacagaccccatccctaaccactggcaactactaatcttctcggcttctaccattttattatttcaagaacacatataaatggaagcatatgatgtgtaactttaggggactggtttaattctctggagattagcccaggttgtttgatgcatcaggagttcattctttgccattcttgagtggtattcaaaggtatgggtcgaccacggtttgtttaaccatttccacgttgaaggacatctaggctgactccagattttggctgttccagataaagctgctatgaacatttgtgttcatgtgttcaagcttttatgtgaacagccttcattgttctgggataagtccacaggagtgccacggtggggtcgtatgggagttgcatatttcgttatgaaaatcatatttaatagcagcttaattcttcatcaagagactagatcttttttttttttttttttttttgagacagagtcttgctctgtcgcccagactggagcataatggcatgatctcggctcactgcaacctccgcctcccaggttcaagcgattctcctgcctcagcctcccgagtagctgggattacaggcgcccgccaccatgcctggctaatttgtgtatttttagtagagacggggt

SEQ ID NO: 102880 - DNA, 2528 bp, Homo sapiens
cgctcacaacggcagcagaatcaaggagcagagaaggcttgcggccccagtgaggtggagggtggcggtcacagccctccacaggtcatatagttcccagtcagcccacgaggcaggggtgggtggtgcagacaccctcctgtgtcctgtctgactgaagttccagaacagcccaggaaattaaagatgcttatcccgtttcacagaggatctcacaggtgatcgatctctggtcatgcagccaggttcaagtgccctcagtgttgtaactcagttaacatgcgcccgggcaggcgaagtcagggttggccaggtggcatgccagcaggtctcggggcagcagcgtggtcccctcaacgctcgggccccctgcctcagctgcccccaagtcaggattctgttgggtggagacgctctacggtgtccatgagccccatggttagatgctggtggaagcttgtctgtcagcctgctcctgggacagccataagcatggtgtggccaggggaacccagaaatggagagggctgcagatccatttcacagaggatataatcattaaaaagcagggcttttatttcatgtgactttctttcattctcctagtaatttcattttattatatttcgccaaagtgttggttgatgttagaccagaaatacagggcgtaagaatcgcaggctgcagcaggggtgccacaagggggtagcaacgtcccacccagctgaatagttgtccctggacaggccagcaggcagcagagttgcagtggattttcccttccttgccatttcctgtcggccatttcctttcccttcctttgccatttcctttcctttccctgttgttctaaattcggcattactagtgcatgcgtgcatccggggaaaaggaacaaggtgggagaagagagagaaagcgaatacccgaggccgccagcatcagtgggtgcccgcgctctcctcctcgctctcgtcctctgccctccgccctggctccctgcccgcattccctgggagcgcagccttgccttagcctgggagacagctgtccacagtgacaggcggccattgttctcggccgagccagcaggcttccggccggtggcagctgctgctcctccgctctgcggccccaccaagggggcgccgccaccgcccaggccctccccgcctgatgggtctctgtccgtccacgcgggagacagcgccacctgccggtgagaaggagcgttgctgcgccggcaccagcccagtcctacgctcggggctcctgcaggcctgggaaggagggagggcgcagctagaaggaagtctcgcctgcccttgcttccccgtctgtcagagtgcctcgcatgcaggcctgcctagcggccttgatcatgctctccctgtcacggaagtagaatgtagtcaagtttttggactccaagccattcttacaaaattgcgtcagagtggggattgtattataagaattgccactgaagagcagcgagtggctgaaacctctgtgtggctgccagtcagcccctccccggtgactggatcagcgaagaatccagaagcgaggttgcggggctgcagcccttggcatggggagtccgtgggctgggcagcactgcctcagccgctggcctttcctgagcagagtctaggctaagcggctgttggaaatagcagtagcacccggggcgagaccgtgagccacagcggcggccggagtctcccccagcccgagctcaggcctggtaagcaccaggagcccacagtttccagagggagtgaggaggagtccatggcatttaggggcagttttctgggcacagtggccctcagacgagaggaagaggaggcagcgctacaaggactggcaggacgaggggggtttcctgctggtttgcaggggatccactggccaaacttgtgtggagctgccttccctgagctgggcctgcctgaatgagttctcaggcccctccttcacccatagccttgccagtccccagttcttgccaaatgcttgaataggcccctgtgttggccatggcggcagcagctggctctggatgcccccacccctgccttgatgcatggattcccaagaacctgtctttctgtgacctcctgcgtgcataagccctcgcgttcatggttcttcctcggtggccccctctggcctcagcccttctccttttcttccacagcctccgcctttaggcaggagctctttcctcctctcagttccccatgtcctttgggtgtggcctgtgacactcaactcctgccctcggctgactggccctgattcaccatgcttgccacatgcacctgggctggcaggagttccaggagagtttgtgcattgaagtgacatgagtccctgaagccagagcccccatggtttcctttgggcctgttactggttgatcttttcttgagaagccaagcttaggtaggatttgggtattttttcttttcaaatgagtattgtggcttatattatttgttgctacataacaaattgcc

SEQ ID NO: 102881 - DNA, 1294 bp, Homo sapiens
tcataatgagcctgggactgtgcctccttcccggacggatgagcctgcctgggcagtctgggtttgcatccctgctctgtcacttaccagctattgacggcagaagttgcttaatttctgggcgctgtgacctagggattgctttccccatccagccgcccacccaaagctgcagaagagaagcaagaggctggtgactggggcggctccggagcccaggtggagccgcagttcgcctaccactaaagggccgcagtcaccgtccacgtagccgccagggggcagcagaggtccggccccgccagcctggaggcccgactgcgcctgcgcggcgcccgcggcgcccgcggcggccagggacgggaagtgggcggggccggccggcagcagcttgcgggacacggagccgcgaggagacagctgaggcccgcggagaccaggggtgaggaggccgggggggacgggattagagggctgacggggctgggacgagggtcaggcgagcgcccaaggcgcacaggggtgaaatgggaccgaggaaccggaggggtggaatcagagggctggggaggcaaggaggccgagacgaggctcacatgggtgcaccgaaagggtgcgggggtgcagtgcggggggccgaggagcaagaggggccgctgcggacatgaggaacccgaggctgggagttggggggctggggagccaagggggcagaactggggggcaggcgggggtgtggccgagccgagggcctggtagggaccgagggctatgaggcagaatcgggtgctgagggggacgcgccccattttccgagatttggcctctccccaccccccaggagcctctgggccggcacgttgccccatatccccccagtccctgcaccttcaggggcccagtctgcctgatggcccccggctccgcggcctcccaagcgtccgtgaagcgagcgtcagctgcacaagtgctcgggctgcagctgcttcagccacaggtctgtgagccagagcctcaggcgcggaggccgggcacattgccgctgggttcggtcaggcaagcccctgaacctgtctgtacaacaggaagaactggctccggctgcagggatttcggcacagcgcttgacacacagtgaggcccactgcatggtggcgggctccttcgaagccttccaccctgcgggacagagtcacacatgtcgtggtggcattccccgggacaagttctctgggcccagctgagctctcaccacgggggatagaaagtggggccggccagcactctgaggcca

SEQ ID NO: 102882 - DNA, 1187 bp, Homo sapiens
tgtgcgtctggcagcttcccaggacctgctgcaattcccattctcacaacaagcccttatggtcttagaggcagctgggtgccccatggaacccattcacatgccaggtttagaaaataccctgtaggccagactgccgtgtggtgccaggtgctggtggcagctgccctctgacctcagtgccttcttgtgctcccctccccagccacccgaggagagacacctgtgcgggatccactgtgtgttggaaactccctccacactccgcccgtgcctcattgagtgatgacgggagctcagcaaaacagctttccagactgttcagtgggacctttctttgaggggcaggtcaggaatgtttcggactcagacccgcccccgccccaactcagtagtagattcccaggctgcaccaggacttatatgagagctcctgtaaggaaacccagagcccaccaagcataccccacctggacccccttcctggaggccctcacaggttaacacgggggttccctggaacacagtttggagagctactcgaagctgaatgaaaatacagagacatggggaaccacatagagggtcctgggatgtgtctcagaagcacaggcttcaggaaggagggggtgctctcagagcttctgccccctcccacccactctggtcccattctggggccctagcaaggccacacctgttaggtccccagtgcggggctgtgactctgctcttccacccacagggcccagtggacctggagccttctccgcagaaggtttcaagacctccaggacccttaggttatagggctcattcaggcttggaggagcagagacggttcctaggtcttaaacccagaccacccagtccttccttactatgcttctgcactgcgctttcagccacaggcagggctaatcacaaagtgttcctttattttcctctgcagttgtcccttgtgtgtgaccctccttcaaggcccttggcttccgcagcttgattctgcactccgagtccattcaccttctcccatccaatagcatccaaccccgctgctactgctgccaacctggccttgggagcaatgaggacaaggaagggacaagaccccttttaggccagaactgccttcagatcagccacgctccatgggactgtacctctgccctggaggctggagaggt

SEQ ID NO: 102883 - DNA, 2060 bp, Homo sapiens
cttgtaagcacctccgtgttctggtggagtggggctctggctccgggagcaggtgggtgccacaggacccaggcaggagaagccatagaagtcacattttccaggcgcagaataagcactgtgaccttggagagttccttaacctccgagcctgttgtctctgccataaagcaggagtaggcgccctgtacagggagggctgcccttgtgttctcaaggcagaacatgaaatgcatgcagttggtgcccagcacagtgcagggggagctcagggcacagccctccctcctgtgaccgggagcagtgagagggcctgagcaccaggggccccgtgacaggtgatacagcacatggttcagtggggcatgtccaaggcaggccaggaaccctggggccttgtacattgcaggcacggatgccagcatccctgtgcatatcaacaacatctgccagcgcaactatgtcacggtggagagcgggcgccggctcaagcccaccaacctcggcatcgtcctggtgcacggctactataagattggtgagttcctcagtcctgcccccagggcccaccgaggctccctggcttctccctggatgttggctctgctgcccgctccagacaggcccctgccctacagtgatcccccagccccacacacactccctcaacacccgctgaaggggtgctgccccaggacccccaggacctgcccagagcaggagctcagtgtgtttgaaggctgaacagatgtgtgagggaaccaaaaagggaggcgaagttgcctcagccctgttccctggaggttccccaggggccaaggggagagggaggagcacaaaactggcccaagggcggcctggagctcatgtgtgatgtggttctagccacaggacatccctggccactctgcctgacatttccaggtgggaaatcaggaaaggtctggggtcataagagccagcctggtaccatctgaggctgtggactggtgggtagggcagaggccaggaggacgggccagagcgggaggggtgaacagggcagtatccctgcctgggaaggggtggcatggccctgggtgcgagtgctcagggcaatatctgccccctgcccacttgcagatgcagagctggtgctccccaccatccgcagtgcagtggagaagcagctgaacctgatcgcccagggcaaggccgactaccgccaggtcctgggccacaccctggacgtgttcaagaggaagttccactactttgtcgactccattgctggtagagtctgcctctggcctgcccctcaccagaggggtgtctctctgtcagcaaggccagtacctggggacccaggtccccacgtgggaccagctcccagatctgggcttcaggcctccgtaggccaggtcagtgacacctcctggctgggttgaaagagcaggtgcattaacaccacacatggccaggaacacgtgcctctgacgcacagggctgctgccctgccgtgctgccaggacagtagaaaccaccgcctatagggaccctttcacactcagacccttgaccacgtgttgcggagccttttgctggggactgggagggagatgactcctgcactctgcttgcccgcaggcatggatgagttgatggaggtgtctttctcgcccctggcggccacaggcaagcccctctcacgctgtgggaagtgccaccgcttcatgaagtacatccaggtaggtgcagggaacactagctcaggcaagctgcctcacccctgtaggcctcagctttatcgttgatcagcaggaatcatgttctttgtcctggttgtcacaaaagaatgatggaacataaagaggccttgccaaaaaatacccagtgtccccacgtcccctagaatacacagccattaggccacgcaaacacacatggtgcatttttccctaacaccatgccacttgccatcatgggcattaatgtacacacagagattttagaactgccttttctgcacgcgtggagcaagagccagagactcatgctccttgcctggcagtgtgtcacag

SEQ ID NO: 102884 - DNA, 3269 bp, Homo sapiens
tctgcggcagcaggccaaccacccctactgggccgacacggtgagtggagccgggccggcctcagcatgtgtgtgtgtcactgaggccttgggaccaggtctggtacgtcagccaaacccaggcaggcagccgagcccagccacagactctgctctgtcttctctccctcaggtgaagcggttgttagcagaaggtatcaaccgcccgcggaaaggccatgacgccggcgaccatccccccatcacccccatgaagtctgccacagaggccgaattaggtaccgctctcatcccatacccggtgtgcttccagggagggaagggcgagctgcgacagtgaaggttgcaggccctgttggcaatgtgggggctccttcagcctctgcctgccctggctgtggggatggggggccacctggaagatgagctccattgctatgggaccaggacaggagtgaagaggtagcagcaggtgctgttgcagggaggcaagggggcagacgccacaggggacatgaatgaaaccagggtagagagtggcggtgtgggggagggggcagcacacctcctacctcccagctggcctaaggtggtaccagtggtccgagtgccaggagaaggcaaatgaggaagggagagcagtgcaggtagagacaggagccacctgtggacagtctgagtttgaagcaatggtgtcatgtcacgagacaatggaaagacaggccaatgcctgaagagcagtcccgccagaagcagggacaggaggttgtgcaggatggtgggagccgcagccagaaagaaaccactgaggcatggaggcttgtgttcccttcctccgcatttgctttttttttttctttttttgagacagagtcttgttctgtcacccaggctggagtgcagtggcccgatctcggctcactgcaacctctgcctcccaggttcaagcagttcaccctgcctcagccccccgagtagctgggattacaggctcccaccaccacacccagctaatttctttgtatttttagtagagacggggtttcaccatgttggccaggctggtctcaaactcctgacctcaagtgatccatccaccttagcctcccagagtgctaggattacaggcatgagccaccacgcccggccttcctgcacattttctttcctccttccccaggatttgcagtgtgtcctgcacagcggctctgtaagcaggagcttgctgctcgagcgagagtactgggggctcctcacggccagagcccccagctggctcccaactgactagccctggcctgttgcagggggtgacgcgtggcggctctatgagtacatcaccagacacttcatcgccacggtcagccatgactgcaagtacctgcagagcaccatctccttcagaattgggcccgagctcttcacctgctccgggaagaccgtcctctcaccaggtcacaccacgggcccagccttcctcctctgtgccttcatgggcagacaaacattctacatcgtgtctggggatgggaggcccagggtctgaggccccggccacccaggctggggaccctgagtggcggcgcatatctctccaggcttcacggaggtcatgccctggcagagcgtgcccctggaggagagcctgcccacttgccagcggggtgatgccttccctgtgggcgaggtgaagatgctggagaagcagacgaacccacccgactacctgacggaggccgagctcatcacgctcatggagaagcatggcatcggtgggtgcgcctgcccaggccccagagccggctccgtctccagtactcaggcttcgagtctactcacaaagctgccccgccagccctgtgtgcccagcccagcacccctccatgggctggtatctggaaactggtgacccagtgtgtggccagccaggcaggtccacagcgggcatcccctcctgaggcctccattcaggacctggccttccctgtgaaggcccagatgtgccctcgtgcactgtggggtgtgcacacaccgactaacgcccacaaggctgaagattggcccagatgccaggtgactcatagaaatcatattggcagtcccctgagtccacacagccagcctgggctgtcctgaaatcaggtgacagggaaatgagatctcacaggagctgcttccctgggagagaacagaaatgcctgtcccaggcacagggctccccaaagggtgaccaggaagtttccacgcaaaaatgggcagcccagggagtttatcaaagcaaaagtgtagtcaccagtgcacactcctcacaggagtggtggcctcacaagtccccaggcctggagctgtgagatgtctcacatgttgggggccagcctcactgccggagccttctccccaggtggcactcgcgccgctgggcactgcctgttccctggggcactacccctggctgacaggctctggagacctgtgggatgtcacagccactgtgtccaggctctgctccagcagtggtcatataggtggactctcagggagtgtctcttcccaggctggggtcctggtgaccatggcgatcttggcaggagagcagagctctgggcttgctcctctcaggggtccagggcacctgccagggtcctgaaatagccctcagcccactgtggagtgtgggctctgctcccccgtgtcctctgccctctcgcattgatgggacactggctcctggcagccctatgctagccagtgagccagacccaatcaccaatacaagtttgtgacagtgaagagggctctggtgttaccttctgaacaggagagtggtcagggtggccctgtgactgagcccccaggagtgtgtcaaaagggcctgaccagagccgccacagaggagcccacaccacgcgtcatggcgcccggcagactcggggtggtagtggcacacgccacccacagcctgccacaccgggtgcagagctggcctcgtgccaagagccatgggccctcggcaggctccttagcccccagaggccagtttcttcccatgtgagattctctccgagctactttgggaaggtgtgtgtcacctgtccatgctggtgagcatgcagggagccccagcctcctttctgcccctctgactggcacccgccatagtcaaaacgcctcagcctccgctgcgcccctctgccaggaaacttcctctgggtgggagagtggaatcctggggactgggagcctcccctggggatcgtgacgggccttgc

SEQ ID NO: 102885 - DNA, 1117 bp, Homo sapiens
gaggcccctggccctgaacactgtggagatgctgcgtgtggccagctcttctctgggtatgtagggacatttctctcaagtcaccagaaggcttcctgaggcaggttcagcctggagcagcgagtgcccagggttgcaggatggtgcccaaggcttcaaggggatctgagcctcaggaggatttcacttatccttaggttgtaaaggtggtaaagttggtcaccacctgaggggacctcctgatgttagagtccctgagcagctatccctggtgaggggagaggccccagccagatgtcaccttcagggaaccagtgtgaacgtcgcccctcagcctcatctcctcagtcttttctccttagtaacgaggagggggttgggctggaaagctggtggtctctggcagctgtcagcccctaggcattggtgccccccacccccgcagggaactatgggcagtgtcctctcagtggacactgagtggtggctccagcgtcctcagagggcagcaatgctgggagtggttgctagctaagcgcctgcctctgctggtcagggagtagcaggacgagcccccctgagtggccccaaagtgctgtgaggacagaaacacccaagggctcaaaatggggctgcgtgctaactctgtcgtcagccaaccccgaggtatggttatggctccatggacaatgcatggggagtggtgctctgaaggccatgtgtcatccccatggccatgagccccatgaggatgcaccgtggggtagagtgagtggcgtttcccatcaggcccatcctgggtgtaggattcagccttacgggtgcgggattcagcctcatacaagactgtgtggcataggtgcccacccggccagcagctttgcactccagctgtgcctgctcagagccaccgtcaccctccaggaggggccggccacaatgggggagcctgagtgcataggccagggcaggcagctggccatccccacgtacctggccctctgagaacctcctgtctctcgcaggcatggggccgcagcacgccatgcagacggctgagcggctctacacgcaaggctacatcagctacccacggacagagaccacccactaccct

SEQ ID NO: 102886 - DNA, 1026 bp, Homo sapiens
aagtggggacaccacctgatgccacctccttcatgcaccacccctggccttgggctggactcacatgggtggccataatagtgtcttgagtgaatcagtgaccaaaatatctttccactccctccaggtttcagactaaatatttccaggggaaatacggtgatttagacagctctctcatctcctttgggccgtgtcagactccaaccctgggattctgtgtggagagacatgataaaatccagtccttcaaaccagagacctactgggtgctgcaggccaaggttccttgcctttctctattcatgctggggctttctgggtttggggcatggattctgagagtcttccatcatcatcagccggcaggccccgggctgagggcagaagtgtggacggctgtacctggaagtggtctgtggtgcctagggctgagggaccccagccttcatgggggcagtgggaagagactgggcctgtatatgctgaatctggataagtgggaatgagttcagctctggcagtgcagggtgaggtcaccccacaggaatcagtggcttcagtggtcaggtccaagcactggactgagaccattggctttcaaactttttaaaattcctagaaccctttcttcaaataaaagcctccacagaagctcactgtaagacttaatacagctaggcacagtgactgatgtctgtaatcccaacaacctgggaggctgaggcaagaggattgcttgaggccaggagtccaaggctacagtgagctacgatcgtgccactgcactccagcctagcaacacagtgagacactgtcttggagctgctgtggctgacacggggcttgggaccctggcggtggccatacctaccactggccaggcactggggataggcaggggtggtgtgagaagtaggggctcaggtgcttcttagggacacatcagcctcagctttgggccaccttcctgagactggctgcctggttttggggcaagtggtggagagggccagatgtcagctt

SEQ ID NO: 102887 - DNA, 1117 bp, Homo sapiens
gggcctttgctagctttttctgtgagtgccccctgctggcccacgaggcacctgcaggcacccccaacacacaaggcagttgccattgccaaccctcagtcctggagagcaggccttctgcttttaaaatagcttgtttggtcggggggtttttctccttaattttaaaacaaatgcatacagattatggaaaattagaaagtgcagataagtagaaagacagaaaaattatgcataatcatattacccaagacgactgctgttatcatttagggttatttcattttaacccttcttctgggcagttttggggtataagatcatgttgcatttatacttttttttttggtccaaaaaacatcaattataaactcaattcttttctgttggctgagccagcctcaacacagccagctccttacccagcccaggtaccagtcctcctaactgaggttcagggcctgggaccaagccctgtcctggatgggagcactgggggcgggtggcacagaccgggtctgcagcaggtacgtgtgaacctgtgctgtgtggcaggtggagggcagaggctgcgactacatcgtgctgtggctggactgcgacaaggagggggagaacatctgctttgaggtgagtgtgaggctcactttgttcctcacttttggcctttctgacaccagccccaaactgacaccagcagtcagtcacatcactcctggggccaaaggagggagtaaactgtaccggtttaaaaacacctctcccctccctttattctgaaactccacagatacttttaactgcataggctctattaaaggtggtcagttgttcctccgcttgctgaggcctcaacggtatgagtgaacataggaggggccaaattgtctgggtggatgcaggtttcagaatgggattgtcttggggcagcttggtgttcagcatcttgtgcccagcgtgacttctcagggaccttgggttgatgctggttgattcccgacctcagcactgagctccttttgcaggcctcgctctgctcatctcctgcctcatccaggatgcctcctgcctccagccaaccctgggagccctgcagagaagcaggtggcagctgctc

SEQ ID NO: 102888 - DNA, 1096 bp, Homo sapiens
aggacagtcattatccatatgctgggcctggtggggctattaggtacaggtagtagaaaccagccctggaaggaaggagacgcagccaggactacaccccagtcaaggtctgatgaggctatgccccaggcattgtcacccctggatactcccactgtcctgtggacctcacgtcactccagagtagccaatggactgagctatggccacaggcactactgagacaccagggagctcgagagggaatgtctgccactcacccccaactctggccactggggtggttggtagggtgctgtttccccctatctttgaattccctccaaataggaagagttttagatgctgggtacccagaaatgacaggcacctacctggcctccccttggtccagcagttgagaggggaagagaccctcgttcagctgagaaggcatggtccgcaggggacggtgccccaaaagtggtgcccggtgcccagaagctgagaaagtacagctgagtatggtcagtggagagggtgagaattcgataattagaaggtccctggtaaccgagagtagatctggagtctgttttagtaaacgatgaataacgtttcaatgaagtgaggcaaaaatggaattgaagagtgaaaacataaatacagagaaagagcccacccctgcctgctcctggctcccggcagcctggggctctgcatcgagagtgctctgtgctaggttgttggcagatgctgttttccctgagcgccgtcccacctctcagtgcccaactacccgcaccagtctgcggaatgtcgtcactcaccactctggggaaggaggactctggccctctgggaggtggcatccgggctggggtctccacagggtcttcagctcagctgaagcagccagtcactttgtgcttcctcatccccagggagcctgtcctcacacaaagggctgaacggggcctgctcagtccacgagtacactgggacctttgctggccagccagtgcgcttcaagatgacgtctgtctgtggtcacgtgatgaccctggatttcctgggtaagcccctctaccctccatcctactgaagggagttctgc

SEQ ID NO: 102889 - DNA, 1847 bp, Homo sapiens
ctgggtgccagaaatatggcaatgaacctgacaattgtgggagagacagactgctgacgccagatgcagtcttcaggaggggaggggcaggggtcagagcaagtagactaagggggaaaagtggcctaggccgaagcctgctggcgcacagggaggaaaggtgggtgcgcagcagagccttgggagatgcagctggagctgtcatgggccagagagctcatctgcagacagtgtcgtcattccacaaggcctcggctctttcactgtgggatggttgtacatttaaggggaacatccacttacttattttgaggaaaaaagcaaattgtcattttatttgggacagctttctggtcaagattactgatttcactgtagtcctgtgatctcttaagtggggaacaaggttgacagcccaaggccgaccttggacctcttcccctgcacagcatgatgagcagcagaagcccctttagtgagggagttcctttggcatcctttctgaacaatgccctttacaaccctcctttatttttctggttttattgtaaagtcccttgtcttagttcttgtccctcagtcacctgtgtccaggcgctaaatgtaaaaggtgcaaaagggaatgtggtgaggaggcacccccagccctgacctccaggccctaacacccactccaggtgattgcttggactgtttgttttgcgttccatccagacatatcgcctcttcataatcaagtgcacacgtgtgcacacatatgtgtgatcacagatggcagtgctctctacacaccgttacatgcccagctttcttagcatgatttatttcagtgatctgatccacgttagtatgtaccaagcagatgctttcctttgtaatgctgccaggtgctctactgtagagaatgccatgctttttttttttttttttttttttggagatggagtctcactctgtcgcccaggctggagtgcagtggcgcaatctcggctcactgcaagctccgcttcccgggttcacaccattctccgcttcccgggttcacaccattctcctgcctcagcctcccgagtagctgggactacaggcgcctgccaccatgcccagctaatttttagtatttttagtagagacggggtttcaccacgttagtcaggatggtcttgatctcctgacctcgtgatctgcccaccttggcctcccaaagtgctgggattacaggcgtgagccaccgcgcccggccagagaatgccatgcttttatttaaccacctccctgttgacagacaccagcttgtttctaaccttttatcatgattgataatgctgcagagaactccccagtgatgtggttcatcacaggcaccaccgtgcccagcctgaggccactccagcgctgccctgtcctacctcctggggactcagagtccacatggacagtcttgtcagggcccaccactgactcctgtgagtctccccaggtgacttcactctctacctgtctcacagcccttgccctccctgggtcagcatgccaccacccaggcccctctgtaattcctgtttgagcctcccaccctctgggagttgcttctttgactcccacttcctgctcttgtgcctcacttcctggaccccacagagcacaccctctgtggaccctccccaaccctcacctccctcttcacccaactcagagtcaggttctgtccttgtaatctctcccctcgaaccctgacccactccctctccctcctactcacctggactctcccatctaactaaatccagtgcttcctctgctgtgggcctgcccgcagcatcaccacctgtcctccctcagtggac

SEQ ID NO: 102890 - DNA, 1029 bp, Homo sapiens
agatgtggcttcaaaagatatttttagggggttacttttagccatctcactggacaagagcttcatagtttccattaactttggactgtgctccaagtatcctccaaagaatctcacttactgccctgtgagtgacatgggctgggatgctgtggtagagcacactctggctgatgtcttgtattttctggagacaaaagaggatgggggcacagtcctccatgggaaccctgaacaggtccttctttcttttcagatatggactttctggggaataatattgggtggcttttgttgttgttattgtttttgaactgtcttaaatgttctcccaaagatgctacagaacatagcctatccatttaccaagttaaaaggctgagtaggactgtgagagatgccctgctcatcatcattcttcttccacttccagtgactgctcttatattctttgccataagccaacaaccgctcatcccaagatctcataatccctctgtaaaactgatgctgtactacataccttgccagctgggacttgtaatcttactgtattttctaaggagtgaataatcttgtccaggtaactaacatatttaaagacattttcttctgtggacactgactccatgccacctgttttccaaagaagtggtgaagctgtttctgagaacacctaaaatcaatggttgtacattccaaaccaatctaaaagtgatttccttttgctgtgggtttggttctattactgatttggaaatatacctttgaacactgagatctctgaaactactagacttctagaagtgtaattgtataagaagtctgtttgcagctttaacaaaatgagaaactcttcccaaattaaagctttctttgaagttaaaaaaaaaagaataatgtgagattggaacctgtgaggtctgaggattcccaagagtactctcaattctgacgctaattgtaacctaagggctccccaacagcccttcacttcttatgattccctagaaaaactcacataactcc

SEQ ID NO: 102891 - DNA, 2682 bp, Homo sapiens
gaggttagttgagggagagcagtggttctttgttctagttgaaggataggcacacattcattctagtcttggggccaggtcaaaaggaacactgcttcagagtatctttacctacctgaaaacatccaaggaagccaaaccattcaaagtaaaatggttttgtttggtgaagggcccctgcagacatcaaacagccgtcatgtatcattggtttgaggtgaaatagcaataaaattaatagaatggtgcctggtactagctgacttcctgttctgtgatctaaaggtgaatttgattcattccctctcctctcccttctggctagccgttagtggagaatgaactggccatattctcagccacagctgtaaagcaagtttcccaaggggaagaagccctaatatctataatttgaactgtactggacccatagttttaactgaaaagggccaaacaagtggtgtctgtccagttcctggactgggctaaatttagttttcccactgttaagctggaatgaggactgtcccaacaacagtaggtacagtggacaaaaatagcccagggtgactgactgaatttaaacccataatggctttatatttttctgtgcatatatatcttaccctaattgaacatgtgaagcttgcaactttatgtcttgctttggacatgaatgtattacagcttgcagctattctgttaaatgtatagtttcccagttttttgacactaatgctgtttgggtcttacctgacacacaccagtgtgcaagaaatgtctctctaattcaataagttttaagacttagagttaatgtccttcatctgatctatcctatctaatctgtactatgggtgaatctttttcccttgctctccccaggggctgtttcacagtattctggagtaccttttgagtattggttcctgaacatcagcagtcttggctgcctctgtggactcccggagttgtctccctgcttgtgttctggtgccatcctttgttcctccacccctgaccaaggtgcccagcagcctgtcttcaccagtcaaggaatccgccatcttggctgtagacataggtctggagaaatctctccctttttccttgatttctttttaaaggtaccttatctctccccactcctttcttccctcctcaatctagttaaatttcctaagctttcacaaaaatccgggaagagataattaagagcttagcatccctcttagagtagaaggcagtacagataacaaagaagttgtgagtatattatctacattttagaaaattttctgactctagatccatagattctgttgtatttatttgccggacactcatttgattgatttgcaccttgaacactatactaggtcttttcagttacgttgcttgggttaagacactttgctaaaattacagcctgaatcctttctttagttgaagaaagggtatgtgtgtgcaagtgggtgtgtgtgtgccagtttttcttgtctcaggtagatactcccactgtgtataaatagatctacagacttttcatacttacctcccgtattctgtttctgtggtaaaaatatgaagtgttttagttgtatgttgagtgattggttggtattatcaacactgttgtttgcagtttcattaaagcatgctcttaaggagtacatatggtcattaattgccaactgtagattccagtgatctggcccctgcctacctccttcctctctttttcattctctgtcatgcttctccactgttttccccaatgacgcactattttgacacactggccttgctattccttaagcaaatcacattcttcccaatccaaagactttgcacatgctgttgtctttcttagaatgcccttcccctaggcctgcatggcttgctacctcacttaattgtttgacacttcctttggttcattgagcttcaaggctcttaaaatgccactgacaatgagatctccctttaaaaaaaaaaaaaaacttctacttttcctcttaaaggcactttactctctccccactcttttcttcctcttcaaagtatttaaatttcctaggttttcatgaaaaagctggaaagcgatcagcatcaagggctttgcttctgtcttagaattgagctagcttgagtcaatttctgtgcctgcaaccaaatgaaaattaatatagtgagttctttcaggagctttctctgtttttctattgatacctctatatatttttaaggcaatgtcactttgttttgtttacaaatatattgaatatgtcaagattactattttgttattgccctttgtgaatttccttgtctattttgctcgcttgttctttcaggtgaaatttattattttattaatgttgccaaaaattataagtaaaatatcaattatagtaataaaatgttttgtgaaaaaaatgctgttgctgtattgttgctgtattgtctttccaccataagtaaaatgggacgtttgttttgttttttgagacagagtctcgctctgtgacccaggctggagtatagtggcgcgatcccaggtcactgcaatgtccaccccctgagttcaagtgattcttcctagcagctggtactatgggcgtgtgccaccatgcccagctaatttttgtacttttcgtagagacgaggtttcatcgtgtt

SEQ ID NO: 102892 - DNA, 2533 bp, Homo sapiens
gtaaaaaacttgctaaagaggaagcatctggtgtgtggcagactaaggattccagcttactcttcaactccaaagcccatgtttctaaacactgcacaatgatgccctcataaaaatgtgtgtcttttccatataattttgcctagtgattagctgctggtaggttttttttttaaaatggaatagagcacaatcagtacagcaaagttatgattctagattcataggaacctgatcttttatcacaggttttaagctgttatttatcctctttcagtctcagtgtccttgtgggtaaaatagtggtttataaaaacaatgttttggaggaaaattaaataaggtaatgcattttcctgtacttactgatgtatgtttgtacttaggtggcagtttatataaaggaagcattgggacttgtggccccaccattcaggaataaaaaaattagaaaatggaacaatcatgtgaggaagagaaagagcctgaaccacagaagaacatacaagaaaccaaacaagtagatgacgaagatgctgagctcatctttgttggtgtggaacatgtaaatgaagatgctgagctaatctttgttggggtgacttcaaattcaaaaccagtcgtttcaaacattttgaacagagtcaccccgggttcatggtcaaggagaaaaaagtatgatcaccttagaaaagatactgctcgcaaattgcagcctaaaagtcatgagaccgttacatcagaagcagtgaccgtcctgccagcttcccaacttgaatcgagatcaacagatagtcctattattattgagcctttgtctaaacctgattatagaaatagttcaccacaagttgtgcctaataactcttcagaattaccttctcctttgattacattcacagattcattgcatcatccagtaagtacagcactttcagtaggaggtataaatgaaagtcctcgtgtatcaaagcaactttccactttcgaagtaaacagcataaatcccaaaagggctaaactcagggatggaattatagaaggaaattcttcagcttcgttcccttcagatacctttcatacaatgaatactcagcaaagtacaccctcaaataatgttcatacctcattaagccatgttcagaatggagcaccttttccagcagcttttccaaaggacaatatccatttcaagcctataaatacaaatcttgatagggaaaatgaattggcaaaaacagacattttgagtctaacaagtcaaaacaagacctttgatcccaagaaagaaaatcccattgtgttacttagtgacttttactatggacagcataaaggagaagggcagccggaacagaagactcacaccacctttaaatgcctcagctgcgtgaaagttctaaaaaatgttaagtttatgaatcacgtgaagcatcatttggaatttgagaagcagaggaacgacagctgggaaaaccacaccacctgccagcactgccaccggcagtttcccactcccttccagctacagtgtcacatcgaaaatgtccacactgcccaggagccctctactgtctgtaaaatctgtgaattgtcatttgaaacagatcaggtcctcttacaacacatgaaggaccatcataagcctggcgaaatgccctatgtgtgccaggtttgccattatagatcgtcggtctttgctgatgtagaaacacattttagaacgtgccatgaaaacacaaagaatttgctttgtcccttttgtctcaaaattttcaaaacagcaacaccatacatgtgtcattataggggccactggggaaagagtgcacaccagtgttccaagtgccggctacagtttttaactttcaaggagaaaatggagcacaagacccagtgtcatcaaatgtttaagaagcctaagcaactagaaggattacctcctgaaacaaaagttactattcaagtgtcactggaacctcttcagccaggatcagtggatgtagcatccataactgtgagcacatctgactctgaaccatcactccccaggtctaaaagcaaaatttcaaaaaagtcccattaattctagtttcagtaaatctaaagcaagtatttcaaaccaaattaaaaaacctcataaaacaaaaaatacaaaccatacattattcagtagcaccaaaaatagtgaaactagtggattatatatgactttttaaacaagattcaggatatatattatttgatctgaattttgaggtattattttaaaacatctggttttcatgttaactgtatctggcttaacacataaaaggtgtttgtgtgtgtgtgtgtgagagagaaaggtattaatttatttttttaattttaattttttttttttttactttagagacagggtctcactgttacccaggctggagtgcagtggcgtgatcctagctcactgcaaccttgaacttccaggctcaagcattcctccgcctcagcctttggagagtagctaggactacaggcgcagccaccacac

SEQ ID NO: 102893 - DNA, 1079 bp, Homo sapiens
ccagtggatggacatctgggctgtctgggttattcattcacaaacacaggccagtgagcccctgcatgtccccgtgcatacatcatgcctcccaaggacacacactcaccctgtaactagagggacacacgtctatatttgggtttactatgaactgagttctccccagagcagccagactaatgcacagcccagcagggccaccatctcatgccccacaaccacaccctgccttggaactgtggacgattgggatgttcctatccccagagagcacagacatctggcaccaaatgagaaccaggtaaagcccaagggcgaggcccagcccgccgggcgtcactcgaaggtcaccagaccctgccaccctgatgcccattctgctcctgcctcgttgaccttggcctccctgagcctcagtttccccatggttttattcagaggttgcagtcctggtccctactcttttgagtctgcacagactggggcccttcccagcactgctagcatgggggcagagacccttggtggccgaggagggtgaagtgggccaccggagccgggatgggattgcaggacaagagggggccaccgggttgggtagtgcgacccccggaaagcacagggagctgtgcccctccacaggattcccgccctcagagcccctcccctctgtgccccagagcagaagctgagcctgggctgtgtccatggtagaggaaatgctccctccattgggaacagcgtggccggcttctgggcttggggaaggagagggagaattctgggcgggcgatagaggggcccaggttccctctggtcatgaccttgaagttgcccaggtgaccaggaaggaggagggtgctcctctctgtcaagaagatctgagcttctcttccctagaatcagctactcttctatccccctaaaaatgtacaggaattttgcacgttgaatgaatggatagtttactaaccagtttgggaagaattgacacctttcaatccatgaatatcctctgtctttcccattagtatactttaataattctcaagaaagttgtacaattttccccataa

SEQ ID NO: 102894 - DNA, 1019 bp, Homo sapiens
gacctttgcctattccctctgttctagatgtaggcaaggagaccaagagctgcacctggatgatctgggacatgttctgtggactggagtcaggagggccccaaagtggccccagcaaaggcaacagaggaggtagagcatggtgacacgttgcaaagtgcaaaggcgctggccctgggagaggcaactgagaaagtagaggttgctgagaagacggaaggtacagagtggggcaacatgtcagacaatccctactggaggagagttgtgggcatcagtgggatcatcctgatcatgctcaaggtccttggcgtcatctactttgcctgaagcagctgggctggggccgtccaggaggaggcagagctgctgcttctccaggatcatcatgaacagggacaaagcgtttcctactgggagacccatgggcctgggaccaaggattacattaataaaaatgttcccttggtgtcatgcatcaagggctaccagcagcagcacacacatgccgtgtggcaggacagagcaaagtccattcgccattacagaaagtatgcaaatgagaacatctgttcctttacaaaatgagtcattttctccaaatggctgcactgcataaacactttcactttaaatttaattttggcttttcatctctatatatatttggaatttttgcttgtgtttacttcactgtcaccaattctttcatgtacccaacttccattgcttggttctctccttattttccaaggtatgtccctgctggccaagatgccgagttgtggaagccccaccccacccctgcaagggaatctcacctgtaggtgctctccagcactgatgaccacacaggccatggggaaacaggtgccagggatggaagctttggcccctgcctgaacctcagtgggactgaggcaggctctgctttaatagaacaggcctccccaccactcaactctgtttagcttctgctgtgctgcatcccttgagggcagattaagaagaaactccct

SEQ ID NO: 102895 - DNA, 1040 bp, Homo sapiens
aggcccaggttgatgcagcgagaacagggcctgccctcgtggggtgtgcagtctgtgctgagcagggtgagctgctgtgctctgtgcctgtcgcctggactgttgcagggacctggcatgtgactgtgggtttgggacacagggaatggattcttccctctgtccccagcctctcagtccttttgttttctagaatctcaggaggaacctcagagacctggaggccccaccagagtggccagaacctggtgcaggagtatgggtggggtctcagtctggccctcaggagcttctagaacaattccaggaatttgcaggtaactggattgacttcacaagggctgcccagggcccccgcagagaggccagtgggacaggaatgctgaatatagcaattcaggaatgctgaatttagtcatcttgtgtgtgaacacatgtgtgcggcttcctcccctggaggcaaggaaggcagccctgtgctgtctgtcccacgctagcctcagaatacttaagacggtgtgtggtggcaaaggcactctcactgctgctgaccatggcaggtgcacgggcacactggaggaggcaggtcagcatgctgctctcccgaaccctccagcaaggaaacctggggtagccaagcctctgagcacctgtgagcactgtgcttggctggaaggagcacaaagcgaaatgaacagaggcgtcagtgcagatgccaagggtcagccccaggcagaatcccagagcagaggctatgctgcggcctgggcagaatgaagagggacgtgggagcacccagactgttgtggctccggggtggtgaggtgagcattccagtctaggtggcagaagacctggagtcaggtcctggtcccaccatcctaggtccagcccctttttctctgaacctcattatcctcatccatacccaaagccaagagtgccctgccctgtccccacaccagcccctgccacacattttggccctttcgtgcgaacaccgccaggggaggcgcttcacaggattgaaccaacaggga

SEQ ID NO: 102896 - DNA, 1028 bp, Homo sapiens
ccctgtggcaagagggagaggtgccccatcccgtgctccttgtctgggcccgctgctgccagaccatgggatgtcggcaaagctcagaggaaaaagaagcagcccggcggtcccggagaattgaccgccacctgcgctcagagagccagcggcaacgccgcgaaatcaagctgctcctgctgggcaccagcaactcaggcaagagcaccatcgtcaaacagatgaagatcatccacagcggcggcttcaacctggaggcctgcaaggagtacaagcccctcatcatctacaatgccatcgactcgctgacccgcatcatccgggccctggccgccctcaggatcgacttccacaaccccgaccgcgcctacgacgctgtgcagctctttgcgctgacgggccccgctgagagcaagggcgagatcacacccgagctgctgggtgtcatgcgacggctctgggccgacccaggggcacaggcctgcttcagccgctccagcgagtaccacctggaggacaacgcggcctactacctgaacgacctggagcgcatcgccgcagctgactatatccccactgtcgaggacatcctgcgctcccgggacatgaccacgggcattgtggagaacaagttcaccttcaaggagctcaccttcaagatggtggacgtgggggggcagaggtcagagcgcaaaaagtggatccactgcttcgagggcgtcacagccatcatcttctgtgtggagctcagcggctacgacctgaaactctacgaggataaccagacagtaagtggggccgggggttttcctctgcttgttcctgctgtcgtgggttcctggaagcaagaggactcgtgaggtccaggacagtctgcagccagaaagggaaccaggcgcaggcctggccctgctgcacgataactgaggcagctccagcaaggtgggggcagagggaacagggtgtggagtgcaggtgtcatgtcccatgcctgaagtactcagggtgtggaggccacagggcaagag

SEQ ID NO: 102897 - DNA, 1052 bp, Homo sapiens
ctccacctgctctcacactgagcctctgccggggagtggcctcactgtctgcctggtttttgtctgtctgcccctttgtctcccagtcccattacctgtcatgcatcctaagctcctgaggacagagaaggtggagagtagcagagccagagaggctctcctgtgacgtggctggctctgtaccgagcagggggtgcggccacaaatctccaagcccaggccaggggagagaggcaagcgcactggactcggttccgcctagtggcaaagaggcccagaaaagtctcaagtgcttgggacagggccccatctgcatgtgatgtgttggggcctctggaaacggagatgccaaggcagtcttctctgaggtcagtggtgatgccagagaggtgaggctcaggccattgccagctgcaccagagacaccaaagcactccagggtcccccaaggtcactttagtagaacccagtgaccatcttggacaaacagcttattttactgaggcaggagctgcggcccagagcagaagtgacatgcccagggtctcactgcagtttggtgggagaattaggtttcagaacacaagacagccagtacctcccaggccccttcctcagggagccagcagggtcgtgggcaagcggccaggctccacagggcaagcccctttggacttaaccctgtttgtgacagccctggtccctgacagtcctcagatcccggtggcagtgggcagtgggctgtctgaaaccaaggtgctccttatttccaaaccagaggtgtctgatcacagagtgtgtcactaggagcatgttctgagaagccagggagcctggtgcccaggttcccatccttagaccagtcctctgtcccttgcagccttagtctcatccacagcaagactggagccttgggggtaaccaggaaaggacaggcactgcccctggcattcatgcagggaccaggagggccagaacacaggcaccctcagcctcctgtcttcaccccgcagcccaaaggagggctgcctgacctccgggcctcacttctc

SEQ ID NO: 102898 - DNA, 1099 bp, Homo sapiens
ctgcacccgaacaaactccatcccctcctccttcctgaatgcatactgttagtgtttggaatggaattgggttgaggatggtcttgtgagggatgggaggtggtttgttcctttggttctagagcaatgtgtttgtgaagtacagcttgtgagttgaaggaagatgcttcaggcagtaacctccttgctatgtgctctctccatgccgggcagtgaggatggcataaaagccggagtcatctctagcgcccacatcggatgctgttagcagggactgatttatgtcttgggcattccccgccaccccactgatcctgttctggaggggttatatgacacgtttgtgaaacctgagatatgctagctgctcctaggccatagaagtgtcaggtttgcttgctaaccagcagtcctgaacacaagtcacagcaggtgagaataggaattagaaggaagtgaggcgacaggcagttgtgactcagtgggccaccgaaaatcaactgcatggagattttatctgggggtgaagcagagccacacccgttctgatctgcctggctttgatgggaggcttcacccatgattattcaccaccaggctcctccatggtggtaacccagccccatttgctgaccctccagtgtgctcctgctgcctcatcttgccaaggataagcacccacaggtgcttatttggggctcccaatctgtggtcagattctagcactaagattaaaactatgggattgtacgcctaacttctgtgctagatgcaaataccatcaggcattttgggtcatgggactatgttttgagatccagacacagtttgccattggggtaaggaaagggtgggctggggtgtgtgtgtgaggctgtcgggaatcttttggagtcctggtccctgttaagctcatctggttttctgcttcattgatttttctttttctgctgatggaggagttgaatgtgcttggtttgtcaaaatcctcttcaaacgagtgaggctatttttggctcttagagctgctgcctttttgtggtgggcactctgtcctgtttgtgttaggtacttccagttactgatcttccatttgcag

SEQ ID NO: 102899 - DNA, 1060 bp, Homo sapiens
taaggttctttcgttagcttctttaatttttttctttaaatttaaaatttattacctttttttttaatagataaagggtctcgctctgttgcccaggctggagtatagtggcatgatcatagctcactgtagccacaaactctcgggctcaagcgatcctctctcctcagcctcctgaatacctggtactacaggcgcgtgccaccatgcctggctaatttttaatttttgttgagacagggtcttgctttgttgcccaggctggtctcaaactcctggcctcaaacgatccttcccgcctcggcctcccgaagtgctgggaataattatagatgtgagttactgcacacagcctgaatgtattattaacacaactttttccatctcttttctgtttatcttggtttatgtctcccttattaaaaacgaaggcaaccacctctccctatccaatcgctcaaaggtatttattgagcatctactttgtgcctggcactatcttcatggaaatcctttcttccttattcattgatttatggaaaggctgatctccaagggccttgtctttaaaacaacaacaaacaaacaaaacctttctaatgtcaaagcattttcccctgcgtatctttctttaacggtatatttgcagctgtttcctgttaatcctttgtctatctggcttcctttttagggtgatgggatccttaagcacagagtatgccctgctgtagtgtcctgcaggatgggccacactctggccctttaacagtgtttgatgtgacgatgcacctgagcccatggaggtctgtgtctcgggccccgtgggtgtttgcagattgaagatggaatgatacacaccatctctgagatttttatttgctcagaccttcccctgttctggcccaaccccgcttaatcatgtctaataagtggtggtgggtttttgggggcctagtgatacaggtggcccggcgatgaaacgttggctttggagattatcccgctggttctgtttccttctttgctggtgattggtactccctggctcacccttagagaa

SEQ ID NO: 102900 - DNA, 1047 bp, Homo sapiens
gtgctccccgagtgtccaccgtcggcctgctctgttccggggcagggccacatctttgtccgtgtgccgaggaggggactggtgggctggagtcccagggggagattattccaagtaggggctccagaaaggtgagtgatgtgtttgggtctatgggaaggttggtgacccccaaagagaggtggctgggttactgctgaacagctatcagggtgatatggctttgcaggggtccagtccatgggcctgacatgttgtagctatgctttgaaggcattttcctggtgggaggccaccgcaggtaaggggagtgaaagggtggctgtggcggctgttccctgtggctggtggccatggataagtgaagaggaacgtgatgctgggcaccatgctggtggtgcctggggcagagcctggccttgtggggctgtggagcagggtgaggatctgggatctaggactgctatgcaccgggccgaatcgtgatacccaagggaggcatcttgtcgtggagcagttgcatgggcccgcccttgttccctggagcagctggtgaggtactgttagaatttggccctaacaggactgggcacagtaggtcacacctgtaatcccagcactttgggaggccgaggctggtgtatcacctgaggtcaggagttcaagaccaggctggccaacatggcgaaacccggtctctattacaaatacacaaaaattagctggacgtgggggtgcacacctgtgatcccagctactcaggaggctgaggctaaagaatcacttgaacctgggaggcagaggttgcagtaagccaagatcacaccattgcacgccagccaaggcgacaagaacgaaactccgtctcaaaaaaaaaaaaaagaatttggccctaacaaatgcaggttgtgattattaacataagtctggtttcctctctcatggcatttctttagtggccagatggtgtgagtggctccagaagactcttctcttctctgtgcaagagccaggaaggctctagaaaggaatgtctgaggaagcatc

SEQ ID NO: 102901 - DNA, 1050 bp, Homo sapiens
tgggctacttgtaactgaatctgaaaagcattttggcttctcttctgtgcatcgtgagttaggtctgccagatagcattgtccagttaattctggctcatggagttcctgcttggctttcattgaagctccaaggaagcagaaggccatggcagaaaaggatttctacaaagggaaagggacttgcatggctgcacttggctggcagaagctgggctgggacgggaggacaaacacctccctgtgcaggcagtgggttcagatggtcttggctggaaggagggcagataatggtgagaccacgtttggagggagggcagcatggtgtcatgggcttggggaggaaaggagaggaatggccccttcttcagcactgactagtcgtcctgcaccgtggagggtgttccgtcttattttccagcgctcacaactaggagccagcagttcagttttagccatcccagctcatggattatggagctgggacccacgcttgctcctcctcttgctctgcgttgcccatcttagctgtgcccttggccgccactctgactccagtgaatcacgtagactccttgggcctctgaattcctgtccgtaaatgatgaagctgaatggcagcatttttaagatccgttagttttgtgattctaaataaaattaagtcatgttgctctgagttcccagaaaattattttaagatccgttagttttgtgattctaaataaaattaagtcatgttgctctgagttcccagcaaattatttggaaatccctcttggtggatgtcccaaagcagccttcctgtaggatcctggttgtgtctggcttcctgcagtaatgtggattggggtggattggcctctgtgtgcacccttaatgggaaccaggacactgctttgctggctgatttgttgtcctcccttactgcccactggccagtctacaggtcaccaccaggactggaacagatttcagaggccgtgcaggtttcatctggggcaacgtgccaaagtgcagagcgtgggcagcgggaggccctgccgtccgc

SEQ ID NO: 102902 - DNA, 1022 bp, Homo sapiens
tatagagacacccattgctcaggaccccagggccttaacagggagtacactggcttctgggaagcttgatggagttgttgctgcataggtgcagaaaatcccagcagtggagtaaggcctgaagtaagcccccactgggctctgtggggcctggggcagcctcctctgttgcagggccgccagcatctccagcagaagtgcagtgcttgctctggggacacaggggccttttggaatgagcatgtggacttggcttatggattgtgcctaccccagagcgttgctgtgtctctcaacacacacagcttccatgggctgctcactccaattctgatggagagggcatttatgactctgtccgttggtttgttttctcactgaagaggaacatagatgcacctgctctctgggcaagagatgtggcagctgcaagctgcacaccctgttctgaatattgcccagaccagaatatgaattacttggtcataaatcagtgtcttgtctgcagaaaacttggcaatgtgagggacggcagctttaacttgattcctgggaggctgccggcctcaaaaaggacaaggactggcaatcagatgggcattctctctaatttgggaggctttcgggcttcctcacggagtgctgctcctggggacgtaccacaagaacctcccttgtctagttttgttctgacgcttgggctcattcacctgactgtctccttgcttgtctggctctcaggaaagccttcccggagaggatgtggctgacccctgcagccatctctccacagacaatcatggccctgagcttggctgtccttggttgggtacatccaaggctctgcctgccagggtaggcactggccaggctgtgggatggcagcgttgctgacttgtgctcctgagtcctgggggccctgagtgagcctccgtgcaggagtcgggctgggctgagaggtgtggagagtcgttcccttaatggatggtcaggcacagcagctatgggctcaaattccggag

SEQ ID NO: 102903 - DNA, 1041 bp, Homo sapiens
cacacataggctgagacatttttctgcgaggtgggggatcgcattgagggaagaaaaggtgctctaatagcttcagcctggacttgggtccagagctttggatagaagcatctttccagacaattgggatcctgtagaaaatctgccctctgaggctcttctatgccttctgttgtgtcctgggaccccttggcatctccaggcagagcctatacagagcatccacatcagagtcccctgtgggccccagtgcctgtagttccatctcctgcctggatgctcggttcttggagcgagcttcctgagcagcctctgcaggctccaggctctggcagcatctccacgccactcctgccggcctttctcctggtggaagcagcctgcgttgcttctctgcccggtggtgacaggctgttctcgtttggaaacagaagagacaccactgcttccccacaccgacttcctaaaacatgaggctcccttctgtggtgtatgtgtaaaatgcctggctctgtatatgcacgtggtgcacgcctggccctggggtcttcacattcttcagaagaggccaggcatggaggctcgtgcctgtaatcccagcactttgagaggctgaggcaaatgaatcatttgaggtcaagagttcgagaccagcctggctaacatggtgaaaccccgtctttgctaaaaatataaaaattagccaggtgtgggggcttacactcttgtagtcccagctattcaggaggctgaggcacaagaatcgcttgaacccaggagtcgggggttgttgtgagctgagatcacaccactgcacgccagcctgggtgacagagcgagaccctgtctcaaaaaaaaaaaaaagaaaaaaaagaaaaaaaaaaagaagaacatggtgacttcacctgcccagggaggcgtgccagccaggggcccatggagaatcagatattcagccagggacaagggcatgtcagtgggcagagtgccagggtgtgggaggctctctgggtggtcgctgaccaaaaacatcacttctgg

SEQ ID NO: 102904 - DNA, 1017 bp, Homo sapiens
tgaggcctgccagtccatggacggctgcggcgtagggtggcaggcacaatctccaggggcagatgaaggtaatcacggagatactggatatcctcattggtaaggtaccagcagacatgactccaggcaaactgttccttcatgtagtagcctcgggacttgaaagactgcatggccttcatgacatgaaggttgggcacattcttcctttttttttttttttttttgagacgagtctcactctgtcgcccaggctggagtgcagggccatgatctcgtctcactgcaacctccgccccctgggttcaagcgattctcctgcctcagcctcctgactagctggggttacagggaacagtgttttcttttgtcaaaagagcctcttaagccattgataatatttcccaagcttgtaacagatacaagcctttaaagaatgacatttgcagtcacccagtaggacatatcttgagatgaaatcagagttgtgggctttgcagacaacagcagtcatttctggtggcttccgggagtggagggggactgcagctttggcaatgtaggtgataccaaaaggactatagtaattttttcttagtaattaaaaactaggctgggcgcggtggctcatgcctgtaatcctggcactttgggaggccagggtgggtggatcacctgaagtcaggagtttgagaccagcctgaccgacatggtaaaatcctgtctctactaaaaatacaaaaattagctgggcatattggcgcgtgcctgtaatcccagctactgaggtgggtgaggcaggagaattgcttgaacccgggaggcagaggttgcagtgagccaagatcgtgccactgtactccatcctgggtgacagagcaagactccatctcaaaaaaacaaaacaaaaaccagacataacaaggtcgagctcagtggctcccgcctgtaatctcagtagtttgggaggccgagaagggcagatcacctgaggtcaggagttcaataacaacatgg

SEQ ID NO: 102905 - DNA, 1055 bp, Homo sapiens
atgaccattacccagagctggcaggtgagtgtcagggtacagcccagggggagggcacaccttctccctaacccctaccaacaggacttcctgggccttccagaggaactgcgcaggctgtcaggcctctcctctgtgggccacaactggaggaagcgtatgggcactcggcgaggccgccatgagcaaagccccacttcaaggcccagaaaggtgagctccctgccacccaggagttgctagctggggcagggagccaggtacagagcagatttggacatccacagagacacccagagtgggatcccttcctgcaggacagacacatatgatgaggggcagaccctcaacaccaactccacgcacatatacccccagatggaacacactgtaccctgagacaggtccccaccaccccacgggagtgccagcgcactaagggccggaatgtcctcaggcttcacagatgtggcataggggctggcacacagtaggagctcagtgcacaactgctggatgaactcaatgaaggcggcagcatggtgtgtgatggcacggcccacactgggtttgaagggcttgttcttccattctggcaggcttggggacctggcacactactgccaactagccaagttggactcagacccaagggggttagccatgacctctgccttgtgtgatcaggtgcaaacagacaacaacccagcaggactcctcttgcagaatctggaattgctgagaagttgcatcagcaagaggggcaaggtcagacaggatttgaggccgccaggggcacctaagctgtgggtgcagagaatgggatgcagaggtagagacaagaagggtagaggtggcaggtatccctgataagggggagaccatgggttcatcctgggattccaccctcagagtcagatgcccttgggatcaccgactaatgcctctccacctcactctggactgcccaaggaatctgtcctgtgctacccacagtgcagattgcaacagggctcctcctccccacccagggccctgattaaggggatggattg

SEQ ID NO: 102906 - DNA, 2006 bp, Homo sapiens
tggatcatgagttcaggagttcgataccagcctggccaacatagtgaaaccccctctctactaaaaatacaaaaaatttgttgggcatggtggcgggcgcctgtagccccagctacttgggaggccaaggcaggacaaccacttgaacccgggaggcggaggttgcagtgagccgagactgcgccgctgcactccactctaggtgacagagtgagactctgtctcaaaaaaaaaaaaaaaaaaaggcagcagaaacatgctgtctgtagccgcctctgctgctggatcactcagcctgcctaggacccttgggacacccaggctggggatgtggggaggggcaggtggccccaggtttgaaacgcacctccaggtgccaactccaagctgatcctgcagcctcttgcactgtacccccaggcccccacccccgctgccccccagcccctgcagatggggccctgcgcctacgagatcaggcagttcctggactgttccaccactcagagtgacctgtccctgtgtgagggcttcagcgaggccctgaagcagtgcaagtactaccatggtgagtgagtggaccccgactcaggcggggagggggagaggccaaccctcctcttgcacctgcaggctgaccaccagcctgtgctgcccctcccttcccaggtctgagctccctgccctgaagaggtcggtgcagactcgggggccagtcctgcacccacctctacccctcgccgacagccagaccacaacaccagattgtacccagatagctgggattggaagtgaggaggtttctcaccccacagataacccaagacacaaatgtgcaattaaaagtttattttagaccacagcctgttgtgtgcctctctcgatggcctgtcttcagggagctccctggctgatgaggtggggtcaggatggatgtctcactacagtgtgcaatccatccccttaatcagggccctgggtggggaggaggagccctgttgcaatctgcactgtgggtagcacaggacagattccttgggcagtccagagtgaggtggagaggcattagtcggtgatcccaagggcatctgactctgagggtggaatcccaggatgaacccatggtctcccccttatcagggatacctgccacctctacccttcttgtctctacctctgcatcccattctctgcacccacagcttaggtgcccctggcggcctcaaatcctgtctgaccttgcccctcttgctgatgcaacttctcagcaattccagattctgcaagaggagtcctgctgggttgttgtctgtttgcacctgatcacacaaggcagaggtcatggctaacccccttgggtctgagtccaacttggctagttggcagtagtgtgccaggtccccaagcctgccagaatggaagaacaagcccttcaaacccagtgtgggccgtgccatcacacaccatgctgccgccttcattgagttcatccagcagttgtgcactgagctcctactgtgtgccagcccctatgccacatctgtgaagcctgaggacattccggcccttagtgcgctggcactcccgtggggtggtggggacctgtctcagggtacagtgtgttccatctgggggtatatgtgcgtggagttggtgttgagggtctgcccctcatcatatgtgtctgtcctgcaggaagggatcccactctgggtgtctctgtggatgtccaaatctgctctgtacctggctccctgccccagctagcaactcctgggtggcagggagctcacctttctgggccttgaagtggggctttgctcatggcggcctcgccgagtgcccatacgcttcctccagttgtggcccacagaggagaggcctgacagcctgcgcagttcctctggaaggcccaggaagtcctgttggtaggggttagggagaaggtgtgccctccccctgggctgtaccctgacactcacctgccagctctgggtaatggtcat

SEQ ID NO: 102907 - DNA, 1643 bp, Homo sapiens
tccatcctgaccccacctcatcagccagggagctccctgaagacaggccatcgagagaggcacacaacaggctgtggtctaaaataaacttttaattgcacatttgtgtcttgggttatctgtggggtgagaaacctcctcacttccaatcccagctatctgggtacaatctggtgttgtggtctggctgtcggcgaggggtagaggtgggtgcaggactggcccccgagtctgcaccgacctcttcagggcagggagctcagacctgggaagggaggggcagcacaggctggtggtcagcctgcaggtgcaagaggagggttggcctctccccctccccgcctgagtcggggtccactcactcaccatggtagtacttgcactgcttcagggcctcgctgaagccctcacacagggacaggtcactctgagtggtggaacagtccaggaactgcctgatctcgtaggcgcagggccccatctgcaggggctggggggcagcgggggtgggggcctgggggtacagtgcaagaggctgcaggatcagcttggagttggcacctggaggtgcgtttcaaacctggggccacctgcccctccccacatccccagcctgggtgtcccaagggtcctaggcaggctgagtgatccagcagcagaggcggctacagacagcatgtttctgctgcctttttttttttttttttttgagacagagtctcactctgtcacctagagtggagtgcagcggcgcagtctcggctcactgcaacctccgcctcccgggttcaagtggttgtcctgccttggcctcccaagtagctggggctacaggcgcccgccaccatgcccaacaaattttttgtatttttagtagagagggggtttcactatgttggccaggctggtatcgaactcctgaactcatgatccacccgccttggcctcccaaagtgctgggattacaggcatgagccactgcgcctggcctctgctgccttctaatgggcactttgggcgggtgcaggagagggaggagaaggctctaggaaagcccagtactctgcctgtactctcagagtatgagccccacccccacaagttctagcaccttcctggctcagctacactaatcctcatgacccctgacctagccacaaagccacatttggcttacggcggtggggttcctagcaggggaaaggtcatcagggaagtggctccccttcgcccttgcgcccagcggccacagtgcccagacctgggtgtggggagaacaggggctcaggaaatccaacatccctcccctctgctagggtgaggtgaccttgggcgagtctctgagccctcagggcctgggtttcccatctttaaagggctggttggtgtctctccctgggagcttagggaccctggcctcaagggagaggccgggaagcctgcctctaagtgacagtgaactcaagaccagtggactaggacccttcccgggcagagtcctgggctgaagcaatggtgaatacacgcggacactcctcactggacacttgggcagctccctgtgtggcctcgagataatcctgcctcagtttctcttggactcgctgctcacctgctggacagcaggctgggagggctccgag

SEQ ID NO: 102908 - DNA, 1050 bp, Homo sapiens
cctaagggcgtccgcagagtgaccttggctgctgctgcgccatcttggcggggggaggggtgggggtgcagcacccacgtgtggagacgtgggtcgtccatctctccgggggtcgtttccaggagctgcagccctccagcctggggtctggccaggattaaccctgcttcctcccacccccgcagccgcccagccgcgccctctgcccacccgcccgcgcacccaccgccctcggcagccgccccagcccccgccccttcgggccagccggggctcatggctcagatggcgaccacggccgcaggggtagccgtgggctcggctgtgggacacgtcatgggcagcgccctgaccggagccttcagcggggggagctcggagccctcccagcctgctgtccagcaggtgagcagcgagtccaagagaaactgaggcaggattatctcgaggccacacagggagctgcccaagtgtccagtgaggagtgtccgcgtgtattcaccattgcttcagcccaggactctgcccgggaagggtcctagtccactggtcttgagttcactgtcacttagaggcaggcttcccggcctctcccttgaggccagggtccctaagctcccagggagagacaccaaccagccctttaaagatgggaaacccaggccctgagggctcagagactcgcccaaggtcacctcaccctagcagaggggagggatgttggatttcctgagcccctgttctccccacacccaggtctgggcactgtggccgctgggcgcaagggcgaaggggagccacttccctgatgacctttcccctgctaggaaccccaccgccgtaagccaaatgtggctttgtggctaggtcaggggtcatgaggattagtgtagctgagccaggaaggtgctagaacttgtgggggtggggctcatactctgagagtacaggcagagtactgggctttcctagagccttctcctccctctcctgcacccgcccaaagtgcccattagaaggcagcagaggccaggcgcagtggctcatgcc

SEQ ID NO: 102909 - DNA, 1210 bp, Homo sapiens
gtaggggcctgggagcaggacactaggatgccacctgtgtgtccgtgggtaagccagctgccctcacagctgctgcttgagacacaggccagggtagatcttcgtgtctaacagacctgtgtgtccactgaaccccagggaggtcatctatgggcaaaccccctgaaaccccaacttagacacatacacatatggagaccctccctcagcagaggggcagagcctccgtcatcatgcaaagagtcgcagcacatgcctgcggacgggtgttcagtcactcaggcagcctttacaagagacctgtgaggaccaggctctgggactccacggtgaatgaggcagacacagccccatcctctgtgtcagtctgaggtgggtgtcagccatgtcattgtccaactctaccatcacaacttgggcttcgagcaggtggagacagtggtaagcggggagaggcaatagtgggcatctcactgggtgacctgggaggaccctgggcaggtgatggggaagctgaggctcacacatcctgcgggtggggacccagcctgaagaatgggctggtgtcacacagcattggagctgagactggggtctttagaatttcctaggtgggggcctgggaaccaacaggggctcaaggaaccaaggtgtccccacagtaagtggcactgtcaggtctaggatgggggtctcgggacccctggtcctggttctttccactgaattcagacacttgtatttgcctaagtatgagcaaaccacatacacatgtgcccatgtggccagggagaccagtgcgctgaagctgaggcccagagtacacctggcctgtgtcctgagtgttcacacacccaccaagcatccaggggcaactcctggtgcctcagccatcgggggctgtcccttccctgaggcccaggcccctccatctccctccaggatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccaggtgaatgggcggcctgggacccctccgggaacagcctcgcctgccagcagccactgaccccgcccccacccatctgtaggtactggcatggggacgacctgccgtttgatgggcctgggggcat

SEQ ID NO: 102910 - DNA, 1016 bp, Homo sapiens
ccctgtctctactaaaaatacaaaaaattagctgggcgtggtggcgggtgcctgtagtcccagctacttgggaggctgaggcaggagactccagcctcaaaaaaaaaaaaaagagttgggattacaggcatgagccgctgagcccagccacagctgcaatttcattagattgaacggtgtgaaatcatcagtagtgggccactgttttactccctgcattattcaatcatgattgctttcagactttcattagtttcactagcttcgcgctgtaagagccaagaggcagagccacagggctgggctgcctggtttcactccccactgcagggctcggttaagcagagtgtaggctaagagaggaatggagaaggtggaaggtgtctctcccttccaacgctcatctgatgcaccagccaaaccaaataccacctgggcctttgaacattgccaagcctcatccgctgttgtcattttgcccacctccacagctgcagggacagccgtaggcccggaactgggatatctcttcctaggggcctgcctatctgctcagctgcactgcgttttaggggtggggaagctaaggcacgagattggggtcccaaagcatgcccagaccacccaggcttccagatactaggtcctcctccttcaggcctcacttcgttgcttttcccctgggctcagttccagtcctggctgtaagactgggaaagccactgcttgagtcaggacctcattggctatttttgtccgtgagaagtcctctacaccacgacttgggaggcagcctgggagaaagagaaattagtcgtggctcctttaaggggtccgcggaggcgcgcccggccttttgtttgagcggcggcgcgcgcgtcagcgtcaacgccagcgcctgcgcactgagggcggcctggtcgtcgtctgcggcggcggcggcggctgaggagcccggctgaggcgccagtacccggcccggtccgcatttcgccttccggcttcggtttccctcg

SEQ ID NO: 102911 - DNA, 1171 bp, Homo sapiens
gaagttccagctggaggacgacggcgagttctacatgatcggctccgaggtagcccggggcgcgttctcgccctccccgggctcggccccgcgggagccccggggcgggcccatgcgccgagagcgcgcgtctccattcatcggggcgggcgggcgcgcgcgcgcgcgctcggggctgtggggcgtggcctagtgggcgtgtcgggtgtggcccccgccccctcatcgacctgggatttccttacttatttcgccgaggtccgccgccttcagtgctgccaagattttggcgccgcgaggggccccagtggttccgcgctgggttggtttccagtcagacgcaaagaaacgggatattgagttagcccctgcgacgcttgggggactgcactgctgcctttgaccctttttagatgtcgtaaatttcacgtgcacccctccccgtattgctacttgtgggaacctcaaatggcaggctggaaaccctggacttagtgagggctcatccccattgtgtttgttgcctcttaggtgagcagtggaggtcttttgacctttgtttaccggtgaagaaacagattggaggaagatgtttgcttttgggtgaataagggccccatgcctaagctagatctttcagcagttctgaagcgattgacactttccatatctgtgaactgattctgaattattacaggggaaagagcctaaggatgtttaacccttaactagagtggctgcattttgttgcatcaactggatgactgacttcaggaaaactctactggcctttgaatgggtgtttgttccaagtctattaggttcttgttttttgttttttatagagacagggtctggctatgttgcgcaggcaggtctccaactcctgggctcaagcagtctgcccgtctgggtctcccaaagtgctaggattacaggcatgagccaccacacccggccatatattaggtttttacagattgtctcaaactagccttttttgctccaaaggcagtccccagctagtatatgttacctttttaaaaaaattatggatatacagttcagatgtacaaatgtcaagcagtagaatctcatgtaaggaagtaagtgccaatcctggagaattaaagctatcatgaaatgccaagagtttcttctccttatagca

SEQ ID NO: 102912 - DNA, 1020 bp, Homo sapiens
aagccgtcctcccacctcagtctcccaagtagctgggactacacgcacacaccaccacacccggctaatttttatatttttagtaaagatggggttttaccatattgtccaggctggtcttaaacttgtgagctcaagtgatctgcccgcctcggcctcccaaagtgctcgattataggcgtgagccactgtgcctggcctccactaatttttataaaacaaaaaatataggattcaataaaattttcacgttgtcacttaaattacaactgttcaaagatgccagtgctggggaggtagagccagtgcctgtccatctgccacagttcagaatggtcctcattggccagtaggcacctgcctaactgcagaatgcaaaaggtgtcaaatttcagcctgtgatactaggcgagttgtttacctgatctaatgggtgtaaaagtaatcagtttggctctaagtaggtgacacttcaaaagaaagctttcatttattagttggagcaaattgagaagctgtgcgtggccaagtgggaagaaccttgggaggcctggttccagccctgctctgccttgctgtcgtgtttctcatgtgtataatgtgatgcttagactagatggtctccaagatcttccccaaaacacattttagtttctagaaagctaattacagtcttgtctttcagccccttgactcctgggcctcccagtaagaataatcttcctgagacccaggctgtaagagactcagttggagaggcagtttgttcttttgggcctgacttaatcatcagaccttcggagtttagggaagagttcaaggtcagagctctattgaaattcagtagctccagtgatagtagtggatggacggtctcagcccactgccctgtggaaaacaggcactgtattcagagaggtgggccagccatagcaacatacccagtgcctccatgcgccatctgtggagctgtcttgggaaggcatctgcatttactaagagtgtgtgtcactgttctgc

SEQ ID NO: 102913 - DNA, 1921 bp, Homo sapiens
ccctgtggtgctgcgacccttataatgagccttcttgctttactcataggtgggaaactacctccgtatgttccgaggttctctgtacaagagatacccctcactctggaggcgactagccactgtggaagagaggaagaaaatagttgcatcgtcacatggtaaaaaaacaaaacctaacactaagggtgcgtcttcacgagggtttgtaaacctgtttcaaaaccactcgcttatgtcatgaagataaaacgttttcactccagagtgtcttcactgcagccttggccttagtcgggcagggagcatcccggggtgggccgccctgtgagcactccaggcaaggaagtggctccagggagccattggtggtccactgtcagttatttccagcagggccattgggtatgtgagcgggccggggccaggacactagcaggtgctgtgaagacatgttggtctcaaaacgttttaggaatgctgcgatgctctgccatctgtcgtgggtgtgtcgccataatcatcttccatgcagcccaagtggcgggtggtggtcccagctcccactcccctctggggctttcactgcttgcttcctggagcacatccatcccatagcacttcatcctggcagccagtgtgctagagcccatgtgcatgtccctgctcctggtggcctgcgtgtgcctggggcttgctaggtacactagtgaaactagtgggctttgggtcacggcagctctgtgcagggtgaaagggtgctcttcagacactctgggggctctgtgggagacactcccatggagacatttgggtgtggacacagcatgtccttgggcaggtggcaaaactgcttcccacgtggcaatggcgccttgtagagagctgccctgggcctgggtgtgtctgtgagcatgtgcgcgatgcttcgtagtctgccctgtttgtttgtgtctgtaggtgctgctgtggttttgtccactgcgggaaagtagtggttcttttaatgcaggagccggagcttctttttgatctgctgctatgacatttccactcacttgcttaaaacagtttcctttttgttccccctcctcccctagcagagcatcagtcgctaacacagtgagtccccagctttgcttccccctccgcaagtccctgggctaagtcttgggagataccttccccataagcgattgatttctccaggagaagccagactgggcccacagacaggtagctcttgacggagattccccggaagagctaggggtcgagctgcctagaatctgtcctgcttcccaggcagcacgtgtggaccggctcggggatagaaattcgtgtttggtgtgaagcagctctttccaactctctgggctcttgttttaaaagaaaagtattcttcatcttccattccatctccccaccttgcatcgtgttgtggattgtggtggtgtcagacctcttcccactggggtgttactctgggagctttcttttcccctgagtgaggaccaagagaatatgttctggagtcgagtgtccccgctggtcgtgctgtattgtagttgctggtgctgccctgagcacttccctctgccccgagccagtgctcctggggcagattagtccaaatcagtcccattggaggctctacccagcaggacttgtaagtaaagcactcagtccagattgcccttttggaagaggccagcattcagcagtagtaagtttgacaccttgcttttcccacctcccgcatgcgaggaccttgatgtgctgcatccacttggctggctgctgtgtgccaccgccaccagcagagtgacccagtgatgtttgtctgttacagatcacggatacacgactctagccaccagtgtgaccctgttaaaagcctcggaagtggaagagattctgg

SEQ ID NO: 102914 - DNA, 1039 bp, Homo sapiens
gagatggaatcttgttcttgtcgcccaggctggagtgcagtggcacgatcttggctcactgcaacctctgcctcccaggttcaagcgattctcctgcctcaacctcccaagtagctgggattacaggtgcctgccactatacctggctagtttttttttctttgagacagagtttcactcttgttgcccaggatggagtgcaatggcgtgatctcagctcactgcaacttctgcctactgggttcaagtgattctcctgcctcagcctcccagatagctgggattacaggcatgcgccaccacgcccagctaattttgtatttttggtagagacgagtctctccatgttggtcaggctggtctcgaaaccccacctcaggtgatccgcccgccttggcatcccagagtgctgggattacaggcgtgagccaccgcgcccggtcctgatttttgtattgaaacactttttaacagttccctctgtttttatacattttcttagccaggtttctaagtttcttctatatcattggaatttctaagaaacgtaagccaagtcctggattccggagaacagttacaaatgcttggaaagtgggactcgtggggcacagtggcttatgtttgtaatcccagcgctttgggaggccgaggcattgcttgaggccaggagtttaagaccagcctggggcaacacagcaagacctcatttcttaaaaaaacatgtaagtgggaccaatttgtcagaaaaatcagtggctcacataaactcacaaaagaaacaacaatagatttgaatgtataaaaacttagaacctggctgggcacggtggctcacacctgtaatcccagcagtttgggaggccgaggtgggcagatcacctgaggtcaggagttagagagcagcctcatccacatggagaaaccccatctctactaaaaatacaaaattagccaggtgtggtggcacatgcctgtaatcccagctactcgggagcctgaggcaggagaattgcttgaacccgggaggtggagattg

SEQ ID NO: 102915 - DNA, 1050 bp, Homo sapiens
ccatcccctttccctgatcagtgggccctggctctggacactgagtggagcagacagtcctcctgcccctataggttccacctcctgactggcactgtggcatcagcatggtccagcccgtgctgtcctgtcaaggaccacctccacagccagtggccccttcctccatctcagagacagagagacgctgggcacaaaagccctgttgaaagttcactttgaagggaagcccatggggtcatggcgacaacacttgttatggaaaggccctggcgcctccagcagctcccttgaggttcaggtgactggagcatccactgggtgccagcagtgctgctgggaggagcagggcacagacaggggccaaagctttctgaggattctccatctatagctggaaaagtcattcctctcactgcctcccctcctcgtagcgagaaccctctgcccacagtggagattgccatccggaacacgggcgatgcggaccagtggtgcccactgctggagactctgacagacgctgagatggagaagaagatccgcgaccaggacaggaacacgaggtacccctggccctgtggtcctgggctctgcccacaggcacctggctttccaggcagaggcagggccattgcctttcccagtctcccatggtctctgagacagagtacctctagtgctgctagaggcaggcaggcttctgggtgataaggccccatccaaacgccagggtatgtttccctgcatggaacaaacataattcctcaggctgagggtctgaccacagcccagatccaggttttggggtccctggagtgatgagcagggcctgagtggcagacaggcgaggctgagagaaggctgggtctgaccctgctgggggcccacatcctgcctctgttcccacccctacacttggctgccctgtagagccttgggaagggcagcgcccaggctgggagctggccccgactcattgccctccccactcctcttccaggcggatgaggcgtcttgccaacacggccccggcctggtaaccagccc

SEQ ID NO: 102916 - DNA, 1050 bp, Homo sapiens
tggccactcccctcaggacacgctgcttatgccctggggcccctctcccatccttgctggagttctcctcacacctggctccatccccatcttcctgccctcccagctgctgtgctcttacagcccctcaagccagccggcccacataatttgcatcgtcaggacggatctactgatgcttgcacggtcctgatgggagtgaggatgggagggtcagggttcctgccccatggctcccactcctccactattctcaggccctcccctccctgggtcctgcctgcttctgggccttttaagcttgtccttcacggccaacccggggctggcactctgtgcaaggctttggggcactcatgctgtggggcctgcagggccaccaggctgtggatgggggcctggggcaggctctgctggtctaggactctgggctgtggagggtgaccccacagtccgtggctgtctcacagggattgcggtgggccatatctactacttcctggaggacgtcttccccaaccagcctggaggcaagaggctcctgcagacccctggcttcctgtgagtgttgagagccctccctccctctccccaccctcagaaggatccccaccgatggggacctgtgctggcctgtgctcaacacgggcccctccccacagaaagctgctcctggatgcccctgcagaagaccccaattacctgcccctccctgaggaacagccaggaccccatctgccacccccgcagcagtgacccccacccagggccaggcctaagaggcttctggcagcttccatcctacccatgacccctacttggggcagaaaaaacccatcctaaaggctgggcccatgcaagggcccacctgaataaacagaatgagctgcagtctcttggcccacagcactggcttccccatctcacctggccacatccttctatgcctgccccgtcctcactcagtgtggcctctcagcccaactgcaggtggtaggataggggtgcccacagagggcaaagaaactgcccatggttgcctggcagagc

SEQ ID NO: 102917 - DNA, 1401 bp, Homo sapiens
gggctcagtgcgtgcagtggaatgaactgggcttcatctctggaagggtaaggggccatcttccgggttcaccgccgcatccccacccccggcacagcgcctcctggcgactaacatcggtgacttagtgaaaggactaagaaagacccgaggcgaggccggaacaggccgatttctagccgccaagtggagaacaggttggagcggtgcgccgggcttagcggcggttgctggaggaacgggcggagtcgcccagggtcctgccctgcgggggtcgagccgaggcaggcggtgacttccccactcggggcggagccgcagcctcgcgggggcggggcctggcgccggcggtggcgtcacaaaaggcgggaccacagtggtgtccgagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccaggtttgccgggaggggacaggaagaggggggtgcccaccggacgaggggttccgcgctgggagctggggaggcgactcctgaacggagctggggggcggggcggggggaggacggtggctcgggcccgaagtggacgttcggggcccgacgaggtcgctggggcgggctgaccgcgccctttcctcgcagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacaggtacgcggagtcgcggaggggcgggggaggggcggcggcgcgcggccaggcccgggactgagccacccgctgagtccggcctcctccccccgcagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactaggagtgcctcggggttccttggcttgcgggaggaattggtgcagagccgggatattggggagcgaggtcgggaacggtgttgggggcgggggtcagggccgggttgctctcctccgaacctgctgttcgggagcccttttgtccagcctgtccctcctacgctcctaacagaggagccccagtgt

SEQ ID NO: 102918 - DNA, 1145 bp, Homo sapiens
cgtggtcggctcacctccagcaccccacgtggtggccctaggtacaacggattccggcgggcagagcgccttagatcccgagtctgcagcccagggcagagtgccaacttctcctcatcccttcgtacgccatagaatggaaagacactggggctcctctgttaggagcgtaggagggacaggctggacaaaagggctcccgaacagcaggttcggaggagagcaacccggccctgacccccgcccccaacaccgttcccgacctcgctccccaatatcccggctctgcaccaattcctcccgcaagccaaggaaccccgaggcactcctagtctctaaaccgtttatttctccccaccagaaggttggggtgggcgggcctagaacacagcgtgcggcgggttcccgggtggagccagcgcagacagcgtgggtccctgcggctcttaggcgaaggtggagttgttccagcccacattggccgcgttcatgtcgtaatagttgatgtagaccctgcggggggaggaggccggactcagcgggtggctcagtcccgggcctggccgcgcgccgccgcccctcccccgcccctccgcgactccgcgtacctgtccgggctgatgcgcaggcgctcggccagcaggccgcacagcagcttgctgtaggagcggttctgcgcgccgccgatcttgccgatgctgtgcaggctgcagagcgcgcacggctcgctggagccgccgaaggccatgagctggtccgggaccacgtgcaccgcgatgtactgcgaggaaagggcgcggtcagcccgccccagcgacctcgtcgggccccgaacgtccacttcgggcccgagccaccgtcctccccccgccccgccccccagctccgttcaggagtcgcctccccagctcccagcgcggaacccctcgtccggtgggcacccccctcttcctgtcccctcccggcaaacctgggggggcttgccggtggcctgcgccagctgctgggtgagctcggagaggaacccgtccggcacggaggcgcggggcacgttggtgtttacgatgaacatcggcatgatggcagaaggaccaggagacccgcgcagaggcacagacgcacgcgccgcggccgccgctgagcta

SEQ ID NO: 102919 - DNA, 1722 bp, Homo sapiens
ttcaaaaaaactttaagctcccgttgtattggttattagggtcgagcctggggaagacccctataggtgtgtgtgtgtccttgtgtgtcgggggtgtggtgttcagacctctaatagggctaggaaccgggcgaccacagcgcggaagcttgagagggaaacccacctggcgccaggcaggagggtcgggggagacagggtgggtccactaccgggttaaagacctgtagtgggtggggctacacgtagggcggagacgatgggacttccggaaatcagccggcacacgtgacttttgtttgcagaagcgggaggtaccctaggcagccaatcggggagcgccgagtctctgtccagccaatgagaagccaggttgctgtggcgcctcgcccctcctccctggtccgcgagccttgggtacccccagcttttcttccgccagagctgtttccgttcctctgcccgccatgccgttcctggagctggacacgaatttgcccgccaaccgagtgcccgcggggctggagaaacgactctgcgccgccgctgcctccatcctgggcaaacctgcggacgtaagcgtgggccgggcagcacggggcgaggggaggttggtgggccaggggtccggccctgtccctgctccgcctccccgacagtgaccccgaatcttttccccagggaccactccccactcctttcctcacgccaagctctgactttccgtgctccacgatcccgcggctccccctccgcacgtctttcccttgtcgccctccccagtcatgacccgggcgtgaccttcagggaccgcggcccgtatcgggatccctgccccgcgaacactgcgcgtttcggctttcgcgcgctcgggtcccgtccccagaggtagcccggccggctccaacttcgggcaaaacttttcatgtccccctcagcgcgtgaacgtgacggtacggccgggcctggccatggcgctgagcgggtccaccgagccctgcgcgcagctgtccatctcctccatcggcgtagtgggcaccgccgaggacaaccgcagccacagcgcccacttctttgagtttctcaccaaggagctagccctgggccaggaccggtgcgtaggggtagtaggggatccatgtgggactgccgcagactggagccactgatcctgcctcagggggaaaaacccatttcttgccctgcccagtaaggacacatcagggtctggagctttggggccccctgaccccttaggttcctgctgttaggaccatcttcaaagtgcgagcaggattgaatgaatttctggctctgctcctcagtgtgtaagtctgtgaaccgggaaggctctcttttaacacccccggggcagtgcaagggtcatgtgggattgtctgtgtgctgtacctgccttggcacctgacagggtaggtacacgtggctgaagtgtgattttctagaacttttccaggctggtcagaaggaattctgggtatgttctgaagttacgtattttggacctgtgtcccagccaggttccaggtgaagttcacgggagactcacagagtagtgaaagaccattggcctggatgtctagacatctgctttctgggtcctgcatagctgggggaccccagacaaacttggaaatgaaccatctccagttggcaacctcctcttctgtgaatacaggggaaaagacctccctcccccacaag

SEQ ID NO: 102920 - DNA, 1052 bp, Homo sapiens
actggaaacttgctgttacctctgagaggggcatgttcacttatggcccagacattagtggcggggttggtggggtggggggtcaccctgtgctcagcctttgagaaaacaggtggctgaggtactgtgcccttagggagcctgcaattaggaggcagggtacccctcagtacacaaactgatggagatgatagagtgtacggcacacacaccgaggctactgtattgtgtgtctgtcctagctgggtcatgatgtgcggctacctcccacacctgagtgtcccactgccctgctgggggttggggaaaatcattattgggatgagcaggtttgcaaaatgcctggtggactgaggcaggctgtcctgagtacccacagtgggagtacctggcaggggtcttgcaagatgtggtattagccaaggagctgatgatatctttttctctgtctcctgaaggatacttatccgctttttccccttggagtcctggcagattggcaagatagggacggtcatgacttttttatgattgggcacggagggatccagggcatctgtgaactggctgcttcttccagagagatctcttggcagagtgagggcctggagataaccagctttggattatcccgcatgcaacattcctgtgatcacataatcctcttcttcatcctcatatgaaataaatgaagagagcttcctcattcaaacatgacttcttaccttctattatctctcctgggcatctggggccaccatgggcagcagggctggtggataagaccgtagggaacctggagggggatgatttagactgctcagatctggggctgggagactcagcctggaggctctgctctccacacccatctgcaggcctgtgggaaggtgtgagcagctggtccagctggggccttcctgcagactgctgacctgaggctcctgtcctcagccccaaaatgggaccagacctctgtactcctcctgaagtctactccctccatgactggctgggcagcctgccacgccactctccccttttccccactg

SEQ ID NO: 102921 - DNA, 1003 bp, Homo sapiens
gttcatggcctctgtgttgtcacttggccctcaactacctttccatcctccattcacatccctgctctaaggccttgtcttctagttttcccatcacacctcgctctccctgcctctttgcttcactgtcttccactgcagtgtattccattcttcaaggcttgatgcagtaacttactcctttgccttccttaatcgctttgaattgttctttgctgcctttagatgttgcctgtgtttcttttcgtatcattcaggttttgaaaaaaataataggcttgttacctctgctagcagtgatccctgggggcaaggattgttctcactcttttgtgtgcctggcacctgatgcattgccaggaaatgatgaatgctatcgtaagggaccaaggagctccttgtgtgttagaccacaccgctgtcccaaggcagctcttcactggcctgtctgcatagagctcagggaaggactggttcctggtggaccttggcactgtgaccttcctggctcttcataggccttgtctcagtttgtcctatttcctttctaggagagttgtggactggggcaacctttgccagtgatgagaagtgatgctcgtggcagtgctgaatctctctgaatatggtaaggactgatgcctgcctattttgcggacctcagtgttcttttgttacgttactcctgggggcgaggggcattttcctgttagattctgaaggctcttattatggagtagccttcctcccaggaaggctgttggcacctttgagggtgtgagattgcttgcctggtggttgaagcggcttgcaggaccttgtcacagttgctggaaagacataaagttaacatgttttgttgaaatctgttgttccattacctgggtcttctactgtgttgagctgttgctggggtgtccccagtgtctgttgcttttgcagtggacagtacccaggacatactttctgcacagattggcataaccctcccccctcggccccc

SEQ ID NO: 102922 - DNA, 1049 bp, Homo sapiens
tctcaccccctaccccttttagatttgataatttgctagaatgactcacaggacttagaaaaacactttacatttaccaatttattatgaaggatacaactcaggaacagccaagtggaggagatatttatggcaaggtatggggtggattcacagagcttccgtgccctctccaggtgcggcaccctcccagcaccttgatgttgttcaccaacttagcagctttctgaaccctgccctttagggtttttaaacagagattccatcacataggcatgattgattaaatcattggtgatcagctcaatctccagcctctcttcccttcctggaagttgggaggtgggggagctgaaagttccagctatctaatcacatggttggttcctctgactgtagccccgccttacacacatttttggcttaaaaaagacagatctttatgctgtatgaaaacatctcttgtcttgatttgcaggaagcagaggcttttgcattgtaccacaaggcccttgatctgcagaaacatgaccggtttgaggagtctgccaaagcctaccatgagctcttggaggcgagcctgctgcgggaggtgaggcatcagcaggccaggcagtgtgccgtggtggttagtgcatgggctgtggggctgggtactctgggccttacctctgctctcccatttcttggctggggaaccttgaaaacattatttcacctctctgcccctatttccccacctctaggtatctgcctcattgagtttttatgagggttgagtaaatccagtgaagcatgtaaaatgattcctggtgtaagtgcttgttaaaggccagctatcgttattacttaatcttcacaaccactctgcccagtagctgggttttacaaatgtggaaactgaggcttagtgaggtcttgatggctcaaagccatccaagtaagtgaagcattcgaaccaggtttggagtccatggtttgctgatacctaatgatcctactggcagcacattttagcaaatgccatttgagtaaaagaccatgagctt

SEQ ID NO: 102923 - DNA, 1188 bp, Homo sapiens
actttaacttttgctatttagggtaggaattatttttcttaattacagaggtcagacactaacgttttagttaaattagcaattgtctatgctcatgtgatgagttatagagttgggagctcagtctcttgattcctaatcctggagtgcctgcagtgaagctctaggccttctgcccccaggcagcctgctgatactttgtcttttatcttatacctggagctgctgactgggtctacctatgctgtaaatgttattcgctaggcttgaaccctcaggcatggcagtagtggtggggcagtttctctctgttggatgcccagactctctgcaaactattaatacctcagggtggtctgttcttctctgtgcgcttggagtaggagtggtcttataagaacacatggtgcagtgccttcattttccagtggtggacaacactagactggctcaagggcctgcagcagaggccagcctggaagccaagtatcctgctggctgcttgctgaggcttcaaggtctagttgtcacttctgttctgttttgttcacaggcagtttcatccggtgatgagaaagaggggttgaaacaccctgggctgatactgaaatattccacttataagaacttggcccagctggcagcccagcgggaggatctggagacagccatggagttctacttagaggtgtggttttggcagtgcttagctaccttggtgttttgaaagctcttggtggaggggatgaggttgcggtcttgtgggccaaaaagaagagtttgtagtggtggatcaccaagctatagtacccaaggctctagggtaggtccataggtgataacaattagtactgaccaggcctggagagcaggggctggggcagagcacatgcttggatgcagaggcctgcatgtgaattcttcctttgctgctcagtgcacgtgtggctgtgagtgagttattcagtctcttggtatctctaggtctacaccaatatagtggtaataataaaaaagagcatagttgtgaaagttaaatgagttggtatgcataatagtatcaaaaacaaagtctgaaactgagcattcaatatattaatacttacagtcataatagtattgctgttatttcatgttactatcagtctgtctctgggcacctctaaagcaccagacactgcgctgttt

SEQ ID NO: 102924 - DNA, 1348 bp, Homo sapiens
cccaggctgctctcgaactcttggactcaagcattctgcccacctcagcctcccaaagtgggattacaggtgtgaaccaccaggcctggccatattttcttttctttcttctccttttacttattaaatatgtaaggaatacagatattcagattgacaaaatatatcaagacaatggggaaactgaggcaggaggatcacttgaggctaggagtttgagacaagcctggataacatactaagaccgtgtctctacaaaaaaattgaaaattagctaggtgtggtgatgtgcctctgtagcctcagctactcatggagctgaggtgagaggattgcttgagcccagaagtttgaggatgcagtgagctatgatcacaccactgcactcttgcctgggcagtagagtgagacccagtctcaaaaaagaaaaattttttaaaaaaattctaagttaaataacttggtccctgtaactttttatatgccattatcactctagatcttggaaacgtgcgactccaggaaagatgagctggcattacttgtcagttataagatagtcatggcacttttgccatttccctgggaagttcaagtggctgtgccagtgccgtgctcctcccgtccccggggtgcatattcaaggagagatctgactgtgtgtgtgtgtgtgtgtgtgtgtgtgtgtgtgtgtgtgtgtgtgtgtgtgtgtgtgtgtgtgtgtgtgtgtttgccctctgcttgtgtcgcttccaggcagtgatgctggactccacagatgtcaacctctggtataagattggacatgtggccctgaggctcatccggatccccctggctcgccatgcttttgaggaagggctgcggtgcaatcctgaccactggccctgtttggataacctaatcactgtcctgtacaccctcagtgattacacaagtgagtcatgctttgatgctttcttccatgtgccagtggtttttggaacagcagaggaaaggcagtttgggtaaactgaaagccaaagttaacactgaaggggtttgccagactgtcagggagaatggcaatgttcttagatttctgctttattctgcatctctttcttgatttgttaaatgccttgtagtaataaagtagcatgttttctgaatgattttactttttttttttttttttttttttgctttgcaaggttttgtttgcttgacagaagtggctatcttatttcctccctgcactgtcccattttgtgtgtcttagtctgtttgggctgccattaaaaaaaaataccatagattgggtggctaaaacagcagaaattgtctgggtatgttggctcacgcctgt

SEQ ID NO: 102925 - DNA, 1890 bp, Homo sapiens
cctgtcttctcaacctggctcccactatgctctaaactctcatgccatcttcccacctctccacctgtcccgccattgcccctcctttgccaggtgtcttcccacagacacacttctgaggtgacccaagaatacctgcccctcctgcccagactgtcctgatgcctgccagcagggccacacctcagagctgctcacttacaaacttatctgtttctcaggtcacctctctgttgctttctgagctctagctgcccttccccacagccctccagcccagccaactccttttgccctctggtcttccttggccctggaacacacctgtaggggttgattagtagtgatttatcttggcgtctatccccggtgagcctgtccctctcctgaaggaactacctgttggcagagataggaactgagggaacatctgtcatgagggagctaaccttgagggagacagataagaagcacatgaaacagataaattcatgagtagctctgaggtgtaaccctgctgggaagcaccaggacagtctgggcaggagggcaggtgaggttaggtcgcctcagaagtgtgtctgtgagaggacacgtagggcctccaagcccctgccctttctgtatttttgggtcgtgatacactttggtgagcttcacttttccgatgactttttgttggcatgggcagtataggatagttacattcttttaagattttctaataataattgagagaaagattttatttttctgtggcttttcagatattattgtgatagtgttaatacatatgaaaactctttctctgcccagttttgaattgtcaaaggaacaaagaatattagtcatttctagtgtatgtgggtattaagaaggctatttactgccctacccaggccagactgaagtggttattttatttataggaagaaaaatacacattaaaaggtattaacctaaatgcatttttgtgtgtaaaatttcagcctcagttttagtttgtaacatgataatttctccctgtctcacatgcttttagtgacatgtcgattcacgatgtttcggtgagtgcagctgagacacaggcgattgtagatgaggccttggggctgcgaaaaaagaggcaagcgctgattgtgcgggagaaggagccggacctgaaacttgtgcagcccattcctttcttcacgtaggttgtctagcgtctctgggagtgctgggtcggccagtaggccctgttgtgggatgctgccctgcacaggagggagagaccttgaggcttgatcctgggttggtggtatgaatgggggctgggtgcacagtggccaaatggttggaggtgcatgcttacttgattactaagaagcaggtcagctctctctcaagtacctccagtctcagtccctttttgctgttgctgttcttgaccccagccacctgccacattcctgtaaggcccttctcagcctgccctatctagagggcgaatggaaactaacatttgccaagcacttgccaggaggaaactgatgttcagagtacttaaatggggagcccagagacagtcccgggtctgggcttctccgctctcaagtccatgttttctctctagggccacgtggggagccctgcgagatgggcctcaatatagtccttgccagccccatgatgtgagagtctctctctctccaggaagggcaaattggtatcggcggttccctggagttgggatagtttagtcccttagcgagctctggaattcaatttctgtatttaaaattctgacattgaatctttaagtttagcatgacttagcagtagcattccatttctattccccaccccctacctccacccctgtctgcctactctgagggagctctggcc

SEQ ID NO: 102926 - DNA, 2012 bp, Homo sapiens
gctggtcttgaattcctgacctctagtaatccgcccacctcagcctcccaaagtgctgggattacaggcatgagccactgggcccagcttcattctgacttttaaactaccacctggtggaatgtagatatactcaatgctgtctgtaaaattgcttccccttgcccttgcccctgactctcggcagggggcagggtctctgcatatctttgtcttaactggtccaacctctctgatgcctgccactcagggagctgtagggctctgaggggcttagggtgcccctggagatagggtgggtgtggttagggccaagtgcaacttctgagaagcagaagggcattagaatgctacacatgaagttgactcgttggcctgatggtttttagtgtctcctcggaactgtcctgctggtatggtgaatggcagatttggacctgacttcccagggacccactgcctgggtgacctcctacagctgtcatttgcctcgtcccagcgcgacctgttcgaggatggttggctggagtttgtggtccgtgtttactggctgaaggctcgcttcctggcgctgcaggttagttccatggtcagctgcttggggagcatgccctgacacccagcagggtgggcagaaaattgaccatgttgagggtgtgtgtgtgtatgtgtgtgtgtgtgtgtgtgtgcatgcatgtgtacatgcatagcacctgcccgggcactgggcttggcatgagaaagtgtgacacagtggggaattctcagcatctcagacttccaagcatgataccaatctgtaaagctctttagcataaccacagagctctggaaggcatttgctctgcctctacctcccccactcaagattgccttggcatcttgactctttgcttatgttttcctgagagagcccgagcaagtgaataaacagatacagagctttctaggagggaattattcacctgttttatgagagttctgggaaagcttcccttcagagcctggtctggaaggccaggatggattggctgttacctagcaccttgcacatggtggtactggtacactgtggtagaatgagtcaagagattgctagggccctgtcagcaaccatttagtctaaagaaagcaacactgtttgatgtgaagaacattagttctggaattaggacaggcctggcttctaattctggctttgctcaagtgtcctcagtgttttcatctgcaacatggggtttatgatatctcccctcgcagagttgacatggactgttcatttagtcaacaagtatttattgagcccaagctacatgccaggcctttcttaggggggtacagtgtaattggtaaaaaacccaccctcatggcctccacagtctagtgagataagtggtgtaaagcatctggcacatcatagtcagtcttctgctttggttccctgacctgttttccgtctaaccagggagacatggagcaggccctggagaactatgacatctgcacagaaatgctccagagttccaccgccatccaggtggaggcaggggctgaacgaagagacattgtcatccggctgcccaacctccataatgactctgtggtttccctggaggaggtaagtgagaattttcgtttgtttgtttgtttcctgagatggagtttcacttttgtcgcctaggctggagtgtaatagtgcaatctcggctcactgcaacctacacctctggggttcaagggattctcctgcctcagcctcctgagtagctgggattacgggtgcccgccgccatgcctggctaattttttgtatctttagtagagacggggtttcaccatgttggccaggctggtcttgaactcctgacatcaggtgatccacctgtcttggcctctcgcagtgctgggattacaggtgtgagccactgtgcccagctgaaaggtttttttttttttttttttttttttattgatcattcttgggtgtttctcgcagagggggatttggcagg

SEQ ID NO: 102927 - DNA, 2114 bp, Homo sapiens
actgagtgaacgagactccgtctgcaatcccggcacctcgggaggccgaggctggcggatcactcgcgattaggagctggagaccagcccggccaacacagcgaaaccccgtctccaccgaaaaaatatgaaaaccagtcaggcgtggcggcgcacgcctgcaatcgcaggcactcggcaggctgaggcaggagaatcaggcagggaggttgcagtgagccgagatggcagcagtacagtccagcttcggcttggcatcagagggagaccgtagaaagagagggagagagagaccatggaaagagatggagagggagaccgtagggagagggagagggagtgaaaggttttaaatggtattttttagtcaaaggtttcttgtgatttggcatagttagccaagggttgacctgtttctgaggaacaagagagcttcccatatgctgagtggggcctctgttgggaagacaggagaggcctgggaaaggctgctgtagtacactgggacactgcagatccttggtggaaagcaggtgtgggagctctcaccagcactatttagaagcagtcattgctctgctctcctggctatgtgtggcagccaccccagtggaactggaaggaaatatcagctggagcagaccagtattgggctggccatggggttgagtcagcagtgtgtggcctatatgccaagttccacccaggtgccactttattcattgtgcagctccagaccctgctgcagttctgcatctgtgacatgtccacactggctgaaagtggccttcagactctcctagagttatttcagggacaagtacaagtacagagctgtctacatgccagggcttcgtcaggtcctgcatgtagcgtatgacaacctctggtccaggcttgctgagtctctgacaacccgatgttccgcagttctgcaagactggttcgccgaactgtgaccacaaggctgtccagctatcttggtggatgctttcctggaactcctctgcttctgagtagtttttggtttttgatgtgcttgttttttaaagaattggatgcctagccattaatagaaatacttttaacacatacgtttagtgtaaacactgatgtatgaaggaggaatctaattttttttgggctggaacatagtctaatttttattctcctcatccaagtctgataaaaacaaacactggccagatttggtggggcaggggctgaggggtttaccctcatacagcattgccgggcctttttcagattgataagaacctgaagtcgctggagcggtgccagtccctggaggagattcagcggctgtatgaagcaggcgactacaaggctgttgtgcatctgctccgccccactttgtgcaccagtgggtttgaccgggccaaacacctggagtttatgacttccattcctgagaggccagcccagctgcttcttctgcaggtgtgtgctgccagtgtccctcacacccacttgcaccttctctccttgcttgtttgtgtttattctctggaggttctgcggtagttcttaagaatgtatagctagaagagagtggatgtcaaaaccactaagcccccaggaagatgttagtcagaagatatggtcaagactaatggaaagttagaaccaaggagtgcaggttctagggttctgcgtggctcagggtgaaccccacacttgactcagaacttctgtgtggcagaggaggaaggaagaatggtcaggtcatcatctgtccatccacttgtttattcatccatcttgttttgtattgctttttaaggtaaatataaaagtggctaaaatatctgtacagtggaaagaatcaagataaaataaagaccaatgtgttgaagaaaaataacactagccttatgtttgaaacctcgtgtgccctcctgaatccttctgtgcttctgttcctcaggaggtaaactcttaccaagagcctgccagggaactggcagctgctgggtgctgggcagttattcaacctctctgagctcagttcctcatttctaggatagggatgaccaatgtccttagctcagagtcctgttgtagggattacacaaggtaatgtgtgttggcac

SEQ ID NO: 102928 - DNA, 1094 bp, Homo sapiens
tcactacatgtcagggctctgtggctaggatacctctggccttgacaggtttgtgatagtgggagacagatcaactatctaacaccaggatggtgtggtggatggagaggagggcacctgatgctgcccatgggtgtgggtgtgggttgagttgagccctgaaggaagagcaggggcagaggaagacattggggaggtggagtggggccagggactgagcaagccttaagtcaggcaggagacctggggcatggggattggatatgggaagaggggccagattgcaaaaggcttttattttctgttttgtaaagctgttgctccattttgctccattgttttcatcatgctgatgagaggtgcatgcactattgaaccatccccgctgctgaacccttagtttggctgcactatttcattcttacgggtcatgccgtgatgaacacctcattcatgcctttttgcttgtacccaatttttttttaggataaatttctaggaatgaatatctttagagctcttgataattattacctctggtaccacattgttctccaaaaggattttagtggtgaaaaaaaacctaaagtttataactataaaagtttgttatttttcttagaaaaataacacgaaaagacttctggactgaaattctccttttcctcaaaattaattatgcaaacaaaaattagttttcaaaaaactgccagcaagtaaatgcggatagaggaatagtcaaataccttaaactttgaaaagtacatcaaagaaagagagagagattggaaaggaaaaagaaagaaaagaaagaaaaaagaaagattctggtggagtggcagtagatgtggctctgtctctgcatgtccctcagcaggagaactgatggaagatagcaagttgaccaaatcctgggaaatattattaatattctcatttgtggagagtggcatgaggggaaacctcctccatcccacccttggccttggcagaggcaggaagagccacaggatcctgccatcttccagtgtgcagactgagctgagggaaggggccctgggataaaacacactatggttgggtggtgaggggcc

SEQ ID NO: 102929 - DNA, 1128 bp, Homo sapiens
aggaattggaggctgcagtgagctataattgtgccaactgtactccagcctgggcaacagttagaccctatctcttaaaaaaaaaaatttttttttttaagttaagaaatggcatgtgtagtatgggttccattgtaacaaattacttttctctcattcaaaatgcatcagatatgcacagatggatgctgtgactgaggttcaccagatgtcagcattggttctctctgggctggtattttgatggataaagtgtgctcctttatattttcctatatggcttgaattgtgttttgataagcgtgtattgctttagtaaagccagtcaagtcactacttatttaaaaaggcaaaaaaaaaaaaaaaagggaaaggaaaagtctgtagtcatgttgataaagacagaaaagcccgaaaagaggagactgagcctcgcagcccctgcaggcacgcaggttcccacactaactctgtgtctgtcggcctgggctttccctagggatgtcagagacgcccatgctcccatcctccctcatgctgctgaacacagcccacgagtatttgggcagaaggtcctggtgctgcaattcagatggggctctgctgcgattctatgtaagtgcttccccttgggctgcagactgccagtgcagggcagggctggggtgggaggtggaatgggaaggggacagattcatgttggcacgctgggcttgcttggccttccctcagtgggcccactgtgtgtctttgacttactgcatttctcactgtagttaccgaagcttgtcagaaagtctgataagactttcttgccagaaagttcccttgtgtacctgaggctcaggaagctccggagctcttgaacagcaggtggatttagatctactagtccttactgagtttcttcctagtcaggcacggggctaggccttgtagttgtaatttcaggagtaataaccacatgcaccaccaccgccttctattgagtcctgtttactaagcattactcacaatgccaagtagtagttgctcattcaatagctattattacatccattcagtcactaaatgattagtgagagcacatacacttccttgcacttgtcagttgtgattgactggaag

SEQ ID NO: 102930 - DNA, 1049 bp, Homo sapiens
tacctattttaagaaagtattcagtaaatattcgttgaggaaatcaatgactaaataaatgagtgaagttcccaggaggcaaatatcttcttctggtggctggtagaaattggctaggtgtgctgaaagaaaggcagcttggtaaacccatcaggaggctactgttgggcccagaggtgggaccagaattactcctattaggataacaagacttttccaggaaacaggtgtttttggaatcaagtcatgcaggagcccaacagacatagccacctcaggttaaaagagttgatagagtggtggtttctctggggccctgctgtgacagggaggcagtggctacaggccctcacctcaggccatctcttctgcccaccacaggtgcgagtactccagaaggaactggctgcatccacctctgaagacacgcacccttacaaggaggagctggagacagccttggagcagtgcttctactgcctgtacagcttccccagcaagaagagtaaggccaggtacctggaggaacactcggcccagcaggtgagggtgctgcaataggcccaacaaagagggaagcaggagctgtaagctcttttgaaggatgtcatatttgtcaacagtcatcttggcagtcctgcttggagttgcatcagaaggaggagagaagacggtctgatgagtgtatcaaaggacaagggtttttcttgcaaaaacttattttcataaatgttgactgacattcaactaatgttgactaatatgtagaaccagatatggtggtgcatacctttagttctagctgctctggagggtgagggtaggagggttacttgaggccagaattttaaggctggagtgcactgtgattgcatctgtgaatagccctgggtggcagagcaaggccccatctctaaaaacaaacaaacaacaaacaaaactaccctaaaaccaaaaaatgtagcatggcagttgtcgatagtttatttctattttggatatgaataattccttagaggttttccatttttgtgttgttttggttttta

SEQ ID NO: 102931 - DNA, 1968 bp, Homo sapiens
taccctgaatgtgttgctaatctgccttctgtctttttttcaaggtggatcttatatgggaggatgcactgttcatgtttgagtattttaagcccaagacccttcctgaatttgacagctataagaccagcaccgtgtctgctgacttggccaacctactgaagagaattgccaccattgtgcctcgcacagagaggccagcccttagcctggacaaagtctctgcctacattgagggaacttcaactgaggtgggcccacaaccttgaggacgtgggggacagggctgggtcacactcttccgctctgccactgctgtatatgctcctttgcttctttttctgctctgtaccagactgaggggcaggagaggctggagagtctgtcctgtgactaaacagtcctgggtttactggtcacatctgagtccttgactccacctcccctcatacttttcctctcacctgccaggtaccctgcctcccagagggggctgacccctcccctccagtggtgaacgagctttactacctcctggctgattatcatttcaaaaacaaggagcagtccaaggccatcaagttctacatgcatgacatctgcatctgccccaataggtcagtgaccagatcatgaggctaggctggctgcagggatgactggggtgactccagctcagcaagctcttcagtgggccactttggggtttccctgtccattgcaaagagaccagggaaaacggaatgagagggtggtttagcactttgctgttgttaggaaaggcaggttttccataaaaagaagagcagaggagaaggcctcttttccaaagtcctctgggagggttattggtaaagggttattagagaaggtacgaagtgtccatctggaccctggtgtgcagggcaaggaggcgcaacctggctccatcctgttggttttgtgctgccccctttcacagccccagagtgtgtactcttgctgcttccactgcaggcttcttaactatggttgccttcttggggacaagtaatagaaaaactcaagccagagttctcttttttgctctgatgcagtgcactgttagcagtagcgattgtcatgatagtacatgtagaagagctcattgcacatgaagctcatgctctcttcctgtggaaccctgtttggctttctcttaaaatgtagtgattgcctggagcctctcaaggggccttctacatttgtaaagtttgatgcacttgattaagagggaatattttttcctacctaggaggtaagccttgggtgaaggtcaaaaggaggctaccctctgtggcagacctgcatctaaagggttcagagtagcatctgtaggcacactttctggaaggactcagaggccaggctgtgatagctgcccttgagccatgggtgagcacagagccaccctaactcagggaaaaccagagaattccaccttgtcaggatccatctggccaagaagagaagggactgggtgtgagtggaaaagccagtttgcaagacttgtgtagattgtgtgaaaggttctcacagaacttcttttgcttagcctgtggtttcttccagtcagggagccatgtggcagagccctggccgtcctcttggggtgactgggaaccagtgtgatagagcagacctatctatgctcagtctggctgagtgcttactgcgccacagttcaggtttcctcgtctgttcccctacttccacatctgaaaagtgagggtgataaaacccacctgtctttgcatggcacctctcacctgacagccccttattcaacagaattaaggctcatggcagcttaactgggcctccctccaaccttcatacctgcctgtttagagggtatcaacccatcagcctggcccattaggcaaccctgccacagaggcgtggtctcccgtgggattggccccagtgccaggaaagcacttgatggct

SEQ ID NO: 102932 - DNA, 1105 bp, Homo sapiens
aagtaggtaagatcacacctggctgagggtcttcctggtgctttagctggactgctgctgccttgccttgtagagcactccttttcctctccaccagagctgttctgtgggcaacccctcaaagcaggggaacagagtccaagagctcatccattagagtacttactgcatgcctattaggcgctgggtgattaaaatacattttgtctcataatgcccacagctcttctcttgaggtaggtcttcttagccctgtgtcacaggttaggaatgaaggctcagagacatgactggtctgggtcatggtcatggcattagtgagtggcagagttgggctctgagccctggtgtgggaagggagtttccatggggtccatctgcctgtccactaggctgtcattatcttccatgcttttcatgtagtgttgtttttagctggtgcttttgttaccaccacaggtttgattcctgggcaggcatggctctggcccgggccagccgcattcaggacaagctgaactccaatgagctgaagagtgatgggcccatttggaagcatgccacgcccgtcttgaactgcttccgtcgggccctggagattgacagctccaacttgtccctatggattgagtatggcaccatgtcctatgccttgcactcattcgcctcacgtcaattgaagcagtggagaggcgagctgccccctgagctcgtgcagcaggtgaggagggggtgctgcagatgggcttgccatccttctgtccagacagagtgccctcaggtcaacgaagctctgtctcattcgtactttattcttgtccacacatccatgctgggagctcactgacgaatctccccatgaggcttaagccataccatggtcagtgacaacttggtccctggtctttggacacccagtctagtgtagacaaatttagggacaggctgttagacccagctggtcagccattagttatagtgtagttgagagatagggaggggagaggtgttggccaccagaagtagctatttcttccctgttccctcaaaggagcttgttggatccttgtaaaattcttgagcttaggttgggatttttgaagtc

SEQ ID NO: 102933 - DNA, 1050 bp, Homo sapiens
agtgggagcctgcctcacacccactcctgcatgagaagatcagggcagacctggttttaacctggccctgggcattcccggctgtggggccttgggcagctcttcacccattttaaattgaggaatgtggtaaggacttgaggaaatggaggaaagcacagggcccaatggatgcaatgagctgcctgcccacccacccccccaccacacccacggggaagacgttttcgaggcctgtgggtgcctggctttgcctgggggctgggctataaacagaaatccaacctagtccttctttcagggagtccagagttcagtggggagacagatgtagaaactcactttctatgggtgcccactgaagggcacaaagagaacagcagcactgtggcgggaggcagtgcccagtgaacggagctgaagggttatcataatgagtggttattactctcatctcactaccatgtgcctgagttactgcgtgaacgtttaagctggaatgctgacagtatacattttaattttcacagcttgttttaaattagttgtaggatggttggtttaaaagctaacaaaaacaagcagtgtgtggcagcctgttgccctggtcatgggcccatttccagtgtggctgactggcctgtggaacaaatcttagcaactgggaaggctgctcacactagaggtgtcgttctcctaggtgtactttcggctccatgcttccatcctgaagctcctggggaagcccgattctggggttggtgcagaggtcctggtcaactttatgaaggaggctgcagaaggaccctttgccaggggcgaggagaagaacacacccaaagcttcagaaaagtgagtagcaccctttaggcgacccctagcagcttaccccatctgcatcccagatggctcgtttactgcaatgtgttgttcagagggttgctacacagtaaacagtaaactagaactcatggagtccctaggacccatctggaaactcccatttgctgggccaaggtatttctgttgagtctgagaaggagagggtga

SEQ ID NO: 102934 - DNA, 1057 bp, Homo sapiens
caggactttccttgggcatggttaggagaccttgcattggagctgccttcccacattggtatgcctttgcttcaaaaccagaaatcagctaggatcaattctgatttggtttaagatttagaaaagatttagaaaaatagctccaggtacatgtgggttgtttgacatttgataatagctgcttcataggacccaaatttgttctctgaaccaccctcacctgcaaccttgtgtcacctgcattagggtggggagcatcctgcagcctgtgcataactctggttaaaagcctttggaatcagcccctcaggtcactctgactctaccgcagcctggtgtcaaagccagcccttcacggaacagccaggagggcatcacagctgacctctggccaagctgagaaagagagcaagagagagaacaacagagagagaagctttgtcctctgctgtgctgctggcagctctggctggttgtgctccccatctgcctaacttctcccttccgtcaatctcttggaatttgcccacagggctgaaatccctaatgttgaagcttcctgaccaggaaaacgaggtgacccgaggagcacattgtgaccttcagggggttcccagtgattactctttatacatattcaagcaacataaggagatctttgaacaagacctctacccctaccctgtgtacagtatgcgtgtatgtatgtgtgtgtgtgtgtgtgcccgtgtgtaattacgccctaccactcaatgctgtgtgcttgctctgtgctgggctctgggcaggtgcctgcagggtagtagcatgtctccatcttcataactgccctgcaggctcggtcatgcccttgtttccccaagaggaacctgagctgagggcaggtaggcactcatccaaaactgcctgctgtagtcagggtatagccaagagatactgggtctgaatctccctccacccctagccagaggtgagactgacactaggaaggccctgtggttggccagcctggcagagactgaatctgtgtgtgtttcccttgtccttcagcagaggg

SEQ ID NO: 102935 - DNA, 1962 bp, Homo sapiens
tcagtccggctccctgctacccctgtgaccaggagcaccttcatgtctgctcgccctgtgatttggagagtgtgtttgatgcgcttggcttctgctgatggcctatcctcccagttctggccagaggcagatgcggtgggggcctcttctccactgcccccctgcctgcacctccagcaggtggcccagtcctatatttccattgctttgctctttcttgctttaaaataaacaacaaaggcaacagactctaacataccaaattatctttacaaggacaaaggtgtaaaaatgcaaattgtgcacagtagccttgatgctctgaggtgggtcctgtgtcttcagcccaccagggccaggctatgtaggacggggagctgtgaatgccagtcagtcctaaagggcaggcccaccctggcctctgctcagtgacctcccctcctagggctaaggggaggtcagtttctggttggagtgccattcctaaacagaccttctcaaagtgggagagactgtaagtggagctcagtttgttctgcttgttcctgacgggcaggggacaggggaggctgtcagcgaagagccactcacctcttttgttctcttctttcattcttagctttttgaaaacctttaggagttagctggtcacggcatttattgaacatctgttgtgtgccaggcatggaaaagggtgccatggggaaagtcaagatgatggtgccttgattcctgctcccaggttggatctgatgtcccatggtatcatgggacagtagttggtgccaaggaggagtgccatgagctggcagacgggagcaagttctggggtttggtgggttgggaagaattcctggagaaggtgagtctctagagaggcctgcaggcccatttagacatggagcttggagagtcctacagcttttggatactgaggtgactggggtggatgaaaaagagactttgaggggagagagcttgggaaagcagctgggctctgagggttgggctctttcctgtgggcagtagggagagtgatgtggtcacaggatctctctctctctgggctctaaggaaggcacaattttccccccatcatcctttgaagagccttcctgggaagctcactagatggctgggggatgccagcctcacaccttacagaactgcttcgcttcttctggcatttgtatcaagaggggctgttcacctgcctttggtcaggaaaatgtttaaagcctcccgaggcctccctggtcagtgcctttcctggctcagagggcaggatgagagatgcatgatgaggcctccgagcatcaggccccttcagggcagcaccatggtgtctacacatatcaggcttctgatatgtctgccaggcttcgaggtgcctggcagtgctcagttggccctcacctgtgagcactggcaaagaatggacaagtggtgcagcctggccctcacacaatgccgtcatgcccacctgctgcctgctgtgtatcttcctctctctcaggggcccccaggtttctggtaccacttttctttggcatccatccagtcttctcagcctgacaatgggcaccccgatttcccgggccagccttgcttctggtggacgtgttcttttcctgtggttggccaggattgactgaggcagcttttatctagtcagaaaatttctcaaaatactaattccacccaagtttacggttcttagaaacctgttgtttcctggtcggcaggacatttgtggtcttttctggggcactagtcagagctgttgcagtagcacaagcatacatcttcttcctcaggctttcactgccccaggctgatggaacaaatggccgtgagctgtttctggtcttactgctggagcaaatggaggaaacacacttaaagagacactggaaagttgcatcttgtaactaaagagctcttttaggctggcctgagaat

SEQ ID NO: 102936 - DNA, 2283 bp, Homo sapiens
gggcctgctgggagtagagagatgacagtagtcagcggcatccttccttttcctcctgcccctcttcaggggcctcccagagcaggggcttcctgcttcaggaatgggggtggctctgggttacacaccacagtccaaacaaccctccctgctgcctgccctgccagcttatccaactgcaggggtcctgttctccaagagctttttcccagcactgtggcacattgtcctccctaccttgactcacccagcccctgggctgtcccatccacagcagcccagctggtggcaggatgagggtccttttcacatgctctgcgatgttcctggcaaacttaccccactgttcatgtctgtctgtctgtctttctgtctgtctgtggcctctctgaggtcttcagtcagctgtaccagagaaagtttgcttccccagaagaggaggaatggaggctggggcactgtctgcccaggtagatagagccattctttaagagctttttcattcatcccttttgccctattgacgtgaaagaattgaaacttggtgttctttcagtctgactggcttgaaacttggtatgaaaccttgggttgacttttagtatttgaaatcagggtcattttaaataggctgtgccaaccctttcagacacacaagatctgaaaggagcagaaaatgggccttgggccttgagtcccttttggtggctctcatttgaagagataacacatccctggactccttcctgtggtgctgcccccttggtagtgggcgggaaccttggcaagcacctcccccacctgcttgcttcacaggccagttgggcatctcatctctgtgtacatagcccctgcctctccagctctgccacagcagcccaccccagcatcatgacctgcaggtggcacccaagactgtggtgagccccattagcagagccttcctcagggccacttaggtaccttgattaccccttaaacaagggtttgtctagaatcaccacaatgccccccagggccagtaccaatctctgctctctggttttttagatggttggcagttccagattctcacatctgtgtctgagaggctcaggaagggcctggcaaagtgtagtcagcagccttttgtccctgccaggtcccttggcttgtgcttgccctgttccactgctgtggatgttattttaagagtctcagcagagtccccactcaattggtggtcgttcttcagggagcagaagcccctgcacagcatgccgtcctttcttgcccacacagttcctggtgaggtctggccaccttcactgcctgctggatggatcctggttccttcacattgcagcatcaagagggtgttagcactttgagagtaaatatctacttgcctaaaccaatccttagttttcataatgatcacagctgggattccaccaaattggcaattcctttaggcccagagcccaaaagagcctgtgagccggtgagctcgtggggcagcttgccagtcggtgaaatcatcctagcaaggcttgcttcccggagcttgccgcaggatgtgctgctgagctgtgcagtgacttcagctagtctcaggctggctgaggagacccagccctagcttgtctttcagggagacttcaactgcggggcatggcctgctgtctttcagagactctgaggcctcacgagcattgtctaagccatcggtgttctcactgtcagggccagagtgaatgctgcagggctgtcacttgtgtgcagggcactagccacgcctttgtgggatcccatgtatgtgtcagggacagaggtaggaagacaatggcaatcgtgttaaaaaacctgaagtgggggcctagagcagcaaaatcatttggccaagatcacccaacccctaagtggcagatctgggatgggaatgtgggtctgggagcccaacccttaagctcctacaatgaccctgcgtggcctctagagggtccccattgctaatcctccctttacacacagccagcaaatgggctgccccacctcttcttgatcccctcatgctggggactcaagtttgggacattttgtgagggctgcaggcctgctcataactgccattcagtgctcatggagccttgtattctggctttgtaagtcagggaagagcctttcacaagcgtgagagagaggttctggtcaggtctgtgctcctccactcaggggtcttatacacgtcccaagtcctcatttctcattgttctgtcagcccagctgatactgatgatccat

SEQ ID NO: 102937 - DNA, 1006 bp, Homo sapiens
gtccgtggcctgttaggaactgggctgcacagcaggaggtgagcagcaggcaggcgagcactaccacctgagccctggctcctgtccaatcagtggcaggcatccttagattcttataggagcgtgaaccctattgtgaactgcacatgtgagggatctaggttgtgcgctcctcgtgagaatctaatgccagagaatagtttcatcctgaaactatcccctccagcccccacagtctgtggaaaattgtcttccatgaaactggcccctggtgccaaaaaggttggggactgctgatttaacacaaagcctattttatgataaagtgttgaatatctcatgcaagaatattgtactgcatatcactagctcaggaaaagatcaaaattcaaaatttgaagtgtagtttctactgaatgcatatcacttttgcatcattgtaaagtcaaaaaaattttaagttgaaccattgtaagttggagattgtcggtatgtctagtgacctgttttcaagttttgatttccttttgctcctcagctgtgtcaggttggctgcaatgtctgggaaaggcattcgtcatctctgttactgtgttttttatttctagcctttgcatttgactcttgcttttttttatctcactgctgaaatttcctgtctcttcatgcatattgttcagcttttccactacagcctttgacatactaatcatatttatgaatcatattaatcttagttattttaaattccctgacatgtagtaccaatatctgggttatctgtgagtctggttctgctgattgatttgtctcttgacgatgtacttttttctttctttctttgtgtgtcttacaatttttacattgaataccagatatcacgtgtaggacagaagaaactgaaataagtaatatttatgcctggaataggcttccctcttttgtttctaggcttttagtagggaaagttgagttaggctagtcagaaattgagctggcttgggtt

SEQ ID NO: 102938 - DNA, 1012 bp, Homo sapiens
tttttgtttgtttttttggggggggggttaggtttaataggcaaaagaaatagaaaagagaatagctgtctctctgagagaggggcggctgagcgggtcttccctgaagctgggtttctgactcagtctaggattgctgttttcttcctctttatgtgttctaaggactctggctgaattcttgaccctctgcctgctttccataaaaattgtgctctgtgtgtctttgtgtccaagctctcagtgcctgatgtgaaccgctgagaggcctgcatcatcatctgattcctctgtctcccccgtgcctagcacagggctgatcccagcattatggcttaccctgtttggtgagccacattttgaacacattagaaacctggcacattttttaataaagtgatggtatcccctgtaagatgggtgccagccctaagctgtgggacgcaggcaacttcttgagctcacatgagaagacagtgtagtgtggaaggagctaggacctcctggcattcagtcattagggccacctcaaagggtagggggagggggcagcccatggtaggctctgggcctgggggaggggagatgctcttatggcttttctttgccaacaccactgggggcagcgatgcaggggagggagaagggcaatggctccaggagaaggagtgatggtggagaggcaaggacactgagggagagcagtggggtgggctgcaggggagcagggagggaaggtcagactaatagcaggtggctgaggggaacatagggagtgaatgctcagattctttcctcaacgagaatagtgatggtgggcaacctggccacacacctgatgtctgcagataggcttcgacttagcatgcggagaactgggggccttggttgttgctgactcggccctgccccagcaggccccagctatctccaggctgctactacagtagggagagggctcagccatcgcataccacctcagagctggtgctgctggctgcttctctggcct

SEQ ID NO: 102939 - DNA, 1033 bp, Homo sapiens
agagggagttggggcaggcagtgggctgagcactgagcaggggagcaggtatgatacttcgtgaaccctggctgtgttttatgcgatgctggtggtggcaacacctgccctttgtgggctgcttccccataccccagccccagaggtgggacagcctgtgccaccgttcagaggggaagacccagagcccagcccataacttcccctctctgtagcctctgggtccctcactgcatgccagctgggacagcctgtttcatggagcgggagacctcggttggggcagagccagcactgggccctgtgcctcctgctgctgggtccagcatccactcagcaagggcattgatccagccgtgctgatcacttcaccaaggcgcctccgttactggtggtagaccactgcatggacagggcctaaaaccagggtgactttctttcccttcttctcaactgtaggaaaaaacgaggagtcattggagagtacagaaggcttccgggctgcagagcaaggtgtccagaagcctgctgcagaaaccccagcctctgcttgcatccctggcaagccctcagcatccacacccaccctgtgggatgggaagaagagaggggacctcccaggggagccagtggccttcccccaggggctgccggctggtgctgaggagcagcggcagtttctcacagagcagtgcatcgcctccttccgcctgtgcctgagccgcttcccccagcactataagagtctctaccgtctggccttcctctacacctacagcaagacccaccgggtgagtggctgccgggccaagggggcttggatcttcccagggcagctgggcatctttgaaggttggtgggcagagctaagacagattggagcttcacggtagcagcacatgggagggatgggcgaggagagctgcaggaggcagggccagccccaggagtgggccagcttgccagggaacctggtggtgagggcccagggtcacagccaggaatggagggaggagtgtagggggtctcacag

SEQ ID NO: 102940 - DNA, 1065 bp, Homo sapiens
acagagcaagcagcccaggaaggtggccattctgggctggcattggtgtaggcgagggccagagagggccaggtatgctgggcaagcaggggtgacctttagggcctagctgtgaggactcagtcaggtcctcctcctagaggtctcctgctggctccccccagcatcctcagtggaatgtttgaagaaccagaatggacagttggccaagagatgggccctggcttggcactggctatgtgcaggaagtggcacttcacagaattctgtttgggggactagatacaggggtccaagaaggtaagtgctgtgtccccacagtgaccggtatgctcatgtgacttggttgatttcctcagggcacagcaggtgacacaggtctgggagggagggagtctcatcatctggggctttggtctgtagttcaaggtgcagtgcatgctagcaaacgatggccagctccggcttccctggctgttggtgccacactggagcctggcttgctcactgctcagcctccacttggcagtggaccttacctctgtatcccaggccttctgcacccaggtggacctgggtcttaataaaccccaaccagcatgtcctcactgctgaagccgtctttgggcctgaggggcaatggctgatatgaactctgttgggctcaccattgctttgggaactttcccctttccctcttttgggagcagcagagcccactgcaagagcccacacacacatcagtggaacggacactagtaaccattgtcctgtcctcccccacctctggtgtccttctgttcaagtgcctcctcaggcagccatgcagccccctccagctgtggtcagctctgaccaggatctggtgttccctagtagtgagctcagacccttcctcatcctgttacagggtaccttctcaagaggcagatgtcgagatggaatttcgggtacaaaatatgtattaggaattggcacctgtgcaagggaagtggggaaggacagcaggtttgggtgggaggagagttgagtagcgatacgggccccacccacccaccctccact

SEQ ID NO: 102941 - DNA, 1032 bp, Homo sapiens
acagatctgcttccaggaggcagctctgcaggtgccaagtgtgcctcaggtagcctcgggccactgagctcattctagaccttgcatatgctgggtctagggtggttcccattggcttctgtgtttgcttcacccagaaacctttgctgagcaccagttaccaccaccaaattgaatgcaggttgttaacacctagctcccctgagagcctgagttaagaccttcctgctgctctggggcatgccatcctgggggctgcatgtggctctgcccagacctggggtgtcagctctgctggcagcagcttgttcacagatctgggggacacaactccatgttgtcactgactaatgtggaaccattaactgggaagtagttaccactttccaaacacagctgtttgttaacaaacacttcccgctgtgtatatttgacagcagcacatttcttcataaaatcctgcctgtgggcttggcagtgcctttttcttgttgccatctcacagctcactggtggactggagcatccgatgtctgcctcttcaaaggggcccacaagcagagcctgcctggagctgtgtggttgactcctgaaccctcaggtctttcacagacacctccaggtgaggctctgcctgcccaggccttggaaagaaaccgccttcagggcacagtgtgccacttgcttagttgctgacagcagggcttttgggggaggaggagagaatgtgggctctgaagctggcctcacctgggttcagatcctcgctccgcatgggaactcttggaggtccagggctcttctttcctcgatgagaatgatagtgatatgaaagcagaattattgtgttaatgaggtgagggatgcagtgctggggcaatgtccaacataccctgcactgccctcagccaacaatccttctcacccatatagtgagacccatttcttcagtgtcagcatctcccatggctccttactcctctgccaggccctctgagggctccctgcctggggcatagtggccaagggcta

SEQ ID NO: 102942 - DNA, 1032 bp, Homo sapiens
acagctggcccctcactcccctctacctccaagtccttacctatccaccgcccctcccagcatggccagctcccagctggatgactttggcaggtcatacaccccctctgagctttggtttcttctgtattttccttgattccctcttactcatggagaaactgaagggcagaggtggcctgaacaggagctgaggagagcaggtttcaggtctggaggggtgtaacaggccaattctcagggtacgtgggcaggcaggtccccgctgagagccagccagctggtgggagtgtctggatccatggctcctcctctcccagggtgtggtcttctggggtcagagtaggagcttgagatcctgaaagccctgcatctgcccaccctctctgttttggtattttatagacaagtaggggtgttattggtaatcaatctacatgataccaagggatttgctgcaaaagagaggtgctctcttatctgcatgcccaggccacagccacctccccacagcagaaactgtttcttgtctcatgtgtgtccttctagagggcatctgcccatttacaagctagtgcacatagatgcgcataaaaggcaaaagtgcacacacttctgccccttgtattttttcgctaaacaatatctctaacagtatctcttggagatactgttagaacccacccattctttttgatagctactgcatagtagtcccaacatagggatgtcccacagtttacctagccatccctcctttttttttttttttttttttttgagacagagtcttgctctgtcacccaggcttgagtgcagtggcgtaatcttgggtcactgcaacctccgcctcctgggttcaagcaattctgcttcagcctcacaagtagctgggactacgggtccacactgccacgcccagctaatttttgtattttttttttttttttttttttttagagacaaggtttcaccatgttggccaggatggtctcgaactcctggcctcaagtgatccgccctccttggcct

SEQ ID NO: 102943 - DNA, 1125 bp, Homo sapiens
accgctgcttgtccctttgctcacacttcaaggagcataatacctgctgtgtgccaggccctgggccagctgtgtggtccaaaagggctcaggtccacaggccagcctgcaagcctggattagtagtcacctttcaaagaggtgctaggaagtaaagtgacttggccatggtcctatcactagtctgtgctggaggaggggtgtgtacttcactatgtatagtgtggaagcccatgcgttgtgactggtagcctcaagtcaggggccccctggttcctacaccgggattggcccagctgtcctagacaggagtgttatctgaatggcccattggctggatggggaggatggaattaggtagcagtgggcagggggatgtgggcatctagccctaccataggaggtgaggctgggattccagactgagagggaaccagtgctaggctgtggcatcaagcagggattcccttgggttgcgggactacactgtctgctagcctgagcccccacccccttttggtgtggctccaactggctggctagctgggttgtaccatttttccttggtagcctacaggcgtgtcctgggctggggctcttgaggctgagagcagtgacaatggaggatgctaccctgcctgcagtgccacagcagctgggcctggctgtgcctggccttgttgggggcctggcagagagtagcggcccatagtagcagtggcaggaccagcacttattgggggcttgatcggggggtgcctccttaggtgacatagcatgtccgtgaggcttaggtactattatcatcctcattgtacagacggggaagttgttaccaataggctctgcaggctgggaaaaccaaagcccttttctaccctctgccccctgggccatcagaggcctcgctcttccccttggacagcagtgcttatggctgttttcaggccctgggccagctgtgtggtcaaaaggggctcaggtcagtgccactccccaactggttggctgctctgggtgccgggagagaatgctgccaaagggatgcttgtcaagtgcttgtcttctgcagcagcaattgccagtattcctgacacagtgggccagggccccatgggagcctgg

SEQ ID NO: 102944 - DNA, 1057 bp, Homo sapiens
cattctcctgtctgtcctaggcccctgccatcctcaccttcctccagtggcccatccttcctccactcagtcctccaggctgtggctgggtcactgcccatccacaagagccctggtattggtgactaagatcccagttctgcctcctggtgatggagaactgtggggacagccatcttggggcatcttttccccttcagtagggcactggtagcaacaacagccctgtgcacaccaggtgccgcatgtgccgtccccgtggatgtgcacgtgatccaggcacagctgtccactgagatggaggcagccccagactgagggacagggatccttgagtcgatccctgctgtggctgacccaggaaggtcatttctgtcttcctcatctctgcgtcctcactcatggctcacacagagcatttggactcagtgacatctaaagttcagcacaggctggacaatttctgagtagcagaagctctagcctgcaagaatcaagtggagctgtgggcatctggacaggatggtttttgggggtctgtgggtctagggaggagaaacgcacttcactctgtctcgaccgttggggaaaggagaggaaactggctgactcggaactgtaaggctcagcagtctctgctgtcacactctaggtagaaaaattgccagacacaggtcacacagagccagtgtcccacagcagggaggcaggtaagcagcagcaaggccttgtgcctccaaaccaactggaagcttcaaagctcccaggctgagaacggggactgttaacactgaggaacattcttgccacggcaagaaaggagccagggccaggcacggtggctcacgcctgtaatcccagcactttgggaggctgaggcaggtggatcatttgagattaggagtttgagaccagcctggctaacatggtgagaccccatctctactaaaaatataaaaattagctgggcgtggtggtgtgtgcctgtaatcccagcaacttgggcggctgaggcaggagaattgcttgaacccacgagacagaggttgcagtgagc

SEQ ID NO: 102945 - DNA, 1003 bp, Homo sapiens
cagaggcttgtgtcctggacatccaggtgctttgtgggtaattaggtcccacagggttttcctgcatagggtgctgacagtgccagtaagcgcagctctttgagcccagagaatcctcaaggatcagggcaggcagtctcaccagcctctgattgtcatagcactatcacatgacgctccagggacctcttggtatgtacacaagcacttcctggggggttggggggtgacagggtaaggctcagcttagtgaggaacctccatgctcagggcctgagtgtttttacctgtcagacatggcagtatccatctgatggggctttggagagggctggcacagatacaggcacagagtgcaggacatcgtgtggtgctgggagggggaccaaggaagctggaacccacaaggcctcggagcccagctgggagcaacattctcccagggaagtctccccagaggctttactcagcagaggcttagcacagaagccctgagctcccctcttccaccacaggactccctcctgctgtgatagccaggcactgggaccccaagctgcccagcccattctgagcctcagtgtgttcatctgtgctggtaggtggagtggtgcctgcagatcccttctttggcaatgtgtctgagagagcacctatccactctactctttctgtgggaaggcatgcgcgctggggagagctaggtgctgcccgtgatggacctggaggcctctgggatgcaggggactagtttccagagagccacacactcaccacagacaacacacagtttcttcctggcctgggtgtgatgagcagatgttctcagcttcctttggtccaacttgatcttacaggaagtagataaggtatgaagtaaggtcatgagctgtgcaaggtgtgagtgtcgctttggtcctcgtgtctgctacagccctgtggacagccgggaagagtggcccaactagctctggagctagtcgggccttggggacaggtccca

SEQ ID NO: 102946 - DNA, 1945 bp, Homo sapiens
cagagggggagaaagggggtcccagctgtgtgggaggaggaagggagtttccaggtggggttgaggagggaagggaattccaggcagagattgaggattcggatggagggaagtgcaggtcaggggggtcaggcaggtgggagggggcagctcatggggcctggctccaggggaggaggctcatgaggaacccctgcacggctggcatggccctgggcccagcttccagcagggacagggatcctggagtgtggcaggaggtgatggtcacccaagccggggtccctgctagaacagcccctcctaaggggaccgcctggcggtccatccacccatctgtcaggctgctgtaggtggcaaggcctggggccaggcctcgaaggaaccccagggctaaccaggcatcctctccctcaggaatgccctactcacaggagtggactgcaaagtggtcgtacctgtaccccctggccacacacatccccaactccggctctttcactttcaccccaaaacctgctcctcccagctaccagagatggcgagtgggtgcacttcggatcatcgacagcaaaaattacgcagggcagaagtaagaaggcatggatgtgcaggtgatggctggagggcctcgccgcccgaggcccatcatgcttgcctgggcagcccaggctgggggtggggagagtggggcgaccatggggtggtgtgggctggcccagctccagcatcatcacctccacagggacgtgcaggcgctctggaccaacgaccacgcactggcctggcacctgagcgatgacttccgagaggaccctgtggcctgggcacgaactcagtgccaggcctgggaggagctggaggatcagctgcccaacttcctggaggagctgccggactgcccctgcaccctgacccaggcccgggctgactccggccgcttcttcgtgagcctcccatcagggcccaggagaggggatgaggggttagcctccccactgaggacagcaccaggggaggcagacagaggtgtcctggagggtggggctggggtctcaggacccctgcagggttggcctcagggaggggatgacagaacccgaggccactgggtgacagccacctgctgctctgcagacggactacggctgtgacatggagcagggcagcgtgtgcacctaccaccccggggccgtgcactgtgtgcgttctgtgcaggccaggtgagcccccaggctggggccggtatggggattggggtcaggggtgggctcccaacagtggcctggccctgactcactggctcctgcagcctccggtacggctcaggtcagcagtgctgctacacagcggacgggacgcagctcctgacagctgactccagcggcggcagcactcccgaccgcggccatgactggggcgcacccccgttccgcacgccaccccgagtgcccagcatgtcccactggctctacgatgtcctcagcttctattactgctgcctctgggcacccgactgcccccgctacatgcaacggcggccctccaatgactgccgcaactaccggcccccaagactgggtgggtgccatcccgtgccccagaccctgggaaagatcgggctgggctggggtgcacccccacgtgaccctccactctcaccctagcctccgccttcggagacccacactttgtgaccttcgacggcaccaacttcacattcaatgggcgcggagagtacgtgctgctggaggcagcgctgaccgacctgagggtgcaggcgcgggcccagcccgggacgatgtccaacggtgaggccagggctaggggctgctctggttggcatggggtagaaccaaggtgggaggctggagccaagtggctcccgttctgctcccaccaccgcaggcacggagacccgtggcactgggctgaccgcagtggc

SEQ ID NO: 102947 - DNA, 1012 bp, Homo sapiens
agtgagactctgtctcaaaaaaaaaaaaaaacagctattacaatatacatgtatgttgtaaaataaccaaaccaacatagaagggtatatagtgaaaggagaagtattgttgtgggtaaaattgtttcaataaatggctaatccagtatttttttcctccaaaaaaacaccttttcccctttgatttagtgtataccacacagagtcgcttagccgattcagtgacttttttgatagctggagaatgcttcctaatggttgcaggtgtgtaggggttttcttgacattttcagtaagaaagtgaatgttgtgccataggaaagctttatcacaggtgcacgttggtagccaactaaataacgtgagtgtcaagtacagtatctagtgagtggagaataactgtaataattacaattacagttgtagttaaagtgaagtttgtatcaaaatttctgtttcaaaggtgaacttttaggaggtgtatctgcggtgtttcttcctcagatgtgatttctctgaagcagtggttctctataactgacttgacacacagtgcatctgatatttcgaatgacttaagtgatagtatcaaaattactatcatatacatatttaaatcacatgactaacctgtgtgtggtattatgcaaactgctcagctcagtaagggaacagaaataagaaaaaaaggacaatattgggagtcttttatacaattcaatttattcaattgaaggactatcttttctttaaaaaagttctgctttcttggtgttaaaataaagcatcttttatgaaatgatggtgatagtaaatggtgatatatggtaaacgtaaatagtaaatgcaagggtagttattgtgatttttaaaaataaagagagccgagaatctcttgttttcctgctgctgttagggagttcaggaaaaagttcctggggcttttgctgttaagaagattcaaatatagagtatttcttaagagtaaatatgagtttattttgagatcatt

SEQ ID NO: 102948 - DNA, 1014 bp, Homo sapiens
cctggggtcatcaccacatttaacattgtagcttatgtggtaggaaggaaattaaatactcttgccatttgcatgtcttcctgtttcctgcctttagaattgtactgggagagattccatgtgtttgtatacttagtttcttactgactgatgctacctgacctcaggattcagttatcacctctctggattagctgccccagtatggctttgtacgtttattttattttgctggggatgtcataacaaaataccacagactggatggcttaagccacagaaatttattttctcaaatctggaagccagaagtctgaaatgagggtgttagcagatttactttctcctgagatctcttttttgtcttgcagatggctgccttctctgtgtcttccctctgtgtgtgtgtcctcatctcctcctcttacaagaacgccagtcatgttggattagggcccaccctaatgacttcatcttacgttaattacctctttaacttcattatcctgtctccaggtgcagtcacatttgaggttttggggttagggcttcaacatattaattttgtgtgttttgtgcgggcacagttcagcctataacaacatccttattcttcagttcatctgctctacctttacctcctccagtgactttcctaagactgtttgatttccatgtatcaattcacttgtctttacctcagattattctgtctactcattacagtaatccagagaagaatttttcttcttttatctttcaaacatgaacagattttctttttatttatttatttatttatttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactctgaacgagcatgctgccttcaagcgtc

SEQ ID NO: 102949 - DNA, 1068 bp, Homo sapiens
ctttttgtattaaacaaatgattgtgtcagttttcacaggtttaaaattttagtagttaagtaatcatgtgattcacgtagatttgattgacgcatcatcattatttaacattagtgcttcgttgttttttacatttagagagacagtataacatactggttaaggtgcaaaatctggaaccagactgcctgggtttcaattttggctcatctatttattacctgtgacatgttggcaaattatttaacatctgtgtctgagtttcttcatctgtaaaacaaggtgataatagcacctacctcacgtctttaatgaggcttatataagttaatgtatgtgaagtgttaatgtatttgtataaccaagtgctaggtatgtgttagctattgttataattgttattatttatgtggcattttatggtgttaaaactattttgcatttactttggtcagagtaaaatttttgtgtttctagtaggtagcttagatttttggttttcccagagactgcttttcccttcttgcccacctatgatctcccttcactatctgtgtacagttagtttaccaccgactggctaatcctggagtcatcttcacctgtcttgccctagaatattatgcctctggccaactggttaaaaccccacttctggattcaagttaatgtatatcatttaaataacagctttgtagaaatgtaattcacattccataaaatttactcttttaaaaacatgtaaaacaaagtgtataacttatttctccttgataattaaaagatgaatgatcttctggttttgaagaaattgaactttaacagactctaaggcaagattattgtagatctaaatcattgtgtagatcctggatttcatctcattacacctggggcaggaactgtgtattctatgtagccttttattgctgacatttttgccttacattttttgtattaaacacataggcacagcttcttcaaccaagcggagcacttctacaggtaataaagaatccagttctactagagaaagattacgtgaacgtacccgattaaaccagagc

SEQ ID NO: 102950 - DNA, 1322 bp, Homo sapiens
gagaaccaacacagtacaagtgaggaactccaggcaaccctgcaagagctagctgatttacagcagattacccaggaactgaatagtgaaaacgaaaggcttggagaagagaaggttattctgatggagtctttatgtcagcagagcgataagttggaacactttagtcgacagattgaatacttccgctctcttctagatgagcatcacatttcttatgtcatagatgaagatgtaaaaagtgggcgctatatggaattagagcaacgttacatggacctcgctgagaatgcccgttttgaacgggagcagcttcttggtgtccagcagcatttaagcaatactttgaaaatggcagaacaagacaataaggaagctcaagaaatgataggggcactcaaagaacgcagtcaccatatggagcgaattattgagtctgagcagaaaggaaaagcagccttggcagccacgttagaggaatacaaagccacagtggccagtgaccagatagagatgaatcgcctgaaggctcagctggagaatgaaaagcagaaagtggcagagctgtattctatccataactctggagacaaatctgatattcaggacctcctggagagtgtcaggctggacaaagaaaaagcagagactttggctagtagcttgcaggaagatctggctcatacccgaaatgatgccaatcgattacaggatgccattgctaaggtattgtttaaatagattaaaatgttccggacagcattaggcagctgccatgcacagtgtttactgagaacctgggttactggtttggtttggtgtgttattagcttttttttaaaactgatatttttaaaacttgggaatggtttccttttattggaatagtgtgaaaagtattcttaagataatgtcactttctctcacttgtattttgtttctgttttcctgcctgtgagaggatatggctggtattacagctaaaaccagaatttgtccctagttctgagtattcctatggagcgggtcatgaaattttacctccccccgcctcatctcgaatctgttttggtgtaataggtggagagtcagtattccagtctgtagcatcagcagtgcatgtttcctcttatcttgctatagtaatagtttttcaaatagagatctgttgatagttaaaaaatatttttggcatatagaggctcctgtttctcagaggcctgtgatttattgctggcagggaccttagcaattatcagtccagacccttgttgtacatgcctccagcataatagtgaggactcagttggaactgctaccca

SEQ ID NO: 102951 - DNA, 1063 bp, Homo sapiens
tctactaaaaatacaaaaattagctgggtgtggtgccaggtgcctgtaatcccagctacttggaaggctgaggtgggaggatcgcttgaacccaggagacggaggctgcagtgagctgagattgtgccagtgcagtcaagcctgggtgacagagtgagactttatttcaaaacagaaaagaaaaagtcacagattgatcctgtgtccatggtaactgcctggcaatatcagcatgattgatggagatataaccagagcgagaatggattattttttgtcagagaataatggggttcataatcaataatgggactcaaaagttatgaacccattattaaatgagtagggcagtgcccagagttgttcagaacaaagttggtctaataacattgagaacagcagtttgcctgatctctagaataaaaataacattgtaaaaattgagttataatttgtaatttaaaaataggaagatcatagtagtagttcttttccttggtcgacttgaatgttgcttttgagttgaagacagtagatggcagtgtccctcacagtaggaacactgaagaggaaggaaactgctgttagaggttcgagagttgaagagtaatgctgctttcttgtgtgaccacaaatcgtgctagatggcagttttgcaaactagtcttcacaacaagaacttaagcacaaattcctttgtttccaggaaaaaaaaatacattccatttcagagtaaaaacgtagtcatgactgtagagattgtaaagtttaaatcaaatccctacagacacttttagtgcattttattctgtctgagtatttccactggctgccactttcccttttacttaaatggatttatttatttatttatttatttatttatttatttatttataagaggtgacagtaataaaaatgtagtgccgggggcagaaaaacaccttttaaagaacagtgattatgtgaattctgtggccatgaatgaaaaaaggtcaataaagagaaaaagagcaaaggaatgaatgcaacttgagaatttatgatcagtctaagatgacca

SEQ ID NO: 102952 - DNA, 1054 bp, Homo sapiens
ttttgattggttatgtaccaacaaagtgaatttctaacggttttactttttgtttcaaaattaagatactgtggaaggaagtgatttagaaattgtgatttttaacttgatattttccaaagaaagtaatatttgttattacttgaatttaacattttttctgttaaagttttgtattaaaattttttatagtctttggacaggataacttttttcgaatgtcatatttaagtatcccttttctttgtattattactctgaagattgttgtgagaatagatatttaaactttggtgatcttttcagatacagttaaaaaactccaggaccaaaagcacgacatggaaagagaaataaagacactccacagaagacttcgggtaggataaatcttcatgtattgtcttgttagaaaacggttttctgaaatctgaggtgtagtcattgaccatgttatcattcatcttaagttttggatacagtgataatactggccccattgggctttgggcagaaagcaaatgctatcatttcaaattgggattggtgctagattttgggtagaagaatgtactataggttgagtacccctaaccagacattctgaaatctaaaatattccaaaatttgcaactcttggagtgatggcatgatactcaaaggaaatgcttattggagcattttggatttcggattttcagatttgggatgcttagctgttaagtatagtgcaaatattccaaaatccaaagaatcttaaatctgaaatgcttttggataagtgatactcgacctgtagaaatttatgggtagtaattttagaaagatagatttggggaaaaagtgtaagaaaggttattagcttttggttataaggtgccccaaactagtctgttttcatacaagttttcttcattttgtggccatgatccatcttgccaacagcaatgcagccatgctgcagggagtagggagaaagctactcagtcgtttgggtcataccacagttgctcaggctgctttcatggtgtaagaaaattgctttaggggtgta

SEQ ID NO: 102953 - DNA, 1004 bp, Homo sapiens
aaatcatgtggagagtttttaaacaggtaaaattcccagacctcatcctggtaaaccataatctctggggactggggcctaagcttgggattgttagtttttcaaaactccctgggtaggaattctacttctagctatgtgggagtaacaggctggattattctgccatcacaaacaacgattaatagaaagatggacaaaatataagaaacaattattttcagacattgtacgtaactgtgatccctgaacaaaaattttaaaatgaggtaagtcctactgtggcccacagtcttttcctggaggcaatttccaggtggtggtgcagggaagatgaacctacatggagcagggaagagaaaaccaattggatctgagtagacacaaatcaacattcaaggagaaggcgactgctcgaatttgcagggcagatactgggaggagggagctgcatagagaaaggagtatagaaatctgcgtaggcatccctttgagtcttttcctgaataccaacctgcacctgcattgggtgaaaccccacaaggataattttccaggaacagccccgcaagaataattttccaggaacaatttccaggaacagggagctatcacacaaacacttctggtagctcacctagggcaggaaatcatttgagttcccaccagccgctgtggagacacctctttgaatagatggcattcattatagactcctaaaggaccacacctgaaagtatcatagaactaaataccctcagagtaaatagtattctagatctgccgtaaaagatctttaaaaataagatgcagaaggaccaaggagatccttaagtagctatagtaggcagcctctaaaatgttccccagcgatcccccattggtggtagttgctccttgtgtaatttgctcctgttgagtgttggctgcagctcgtgatttgcttccagtgaatatggcaaagcaaaagaagtggtgggataaggttatcactgctaaaatcg

SEQ ID NO: 102954 - DNA, 1039 bp, Homo sapiens
gagtagtaaatggacctgtgttcttactgtgacaagtgcctctgggcagatttgattctcacagtggaaatacttcatgaaatggcagcagcctggattgtggctgttaaaatttaacacaaataatttttaaaacaataccctatttgggttctcagtgcgtttttgtgtattttcagaaagtaagtgtgaggctgtgacagggacagtctgtcagattgaggcagacttggatccttaaccatgcagtaagaaacagactcagccagcgttgggcacatgtatcagcaatacatttcatgaactttttttttttgcaattgtgcttatagtgtgtattgtaaaagagaaaattaagataacttagacagttttcatgtagggaatgaccagggcttatgcctgtgtccatagcaagcaccttgttttgatttatttgtcttttcaaccttcgttttcactttcttagcttgctgtgttcttctttgggagactaaaattttttagggaaataaccatggtgtcaaaattatagaatggaaaatttgattaaatgtaaaacattgatctttgtttcctactatttccatgttcttttgcctttgttttgtctgtcagattttgggcataatatactcttcctttacgggtaaatgccaactgccaacagagttcagaattctgtgatgcttgcttatgggttgtttacacagagatgatgtttgttcaagataagaacactgtagggactctttaagctatatacatcccatctttattaagctcatccttccactcccctaggcctccaaagtagcaaataattataaccaaatgttcctcatacccttagaaaataaattttagccagacttggtggctcatgcctgtaatcccagcactttgggaggccaagatgggaggattgctttagcttaggagttcaagattagcctgggcaagatagtgagacctcatctctgcaaaaaactagccagaagtgatggtgcatacctatagtcccagcccttcaagaggc

SEQ ID NO: 102955 - DNA, 1028 bp, Homo sapiens
tcttaaaggcgagaactattatgccttagaatcctgcaccttgcataaccttaccctgtatattttacaataagtaatttttttaaatgatgagatggtaaaggacataaacggttattttattttattattattatttgagacagtgccactcttgttgcccaggctggagtgcaatggcgtaatctcagctcactgcaacctccatctctagggttcaagtgattctcctgcctcagcctcccaagtagctgggattacagacacccgccaccatgcccagctaatttttatatttttattagcaatgaggtgtcaccatgttggccaggctgatctcaaactcctgacttcaggtgatctctctgcctcaggctcccaaagtgttgggattacaggcgtgagccacagcgcccggcacattttaattttaaatgcactttgtactgtctttgccactttccatgtgggtgatttttatagagtccctttcttcagttagcaaagaattctgacaacagtgcatctatggagccataaactaaaaatcaaatgtatgaaaaactatgtcttgcctttgtattgccttaccatgtatatttcccctgtttaaaaatgcaaactttaatacttttctcttattctggtgcccaaacaaaaaatatttcaactttgggttacttgttttcagagaagaaaggaaagaccctctctcagcattggccagagaatatggaggatcaaagaggaacgccttgctgaagtggtgtcagaagaaaacagaaggctatcaggtaatcatatgattcttttgtcccatgtgagtaattggcaaaccaactgctggagtgtcgtagcttactacgtgtcacacattagaaatgataagtcctgacctggcatggtggatcacacctataatcctaacacattgggaggctgaggcagatggatcacttgtgcccaggagttcaagcctgggcaacatggcaaaaccctgtctctacaaaaataaaaataataataag

SEQ ID NO: 102956 - DNA, 1019 bp, Homo sapiens
tgtctagctataaatggatgatcatgcccatcctttggagccagcagttttggttctgtcctttggtctctgactactcacagtctgcagaaaagagcaggttgtgacacttgactagtttatgagagcagaagctgttacgtgacacttagcacatactgctcccagaggccccagatggatcattaatgcttggaacgtgcgtgctttatgaagaagccgtctaatcaacggagatagattccctaatacccatatcatctttcgttaactctcttaagagtcaccctaaaattactgtgctgatcactgtaatttcattaagcatccattacaaaacaagcccttatgagtttagcttttatttaacaaatacatttttctcttttaacttgtgccctgccatttatcatacattgaagctttagaatagtagaatatttgtgttgaaaacatcttggcattctggtttattatcaggtttacagatctgggactgaaacccccacaaggataaatggctgcctcaaggctgttttgtgagtccagggcattatgtaaccagctttcagtactattgctttaagggttgggtcttcctttttttctcttttttaaaaattagtgcctctgtttatatacaattatgtttttaatttaaatatagggctaactctaataatttttaagtgcttatcatgagaagtggtaatccagttccctgcttccttatctctaaaatttctgctgtccagagacaaccacttttaatttttttagccgttgtctttagggtttgatggtacaaggttgataatacaagaataaccaactggaatagggaaagtatttatactttcagtaaacttttctttggttttagattttatatctaagagcttgtgttgcatcactgttttcttgccctggaaaaccctaactgaatgtaatcaggatgcccccaaaggttgatttgagagctttattttgaatgaaaaatctcaatgttttctgataaa

SEQ ID NO: 102957 - DNA, 1875 bp, Homo sapiens
ccagtttcaagcaattctcgtgcctcagcctcccaagaagctgggatcaacaggcatgcaccaccacgtctggctaatttttttgcatttttaatagagacagggtttcaccatgttggccaggctggtctcgaactcttggcctcaagcagtctatagtttgagaacccccttggcctctcaaagtgctgggattacaggtgtgagccaccaagcctggcccagagaaaatacggattaaaaaaaggctttgatcttctttggctagatgttagacctcaagttatcaagtaaggcaagattctgctcttggccttgggtgtcaagtgacagagtgattctttgggtttatagctcctgcagggaactgtcagcggatgcatctttgcaatgctagctctctcctttaggcatctaaacttgtggaaatttttctttcaatgctctaaaccagtcatgaaatacatatttgacacttgttgtgcacaaccagagaggtagttaaatacaaggaggaacagaatgcagtctagagtatgacctttgccctcaaagaactttctgtggttttttttttttgttgttgttttttgtttttgagacagggtctcactctgtcacccaggctggagtgcattggctcactgcaacctctgcttcccgggttcaagcgattctcctgcatcagcctcctgagtagctgggattacaggcgtctgccaccacgcccagctaatttttgtatttttagttgagacagagtttcaccatgttgatcaggctggtctcgaactcctgacctcaggtaattcacccatctcggcctcccaaagtgctggaattacaggtgtgccaccacccccagcctcaaagaactttcaagattatttctgaaacatattattatttccaggccttttaaaattctgccatttccagggaataatttaaccttttcaacactccagtttgtgattaaaaacactcatttactgtactgcatagaagttgcgtttcacgtggcctctgtacttctgctgccattgtgtccctccatagggtcctcaacactctttatctggctgtaccctaccctactgtgttttaataccaaggaaacagcaagaaaagctggtaaccaactcgtatgtaaaacaaaacccaaaaaaataagcatggggtcaggagtgaagtgccacgcagggcgctctgcttgaacaccagctcttctctggggtcctggtgacggtcctgtcgtcactttcttccagtggtggtatcttgttatatttggtccaaagtaaagtgttttatggttcccttcatcatttattgcactaaaggaaaaagtaagtaaactattgagcactgagttgagggctctggagagaagtacaggaaggtggtgccacaggtgtgcaccttttttagttgttttgccattttccctctgccaaaacagtatctagtaggtgtagaaacgaatacaccgacagagtgaaaagaatgcttcagttccttctgtaagcaataaaataagttcatcgtaaggtgagcacactatattgagcatctctttcctgatatcatttccttcctaagctcctgcaagaccatggtgcatttcatatccaggctgctgtactcagatggcctggatgtcccaggtcagactaaatgcactgcctgtgatttcagaaataggaagtgttgtgccagggaagaccagttgtccttttaggctcccgttctgtctcagccggtgtcaggtgcttggagggtgaggttgggtgggtgatcttcctctgaaataccagtaccaagacaataatgatgcattcagaaagtgcataaggtttcaccattgatgcagtg

SEQ ID NO: 102958 - DNA, 1044 bp, Homo sapiens
gccccaggcaggtgcccattcatcactcccagggcattctgtgtttaacagccactacccagagatatcaatcaacagtctcgatggtttttttactctctttcagacattatatcttctcccaccatactacacagaaaaggaacctcactcacctcactcaggctcccaaactctgccacagtataggggggcatcgtgagccagggttttgttagtaactcactcttacctcatgaggctgggctgtgatccccagcaggtttcattctgagtgcactgggttgcagcttaacagtgtggtgtccttgtgaagctggaggaccagtgaggaccacctctgcctgaaggtggacctggggacagcgctctgcacggctcagacaggcatgaggaagtggatgcttgcatgtgtcagcagagagatgaatcagagcccttggcttcttgccctgtgtccataaaagtggcatttccttaaatagaccagaaccttaatagctatttaaagagcatgtggtatttgggagtatattttatggcccttaattaaacttcaaacaaattaaaacatttagagatcttttatgacatatttttaatcttttttgtggagatttgtataatctcttggctttcacatcccaccctaaggccacagacagaaggcagggtcacatctacagttggggtttccatccttggtcaagaagcagtgagtggaaaccacccagccagtcccttggaggggtgaggctgtcaggagtctttatgagggtagaaaggacagcaaatggcactgtgaaacaggccctgtctgtcccctgtcacatctcttagttgacatttcctggatgaaggatgtgtgcccttaggagaaaatggggcagagcttctcattcgagtctgtgcagaggccgttttgaaagtttcttctggcacatgtcatctctcttgttttgtcgaccctaatccaaacatggaattatctcgtagagtagaaaagctctaaattgacctgaaaaaaactaagtgcaaaatctg

SEQ ID NO: 102959 - DNA, 1035 bp, Homo sapiens
gacagagtgagactccatctcaaacaaacaaaccaaaaaaaacaaaaaacaaaaaagggggggtcattgattaccacccacatcctctggtctgtactgtcaccccaacaggtcatggtagaggccagcttcagcagcctagggtcctctctttgtatgcaacagctagtaagtcagcaagacgccacgtgttataccaggcccaggcgtgaccacgtaggggcagccatctacagctggtgggtgggacgggttggggagtcatagataccaggtagcccttggacacagccgccctgccctggttttggttttgtgttttggaggccatgcagcatctgaggcctcctgcgtcctccttggcatctcctaagagggtcccagcatgtgttggttacatgtttttcttcctttccttcagaatattgacattacaaacttcagcagcagctggaatgatgggctggccttctgtgccctcctgcatacatatctccctgcccacattccatatcaagaactgaacagccaggataaggtaggccatggagggccagctcctggcacccacctcacagggttggagggctgagaaccaagggcagcacctgcctcagcaggtcacatgccacagcgctggcttgcgattgcctcgtgccatctgggtcttctgggatcaggtcattcatgctgagcccaccagtccctgtcccaccttgtgtggagtatttggttggttcagaattccccaagtgatatcattcctagtgggagcagccagtccttcctgagtgactacatttaggatgaagagcttcaccaggaggggcccaagaagctccgtgaaggcaggagtagtcaggcagtgctgaccaggccaggccagcctcctgccaccttgaggagggctgtcactccatagcccattctgcactgtgggccttagaactggcaagaaacaccaaccctgtgcactccagggcatggtttaatgtttcatccagatagttccttggggacagggtcagggaagaa

SEQ ID NO: 102960 - DNA, 1046 bp, Homo sapiens
gggactacaggcacatgccaccatgcccggctaatttttttgtatttttagtagagaccaggcttcgccatgttggccaggctggtctcgaacccctgagctcaggtgatccacctgcctcggcctcccaaagtgggaaatgggtcattttcaaaggggcaacagtgataccatccctgcactcctgggtcctgctcttccaatgcccaaggcatggcatggtggcagctgtgcccccgcccattgctttggagcacagatgactctgggggcagaggtgggctctgtttaggagggcagtgagaccacccagccaaattgcttctcaaccctagacaaagcctttggccaagagggaggtgctgttagttgggcagcccttctgggtttcagagaccggtgttggctctagactggtctcatctccattgccttaatgccaggtggcccaggagtacccatgcacagcagctgtggggtgtgggcatcttcaggtggtgttctggtaaaattgttagaatagctgtatgaaggaaaccagtgggaggaaatgaagttttcaggatggtgggatgtgatttagacagtgcacatgctgttagggctgtcactagggagtggccttcatggagggtggtaacagcacctcagtccagccaaaatgtttagaaacactcagtctctggtcccagaggatggcttctcagggcatgccacaagttaaaggtcaccttcctgaaagatgaatgagaaagctgcccattctcaagactcatctgcctagggagggtcacagaggcaggatgtaagacacactgtgttgcattcttgcacaagtcatgaaaatggagccagagagcctggacatcagggacttttgcccacagcacatgacaccgacagctgcccagcctgttcacatgctggggaccagcacagcacctgaagccatgtgggacagttgggctttgttcattctagccacggggatgaaagggatcttttgcattgcagagattttatatatattttgtttgtaatgagcc

SEQ ID NO: 102961 - DNA, 1065 bp, Homo sapiens
agagtcccaggaactcggagactggcacagctgctttgtctgccagtgccgtgtgttgtcatgtcactcaccccaagcacctgctggctgctggaagcataccccaagaccccaagccttgactccagctgcgcccacaggaagtccagtcccgacagtgcccttgttgcctttgagccagatccatggcaatggtctccccacagaccgcaggactgagcctggagagagaagttgcttgacggatgccacttgtcaggacagtatgtgagtgtctggagacagcatagctgaccccaatcccccagggctgaggacccctccaggcccctctctcctggaagtgctgcatatgcccctgtgcccagtggttgatgataccaccaccacctgcctacccatgggcccaagtttctgtggctcattacagggcatctgacccctgccacccagcatagacacacctcacagctgccctgccatgcagagccctggccgctggagactcttaaagcccccacagccctccaggtcctccagctctgtcagatggagggctctcgggcctagatcccactggtaggcctcgtggctggcagcagtgctctgggaataaacagctgccctagccccagagggatccctgcacccaggaggcctcctgacaccagccaaaatcctgacagcagggtctgccctcttgagtgtggggagcccctagtcctttaaggttggctgctaaggcctgtgctccaaagcaacgggctggggcagcctgcagctgcccacccaacctggtcttcacaccagattgcacaggatactgggtcttgtctatcttgatggagaagaggggttcctgcccaggatcttacaacacagcaagtagcatagagctctttccttcctcttttttggggaggttggggtcaggggttgtttctttgagatttaagttttcatttttgaggggtaatcaccttcaagtaaaacagtaatagcaagagtgaaggtactttggaaccactaacacctctgcacagggcagttagccagctcaagttc

SEQ ID NO: 102962 - DNA, 1062 bp, Homo sapiens
catctgggttaagaggaaggaagagaatgaggcctcagtccagcctgggcttagcataccaggccccagctgggggcaggttcacattattagcacctgcaaagggctttatagacgttcttgtccttagggttcacatcaccctgcaggctggcgtctggtagtccatttcacagaggaagaagcaggcacagagaggccaggcaacttagctagcaggtggcctgctttgctcatgccattgtgccttccatgggccctgctgcacatggagtagaaagacaccaggagcagtgataggtccctgcctcttgggaacgtataagcaacacaggagggcacagacaagctcaatgcaagggccgcatcctaggaggcaaagtgtgaactcaagcccagagaagtacagatgagtgaaagggtgtagccagtctgtgatcagggaaggccctggaaatggcctctgagccaggccttgaaggctggggaaggtcagacataggaagggaggaacttgggattcaaagcctggtaggttggaaaggccaggacagatcccaggactagtgagtggccgtcttagctggcgcacacagggaagtgaggggaactggggctggcacagcaggagggctcctggggtggctctacacagagctggtcacacagtccaggagagacctgccagatggggaaacaatgtgggcaaggttttcacgtgctgaatgagtgtcatgagtgagtaacagcagagataagtctcttcctctttagactctgaactttgtccaggttcatgaggtggctacggaggagggtcctgcatgccacaagcccatttgccccacctcagggccttagcacatgctgttcccccatcccctctaaggcacacccccactgttttccccagcctaggcctctattttgctatgtttgcttatttttgctatccaccaggagagtgactttgtgtcattcactgctgtatctccagtacacacaccaggcacttactaggcttttgggaaatatttgttgactgaatgactgaatcagacc

SEQ ID NO: 102963 - DNA, 1028 bp, Homo sapiens
gcggggcctccagattcgagacctggaagggctggggcggcgcttggggcggcccagccgccgcctcccgttctctcctccgcagcggcggcggtggcggagaaggaactcgacacgcaccgaccgccctcccgccccagccgaagcggaagctgtagcccgctctgggccggggccatgggcgccccgcgccgcccgggtcatgaggacggaggcggaggcagcggggccgccgctcgagcccggtcagtgcctctctgtgggcccagtcttcaccctaggaacgaaagggacccctccctagcgcggggcagggtccagtcgcgcgaccttgggccgactcccgcctcgcccccacacccgcctggttccagtcagtgggggtttcctgacactcgcaggattgcgacccttgtcagcatggtgggaaggtccgggtagcaggggcaccaccttccccagaagcgaaaagtcctgctggagccgccttgggagctcccatgccttgggaaaccgtggaggactgaggctgggaagggcaggaaactggccgagagcaccgagcaatggaagggccagtgccctggcctccgagactcggcgttttgtcttgctcttgttcttcactttcgttctctctgccacgcggtagcctgagcccctttggggcggagacccggactggtattcaatgtcttggccgttagtttgcttgcccaagacgtaggggagggggaagacgtgattcctgtcctgctgaaggcgcggggttgatgacaaacggagttctagctagtaaactctgaagtgaagtgccaactgtggaagaggtcaacagcatgtgggaccctgaccttcaggtgtcactcccagggagtgttcccttttgtgtctgctgtgtggagttggtgggggatttacaaccctcctcctccagttgtctagccctgtggtctgagacaagatacttgcctttcctgagcctcagaggaggaatggcttacattcacagggagtgttctatgagg

SEQ ID NO: 102964 - DNA, 1042 bp, Homo sapiens
caactgtctttagggataaccctgagcgggcagccgctctactctatacctaactttatccgtaccagatacctagcctcactcagggccccccttacctggcggtgccgggatcaacaaatgaaattgtgacgggaagtcctggcccttggcccaacctcctgctgtccccggtctgagggcccaagccccgcgtctccgccttgccgtccagcctgtccttggtgtggggtgcttggaagtgtgagcaccctctctggctctttgccggccccaagggtcgttgcggcggcccccgggcccagtcatcagccctcttttccggtgccggaactatcgtactggtgccctagtttcccagccggcaggcggagtgaggaggaagcggaggcgagaccgcgctcaacactggggaaaggaaggaggcgggccctgcgcgcagcattttgggaaagagtggaattctgggtgttaggcccgccattcgcttgactcacgccttcgccgtagcatctttcgcagcggaccgaagagaagaaaagtaggccagagccggtgaggctggggacgggcgaggggaggtcgaggcgcctgtgaggggccaggggctggagaaagacttgctgcatggaactctgcggggctcggggagggaagaaagcgggaagcttgggccacccaaacatcagcgtcgcctcactagctcctggaagtaagttcattagctttcccctcaacgtgcatgcttctcacattctgtatctctccaggtgagtgtttttcaaagcttccaggcagtaatctcgaagtcatttctgattgactatctccttcccccaaatcctatgagtttttttttgtttttttttttttaagtagagacggggtttcaccatgttgccctggctggtctcgaactcctgggctcaagggatccaccggcctcggccttccaaagtgctgggattacaggcgtgagccaccgcgcccagccggtcattttttaaaaagttctttgtatctctgccccagtcccctttca

SEQ ID NO: 102965 - DNA, 1032 bp, Homo sapiens
gaccacaggcatgcaccaccacacctggctaattgttaaaaatttttgtagagataggatcttgttacatttcccaggctggtctcaaactcctgacctcaagcagtcctcccaccttggcctcccaaagtgctgggattacagacatgaaccactgtacctggcctgatttgctttttaacaatttcaggaaatgtgcagtggttaagagtgtgagttagaaagaactgggttcaaactccagccaggccatgtaagcgtggtgtgacctcaagcaggagaatagagggaaagggcatgggtttctggggacagatctgcctctgaatggctatgtcacttcatctctttaccttgtaggattttgtggggtaacatgagctgccgtggggaaatcacctgggccagcacttgatgtctaataagtgctcagtaactgttggctttgttgtcttgtattttcaaaactcagctttgtagttgagggaacggaggctcagggaagcctggagatatacctagggttacacttctgacaaatggcagagctggatctcacctataggtctttaggcctattttgtgtcttctacagagtcatgagtgtggcacagtccccaaaacacgttttttgtttgtttggtttgttttttgttttttgagacggcgtcttgctctgttgcccaggctggaatacagtggcgtgattttggctcactgcaacctctacctcccgggttcaagtgattctcctgcctcagcctcccgagtaggtgggactacaggcacctgccaccacacccggctaatttttgtatttttagtagagccagggtttcaccgtgtttgccagactggtctcaggtgatccacccacctcggcctcccaaagtgctgggattacaggcatgagccaccgcgcccagccccaaaacacattttaattgtcagtcagattcaggtgagcctgagttgtatccagtttctgtcttgggtagtctgaccataaacctggcgttcatttgtggcact

SEQ ID NO: 102966 - DNA, 1724 bp, Homo sapiens
aaacttgactgactcctttatctgaagtaacgaccccgtccagtgtcattattcgactgctctggtcctcacatcctgtaggctcctgcccaagtgcctgctcttttccttgtgcaagctcttgcctcataaccctccagtaatttcaggccctttttacaggccttgtggtaccacctccatttctcagtccctagtcactcaacctagagggttctgtctcaccttctagagtatgcactctggagggtcagaaccacatctggtatatacttgtgaccttcatggtgcctttgaaatctgagtgccaggcagtgcaggggaagacagtttggaccagcagtttgaagctgttttcgttagggtttagcaccttcaagagctcttcacatctttgctcagcaggcagtgcagcacagccagggctctgaagctaggccagctggttcgaatctggagttccctgcattccagctgtttgacctgggataactgctttggtttttttaacatgtaaagatgggagcactcggctgggcgcagtggctcacacctgtaatcccaacactttgggaggctgaagcgggcagatcacctgaggtcaggagttcgagaccagcctgtccaacctggtgaaaccccacctctactaaaaatacaaaattagccgggcatggtggcgcatgcctgtaatcccagctactcaggaggctgaggcaggagaatcgcttgaacccgggaggcagaggtcacggttagccgagattgcaccattgcacttcagcctgggcaacaagagtgaaactccatctcaaaaaaaaaagggggggagcactcatacccacgctgaaggtgttgtgaggactgtttaggtaaagtgctcagtgcagtccctggtgtacacagttagtaccgatgattgctgggtaattcaccagctttgtcacaatgtcagtctgcttttctggacttccccctcccaccagtcaaggccctccccaccgctggtgctgttgaccgttaacttattagctggtgatttccttccagatgtccaacatcacagtcacatacagagatggccgagtggcacagctggagcaggtatacatccgtggcagcaaaatccgctttctgattttgcctgacatgctgaagaacgcacccatgttaaagagcatgaaaaataaaaaccaaggctcaggggctggccgaggaaaagctgctattctcaaggcccaaggtaggtgcttttcatgcacaggttttaaaatataggtttgtcttgtgtcttgtagaaaggggccctattactgcctggagacagagagggtttgacctctgctctctccacacccaccacccactgccaccccttccccttgcagcgtggagtgatcctgtgaggccattattttatttttttgagacagagtctcgctttgtcacccaggctggagtgcgatggtgtgatctcagctcactgcaacctctgcctcccaggttcaagcaattctcctgcctcagcctttcaagtagctgagattacagtgcgcactgccctgcctagctaatttttttatttttaatttatttttatttttattttatttttaattttttttaatttttttatttttttgagatggagtctcgctctgtcgcccaggctggagtgcagtggcgtgatctcggctcactgcaacctccgcctcccgggttca

SEQ ID NO: 102967 - DNA, 1112 bp, Homo sapiens
agtccccagcccctgcccctccgtctccatcccccctgttaaatgcagtggctgtcagctggacgtgttggcttatgcttgtaatcctgacactttgggaggccgaggtgggtggatcacctgaggtcaggagtttaagaccagcctggccaacatggtgaaaccctgtctctactaaaaatacaggaaattagccgggcgttgtggttcacggctgtagtcccagctactcaagtaggaggctgagacatgagaatcgcctaatcccaggaggtggagattgcagtgagccgagatcatgccactgcactccagcctgggtgacagagtgggactccgtctcaaaaaataaaaaaaaaaaaaggcgggaggtggaaatgcaatggccagggtggtgttggaccaggtaacccttcagaacccttctaactggtgtcctagggccctggctactctgtgctatgagcattcaccgaccacactgacctggcctcatattttctcttccctttcagtggccgcaagaggaagaggacgtggaatgggacgtggaaacatctttcaaaagcgaagataattttctaagttgaacagaactttgtccttttttctttcaggttatctgagttcattggagtgggtgcttgtgcatatatgctaggtatcttttgccatctttctctttagatcaggggaaatgtttaagctaaataaatctggggggttttttgttctgttttgttttgttttctttgagaaaataaggactttgtgttcatttgaagtttgctttggctaaattttgacaccctgggggatgtcctgggagaatgccagtactttgaaatagcacagctattgatgagattttaagctgctgttcctggccagttgcaggttaagccccagaaaagttcaccttggagaagctccgagaacacacagattgtgtctcattcatcttcagacacaggcacatagtgtggcactttgttcagttaacatttgtggagctgtcatcagctcagctttaacaacacaggtgactctttcccttgataaagtcataggtaattcaggggctgggtgcggcggctcacgcatgtaatccc

SEQ ID NO: 102968 - DNA, 1076 bp, Homo sapiens
tcccatagcctcaagagcagcctccagaagactctgctggcaggggagactgtggacctctcaggcatcccgctgtcgacacaggacgtgcaacacatcacacgctacctgagcagccatggtgctgtgctggcggtgctggacctgagcttcacggggctgagtgatgagctgctgcacctcctgctgcccagcctgtgggcgctgccccgcctcacccagctcctgctcaacggcaaccgactgacgcgggccactgcccgcaagctcactgatgccatcaaggacaccaccaagttccctgctttggcttgggtggacctgggcaacaacgtggatgtggcttccctgccccagcccctgctggtcggcctgcgccggcggctgagccagcgcacctcactccccaccatctacgagggcctggaccttgagcctgagggcagtgcggccggggccaccacccctgcctccacctgggactccacagctgctgggctgggacccgagccccaggcctgctgtgccaggtgacccaccacccacctggctcattgctactgacttgtgatgctctcaagcacatgatagtgggcgatgaaggtcaaggaggactcacaggcccccagaaatccagtgtaaatgctcagcctgagattaaggggacagaagaatggactcataggtggccaggtggccagccctggctagaggctcagccttccctcagtgggaggggccccagcacccacagtgtggaccccgcaataaagagtgacacccgcctctgcttttctgcatcaccaacctcagggtcactgagcaacagccctgctgctggggtggggagaaagggtggctgtgtctatccaaaagggtgggacaaaggtcacactgaccttcccccaggtgctctttgggcaagtcccccatggagtctaagatgtgggggtcctgggtccatccctgtgggctggagagttagaggaggcctccagggagcgggccctcacatctgggcagggcttgggctccttgagaaggggagctgcgaaggagcgggtcgggagccccag

SEQ ID NO: 102969 - DNA, 1050 bp, Homo sapiens
aagctggggagagggcctgttaggagaggcatcccctgccctggggttgtagaggtgaactaggctcctcagaccttgtggggcctcagatgcttacatctccagcccctcctggcgtgggcatctggctgcagcccagctctgtggccccatctcccagggaacctttggtctaatctgcctcccgctgaaacccagcctcattcagccccaccgaggctttcagagttcaggtctctcattcagggtttgagaccccaccgggctcagagacacctgcagcctgcagcggtcccagatcacagcctcagggatgggaccaggagccagcccacatcccacctgcagcagttcctgtgcctttaaagcctcccctccccccgccccgcccccaggccactaggggagggaaggaggagctgggtcacagcagggaatcttagcttggttttggtgtgctgctggatgaccagaccgggcgtcgggtgagcccagaagtgagagcagttggctgtgccccagtgctgtgtgacccagaggcgccgctcaccctctctgagctggtggacatcataggtggggaagctcaggtcagggcactcccatgagtgtctggaggcctgagtcccattctcagctctgccatatgcttgctgcgctctagaggagttcctcttcctctccaagcctcggtttatgtacccgtgcagtgggagtgagttgcacttcggggtgaagggggcaagacttgtgtgggcgcatcctgcagaaggatcccacaggtgggcagagccctgggttctttatccgactgggtctgggctgggggcctctgtttcttggctgatgagtttatgtgagtttgagtgaggtatgcgagtgggtgaaggagggctggggggagtcacctgacttgtgcgaagaagctcttgagagagccgtggcttcttggaattaagaggaaagagtgcagcatgaacagacaggccctggaggatctggcagccctgagtgggggcggggggtcagctctggagtagagccagagct

SEQ ID NO: 102970 - DNA, 1060 bp, Homo sapiens
tcacagctaccattcaccaagccctgcccacagtctaacctactctattcacaacactcccagcagcaaggcaagtgaggtgctgccgtcatccaggctggacagttcagtgatttgcctgaggccccacagcaggtgagtggcaagtccagcatcagagcagggcaggctggcggtgccccctgagccccctttgccatgctgaccacatgcacatcctgggcttctgcaggaatgccctgtcccctacctgccctgctccgtgcaaaaccctctttgagctgtgcctgggagacatgctgagagaattcatggaaacaaatgtgttactgacagcctctttgcctccagagttcaactggagacagagaaaccagctagaggcagagggaggtaacacggagtcccccagaaaggtctgggctgcgcgtgcttcaggtaacctcccttgaccttcaggagaacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacggtaagtcctggccccgtggcagtgaatctgtggggcgctctgattgtgggcactatggaagctaaaccccatgctccaggtggggtggagggtcttcagaggactcctggacagtgccaggctctaggctggggtgggggacacaggagaaaccaggccaggcccatccctactggagcttctccctaagcagtggaggctcagccactgtaaggaggtaggcaaggccctgcagaaagaggggtgtggaaatctgggggctcccaggaagggccgctgctggagatggggttcttaccaggatgggctctgaagataagcagggaggatttgggagggcagagatgaggcccagagcttctggcagagggcatggcctgcgcaaaggtctgggggccggacagcctgcacgtattctgggaagcgg

SEQ ID NO: 102971 - DNA, 1001 bp, Homo sapiens
ccaaggaccttgcaggccgtagcagcagtggagcagccctctgccttcaggaccctgtgctgataatgggatgaggagatacagacccttcccaccacgtgtggggacacattctgagcgtggggtcccagtggccactgtggctggccatgtgtcctgagtggcaagggacactaggaagctcccggaagggacactaggaagacgagcgctgagtgacagggccacccacctgtgacaggcgctgcccctgttctgctccgttctcctgtgtggacgggtgtgaggggtggtctagctgagtccaccccacctgctgcctcacatgagccccctctgccccagtgaggtgttctgccgggatagaaaggtgcttcgggagggggagagactgaccctgccgcagctggctgacacctacgagacgctggccatcgagggtgcccaggccttctacaacggcagcctcacggcccagattgtgaaggacatccaggcggccggtgagtgggtaacctcaggggcctgggtgaggaactctgcagtggaaaccctgagctgtagcccagagctatggggtcctcctgtcttgcctgagcctgcaggaagttcctggtggaggagggtcagtgactggccatgtgggtccacagctcctgcttatatcaaaaccaagagaggccacacagtccaggagagcaagtccctgttggggtaaatgcaggtgtaggcaagagccagggctagggaagcactagaatacagcctgaagatccaggaggacttcttggaggaggtggcggctgggctgcagataactttgttaggcagagagaggaagggattcctagcagaggaacagctgggctaaggcccagtagagggcgctttgattcaccaagagggttacaagggatgagggtctccttgagagaggcatggggaaggggatttgtggggcaggggcctggagcttggctgtggctttcttcaggtaattt

SEQ ID NO: 102972 - DNA, 1116 bp, Homo sapiens
cagctactggggagggtctgctggaggatcacttgagcccaggagttcaaggctgtgattaagccactgcactccagcctgggtgacagagcaagatcctatctctaaaaaaaaaaaagaaaagaaaacactctgtggccacagatgagagaaggcagacaggaagccagtaagccaagcaggcaaagggcaggtggccccagcccggctgttgggtggtgagcagtgtcagggagacaggagtgccggagctgatgaggttcccaaggaggtgaggttgcctgtggccccctcccagggcacagtcccacccctccagtagtgcactctgtcctccctggtaggtacaggcttttccccaccaccatggtgcagccatgcctgcccccaacaccactgctgcagctccatcctccacgcagtggtgcagccccatcccagcacccatttgagctgctgtcccattgcagggggcattgtgacagctgaggacctgaacaactaccgtgctgagctgatcgagcacccgctgaacatcagcctgggagacgtggtgctgtacatgcccagtgcgccgctcagcgggcccgtgctggccctcatcctcaacatcctcaaaggtgagtggtcgcaccacagccgtgtggtaggacccatgacactgcctctctctccccacgccccacccctcctgcatctctgctcgccccccatgccacgtctttccatcactgagctcccgaggtgtgtccctgcgtcacagttcaccatgtcctgaaggaggcagtgcagagcgacagggctgaagcgggcaatgctcaagggttggaggaggaacaggagtcatcaggagggagagaggtgcaggagctcagggctgcagggccggtccagagggtaccccggtccagtgggtgaccctgccacttggtcattgaatggccagagctgatgcgtgacgtgaggtccaggctcgggagccctcaccttacttcactctcaccacagccttctgaagcagctgctgctattggttattaaacgctccttgaggtgggcaaagtggctcaggcaggtgttaaccctctgagcccctcagagcctctggggctcagc

SEQ ID NO: 102973 - DNA, 1047 bp, Homo sapiens
cgtcacgacagtggagagaaacattgaccaggtgggccgggggttggagaaactgagtcaaggtgtggggccccagggcatcctgggctggaggcctggatcatcacagagtggacaatggttggtgtcctctctctagtgcctgggccatctggagcccctgtgccatgagggccaagccccctgctccagtgagacccagcaggccccaacctgctcttcctgatgacctggcccgaaatggcaccacctgggctgaggcctgtgaccacacagatgtggttcaggtggcatctggagccctgctcaggcttcccctctcctcccacccccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggaccggcttcccctgtgagcagcagagcagcacaataaatgaggccactgtgccaggctccaggtggcctccctggcctgtctccccactctctgggcctcagtgtattgtgtgtgaaatggagccatctggctggggaggaacagagaggtgggattcggagatcttcacaatgcgggcactggaactagcctcagcatcttcagcatggggagagccaggcacatggctgggggccaggggaaggttcacaccaagctctgccccttcccaccctgatccctcggactttggggccaggccctcccttactggggctgggcagtgacactacctaggatcagccaccagggggtaccacgaccctggcactttcttaggcagagggtggccagctgatgctgggaacccgggtgccttcttagacccgtaggcgtccagctcaccctgccgatgacactggaggtgaagctgaggtccgaggaatggg

SEQ ID NO: 102974 - DNA, 1034 bp, Homo sapiens
gctggaaacaaggtggcctcagcgtgatttcctccagttaaatctgaccagctctatcttggctccttcctggcttcctttaccctccctgccaacccttaattttgttttggttcccagagcgagcagggactggcttcccgttgccataacaactgccattaaaggagccagccatgtgatgccagttgataatggaagcaaagtgactaactgccttgttttcctgcctctgggctgggcctagaaagcctcttaattggaggggagaatgcaggggctggtgggaggcagatgagaccccaggaaggagacagggagatgaggcaggtcctggagtggaagctacatttagctctgcgaccggagctggtggaagggctgtaattggggagccatcatcatagctgctgaacagagcctgtttggagaactgagcctcccagcctctgggttaggggtgatgagatgggagaggcaggcaggacttgctaagaaggttggagaaaaacgagagaagcaattgacgttaccatggggaccctgcagttttactgtgacccagtggttcttaatgaaggggagcagttttgtctcccgtccctaggtttggttgccagataacatccaggtcgcccagttaaatttgactttcagataaacagtgagtaagtttttagtatgagtatgtgttgctaaatctggcaaccctactccaggggacatttggcaatgtctggaaacatttttggttgtcacagttgggggtgctatcagcatctagtgggaagaggccagggatgctgctcacattcctgcaatacacaagacaccccctcagcccaccaccactaggagcacaaagaagtggccagcccagaataactcttgttaaggcaggaaaatctgctccccgctcaccctacccatcctgcacctgctgcgcccttcacttctctaggctaatttgatacgaatgtactgttcttgaacaactcattcttactgcttttagattgtcttgaatgcatatt

SEQ ID NO: 102975 - DNA, 1319 bp, Homo sapiens
ccatttctgcccactatttactatatgaccttgggcatgttacttaatctttccttaatctttctgcccctcggtctcatcatctgagaactaggtatgaaatagaaactgtcctcacagcactgtggagagggcataatgagcgaataatacagatcaaacaaacctagatgccatctgttagctgagtctggcacacgagaagggcttggtcagagggagagatgatgaagatgatgaggatgatgaatatgatggtcatggtggtgccatcagtggatctgttacttcactagggctgcccttacggtacacagaatgggcagcttgaatgacataaactgattttctcacagctctggagatggaaatccaagatcaaggtagctgcaggactagttccctctgagctccatgagggaaggatcagatccaagcctccctccttggctcataggtggccatcttctccctgatcttcacatgatcttccctttgtagctgtgtctaaatttcctcttttttttttttcagacggcgtttcattcttgttgcccaggctggagacagtggcgcgatcttggctcactgcaacctctgcctcctgggttcaagcgattctcctgcctcagcctcccgagtagctgggattacaggcatccaccaccacgcccggctaatttttgtatttttagtagagatggggtttcaccatgttggccaggctggtctggaactcctgacctcaagtgatctaccctcctcggcctcccaaagtgctgggattacaggagtaagccaccatgcctggccaatttcctcttataaggacacttataatcatattggattaggacccaccctaatgacctcattttaacttagtcacctctgtcaagatctaatctccaaagacagcacattctgagatagtagtgttaagatttccacatgtgggccaggcgcggtggctcacacctgtaatcccagcactttgggaggctgaggcaggtggatcacgaggtcaagagatcgagaccatcctggccaacatggtgaaaccccatctctactaaaaatacaaaaatcagctgggcgtggtggccagtgcctgtagtcccagctacttgggaggctgaggcaggagaatcagttgaacccgggaggtggagcttgcagtgagttgagattgtgccactgcactccagcctggcgacagagcgagactccgtctcaaaaaaaaaaaaaagatttccacatatgaaatggaggtgaagggaacacagttaagcccatagcgatgggggaggtgacatttt

SEQ ID NO: 102976 - DNA, 1058 bp, Homo sapiens
cacgaggtcaagagatcaagaccatcctggccaacaaggtgaaaccccgtctctactaaaaaaaaaaaaaaaaaaatacaaaaattagctgggcgtggtggcgcatgcctgtagtcccagctactcaggaggctgaggcaggagaatcatttgaacccgggaggctgcagtgagtcaagattgtgctacagcactccagcctggtgacagagccatactctgtcaagaaagaaaggaaggaaggaaggaagcggaggggggggagggaaagaaaaatagaaacagtcttctcacttttgtatccccagggcctatgtactatctagcacatagtaaggactcaatgaatagttgaaatttatatatgtatgcatgaatgaataaaggaaggagggaaataaggaaagaagtagccttgctccctttgtgtcttcagagcctaaccagtgctaggcatagcatagtaggtgctcagttaatatctgctggatgttaactgcgtgaatgttggatggatcagagccactctcttccacgttggtctggccctccccaggcgcccctttgttgacacctcgggtgacattgcatctgccctggcaggtggacgagcagattcatgcctgctatgcacagaccatggctgagtggctgggctgcgaggcgatcgtgcggcagagggagcgggagtcccatgcggccgccctggccaaatgctcatccggggccagcttggacagccacctgcaccggatgttgcacagggactcaaccatcagcaatgaggtgatgggcggctggcctcggggagcgcgggggctggggaaggtcagggtctgcttcattgggctgttctaagagtggtgaagactgggtgtctggggcctggtgacagtctcacccctggctttttctttaagagtgtgcggtgactttggaatcagacctgaattcaaactctagtcccaccatttagtagttctggggttccctaccagtaccttttcttctgggcctcagttttctgcatctgtaaaatgggaataatcaggtgtaga

SEQ ID NO: 102977 - DNA, 1057 bp, Homo sapiens
ttgcacttctttttttctttcttttttttttttttttttgagatggagtcttgctctgtcgcccaggctggagtgcagtggctcgatctcggctcactgcaagctctgcctcccaggttcacgccattctcctgcctcagcctccagagtagctgggactacaggcacctgcctccatgccctgctaattttttttgtatttttagtagagatggggtttcaccgtgttagtaatttgcacttctaacaagttgccaggtgaggctgatgttgccagcccgtggactatgctctgagaggcactgacatgcactgtgctaagcactataaaatcattagtttacttcatttccatgataattctaataatttattgggactcatataagtgagaaaacctatttcccagataagaaaactgaggcccacagagataagagtatatgctgagtttgtatggcagaaatacaaacctggattccaatccaggtgggctctaaatagctcagtctggagccactaagctttactaactgtttcccaaaaaagtccaaagcaagaatggatgctgggtcatacctggatcaacgatctcatgtttgcaaagtgcgtgtccatggcgcctccgtgggggaagttctggttcatcctcttcatgagctccgtgaagcagctgaaggcaagggcctctgagaaagcatcacagaacagtcagatgccccgctgcccaagtgatatggttcagatgtttgtcctctccaaatctcatgttgaaatatgacctccaatgttgggggtggaccttttttgtatttttagtagagacggggtttcaccgtgttagccaggatggtcttgatctcctgacctcgtgatctgcctgccttggcctcccaaagtactgggattacaggcctgagccactgcacctggccaaaaggctttatttttcagaaaagttttgatttacagaaaaactgagaagacaggaaagacttctcatgcaccccacacgtggtttcctctattaatatctggacattagcatggtacattt

SEQ ID NO: 102978 - DNA, 1132 bp, Homo sapiens
gatgtatttaagtttttgaggaactaccacactgttttccacagcacacaccattttacattctcaggagcagtgtatgggggttccagtttctctgcatcctcgccaacactttttattgtctgtcatttttaattttaactatcctagtgcgtgtgaattggtatcttgttgtggttttgaattgcattttcctaaggattaaggatgctgagcatctttcatatgccgcttggccatttgtgaatcttctttggacaaatgtctattcagatcttttcccattttttaaactgtaactggctgttaaggaccgtatggtgtctggtgtgtggatgtaccaccatttattcagctgtctcctctgctccaaccttttcccaggaggctgatgctgcctttccttccttgacagatcctggactcagagctgtttgagctgatgcatcagaacggggactatactcacttctacttctgctaccgctggttcctgctggatttcaagcgaggtacagactttaaattggggacctgtgtccagactctttgtagcagaactttcaggggaaaagatcccgtggaggtgaggttgaggggttggcaacagaggcagcagaggagagaagcacatgtttatggagtccagactaccgtttcacctgccttatcttgcactgacactctgtagtaggtgctgttaagatcttcatcttaccagtgaggaaaccgaggctgagaagggttaagttcagagctagggagagttaacttcagggctagggtgagtacagccaggacttgaacccatctctttcattctgctgtgctgcttttcagagcccaagaactctaaagcccatgaagcagggactatttcatgcacgtttccaacatgacataaaagtgatgtataacacagtaccttgttgctattgttcagatttggggtgatgttaataattatagtatctgacatgggccgggtgcagtggctcatgcccgtaatcctagtactttaggaggccaaggcggtcagatcatgaggtcaggagattgagacctaacatggtgaaaacctgtctctactaaaaatacaaaaaattggccgggcatggtggcacatgcctat

SEQ ID NO: 102979 - DNA, 1053 bp, Homo sapiens
cctctctctaaacatccacttcctcatctgtgaaatgggctagcagtgtctgctttggagggttgacatgcataggaaaagcaggcccagggcagcaatttgagtaacacgaaaaagacacagcctttgaaatcagacagatgcgaattctgatccaggctcctgggagctgtgtgactttgtccaagtgacttcacgtctctaggcctcggattcttcagggataaaatggtactaacactccctccctcacagggaggtccagaggattacaggagacaacatggttaaatcccagcacgtggtacctggctcataggagggacccaataaacaaaagctattgccactgttatcactatttaaaaatgtttttaatgaaagaaagttctggaaaaaaacaaaagaaaaaagccaactgtgacctcacttttgaaacattattagggttcttaatttaagtaaactttttgggggaataattttgcattttaattgtctactaaaattgtagattgagaactgttttagatttagatgtacagagaatgcacgataccttggcctcgctttgcctactgttagcatttacataaccctggtacatttgccaaaactaagaaattatcattggcacgttaccatctattaaactacaggctttatttggatttcacctggtttttcactagtatcctttttctgttctagggtctaatccaggaaaccacagtcatgtttatttttatgtttttacataatcagaatccacttgtatatgccttttttcacttaatatttcaactattgtctttcatataatctttttttttttttgagacggagtctcactctgttacccgcgctggagtgaagtggcacgatctcagctcactgcaacctccgcctcccaggttcaagtgattctcccgcctcagcctcctgagtagctgggattacagacacgcaccaccacgcccggctaatttttatatttttagtagagacagagttttgccatgttggccaggctagtctagaactcctgacctc

SEQ ID NO: 102980 - DNA, 1001 bp, Homo sapiens
atggcgcgatctcggctcactgcgacctctgcctcccgggttcaagcaattctccggcctcagcctccagagtggctgggattacagatgcccgccactctgcccggctaatttttgtatttttagtagagatagggtttcaccatgttggccaggctgatcccaaactcctaaccttaggtgatcctcctgcctccgcctcccaaagtgctaggattacaggcatgagccactgcgcctggccggggctgttttttattgaaggctgaccttggcaggagaatgaaggagccagttgtctggctctgagcatttctcctcaccaggctacatctctgaccaactcagaaacagagcctcacagggatattttatatgtgcattcattcatttatttatcatttgttccttcaacaaatatttcaagacactgtgtcaaagatgaggctagcagccacatccttaaggggatactttatgccctgaaagtctttgtgaacatatgcatttgtctggaaggggagaactatgatcataggaggaggggctgatgcctttggctataaggagggatgcgggtcagagagtttagttttctcgacagccagtgggaagaggttggtgttatgggctgcagaaatggaatagcttgtgcagaagcctggaggtaggtgagtgcctagggtgttgactggggccaggccagccatgcttagtggtttggactttattcctggagcgtggggcgctgtggatcacagtggaagggtctctgcaggtgaggggcagggtcagatgtgtgttttgggaagcttgccctggctggtgtggggaggctggatgatcggagggtcatgccaggaggctgggggccagtaagcaggctgctagaaaaatccaggtgagaggccaggcgcggtggctcacgcctgtaatcccagcactttgggaggccaaggcaggacgatcacgaggtcaggagatcgagaccatcctggcta

SEQ ID NO: 102981 - DNA, 1049 bp, Homo sapiens
gcactttgggagccaaggcagttggatcacttgaggtcaggagttcgagaccagcctggccaacatggtgaaaccctgtctctgctacaaatacaaaaaaattagccgggcatggtagagggcgcctgtaatcccagctactcaggagactgaggcaggagaatcgcttgaacccagcaggtggaggttgcagtgagccaagatcacgccattgcactccaacctaggcaacaagaacaaaactcccgtctcagaagagaaaaaaaaaaattcagcaagtgcaagtgttacaacctcatcatcttggtagtcagtggtttgctgacacatttcaaaatggggtgtgtctccccactgtgtcacgacaccttaggagggaacttgttttccaagccagtccttctattgtgagtcagtgattctaggaaagagtggtgtcataggttgggttcccccagaagcagagcctaagtcaagggtgcaaaggcaagcagtttatttgggtggcagtgtaccattagggtgagataaggagcaggttaccttggggaacagctggggctcagctgtgctggggacctctgggagcctatagaacatgccattaaattatccgacttgagtgctaggtagctggggtatttatcccccagcaacagaaagttatccactagtgctgagaggatttgggtggagtccaacagtgtttggtatgacagagtaggctcttcccaggcaccctgtggtgcctggggtggcacacctcttgtgaggacctggctggctccagcaggcagagggcgaccgtggctcaggtgaaccagcgcatgaggtcagaggctctgacaaaggagtggcttccctgttcctgcttctgcctgagatccagggctgtttgcagaaaggcgactctttaggcatgtaaggatctctgagcccagagaggtcattttcttggggtccccttttaagaatgaactgtatcatcgtcagagctgttgtatcctgagcacctgctgtatacactttccaggcctctttgcttcctt

SEQ ID NO: 102982 - DNA, 1043 bp, Homo sapiens
tctcaggaggctaagatctcctcaatctaaagcaggggtcagcaaattttgtctgtaaagagctatagtatgtattttaggttttctgggcgatatggcctctgtaacaactactcaactctgtcactaaggcagagtcatggataaaggctcttgaaggaagccatagatagtctgggcaacatggcgaaagcccttttctacaaaaaatttaaaaaattagcaggtcatggtggtgcatgcctgtagtcccaactagttaggaggctgaggtgggaagactgcttgagcccaggagattgagactgcagtgagctgagatcatgcctgggacacacagcaagaccttgtcccttaaaaaaaaaaaaaaaaaaaaaggcagcagcagcagcaaccatagataatatgtaaataaatggctgtgggtgtgttccaataaaactttatttgcaaaaccaggcagtgggctagtttggcctgtggactctagtttgccaattttggatccagagaaaaacacggggggaaacagcagcttaattaatggtttcagtgagtggtcagccagtccaaaaatagcataaattgtaggaaggaacaagccaatgaaagttgaaaaggcggaggttaagcagaggggtaaagataagttgtaacattgtttctccagatcagcagctgcacttggacaagcggcctggggtgaggcagtttggattatgctttagagggcctaaaaggcaaatcagcatattaaaggttctgaaaagtcctgctggaaagacacctgtttattcccattgttgaacccagcatttctcacagtcttttaatataccacagaatgcttctgtgggtaatgggtgtgtcctaccctacatcccatggtccaggggaagtttggggaaggccatctcaagctgttcccctggatcccagagtcagaaacaccagatgtaccgcactctgatggaatttacacaggagtcaagactttgctaattatgtcaattcttacagaaacagtacacactccgtacgaa

SEQ ID NO: 102983 - DNA, 1033 bp, Homo sapiens
gcaaagtgccacccacccctcccgagaagacgtgggtgaggaagcccaggcccttgtccatggacctcacggcccggtttgagaacaaagaggccttgctgaggaaggtggccgatgaaggaagtggacccacagcaggggatatggctgggctagagaggcccagagcagcgtccaagctggacagggactgtttggtcaaggcggaggctcctcttcatgatcctgatttggacttcctggaggtggccaagaaaatccgtgaacggaaggagaagatgctttcgaagccggagatgggcagccccagagccctggtggggggctcatctggggtcacccccagcaatgaccagagtccctgggaagaaaaggccaagctggacccagagccagagaaggctgctgagtccccctcacccaggctgggaaggggcctagaacttgctgaggttaagagcagagtggcggatggggaggccgcggcagggggagagtgggcctccaggaggagtgtcaggaagtgcatcagcctgtttcgggaggacagcaccttggccttggcagtggggtctgaatctcccctggccacccctgcgtccccatcggcggcaccagagccggagaaaggggttgtgagcgttcaggaacggatcagaggctggactgccgagagctcagaggctaagcccgaggtcaggaggaggacgttccaggctcggccgctgtcggcggatttgaccaaattgtaagtaggcacatcccacacccctctctcagccgcccacccacacaccctgaggaagacggaaccaggctccatgctgggcacttgtcaccccccctcagtttacccatagcccaagaggaggtagtggcagtgtccatttctcagatgagaaaggtgaggtgcggagaggcagtgcagctctcctctgggtatggccagccggggggcccggagcccaattttcatggcttttctcagcttcagatgtagtgtgtgagtgaagtgggcggtatgtgcccattt

SEQ ID NO: 102984 - DNA, 2294 bp, Homo sapiens
ggctgggcagggacccaccagacatgacaaaactgaagaaagagaactccagagggtttgacaatcccgagacggagaaattgggaccaaccacccttttgaatggtgaactgagaccgtatcacacgcctctccgggacaaataccctttgtctgaaaaccacaataataacaccttcctcaaacacttggaaaatcctcccacatcgcagagaattgagcccagatatgacattgtgcatgcagtgggagagcgtgtgcacagcgaggccatctcaccggcaccggaggagaaagcggtcacgctccgcagcctcaggtcttggctctcactgaaggacaggcagctgtcccaggaggtcacccctgctgacctggagtgtggtttggaaggtcaggcggggtccgtccaaagggccagtttgatttgggaagctcgaggcatgcctgaggctagtggaccgaagtttgggggcaattgcccgtttcccaaatggacaggcggggcagtggtgagctcgcacaaagccaccgtggcagtcagcgaagagcactgtgctcccggggccacctccgtcagggctatcaaggctgccatctgggaaagccagcatgaggggccagagggggccagaagcaagccaggagtgggagcaaggggcccaccccagggatgccccctcgatcctctttccagggctacgaatgggccttctgactcccaagcacgaacacatccagatgcatttgctgtgcagaaagggcccttcattgtagccgccagggagggtgatccagggccggcccaggtgccacagcctgcagtcagaatgcggaaagccggcgccatggaccagagaatggacagatggcggcggcggactttaccccccaacgtgaaatttgatacattcagttctcttgtcccagaggactctccacatgtggggcacagacgaacagattatgtgagccccacagccagtgccttaagaaaacctcaactatcccactacagggtggagacccaggaggtgaacccaggtgcttcacgggaccagacttccccagcagtgaagcaagggtcacctgtggaacccaaggcgacattttttgcagtcacctatcagattcccaatactcaaaaggcaaagggtgtggttctgtcaggagctgaaagcttgctggaacattctagaaaaatcactccaccctcgtctcctcattctttaacatccactttggtttctcttggtcatgaagaggcattggagatggcaggcagtaaaaactggatgaagggacgagagcatgaaaatgcaagcattttaaaaactctgaagccaacagaccgtccatcatctcttggggcctggagtctggaccctttcaatggaagaatcattgatgtggatgccttatggagtcatcggggatcagaagatggccctcgtcctcaaagcaattggaaggaaagtgcgaacaagatgtcccccagcggcggagctccccaaaccaccccgactctgaggagtcgtccaaaagatcttcctgtgagaaggaagactgatgtgatcagtgacacgttcccaggtaaaatcagagatggctacagatccagcgttcttgacattgacgccctgatggcagagtaccaggagctgtcgctgaaagtccctggggaggctcaggagaggaggagtcccaccgtggagcccagtacgttgcctcgggagaggcctgttcagctgggcggggtggagcagagaaggaggagcctgaaggagatgcccgataccgggggtctctggaaaccggccagttctgccgaaataaatcacagtttcactcctggcttaggcaagcagctggcagagaccttggagacagccatgggcaccaaatctagccctcccttctgggctctgccaccctcggctccttctgaaaggtatccagggggctctcctatacctgcggatcccaggaaaaaaacggggtttgctgaggatgacagaaaggcctttgccagtaaacatcatgttgcaaagtgtcagaattacctggctgagtcaaagccctctggtcgggaggatccaggcagtggggtcagggtgtcacccaaatcgccccccactgaccagaagaaagggaccccaaggaaatccaccgggcggggagaggaggacagtgtggcccagtggggtgaccacccacgtgactgtggacgggtgccgctggatatcaagagggcctactcagagaaggggccccctgccaacatccgagagggc

SEQ ID NO: 102985 - DNA, 1011 bp, Homo sapiens
ctgggtacatagcaaacaataagtgtcatcgtcacataattattactcttgctgttactggtacgactgtccttgttttcaagtctccctctggctcttgcttatctctgtgtccttgtgccctcttccccctcatcctgtttccttacttgtgaaaggaggtgagtacacactgagcaggccccagggacagctgtcccattcagagcttcagtgtgcccacatgggttccagggcttcgccacctccagtgagtttcttttcggactttagttccatgctgtttggagttttgcacttgctcatgaagcccctttccggcccaggtcctatacaggggcatcgaagacagggctcctaaggcagcgacacttctgcccacaaaggcctctttggttgctcagctccacaagcttcagggatacctgggcctggtctcacgttttggagacatatgattttgtgctgaagctccattgagagtccatcccttccagttttatggccacaggcaagaaactttgctttcctgaacctcagtttccacttctgtaaaatgggggtaaagaagataccctggcatggtttgtgctaggagtgatgcagaacagccacaacgtgagcccgactgtggggctgagggagacgggccggggaggaactcagatcccagctaggtgtttactgagcagcccaggaattttcctcgaggatccagatcctagccaaagattcacacacatttgaaacctgcctggattttttgataaacattcccttccattgacttctttctcagctatttctccagtccctctcagatagctctgacttagcttatctgattgtacttgaacttttatgagtgtgtgtgtgaagacaaaggtgatgggagagaagcattttaaacctgtctttttagagtctgcttgctggcatcctccttggccgtcctgctcctcctctttcactctctgtcattgaagagcttttgtccttggagtcctcggg

SEQ ID NO: 102986 - DNA, 1050 bp, Homo sapiens
cacatgcacaaaacacactcgtatgcacacatgcacacatacttgactccacgtaaaagcatgtacacacacactccttcatgcataaacacacacacacacgcgtgcacacattcagttcccgggcatcaccttctctcttcttgccttcttgccgtacaactgaaaaccctaaaaccctccgtgcctacggctcccgggagggtgagggtccaggcagctgggttcagaaggatccacccctggacccgccccactggacgagaagccagagatgccccgggcggggctcataggaccgagtggtggcttctcagttccccaggcagccgtggccattagtggagccgactggctggtcccctggccgtgagccggcttctgaatgatttatgccgccttgaacttgactccagcgtgacaggagtgagaagagccgctcccgctagaggaaagctggaaaccgtactgtgctcaccacataacctctgggtgctggaaatggagtattactactgccccagcctgctgaagctcttgcgctacctctgggtgagtggcggggggcagtgcaggctccaggacggggtcacgtcctttccctctcctcctgcttcctgtcaactttgctttttggctgtgtctggttagcaatgtctctgttttctttaagaaatggtggaggttacaaggaagagagaatgttggggaaaaaggaaacgggcttggtttgggaggtagcacaggtttgtaggaagagctgagactcctgaacaggaatgaagatcctggatccgatgtgggctttcctccagtcctcaagaaaacaggaagaacgagaaccacttcagtgagtttttcagaaagcaacatttatttgatttaaaggactattctttattctgaaattacatccctcttgcctctgtgtgtgtaagaatgtctgtcttctatgggatgaaaataatagattttgctttccttttcctgaacctacacagtgatagaagaagttgggaccccttccccactaacactcacactgtgctg

SEQ ID NO: 102987 - DNA, 1048 bp, Homo sapiens
ggcagtaatgccctcagcctcctaggggcagctttgtggagtgacagagtcacagctcctcacctggctgtgtcccacctctctagtgaccttgggcaagtcttttcctctctgggccttggtttccccatctggaccatgaagaggtaggatgaggcagtttagaaagtctttcctagatgtgataatgagagagattttcatttgtccgctgctttctgtgggtgaccaggtcctgggggagtgaggagccacataggcccaccgctggttttgcaaattacccacaatttctctgtctctctgagtcactgaagacagcctggcacacgtgttaacaagaccgggatcttagattagcccaggtgtctgcacttctaaactggaaactcttgcttgacctctcaaggaagcttgggaatgtggacctggattctgaggaagccccgtggccttgggaagtccatttcagcttcccaaacttcagcttcctcatctgcaaagcgaggccccgctgccttcctgatttgcttcttggggcaattcctttgaattctctagctcatttctgaaacctagaagctgctcccagaatgtcagttcctcctgcttcccaggaggccaccgtcagatttggtgaccagctaaccaggaataattgcagagagccaggtggaggtgctcgctcccctgccactcctgtagcttcgcatagcttgaacatgcgttcatccatcatttcttcagcatgggcccctcctcactgcccctgggccctggtaatgttgcccattcactagggtcttccctggtgaatgacccccttcccttctgcattctttgtcctgttattctacctttttgtttgtctgtttttagagatagggtctcactctgtcacccaggctgcagtgcagtgaatgatcatagctcactgcagccttgtcctcctgagctcaagtgatcctcccacctcagcctccagagtagctgggactacaggtgcgtgccatcatgcccagctaattttttaactttttatagagat

SEQ ID NO: 102988 - DNA, 1030 bp, Homo sapiens
ggccctgacaggaaccaaatgatgctcaccctgtgtgtgtgagctggtgtgtctatgacttccttcagatccaggcctgggattcattcctctgcctccgcacagcctgatagacagtaagtgtccaatatatgttgagtgaagcaaactgataagtggtgaaggaaggaagggaggaagggagggagggagggagggagggaggaagggaggaaggctgttcaagagcagagattctctcgtatgcacatctgtgtccctgacacatagtaggcactcaataaatactcactgcactggaggaatgaaagaatgaatggatgagtgagactctttgcaagcagaaacagcccctatctttgtatccctgtcacgtgacacagtgcctgacatccaggagtttccatcaatgaatgttatgctgaatgaatgaatgaaccactgaagtgaactctatcagtagtggctgtgtcttgtttcatatctatatgcacagtgcttagcagagggctgagtacacagcaagtgctcattaatcatttacagaactgaatgaaagagtgaaagaaaacaatgaatgcgaaaatgaaacttttcatcctcagagagcatgtcttgttcatctctgtctctccacttcctagcttaaggtcttgcacacagcaggtgctcattaaatgttaatctgaatgagcgaatgagtgggtgagtgaaaaagtggttcttgtgggtagggacatgtcttgctcattagtttccccacttcctagaacagggcttggcacacaataggtgctgaataaataaatatgtgttgagctgaacgcaggagtgagtgagtgcataaatgaacttcttgaggagaggaatgtatctcgttcatcttttccctcagatcctaatgcagggccaggcatagagcaggtgcttagcaaatgcttcctgcactgccctgacctttgtaggagcatccatctgtgaatgaattgagaagggaagcccagctgggtggacctcgcccatctccatc

SEQ ID NO: 102989 - DNA, 1059 bp, Homo sapiens
cccaggcagtgtggccaaagataccagcagagctcccctcctctttcccagggtctgattgcccccagaaccaccgggtggcccagggagataagtcaggcaggggaattaggtgggggcctgccgcctgcctttttccattttagagaaggccagggtttgcagccttgtaagaggcctggctcttggaagaggggctgtaattacagattggctttgccatgccaggcagggccacatggcagactctccacagcatggaaaacgctgctttctacttgagctgagggtggggcctgataaagaaaggtgatgagtttctgtctgtttctagaaagatttccttgctagatgatttttattgattgattgattgattgattgctcatcccaaggttaaagacatcttaggtcactaaaatgactatttgaagaagaatgtgataaattaacacaaggaaataatcttgggcttggtttataaataatctgggattgacttgtaaaatcaagtcatttctatttttttttcttttatctgaattcctttccctgttgccttggaaacaagtctcccaagaaggatgtttggagtcctgtgacttgggttcaagcctcagtgattccttcatctcacacagtgggtacgatgagagcctcttcaggatgttgagtgtcaagggtggacaggacacgtccctgccgcccacaggctcgggacctggaggggaagactgatgggtaaaccaaattatggccaggtaaactgtgtgattcggtaggggttacataggcagagtgggaccccagaggtgccccctgcccccatggatataaggaaacgggaggtgtctcagaggcgggagtatctaagctgagctgtggtggactagatgctggccaggtgaggaaggggtggaaaggtgtcttagccagagggaacagcatatgcaaaaggctgaaccagagatgtcatggcacattccaggattaacatctgtccagtttgttcagggtagaaagaagctgggaaacaggtaatatgtgaggttgcagacg

SEQ ID NO: 102990 - DNA, 1046 bp, Homo sapiens
cgccatccagactgatttggtgagggccaggatatatagcttgtcacaggtatgaagttggggggggggggtgccaaactccaccacttaatagctgtgtgaccttgtgttggtcatttcacttctttctgccgtggtttttccatcagtaaaatgtgagtgataaccatattaatagtatcagcctcctttcattgttgggaggagctgatggtgtaatacagtgatgcaatgtaatgcctggcacatagtaagtgctcagttagcagtagtgatggtggtgatggtggtggtggtctttggtcaggttccctagaagcagagactgacatgaggattctggtgcagtgattcattgagggaaagctctcaagcgaaacccataaggaagaaagggcaacaactggggcaggggacaaagctaactacagatgtggtttcagctgagccccagcctcagcccagtcccatggggacccctagagtgtgaattgcatcactgagttggtggtgccttgaggcaaggagacctgagtgttgtgttctgtattggtcagtcattggctgtgggcatctggacatagccttcagtaagggcagttctccagaggagggtagagctctgagcctttcgtaaccagcattcacagcagctgacgtgtgtgtgtgcaccttctagaaaaggggatcttagtcaggggaggtactagctgcatcgatggaaatgatgagtttgatgacttcatctctgaaaaccagagaagtcaagtaacttgttcaccgtcacacagctaataagagctatagctgggtctccaaacccttaatcatgatgctatacttatttagcaaggacggggtgggtctagaataaggcaagtgaggtgctcacatagggcacaaaattgggggacatcaagaaaagtcactgatcactgaataatatttcaattgtttttaaaaaattaaaattaatgcaaaaatttgtgatgagaaaggaatcagaactataaataaaaacaggatgagtattacttatttttttc

SEQ ID NO: 102991 - DNA, 1071 bp, Homo sapiens
cactctggacgtcctgggcctgcgtaatgagggagcagaccatgaagaggacttcatggtgtaggagctcactatgggcaatctgtgtggggaaaatggacaaactttggaggcccactttggatgccagaagtcctgggacctaggaggctgcatgtggtggagggtggagccaggcactcatggaagtgcgacctagccctgtgtatgtttcctgtgtatgtttcctcacctgcatggtggagtaatacttctggatatatcaatgtaaggtatataggctgctgcaagagccccccaccccatctttgccttcaatcttcagttttctcatggaccagttacctacttgcctctgggcacttgtatctctgtgatgtctatgggccaggaatttgggagcagtgtggctgagtgactgtgacttggaatttcttatgacgttgtactcaagatactggccaggtctacggtcagctaagggtttgactagagatggagcatctgcttccatagtggctcactcacatggccagcaactggtgctagctgtttgctgggggcctcagattctctccatgtgggtttctgtgtgtgactgcttgagcatcctcacaacatggcggctggctttccccagtatgacctcagagaagaaggtagaaaccatgatgccttttatgaccaagctttagaagtcctacactatcacttcttttttttttttttagacggagtctcactctgtcacccaggctggagcgcagtggtgtgatctcagctcactgcaacctctgcctctcgggttcaagcgattctcctgcctcagcctcccaagtagctggtattacaggtgcctgccactgtgcccggctaatttttgtagttttagtagagacggggtttcaccatgttggccaggctggtcttgaactcttgaccttgtgatccacccgcctcggcctcccaaagtgctgggattacagacatgagccgccgcacctggcccatcacttcttctttactcagacgtgagccaccgcgcccggcccatcacttctttattctgct

SEQ ID NO: 102992 - DNA, 1062 bp, Homo sapiens
tagttgttagaagggagtgaggtggacacatgggcctggcatagagccagcagccccatcctcttcttcccggcctcttttgcatccacttggcttccctgccccccttgcaagattcttcccatcccatcctgccccaccccacccctaagttgctacttgatgatcaaagcatatttgtgtgtcattaacagccacggctaattaggaaggaagggttaagtaggaggcattcctatacacgcctgggagctgaacagttagagatttttcatatgctatgttggattttcttttcctcttctcatgcataaatacaagtccttttgtgggggagatgaaaaaagaatggaggtcattagagatctgcttagtgagtttcctaatcttttcatgggatgcggagccccgtggattttcaacaacttagtgccattggttgaaaaatggtttctgagctgaattgtggtgaagcggctgctgtggttcagtggtgtctgattgctgggatgggggtggaggaggagacaacaggggtacagatgggcctgagttcaaatcctggcaccacacttctgacatctaggaccttggccaagggcctcaacctctttgagttgtgatatccttgcatttacagagggctaaagatatgaagattgaactcaaacttgggtgggcatcagatatatcttgggtcctggtgccacgaggagagtaccaggcaggtgccttgggggtctgaggaaggacccagaatctgctttgtgtggcaagagctctaggtgagccccaggtagagatggttacgtggacaccgccctttaaggaccaatcccttaatgtttcttcatgttcataaaaataagtaaataaatacatatctgatggatgaatacatgaatgcatggaccagtgcatgaacggatgccaagctcctagctggcttcacaccaggtgttgggtggatgatgagggcccagcagagctgtgctatcttgccaggaacatgatttggagaggctcaagattataattctgaatttcctgttcaacagcaac

SEQ ID NO: 102993 - DNA, 1078 bp, Homo sapiens
atgcattttattatgtaaccagctccattttactgtgactttaaaaattaccatataggtgttggtgctcaatgcatggggtggcagcttggataaaaacccacagcatatattgtatattaaaaaatagcaagaagagagacttttgaaggttctcaccacaaagaagtgataatgtgtgaagtgatggatacactaactaccctgattagatcattatacaacatagatatgtgtcaaaacatcaaactgtacaccataaatatgtacaattgcaatgtgtcaattaaaaaataaagtaattttaaaaatatgtagcatggtgtttggtggtagatgtgctttctaggcagcttttgctcttcttataaacttttattgtttcactctaggactgtcctttcattgtatgtatgacctatgccttccataccccagataaactctgcttcatcctggatctgatgaacggtaagcaaaacttggaaaatctgaatgccttgaaagactttgccatgatgttaaatcttagcatgcattaatctaggcagactggcaatgtgggtctttcaggtaattaggttccccctgaagtttgaggaaaccttttaccctttaatcttcactgaaaattcatttttcaatgttgactgcaacgtccttctgggcctcccagtctcttcccaagaaaagattctagaaaagattatcatgaaatacttacagtgaaacttgattttctggaatgcagctggcctagatctttaattagcttatttcctggccctcaacttttaggaatgaaatacctcataagaatataggccaaagatagaaatgtatttaaaaaccaactttgaaggactgactttgggccaagtacagattttagcccaatcttctgcaccttctaaatctgcactactgtacattgatcttttaaactgtggatgatgactttgaaaatgctggaaaacgttcagctagaaaaggagctttctgatactagaaggtgtcatggtatatatctaaagtatttttagtaacaagaactgaaataaagcatacaattcacaac

SEQ ID NO: 102994 - DNA, 1026 bp, Homo sapiens
tgagggcaggagttggagaccagcctggccaacatggcgaaaccccttctctactaaaaatacaaaaattacctgggtgtggtggtgcatgcctgtaatccctgctactccggtggctgaggcatgagaattggttgaacctaggaggtggaggttgcagtgagccaagatcgtgccactgcactccagcctgggtgacaaagtgactctgtctcaaaggaaaaaaaaaaaaaaaaaaagagataggatctcctcccatgcagatctcacccacacaatccactacacaatttagctatggttcctgcctctgtattactgatttgtttttttgcttctagatcttgtttctgaaggacactatctacttcctattgttaagcatcactttcttcttggtgcttccagtgtggggtccagaagctaaccacacacttagtaggtgttccaatatttactaattgccgagtgaacccatgaaacattcacacatgcaaaagtgagagcttactcttaaaaatggggtggtggtggtggctgtgaatatcaatcaaaagggtttcctgagcacatctgcccttcagggctttgcatttttagaacatagaacaatagcacctcttagaaccttcagaccatagaaatatagaacacagaacgtaggacagaacccagtggctcttggcctggagttcctccagttttctcccatggggtgatttcagcagacagaacaagtgaagtgccataatttctctgatatttagattattttctatctctctataacatatatgaataccctaggatggtgttgtcaaacatggtagccaccagcctcacagggatatttacatttaattgaagtggaataaaatttaaaattcagatcctcggtcacaccagccacacatcaggtgatcaatagctatgtgtggctagtggctaccatattggacagcaggcatgatctcaaacaagcataatccttttgtgcataatccaaatgctttgtgttcccatctt

SEQ ID NO: 102995 - DNA, 1037 bp, Homo sapiens
acacaactgcttttcgtttggctaaaagatggcattacaacttttcctttttgcaggagaaaatttgctttctgtaaacatttgcagccccaaactcttggcttgcagttcttggtttaaaaggaaagatccagaccctaccaccagccctgtttgtttttatttgggataaggctggcttgaataagtaaaaaggtctaaattacacagtattgtctttaaaaaaacagttgcgttactttcaaagaagggcaattactctactacagacaggaagccaaagatgggtcatgtgagggctgcttaaatgatgagataagactcgtttgtaattagttcattaattatggatatgtgaataaatggtacttagctttaaaaaacagctcgttcccaaagtggggtaagcatctgatgctaatcttatttcaatagtacatttatttactggtctcggcattcttagaaatggagctcaggataattttaatccatcctggaaatacttaatgaaagggcctctcatgaatatggttttatgtcttcctaggacataaggagtctttttagttttatcagtattaggaagattagtggaaaagattttgaaactgaatgcacagaaatattaaatgcaaacacattaaccatggaccaaaggcctgagcaagtgaaaacaggtgaagtctgaatgtagacacaggatttatccttaggacccaaatccctctcagacaggtatttataggaaggaaggctgtttcctgtctagaactcgaggtcttggatggtaggtctatggaccttttagaaaatttgaggttcacctaagctgcaagtttgtagaaaactatttggatacatcgttgatggttcagaacattcttttaaaatctgtggttctctgattaagctaaggttttgttacgcaaatttaccattgaaatatatatacaggaaagtggatcttgaggaaattttcaaaaaattgatcatacctaattaatttgtaattactaacaaaatcaagactggac

SEQ ID NO: 102996 - DNA, 1084 bp, Homo sapiens
actccgaggacctagtactatggaaaattacttctgtttttcagcaaactgagggtcagagaaactccaccatggaacagtgccttggtttttatttatcctgacattgacattttggaagagaacagacccattactttatagaatgaccctcaatttgggcatatagacttttgattcttacaaaatgtcagcatgcagcccatattggcctatcacttgcctttctcctttttgggtgtctttgctatgattgaaacaaggcctagaattcccccaagtcaggctgtcttcactggttccctctaccccagtgtctagtaccaagcaagggtgcccctctaccccacttctgggatccctaaccagatgcctgcctccctctccaccccacttctgccacaatgcttccacggcaccaggctggtacccttgctatagtaacgagcctgctctagtcttagtatttgtttatgcatctctctttcccactaggccatgggaaattcagaatctgattcactgattcaaccccaagaagcaaatatttaataaatgtctactttgtgggctctgctgtaggtgctggaacaaaaactaatagtgccagccctcaagaaatgtatactccctgtgatctttcattcatttactggcccaaaacattcattcatttattcaataaatattcattaatattttgtgtgctgggctgcataccccaaagcatgcggatcattcaatgtttgcataatggggtagaaacaatggtctactcctacaataaaagaaaaaaaagtttaggcttattaatctctgatagaggccagctgtggtggctcacgcctgtaatcccagcactttgggaggctaagaaggcaggtggatcacctgaggtcaggagttcgagaccagcctggacaacctggtgaaacctcatttctactaaaaatacaaaaattagccaggcatgaaggcatatggctgtagtcccagctacttgggaggctgaatcaggagaattgcttgaacccaggtggcagaggctgcagggagctgagatcgctccactgcactccagcct

SEQ ID NO: 102997 - DNA, 1049 bp, Homo sapiens
aagaaatagctaaaggctgctttccaggacccaaagccccatttaatgcaagaaccagagaagtgttctaggccattagtggacaatgtcatgtttggagaaagataacaacacaaataatgtaacctttccttaaaaggcagaactcaatccattttatttgatgcttattctaaccctaaccctgggtcacctggaatgaagaactctatgaataatatttgattttacaacgtgttatggttatgtgaaaactaaacatttgccttttataaagactgacaaaatataaatctttattctaaccctatccccaaaactagccaggccacaccccagatgttcttattgactattggaaagatagaaaaggcgttgtgttttttgtttttttgttgttgttgtcattgttgtttttttcagaagaccagtgtctcagttctgtcttagtagtaccacacccgtaaccgtgttttaaaagtttgttttagcctagagacagatcatacgagttcaacaatgtacagtgtgattgaaaagacaggttggtgtctatttttctttttaaaatatctgaatgtgtatttgtaatacgtaaaggtaaaaaaaaatagtgccaaaaatgtgcaaggcatctcattacagctcatgtacgtctgtttttataagatcaatattaaaacccattgggattaaatatttttgaataggatacactcttgagaaactcgagaatggactgagccttcctacaagccactctttgtttttaaaacagtggggaaatacgtttacagagattgtgagcttcagagaatgcatgtgatggtgtgtattacatgctaattcatataagctgtatctgtcagctaccaccctgtgctttaaaaatgcacacactcaaccctctttagcttggagctcagctttttgcttttttttttttttttttgtagaattatttagctaacataagtattctgattgctacctgatggccattcttacttagtttcatagatgtgctttaactatgatcctttgaagct

SEQ ID NO: 102998 - DNA, 1013 bp, Homo sapiens
cttttccaggtgtaaaatttatgctgattttttttttccatcccaggtttggttttcctaaacaaatcctttcacagggaccgacggcacttgataatgtgacaaaaaccagcctcttccaccccactgcagtgacttttgccggaaagtggagcagtgggcacggccaaccttgtcgttcatcaatgccgcccctggcagtatctgaggatcggtggcagccatgcctccccctgccccagccgctccttcccccccacgctaatctgcatggtgtgggcgcccttgggacccccgaggactgattgtctgaccttgcttcacacgcccagtaaggactcccccaagatgtcgctcgagtggctggtggcctggagctggtcgctggatggcctgagggactgcatcgccaccggcatccagtccgtgcgggactgcgacaccaccgctgtcatcactgtggcctgcctcctggtcctcttcgtgtggtactgttatcacgtgggcagggagcagccccggccctacgtctccgtcaactccctcatgcaggctgccgatgccaacgggctgcagaatggctacgtgtactgccagtcccctgagtgcgtgcgctgcacccacaacgagggcctcaaccagaagctgtaccacaacctgcaggagtacgccaagcgctactcctggtccggcatgggccgcatccacaagggcatccgcgagcagggccggtacctcaacagccggccctccatccagaagcccgaggtcttcttcctgcccgacctgcccaccacgccctatttctcccgggacgcacagaaacatgatgtggaagtgctggaacggaacttccagaccatcctgtgtgagtttgagaccctctacaaagctttctcaaactgcagcctcccgcaaggatggaaaatgaacagcacccccagcggggagtggttcaccttttacttggtcaatcagggggtttgtgttcccaggaactgtaggaagtgccc

SEQ ID NO: 102999 - DNA, 2606 bp, Homo sapiens
tgaggcaggagaatcgcttgaacccaggtggcagaggttccagtgagccaggatcgcgccactgcactccagcctgggcgacagagtgagactctgtctcaaacaaaacaaacaaaaaaattagccgggtgaggtggtgggtgcctgtaagctactccagtgcctcccagctactccggaggctgaggtaggagtatcatttgaacctgggaggtggaggttgcggtgagccgagatcacaccactgcattccagcctgggcaacagagagagactccatttcaaaaaaaaaaaaaaaaaaagggaaaagaaaaaaagatgcaaaaggaggtaaagaagctcccttgggcctgttttataaggatgctgctcccattaggaccccaccttcatgatctgatcactttccaaaggccccacctcctaacaccatcaccttggggtcaggtttcaacatgggaatttgcagggacacaagcccacaagccttcagaccatagcacgggctccagaggtgtgaggcaggtcaggtgctttagaagtcaaaaactctcagtaaggcaaatcaccccctatctcctggccttccctgaatcttgcctgccttcactctcctttctctggttttcctacaaggtctgaaaactccaaatggctgtgagctggtggtggggggagagccccagtgctgggcagaagggcgctgccttctctttgatgactctttcctgcatgctgcgttccatgaaggtgagtggctgcctttcccacttcctttttttcaatgaatagacttttatttttttagagaagttttaggtttccagaaaaatcaggcagaaagtaccaaggaggccccttcatatcaccccataacacatatacacacacagtattgatgcgttattattacctaaagttcatggttgacattaaggttcactcttggtgttgtccatccattctgtgggtttcgccaaatggataatgacacggacctaccatgacagtatcatacagaatagtttcactgccgtaaaaattcccacttaaagatccctccatctccccatttccttttgtccaccctgctcagaagcccatgaagccaggtttatgctctcagtgagagaggaggtggtccgatccgagccgagggacaggatggggtccctgccccgaagctgagcacgtagggtccagccctgcctggatcctgggtcctgactccagggtggtttgaacctgtcctctcacccctccttcccccccaggttcagcagaggatggcccacgggtggttttcatggtggatttgtggcatccaaacgtcgcagcggccgaacggcaggctcttgatttcatctttgctccgggacgatgagagtatttcccatgctggagtcggcgagaagggccgaggcggggcctgggcagactgtggtccggtccagtccctaccggtgttgtttccatgctcagaaacctgcctcagcggaaagctcttatttgggattttatatcatgtcgggtccctctttcccttggttattgtaaatggaaacttttcggcttgtatttccttagattttttttttttccttccaatcatttgcttcagagactcctttctggcctaacagcgcattcctttgattggtccttgagtgaccagagacttagtgcccttgtaagtctgtcttctgttgctacttgtttttttcagtgctctgaaatagagtaactaaatggttatttgtctgaatataataatgtaaaacttcttgtggtcatcttaaaaaaaaaaaaaaaaaactaaaaactgcaaaccagagagctagagaacttggcctctgatgctggcacactggggacccttcagccacctgacggcagggggacagtctgcagcccccacacctgactggcttcagtagccaggtggaggggctgccagacacagtcagggtggcacacagtgtccaggcccagggatactgtcaccatcgctcacctcattctaaaccttgtcaggtccctgatggcaaaagcattgggccagtaggactggaggctactctttaaacatggctttcctgcaaagctgaagctggtgtcccccagcaccaagctgcggctcacacagatcagccacggaacgtgtgatccgcttacctcactgcctacagaagccctactgccaaactgggcctggaaaattcccagttttaggtgttttgagtccacagtgatgaacgttaaggccaccaggttggctgataggagctgtagggggataggaccgcgctcacccagcgacatttggggaaagcctttctctggcaaaactggaataatagatctgaccaaagtttctgttttgctttggagttctgttgcctatgtttttttttttttcatttatttgtctgtacataaatgttcaaacactagacttggagatagtggaagagttggccctgtgtctttgtcatggcacaaaggtgtgcactgcgtgacaatgacccaagccagtgtgtgctagtgaggagacagagaagacctacatgcccagaggacccgtggccgttgtgctggttttctgg

SEQ ID NO: 103000 - DNA, 1033 bp, Homo sapiens
acaaaaaccagtgcttccagctttccattatgcttgttgcttatcccagcccagattctcacataccttgctctgtaccttagaaagtacatagagagtgcctaatacagaggaaacactcaataaatgttacttattattgttatttagtattattatctttattcgcagttttgtttaggctcaataaataacagctttagttagcacttaagatcagcatccgaagggccgtcacaaggggagaaattagattaattttgtgtgctcctctcccctagaattagggtcaagaggcagtaatgtcccagagtttacctctgaagagaaagttgctgaccatttggctcagcctgaataaaaagcacctgcgattatttttaagctctcagaggatgccagtgagagtgaatgtgcctaggggtttggaaaactcaaggcatttttcatatcccttgacactgtcacgatctcctcaactgcttcagtattccccaggagctccttgcttctcccaacacccaagtgtggtgcaatcaccatcgctctgagtagagattgagccagcattttacacgcatatctgtgtacgcatttaccagttcataaagcattcctgtgtacatcagaactctctaccctctgtgagaaacgtgcagcagcctctgggccgactttcaattctctgtactcctttctgaaccccataatcactgtctctggctgtggcttgtcagtttaaatccagttcattttaattcactgttgactttcttttgctctgggtctgtaaaaccagttgacttgaataaagaaagcccagacacttggttttgtctctttactttccccttaaaactatttataataacaaataccatttgttgagtacctgctatgtgccagacactgggctaagaatgttaacccattttatgcctctaaactcctccgtgttgggaatgatttttatccccattttagagatgaggaaactaaagctcagaaaggctaattctgagcacttaacaac

SEQ ID NO: 103001 - DNA, 1011 bp, Homo sapiens
cagctaatttttaattttttagaaatggggtttcagtgtgtttcccaggctgatctcaaactgctggactcaagtgatcctcctgccttggcctccagaagtgctgagattacaggcatgagtcactgcgcctggcccaagagtcccctcttgaccacccactcaaaagaagccccctggttactcctaatcccacctctttactgtacttttttcacaacagttcccatggtttgctatgtccttgtttatctgtgtttatttttcttgtatgttatctggtgccccctctagaatggtagctccaggggaacaggaatttccattatctggttaacatcatgtcaaccagacacaatgcttagaataatgcctagaagaagaggagcttaagcaatgtttgttggatggagggatgggtgggtggcgaggtggatgggtggatgactggatgtgttgggaatgactaaattttattttttggccattttcataatagtgatatttctttttctcttccttaggtcttgaaaggggactataaaacaccagccaatctgaaaggatattttcaggttagaaaccccaaggggaattccgaattctgtctttctcagctataccaccatctggctgtatgcccttagatgtgtcacttctccactctggttgatggttttcccattataaaaagggggatgtgagctggctgcctgtaatcccagcactttgggaggccaaggcaggcagatcacgaggtcaggagttcaagaccagcctgaccaaaacggtgaaaccccgtctctactaaaaatacaaaaattatccgggcgtagtggcacacacctgtaatcccagctacttgggaggctgaggcaggagaatcgcttgaccctgggaggcagaggtcgcagtgagctgagatcacgccgttgcactgtagcccgagcgacagagcgagactccatctcaaaaaataaaaataaaaaataaagggctgtggggatgcgt

SEQ ID NO: 103002 - DNA, 1050 bp, Homo sapiens
cgcctgtcggtgcggagggtgctgctggcagccggctgcgccctggtcctggtgctggcggttcagctgggacagcaggtgctagagtgccgggcggtgctggcgggcctgcggagcccccggggggccatgcggcctgagcaggaggagctggtgatggtgggcaccaaccacgtggaataccgctatggcaaggccatgccgctcatcttcgtgggtggcgtgcctcgcagtggcaccacgttgatgcgcgccatgctggacgcgcaccccgaggtgcgctgcggcgaggagacccgcatcatcccgcgcgtgctggccatgcgccaggcctggtccaagtctggccgtgagaagctgcggctggatgaggcgggggtgacggatgaggtgctggacgccgccatgcaggccttcatcctggaggtgattgccaagcacggagagccggcccgcgtgctctgcaacaaggacccatttacgctcaagtcctcggtctacctgtcgcgcctgttccccaactccaagttcctgctgatggtgcgggacggccgggcctccgtgcactccatgatcacgcgcaaagtcaccattgcgggctttgacctcagcagctaccgtgactgcctcaccaagtggaacaaggccatcgaggtgatgtacgcccagtgcatggaggtaggcaaggagaagtgcctgcctgtgtactacgagcagctggtgctgcaccccaggcgctcactcaagctcatcctcgacttcctcggcatcgcctggagcgacgctgtcctccaccatgaagacctcattggcaagcccggtggtgtctccctgtccaagtgagtggagcccctgatgcttccactcagactctggccctggagtcagaggcgccaggcaagaaaatcagcactgcctttcttgagctgtgtggccttgggcaagtcactatatctctctgagcctccgtttcattatcccaaaaaatgacaacaattactcctctcctttctgagagaatctgcaaacttcgtgggctgtttgtttgtt

SEQ ID NO: 103003 - DNA, 1009 bp, Homo sapiens
accaagaaatgcagtcaacaccctgcagccggtttattgccatcatggcacaaataataaaagctgagttttttttttctttttttttttttttgagacgtggtcttgctctgttgcccagactgtagtgcagtgatgcaatcacagctcgctgcagcctcgacctcctgggcttcagcaatcctcccatctaagcctcccaagtagccgggactataggcaggtaccatcacctggataactttttattttttgtagagactgggtctccccatattgcccaggctggtctctaactcctgggctcaagtgatcctcctgcctctgcctcccaaagtgctgggatcacaggcgtgagccaccaccccaggcctggctgagatttaaaaagctgacattttaaagtgttgttaccctggttaaaatctcctgtttacagaataggaaaagtctgagaggagtgatatgtatactcaaggagttggccaactccagagctgcattccaaactacccacctcctgaaacaggactgacaggtgggaggtttagcttcagactcagtatgtgagtctgtaaaatgatttttccttgtgggcctcagttgtcccatctgtaaaatgggggaaggtttgaattggactaaaaatcttccctaccctaaatggtaaggacacagcactgggagatatatactccctgccctaaagctataaggatccccttgattccactttggcctggttctggctacatgccaggactcatcgtggacacagcctcgttcctgtaaccatgggagattaagtgttaggaaggtcttacagatctggatggtgaaactctttccatccattccttgggtaagttgctcttcctcttggtgtcatgctttctcatctgtaaaattgggatcatcacactttccttttattggggtttaaatgacacaggtatttgcgtggtcagcatttggtcagtgttaggtggtgacagtaggatgttgtgtt

SEQ ID NO: 103004 - DNA, 1197 bp, Homo sapiens
actccttcggccttcttcctgttctgctctgcgtatcgcccaaaaatcaaaggagaacatcctggcctgtccattggtgatgttgcgaagaaactgggagagatgtggaataacactgccgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaagatgaagaagatgaagatgaagaagatgatgaataagttggttctagcgcagttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctgatggtattttcaatagccgctaaccttgcctggtacagtatgggggctgtaaattggcatggaaatttaaagcgggttcttgttggtgcacagcacaaattagttatatatggggatgatagttttttcatcttcagttgtctctgatgcagcttatacgaaataattattctgttaactgaataccactctgtaattgcaaaaagaaaaagttgcagctgttttgttgacattctgaatgcttctaagtaaatacaatttttttattagaaaaaaaagatattgcatgtgaagcacttagttccacacctagcaaacagcaggtgctctaggtcttatcatcattattactattattagtatctggaatctagcatctcacggagagtcctttgtaggacatggaatgctatcccagcaggcacaggaaggaaaatttaggcttaggtactagggagccatggcagatgtttgagcagtgggtgagcagcatgactttgaagctgcatagggctggccgccagtccagtacccacctacagggaacatctttgccaaggtccttcctcgcaggctccaaatccctggcagtcctcccagtgctgctgggcaaagccagagcacaactcccacaggctacaccccgtgacatttccagccttgtttg

SEQ ID NO: 103005 - DNA, 1077 bp, Homo sapiens
caggctcctctgagcagtccagggtctatttacagagagcagcaagttcctgggacagaggagacagaagggaatttccaggttcttcaggacgttcacaaccacactgagaagcatctttgcagataagtatttaaacttaccagcccatagcctaccagcctgccctcttctggtctgtgcaggaaagtgtagtatcctagaatgccaaagtgggaggggaaatgggtgatgtagctcattctcttttctacctctatggaagaaagaaagagcctgtccccattttgtggggtcccagaaagggtgattttcacacttcacatttggcgttagggctagtatttcacaaacattaccgtctggaacttttgaaggctgagttaaatgacttcatcttgtgtacttgtagaactgctattagaaggaggctggggactccctgatgatgtgaaccagcccttctcttctcagtttcagcactttgtgatcatatttataaaccttggacagggctccttggccttagagttaagtgaagagttaacactgtgactttagatgcatttttctcagtgtaagtgtctgagctcatctccagttctggactcgtgcccccactcccgggtgctgacagcaagctctgaagatatgctgagagagctccctgactctcctgactcaggtctgccagttgatgaagacagcacagttgttaccaaaaacaaaacctggcagatggtcctaggtcaggattagtggtcattctctggtcttctccagactggtgacacagggtggtcttaaaagagtcctagtccagcctctggctccccgaatttcctctggtgcatggggcatcaggaaagggcaggggagaaggagggggagcagaaaaataactgaggctgggcagaagggtcccttccatttcccatccattgcttcaaacaatgggtgattaccgtgcaccttgagtgaatgtcaaggcaggaagggttccagggccacccagtgtggcaggagcagagctgggatcagaattctggattcctgactctccgttcagctgctatt

SEQ ID NO: 103006 - DNA, 1015 bp, Homo sapiens
tagtaactcacaatgcttcctggggtatttaaattctactctctcatcagcactgagcacctactttgggccctttcccgtgctagccatttgggggaaatataggtgaagagtggctggggtttgaacctttaggatttcacagccatgctggatgggataaaaccagctcacatggagaatcagagaatgggacagtgccacaaaacagtctactgaggcacaagttctgagtgcctgggaagtggtagagagaccccagagagggctgctgcagtctggaacagcttcctagcaagctgtaccaaacagggccttgaaggatgagaaagatctggctgagatgatacccgaccctctagggaaattcttaaagtaacttctaggaaatgtcattgctccttaaaaaaaaaaaaaaaaaaaaaaaagcaggttctaattcaaattccgctgcactactgaagtagtgcaggacttatcagaacctttaaaatgctaatggcaatttcaaatactcagggacagggcataggatgaagtgttccttgacttttatggccgtagaatctttttctcatggaacatcgtttagaactgtgggagatgctaggctggggtttctatgggaaaagtacagcagtgatagaagatggcataattagggtacacttaggtgctttgtagcattggctgaaaaggaagcagaccgggtgggcgtgggggagtctcaacttggttccaggagccaggccagcttgatgcgttttttttttttctaatggtgggagggcaggccaatagttggagaaactagaggcctgacagtcggtgatggaagagatgtctactaagcacggttgtcagatcttttgcggagagatgcgggtgtgcgtgtgtctgtcagagtgtaacaggatccagccctctgggaaggggctgaccagaaccaggcagggggtttctgtctaggacaagtagggtccattttcaggggagctgaaatatttgcaggggg

SEQ ID NO: 103007 - DNA, 1120 bp, Homo sapiens
ccgtcccattcccggaagctagagggcgttagttgtcgggttgaaaaggggtgtggggaggggaagcagctttaccccgggctcggagtttgcaggagagagaagtggggagcaagaagtgaacctcaggggctcacagggttcccgcagatgctcaggccggccaggaatgcatctctggctctctgttcccacggacgtcactgcctcagccagcctcccccagagcccgccagccgctaagccggggccacacctgggggtgatttcatgcctcacctccagtaggcaccttggtttctttgggctaatctctggctcccttgcgctaactcttgctctcacccagctaatccctgcctcaccctgactgccccaggggctgaccactaacaaccaacctggccctgtctgggggttccaggctcctggcctggccctgaccggttcttaattaacctttccttcaccttgactaactcctgccttcctggtctgttcctttcagcagaaactaatggtttgtggatttttttctgactaacaacaggtctaacattcctcgttactgttaacagcttggatgtcggcatggctgggaaggggctaacacagctttgaacttggctaacacaggtttgaacttggctaacacaggtttgaacttgactaacacagggaaaagcatagctaacaattttgggcgtggtggctgctctgagtcagaacaatcagaagtcggtaaagatggtagttttctaaaggaggtgccagggctctggtgtggaccaggcctgatggagcagtggtacccaccaaggtggggtcagaagtatagccagtcttgcaaggttttggccattgggcatatcttcactcctcatagtctgcatttggtttcagttcttaaaaaaatatagccttatagctacagtagtttgcacaagtagatgcagctcttataaaccttaaaatacctgtctggtgtctacagagcatatgccattttgtatagagtcacccttccccaggccagggcctagagtcttcattttggggactttgtgttttggaagttctaggacataaagctttagatcagagtattcagaagggttat

SEQ ID NO: 103008 - DNA, 1012 bp, Homo sapiens
tatacattcattatctatcctatattttttacttatgaattaatccatttatccatccatgcactcagctattcatccatccatccactctccatctatccacccatctatacatttatccatcactgatccattcacccaccatccacccatctttccattcatccacccattctttcatgcatccatctatccatccaccaacccatccatctacccatctatccacatatccatcatccatccattcacccattcatccaccatccatttgtcatccatctatctatccatccatccatgcatccatccatccatccactcatccatttatccactcatctatccacttatccatcatccattcattcacccatttatccacctatccttccatccacccatctatccacttatccatcatccattcacccatcctgcattcatccattatccattgatatacttttcatttaatccgaacaccctaatgcctttatgttaattaatgaatttattcacttaaccatgtgtctatttattaagtattttaatttattaatttactaagctttcagttctattcagacccccgagtatttacaagtgctactactttgtgccaagtgctatgttaggctctggaattaagaggtgaaggagacagacctggttcctacctgtgtgcggttcaccccactgatttctggaattcaggtgaggagctgttcatgggagatcctgaagtcagcacaaaatttctgctctctagggactcatgatgtgacagagctggatcgtgacacctggtgctggttctaccactggaatccttaacttctggatgggcctcagttttcttttctgggaaatggggacaatgttgggaaaatcttcttcttcttcttcttttttttttttttttttttaacagagtctcactctatcgccaggctggagtggtgcagtggcaagatctcggctcactacagtctccacctccagggttcaa

SEQ ID NO: 103009 - DNA, 1225 bp, Homo sapiens
tctctactaaaaatacaaaaattagctgggtgtggtggcgcatgcctgtaatcccagctacttgggaggctgaggcaggagaatcacttgaacctgcgaggcagaagttgcagtgagccgagatcacgccactgtactctagcttgggcaacagaggaagactctgtcacacacacacacacacacacacacacacatacacacacacacacacacacacacacacaaagaatttcaagacggtaacagcaaaacataaacccagcttggagcctttctgagcgccgggctctgtgcaactgcagagatctcatggccgtaaagttggccctgattcatgcccattctgcagaggagaaagctgaagctcagagaagtgaaatatcctggtattctcactccaattccagaaccccctatattctgcacccccttccaatgcttgctcatgtctaatttttattcaccaatctccagagaagggttcgaagcaattgatggtaaaatgcaggagctgttaacacaggtgcagtggaaggcacaccatgaccctgagggaggacgccggcctgggagctgtgtgaccttggatgggccgtgcaaactctctgtgcccacagtccctctgcagagactggttcagaactcctgtttccccagcccccaagccttgcctcccttcctgacccatattccccttggtgtctgaggcttgaagcggttataaaaaataaaaccacagtcccctgatgtgctttctggcttctcaggccttattttttttggccgctaaggagactaataaatggcttgccacttgacgtaatcattaagggctccactgagctgtgggcagtgttttctctcctccttggccgggcctggggcgcacagccaccgagggtggcagtgatggatggtgtcatcatggggcttgcccgggggaagtgctggtggtggttggccatggctctctctcctgcaggctcctgggctattcattatgcgaaggaggagctgaagcgtgggggtgacggctggcttccagaaggagcatggactggaattccaggcggagtgtgggccagggtgtatataaagattagtgttcgggtgcaaagagtcaattgatgagtggccaataaacagagggaaggaaagcagggtataatccaataatatgcattaaaacattttctgaagttagaaaattggtaaaaacttt

SEQ ID NO: 103010 - DNA, 1035 bp, Homo sapiens
catctgcaatcatacatttctactaaatattaataaaggacaaggatgttttaaggggctgaaagctggcagtgttgaacttgtcatggttttctaccactgggttttctggctgttttgattttaaatagccattgctttctaatatgcaaaatatatttatatattcatatatatatatatatatatatatatatatatatgcaatttttatagattgaagggctttcctcaagtatagctttctttaatataaattcatttagatttcttgtgaggccccttcagaccggaaataaggaactattgaaatgtacttctagtttattgaggtttctaggaaaggagtgagagttagttaatctaatttctctttctagcaaggaaattctatgattcctgatatgattttgtttgcctgacagaggtatttaaatttccacaaagaatcttaataggttttgaaaatgcggctactcttgccaagaagttacttgataccctgtgctgatataaaatatacatttttaataaatagtccggcaggaccaggtgaaattagaggaggaaaattcttcccactgtggaagggccaacttgagtgggtcactgggatttcacaggatctcctaaactcactttatgctggaaaatgtagcagaatcacttgtgacccgtttctctccacctgaatgacaatgacgtcggattgtgttctttgcccagggagtgatcagctttgccgaaagcatttaggagagataaacactcttggtaaggaatactgtatttacctctgtttggttatttttagagattaaaaggctgtagctttatataataggatcaaatgtctggggagtgtgtgggagcaagcaggcctcccaagcacaccgcaacataaaaacaccaaatcctctcatgccagagcggtcctctgtttgtcggagggggtggggggctgcaaccagtggtttcaccttctgtccttttctcactacccgctgcttgttccacccagttctctggtctgga

SEQ ID NO: 103011 - DNA, 1050 bp, Homo sapiens
gtgcacaggctgcgcttgcagcccccctgcgtgcaactccgagtggccgcgcgcgtggaagccgtagggctccatgttcatgcccaagatcgggggttcgcccagcgcgctcatagcaggatccacagggccagggggccccccagtgtggaaagccggggccttaaagtgggtgttcatgctcagtccggtctcgttaaagttcctctcgccctggccagcgttcctgctgttgacctggggctcgaattggtccagcccaaacatacttggcggggggcagagggggatcaatagggcatgacagccggctctccgcggcgcgcctccggccagctactcgttccagcccaggattgggcgctccgggacgctcagcaccgcgggggctcagcgcgcacctccaccccgcctgatgtgagggacggggggcggggtattagctcctctcctgaagctccgattctgcccggggagggcctctcacatcttgcgaggccgcggggcctctaggagccgtgttggggggcccatgccccgggcggttgtcacagccgcgggtgggtctgcggggaggggacgaagccgcggatgaacggagacaaaaagttaagtggggggaatggggagggaagggggttgggagagcagagcgatcaccttctcaagtccgattgggtctgctggggagccctcaggacgccgcccgcagcctcccggagtccgtggcagagctgctaagggcaggggagggagacccttcaaagccgcggctggcgccgggcaccgacagagcggtccctccccccgccccccggagtccccgcgccccgcagcccgagcctccaccgagcacgatccgctcgcacaatccccgtaggctccgggcgagcggctgctgcttcttcagcgggtcggaggactggaggctccgctcggcatcgccggtgccggcccccgagccgaggacgcagaggggctgcgaggcggcaggcgccgggggctggagccgagggtcggggaaaggcgcggctcctctgctcggcagcg

SEQ ID NO: 103012 - DNA, 2482 bp, Homo sapiens
accatttttgtggtcttatttctctaacacattatatgcccatataacaaattttcccagagatgcaaaaaaaaaaaaatcaaaatctccctcacaaattgaaaccagtgtgagtaaacaaaaatcaacagtgtgctgtcatcatttgtttatactgaactataatgtttattataaagagaacgagatgtagcactcccctccctccactgtggttctttgctgccccacatgagctacctgctctttaatttttgaacattgggatgaatgaaatgttcagttgtgagaaaagctagttgtgccaaataagaatgaagtaactcttccaagattccccccaaacacttttaaattccatgttcattaaaaaaaaaaaaatttaagttattgttacttttgttaaactctcctaagtttttgtgatttatttctgcctcgactttattttcccctctgatgagacaatatattgtggcattagtagtaagaccaaaatctttttgaacagatgaaaattgtaagatgcagtagttggggtacattttctgccaaaagttttgatgcatttggagagtgtgtgtgacgagctgctaacatttcctgtctctgtattttaacacattttgcactgtctttcacttttcttacagttacgtaatcaaggtcaagtgaggggaacaagcgcagccagtgatgagtgaagaagaatctgaccagtatcttgcagtgttgacgtttcccagatgtgtgcttgtgatgatacacacacatgcacaggttctcaaccacgtgtgtatatatgtatgtgtgcatatgtctgtagctgtatataaagcgcatgtagagctacagatccagatacacacacttgtgtatatatgtacatacagacatactgaagggattagtacaatttctccaaagtactgtacctatcttcagcaagaatgcaaaagaaaatattttcaatatatatacctggaacagattttaataattatcagagtaataccattaatggacaaattgactgcaatgtaatactagctggtatgtttcataaatgtcaagctgtggaccaacatatatagccttttattatttttctcttcttttaagtcagtctgttataaatttttttttagtcccataagcagtagactcccacagaaaatttcttcaaaattttttggtgttccaatgaatctgggatgtaaactctgaatgtatttataactatttatttctggatggtcattatcttgtagccaaatttgacaatataaagtaaggagcaaagttacaggccagtttttacttgtttgccctgagggaaaaatccttttaaaaaaaatttctggtttttattggatttttgtattttaaatttcaaatatttttctacatcaaacctagcaaaaatggagatgacggtttctgatttataataaatactagacagttttcaggctcctgttagacaaacacattgatgaagaaattagtcttaataggattgtaggctgtgtagaaaagttggaaatatagcacttcatggagtcttgttttgaagatgacagttttctgtaactacagcttggaaactatgcaaatggtctagattcctcagagctcacatgataggatatagttagtgatgacattttgctcttcttgtgggaacacacacttcaaggaggagatagtgactttgagataggaacagtttaagatgcagtgtgagtctggcctgcgtgcggtgaggaggccccgccaagagactggtggacatctgactgtgggatgtgctctcaagtaggacgtcatcaggacagattctgaataggcatcatgagagtgctggtcagaaacggctgccactttttttaatttaattttattttttatttaaaggaaggaacaatagctaggtaagatttttatcagctttctctgtctgaatccagtttttcctctgtcagtcctggaagcttgaatagaattatattgttgaagccttcaggtcacaaactgtcttttgtaacctcctgtccctcctaaaacacgccaacccctgcagtcaaatcacattagtaatctgatttgctgacagtcctgccctgcctgctcctcgttttcccacatgtcctgcatccctcccccactggagtgatttcagtgaatcagacaaggaaggatgtgtaggatcactactgcattgcaataccctgttatcctcagcaacaaaacccacatttcatacatcctttgtgtactcaggataaagactgatgtttactctctgggcactgttgtaagataggttttgtcagagcataatcattgtctgcaaagtgtttggtgcgaggaagattattgctaattttgtgaaataaagagtctagccctctccttttaatgaacttaactctcgctggcatctgtagtatcattgggagcttaggcgcacatggaaatg

SEQ ID NO: 103013 - DNA, 1049 bp, Homo sapiens
aatgcctacccagaaagcacctgcctcctgaagaggcatcccattttagagtcctcttcacacgcagaaatttctttttccttgaggtcctgacccctgacacctgatgatagattttaatgacattataatgctcttaattcacaaatattttaagaattggatttctttcaaatgggttttggccctggagagaactagcatcttgagaggttaggcacacgaggaatgcccctgcctatgatctgcagggaactgccctggagttgaggctcagcagctgaaggaggactttaggtaaacattttacctgtttgttcttaactggcacctccggttccggggtgggggtgaggatgtgttgagttttaacgtatttattgcatttgtttgttttctgttcatttcgttttttgttttctcattgagtggtgtcacttgtctggaggctattgttatgaatgcctgtcctttctaatacatctgtgtgcccttcatggtttgccatacattgtttctgtgcttgccttttctccctttcattctccctccttgccttttctccctttcattctccctcctttcagtaaacttcctttaaaggactccactgagagaccctgttctcagaagcagcaaagaggtgtggcccacaccctcatggcttgcttgtctggcctagggactatgcaaatatggaccagacccttggggtattttctcacattatattggcaaacaatttgtttacccattggctgtttttgataattttttatcagtctgcaggcttttgttttttacagttaaggatagataaaccttttttgtgctaagaaaagccttttgcaagaatgtcttcaaaccaaggttatttgaggggccacagaacttcattcttaatgtggatatggttatgaacatcacttcataatctcttctagatcttttttctccccttgcttactaacccctatttagagtctgatttcagcagctcacaattttattttacgtttagatgcgtaagaggggttccgttcgaggca

SEQ ID NO: 103014 - DNA, 1071 bp, Homo sapiens
ttgaccccaatttctcatactaatattaggactctgagttctggatatagggaatagggtgatgagatggcaagagtggaagatacccccctcattccttatttttagtctagccacaggcaaaacacttaaataggcaagagcagatcatgggcacttcctacctttctttctaggcctctctcccacttctgtgttccctttttcaagagtcaggtgcctttctctgactctaacaagcacccccctggccctcgctaccctatccagttttagtcccatttgccttgtctggtttcactccctccaagtgcccaaggcttcaggaatacctgccagctctgcctttggctcttccaagcagctggtgggtgtccactgaacatgaaacagaagcagcaagagacacccaaacacgctaagcccatgatgcagcactggcatttcctacaaggatttaccaacagctcaaacccttgggaaagagcccttctctcagtttttaatttttatgctgaagaactgtgtgtcacatggggaagagtagttaccattgaccaggtgataagccctatctggtttggactctaaaccctacctatctctggaccccttggacagaacttgactgagatttcttcccccagggaagtgctcttgcttctctaacaagtcctcagcctcacgatacctgaacacagaatggtcccagcctcaacacgctgtgaccctccgctgtggagctggtgactcttgctctcacctatggcagtgggcctgcaggtgcagctgctgctccatgcagatcagttatttgtgagttgggaattgcactcgagaagaaggtgtaagatagacaagtaaaagcccaattccttagtgtcaccattcttatacccacattgctgaaactgattaaccccctcataaagctggtggaaaatctatcattggttcagagtgagggtacatagcagttgctttgtcaaatatctcaaaaacattttaagacaaatttcaccattaagtggtgcatcttaacgttgaatcccatttaagttattttgctgt

SEQ ID NO: 103015 - DNA, 1341 bp, Homo sapiens
catgttgtgtagaaaaattaagggagagtttgtaatgattcttaatttaataaaagaacccaggactcttttctttcaatgcattattgtattccacctcatagtgaatgttaagaatgacaatatatagttttatagcagaagaaatctagttgacctttgctcattgacatttagaaaaaggtaaaaataaatcaggcccagcaggaatgtgttggattaggtcatacacaccgcatttttttagtttctactagatcatgacacctttgcctaggagattatttttcatttcacagggaaagtttttttttgtttgtttaattttgctggacacaatgataattaaatggaattatgatttccacaaatctacagagtagtctttttgaaccaaatgtgtaaatttcatgggttaattggaacatgtaaagttaatgtgtcattaatcttaggtttttgtcatcttatgctacttttttgttgttgttttaaaagcaagaaaaacggatatttacaaacttccatcgccagcttttttgttggattgacaagtggatcgatctcacgatggaagacattaggagaatggaagacgagactcagaaagaactagaaacagtaagactggctgttctatggcaattctctaattttcccttttctaaaactgtatacatgcttggtaaatacagagttagaattaggaagagtgttgttaaaaatcattccctattctacttattctcatcaaaatggagtttcttagacactgctattccttcacatattctgatctctcttttgttgagcatcttgcgtgaaggtagactagagttttctcagtctagaattggttacctgttaaatatctaatggttctgtattctttcttacacactagctttagttctgtaggctggttcctggttcacagtcgttttagacactttgtcagactaagttgcttttggctcagtttgtatcacagcaagcttaacaaatgttaacatgataagtcctagttcgctttttttgtagaaaaggtaaggctaatggtattgttactaattctggaaatgcctcctctgcttcccccaactggcagtgatccttatttcttcctaagctttgggcagattcaggtgatccttgggcaggaggtcagcatgccacagttcagtgttacagcccatcccagctgctccccaccaccagtgggcagggccggcagccagtgggtgtcttctctctcctcgggatggattcttccctggcttcctcttgcatgtgtctggttttgtttttgccctgggccatgcttgtcttcagttggcagta

SEQ ID NO: 103016 - DNA, 1038 bp, Homo sapiens
taaacagtgcagctccacttgccaatatctgaagatacagaagaaggctgaacttccttgtcattttttattgtgcctcaccacatccacagtgggagtgcggtaatggtgttatgagaacccttatgtattaaagacactattggtttgatgtgaatagaatttggtatttaatatgaaatctgaatagtgttatttgaggcagagcaacatacctattaaactttagagctaggaagtaacttggtctgtggaaggagggtttacagcaggggaatactgcggcttttgctaaaatgatttcaaattttcaaatatctgaattaaacacatgagattgtaattttcttcatgtatgtctatgatgtcgttatacaacagtcaattttaatgaaaacataaatatttaagtcataatttctccttttcaatttttctcatctagaaggagctggcaaacagccctgactgtccccagatgtgtgcctataagctggtgaccatcaaattcaagtggtggggactgcaaagcaaagtagaaaacttcattcaaaaggtaaaatctgctcaaaatgtggtgacttagatttaggatgagatcggagctagctattaatgggatatcttctctgttattactttttttcctcctttatgatatgaaaattattgtccctacataattcatttcagcccttctttatacctcaaagcagcaaagacagatggcagcagaggttttaagggactttctttggagacaagcacagcagctttttgttcaaagtgcttaccttatggtttgcccagcgcttctgtagagaaccctttccccatacagcacgtccccaagaggacctggtgttctgatcctgactggagggagagagcgggcccagcctgctgaaggactcccctgccccatctcagctggacccttccccctaccctccatatctctcagaatatgtatgtgtgccttgtgctgtcacaggggatgtcttctttagaggtctttactgaaaaatgggcacactg

SEQ ID NO: 103017 - DNA, 1079 bp, Homo sapiens
tcaactttcttctggtaatgtttatgtttttaggcagcaggctgtttagttgtttgttttttagttgggtacgtgttcttctctgaagggtttttaaaaaaataattacttgtaaattggatggaaaacaaaaatcagattgggactgaatatacattttagatctggaaagatatcttagggaactggttcctttttgtcccgtggcttatagtttctaaaatgaattttatagaacaatgccactttatgaattaccagtattaattgatttgagttgcttgccagagtcactagaaagaatgtgagaaataaacttggttgattgttgaagtcacgtatgtgtactctgttcttggagctcaagtttagtgtaggcatatttgtattacatttagcttactcctttaattagaaccatgcttcatcccactgtttttataaaattgctggagaattctgaagcatcagtgttctaggtacacccaagattttcatttagtagaaagtgtccaatgatttgaagttgtaaaagaaagctttcaggagctcataattaataggaccttctaatgttcaatctggaaagtatcttagagttcatcagcagtttggtggggtactcagtcatagaggaaattcactatgggtgggtgacaggcaggggaatatttcctgaagcccaggcatattacagaataaaacacaaaattgtaggaagttttaggacaagtcattggatgtcaaggatatgtaatgtttaccacctacagccctagaccaatcctggccctcaaggaccttagttcgctcacccctgcttttagtttttcctcagtggagaatgaaaagtcctgatagagtctagttttcctgttacagagggagaaatgaggcccagagagaggttaaggatcctgacctttgttaaacaggaagtttaacaaagtagcactcctagtctagtgctactgtttggcagctatatctcacaattaagtgccatattctacatatacccaagttgtattgcatatgaggattttcagtgacattcattggattaggaagtacttcag

SEQ ID NO: 103018 - DNA, 1326 bp, Homo sapiens
tttcagtttttcatactgtttagctgctcagtcagctttagactcattctagaacagccgtagaggccattctggatccttcatgccagtggagggaaaccatatttctgcattatagagatgttaatttgtttactgccatgctaccaagatttctttctttgtctaccccatgtctgtgaaaagatgttggtacccttggtgtcagtgacctaagataatgaaactgcaaaatttttttggccagggataggaggagtagaagtgagtgatgagggagaagttgaaattcaggtgtggaaatctcttttgagatagagagtggcaggaaagccacccagagactcaagtggcttatgagcagtgttttttacttgttagccgccctagtagaaacactgggaggtgctctcttgtttcttagcctcgacttgtctgtgaggtccagggaggatacgaagcatttgaaaacatgttccctccctgtaatctcacatttgaaaccccatagtgggtggcataaagaggcttagtaattagtttctggttagaccacattttggattatgtataataaagcagaccttcaagcatggctgatttttttttaatatctagtttgatgactacattttttatttgatttttaaaataaatatatagcacatagtatgtactaattatattaactcctacagaagataccaaaaaaaagctgttccatgtctttaagaagctaagtgcccaaagagtgaaactgattaattctaaccttatcttggctatggaatgtctctgttctcagacagagttgaaggattcaggcacagacgaatgaatgtcttattcaggttcaagaagtaatttggcagtgtgagcttcttgcagattcttccagacacttccagaaacaaagttttcttcatgagtttcatttgaaggtgaacttggggttttacttgaaaatagtgtcactcctggagtaatcacccacaagcatgaagcatttaacatagtcctctttagtaaaatgggtgtgagccatacaaaaaattaagtttggaggaacatggaaaatgtgactgattatcctctcacaggcagtaagctttcctgtctggatcttatttcgcctttttgtgaaattagattaacctacaattagttcagtctttttaaactcacatttaatctcatgtttacttcttccatttaatattttccatttaccccaccagatgggacttccccacctttgaatgccactagagtcttgccgatgaccttctcatggctcccagtgtgtcttgggtcagggtggtggtt

SEQ ID NO: 103019 - DNA, 1076 bp, Homo sapiens
gttataatgcttttgtctttcgtctcttggggttgctgagatctataaatgtgcccctgtatttatgatgcgtaattcttatctgtctagtattcagagttcccctcattctagaatgtgttcccctcattctggtatctagggattgttaaacacatccgggttcacgtgtctttacccctcgtggttatatatgtttaatgagtgattttatttggtcatgcataaagcagagagccacacagtttagagaggattcactagcaggggatgatgaggttgctaaggaatatattttcatattttccacatttgttaagagtacagacaatttttttagcctatgatgtgatacatatcttttatttttaaaaaactacaaacccagagatgcaggcctcagttgtatatttattttccctctgaagaaagaatttttaaaatctgagtgcagaaattatatttttgttacttagggttcggcacttgatgaagtgactgtgtgcatagtaataggaaagcgatttataacctgattaagatttttgcttcaaggcagaattgtgcatttctgatggatgttaatgtcttgtttctctatagcactgtgtgcacgtgtgtttgtgtgtgtgtgtgtgtgtacctgtttccatttgtttttagcttttcagtttcccttcctgatttgggtgaggaattgttattttaacagattgaaacactacctttgacgattatggtttcatttttatcccatggcaaggcctcatttcttccttcatttaagccagacacctcttgaagatttaagcttctgtgtctacaaatacatgatagttaataattaggcctctaaaggtctttgtaagaggctttgtcaaagcgtctcttccttatagggcttgatgtgtctcggaagtctcagccagagctctgaactttggaatatataaggggatcaggtcaaataaataagttgatccagaaattatggtggtttttaaattatctttatgtacatgttctttctcatcataaaggcatgccccatttgtcttctgtgttaactctagcct

SEQ ID NO: 103020 - DNA, 1050 bp, Homo sapiens
agacaatgctacattatgtggtgggctttatgtttgggctcagatccttcctataggaactcctgattttataacaggcagcaaaagtagtttgatactatgacttgtactgatttctaactttttaggaacttggaatatataccatgtctggcctgatttgtaactgatattgctttgtcttttattattgactaatgattgaaattctagaataggtttagttcttagaaataatgtgaattttgtatttctgcagattgcagaactgcagtttttttccattttcccccctgtgttaaacagtaacttattaggctgatagggtgctggttgtttctgcccatttgcctgttgattgttcattttatccagatgatggtgtatccagctactcttataaattcagctactgcctgactgaatttctgtgaattactgtgatctcagaaataactagtgcagtcaagaataactgataataattaagccatccacttgctgctgtggagggaaataaagcgtaagaagatagctgataatatggcatacaggaaaataggaacctttggacttgatcttaccagtgtcttctgtaaacatgttcagcaggccctctttgccaattactgtcctggtggaggcactgagggtagcactggggaacgataatagttggaaatttttatacttctgaaatgcaaggaagaaatagggaacaaacatgataattatggctgaaaggaagaagaaatcttattgtggacccacttaaccagggtagtgttgaagaatgttcttatagaagagctgcctggtagttccacagtctctctctcaaaaggcctctgtgaaccatcccacacatacccttcagcagaaacctgccttaccagtacagattccaaagtctattcaaagctaaatgcaaatcctatgatttctttgaaacttttccttacttgtctgatggtggtattttccctctgaattattgcagtatttacttcctgtctgcaccagactgactaggggtaaagaaacttttcc

SEQ ID NO: 103021 - DNA, 1024 bp, Homo sapiens
caagaaactgagatgtccaccacagacccagctgtaggaagaggttgggggtgctgcagaatcgatagttctgattttgttcccagccacagtagttgctctggccagcattaacagtccagtgtcatcatctacctgtagtgtcaaaactgggatgggtatgttttattctttgaatgtgattatccatatatcaaaatgcttaaattatttaaaaaactgttgaaagatttgttattggagacagctgtccagtaaccagtcagaatggattgctagtccaggacttttattatttcttattatgtagttatttagcccaaggtaaaagtttaaagcaaaggaaaccaaactgaaaacagtgtcttaaagaagcatttttctacttttacgcaaaagcacagtgagtctaattgatttctgtcctgtgttttggtagctgcgaagagctattctggcacggttaaagaatattctctggttttcttctctgcctctgactttgttttgctttgcaggactacaaagctgatgaagacccagcattattccagtcagtcaagaccaagagaggccctttgggacccaactggaaggtactggatgctgacctttctgacaggcagagtcttggcaacagaacacttgacaggtcctgagtcttgaagagctggtgacgtttaagtgaaaaatagaaatggcacaaaaatagttttatttgcgataaggacttacagccagttgcagttggccagcaaatctgtgctgcattaacaaacagaacagagccagactgtcactttcagcataatgcagctccaataactcttaaaagagacaagtgatttagtctttggggattctaatgttctcttttgagacctgaagcagtataaaaatccattttaaatgaaggtttatagtttaaatttagtcttattaaaaactgaacaagctcccttcacccaagctcatattcctggacttttaatagttatatttttggaaagcaggacacgagtga

SEQ ID NO: 103022 - DNA, 1713 bp, Homo sapiens
aagttagtaaatgttatttctctttacacctctgttatttgcttttgcaaaatttaatgtaaacttttttttaatgggcttacttactctttggagtctcgcttgaattttgtcagcttgagttagttattcgtttggcattagggtcaacagtgataggatccaggaactcatttaggtgccacaatactggaaaattcagggcagtgctaataaatgatgtttgttatttatcttcatatttaattcagctttattccccatcctgggctttatttttaggatgtgattagaggaaataagccttgctaagttgaactgcaatacccatgcatttaaaacttaatgattatctttgagctattttaatagacacctaattaatcattgtatgctaaaggaaagcattttatataacaggctgcaggatcctaatgtctctctcaagcttttatgtttgcccagtaaaacaccccctctccacaggatagaaaataggggttgatcttttataagcaggtgccaaggagttgctaatgcttgtggtttgggtcctcttttccttagtttacacttagcctcacctctagtaacccatgcatggttatttaagcagtttctggtgtctggagctcatctcaatttttccacaagctgtcaagaaactcctaccagcctgccccccacctcctactcacttccccattcataattaggagttaaatctgggctcagggacatttagtttggctcagcacagacagattttgtactttcatttttgggggcagccactgtactcaaagattcatgaaactaatattctttgtattcgaaatgaatccggtttctattgagagtttctgttgagatctgtagtaacagatgtacacccaagaagtagcacaacttttgtattccagtgacagaaaacagttatttataagaaattaatgagtgtattctgtggctccagtgtggagactcagtaatccatttatttaccatattatattttgttttgttctccgaaggctatcctgcctttttttcttaaataagagttttcaattaaatagagttgtattaacactaatccgaatataccttatgctgatactattgtattttttctttgttcaggcactattattggtggagcaagtagtgtctagggatattacacctaacttgataatgatggttttactaagcccttattctggccaggcctctgggcattatacagataattaaaattgaatcataaaaaattttaaacacagtgcactttagcaataagatttttctacttttaaacatgattttaaaacccattttaaaaatgcatttccttggcctggtgaatttgctctcttttttccccaaggattacagaaagtgcatagcaaattcagccttcagaatacccaggagctgaagactcaagtaggctacagctgtcttcacccacagtattctaaaagaactaatgagatgagaagtctgcagctggtggcaagcacaataaaccatgagccaagggcttctcttcatcagagcctcccctttccccatgggatcccaaaggagacagaatactaacaaagccagcaggctgtctcattccacactattgctcatttgcagctataattggtagctgaggttgcattctgtatgctgaaactgtcatacatgaaggaatatatt

SEQ ID NO: 103023 - DNA, 2470 bp, Homo sapiens
gtttgtactggaatacaaaatcaatttgatgtccttttgataacacctgggttggcaagggatgaggaagcaggcactcccatacattgtctgtgggaatgtaaattagtggaactgttgctagtctagcagaattacaagtgtacatagcctgttgacccagcaaaattctgcttctaggaattaactctacccactgtaaagtgacaggtgtataaacctaggatcagaagtctaagtgtttctttatcaatcgggaactgattaaaatcattgtggcacactcatgtgatggagttcagtgcaatcattaaaagggagtgagctctatttgtactgatggagaatccttttcaagacaacctggagggagaaagacaaagaagtatgtataatatgcttccatttgttatattaaaagggagaaaaatagtttgcttagttatgtatggactatcaagaagaatgcataagatgccattaatagtgatttcccttaggacaggaatgggatggaagagttgaggtctgacagagatgtgtgcagtggatcaggggataaactcctctcaccaactgtatggtttctgttgctgcataagagatcactacatatttagtggctgggtaatgtgacctgattagtttgattaattaagggaatggcctcccattacctttgccacagtctgtggcttagaagcaggttagcggttctgcttgcacttaacgggagggaattacatgagggtgacttatggcagggaggggtttactttaggatgcatctgccataccagcagtcaatgtttagtgcctaaaacttgctctttaaggattggagtgacactagaatcgagagcttagtaactatgaataggccagtaagtgggtgtgggattgagtgggggtggggctgcaccccatggattgggtcgcctgttagacctggggaggtggggtgggtggggatattggagcagaatctccttcctagatttgctgagtctgtcttgttccggggaccagaggacagcttgtggaggctcaggttggatggttgaatggccagatccagatcctaccccttcagtcagccccagctcttaccctgcagctcagctgggagcctgactctcttgctttgtaaacagggaatgatcccctttcacaagaccaccatcatgtctgggcctgtactaggaggctgtagctagaacctgcgtttttctcaacactatttttatgaccaaagggcagcaccttctgaatgggagatcgtgtgactactgggaattcatgttcctctaatgcgcctgtgtttagtggtaacacctcacatgtagaatctggttacctatgcagttgtgaatatccagaagtcaggtaaatcactgtctatagtcttacccaatttaaaatttcatgatttgaccttttctcccttaaatgaatgtgttggtggtgatttggaaaaagaaaattaggaagaccttctgaaggtatagtgatcctcaaagtttgtacttgtggcaccttgactcctggagatttttgtctcagtctgatttaatcagtgatttttcattctgtatttaatgacttctggtttttcttgagtgagctaattaaaaaaaaagttaaatggttgagtttctttcatattacttgcttttaaaaagaaagaaaacagctgcattattaaatttgagtgaagtcctcagagtcaggacaaacatgaaatagttgggagtgcaagaaaccaagaatttgaaactccacctggtgggggctttctgtcactgcaggtgaatgtaatacaaatgcagccccaaatattttaattcagagtgattgttgattactcttaagatttaactctctcagctaggttgtcaggtggcttgtataccactcttgtagatttgctgtctttggtagtgtttatgaactatacttcaccatgcagagaagagatgggatttgactcatggcataactgaatacttgagtggatgctttgacatgtttacataattggagggtgacatcatcacaataactctaggaacaaggatttgttttaaaaatctgtcagtgtgacctagggtcacagagtagtttgctacaaaaatcatatgtatttaaatatatgggtcattaagactttttgttgatgacttgtgggaagtctgtatatgactattgctttagccactgttctctgtaattttctagaagctacatcacttcctgatgaaagaagccaagtagtctgggatttctgcataatgtcctcacttagtatcttttgtcccttcagaatgtacctaccataggaaacggatttcctgtttcaagagaaagtgacattgtagtgaagtgttattaagttgttatatcctttaagagggaagcgtccttctgctggtcatcccagtggtcacagagtacaccatgctccagcagg

SEQ ID NO: 103024 - DNA, 1027 bp, Homo sapiens
taggataatcaaattttggagagattttagaccatacagtgcatcatttgaattctacttgtaatgtcaccttatgtttgtataggactttgttggttacaaaggttacaagtactttgttgtgtatcatttggattaagcataggtctcgtatatttagttacataaatcatctgtgaggactgtcagaagataatattgacaggtttctattcatttggcagcatcctcattctctccttccttattatttggggttataagtggtaataaaagacttttagatcctgcaaaatgtcagacagctaatataatgaaataataatttgggtcttttaattccctataatgtcccctgagagactcaagataaagattatatgtgtaagcataatagaataatctacagtttgttttgtttcttttctctttgtcattggtaggtacatggtttagatccaaacacatggaaaactgttgaaattgtccatatagatattgcagatagaagtcaagttgaaccagcagtaagtattactcaatgacatttaatctgttcccttttacagttaaaaattattttctactatcacatttgggattaagttaaaaaaattatttcctttctttcttgtatggcctacatttctatgccgaagtgagcttggagtgaagtctagtacgtctgtgcagcaaagagaccagagtaagagagaaggcgatttgttttctgtgtagattttggctttgtgcaagtgatccctttaagaaatcccagtatacctgggaaatgtaggttgttttcattgaaaaacaaaaaacacattgtttacaaaataattctccctccagctaggtcccttttacttttcaaatgtgattaagaaagcaaaaatttaatttgcatacaagtatttagtaactcagctacagttgttatttgtggaaaatggttggtgtagagtatctttttaaaaatgttcttttagattccagaagtaggtgtagagtattttaatttaatagt

SEQ ID NO: 103025 - DNA, 1436 bp, Homo sapiens
tttgtgtctcatactttctttatctttaaactttgttttacacagtaattattttcaaccattctttgctaactgcacctcgctgcatggttccttcctgtgtcccaccaaccagccgccacactctaccacatgttcccagtgttcatgggccctttccacccttgtctcaaaatctccctattgattttattttgcttttgttactcccttcaaacgccatatttgtttatcagacctcacagcttctttattagcccgatatgccacgtggcaagtagaattgtttaaattatttaaaagcatgtagcatttggtttgcctgacaagtctataaaaatcggtagccaatgattctttgtcacttgagtatcagtctccttgtagagtcaaagcatggatgcctatactgggaaaagctccctcagacgtgggcaccaaggaacaggtagaagatcactgtcattttcctgttgtgttttctgcagaatgaatatatgaaagatgatttcttcattaaaatcgaaacatggcacaaaccagacttgggaacattagaaaatgtaagtttcaactctgcacttttagtacaaaagtccctggaaacgagaattctatatgtagttcactttgtcatcatcaaagtaatgtcacctgtgtatctgaccgcaccaagctgtgtcaaattgagatgaggcgggcaagcagccagaaaccaaataggctttccctatcagtccgcttgccttgacactttggtaaagttgctgttttgatcagcaactctctttatccgagacaaggagagcatgaataaacaaaattcacagataatccccagcccaattttagccattagttttgctaattagattgcttttatatctgagtgtttgtcagagctgctctgcatagcaggattgattgctttaatttttacctcttgtctgctttgcaagggtatgggctcatgttagagaaatggccaaaaggcaggagggataaagtacttgaataacttacaaaaatgttgaaaagctgttgacttatataagttggttcacatttatctctttaagattcaagaacatctttgagttaggacttaaaaaaatgtaatcattaacttttggtaaggtttgtcgtggaacttgggaagtcctgttgtataggttgatgcccttggtctaggagttctcaaaagtgtggtctttggatgggccagcagcagcacagtatctgaggacttgtttgaaatgcaaatactctgacctcacccaagaactaccgaaccagaatctctaggggtgggactcagcagtttctgttttctgatgcacattcattccaggagagtaggttaatgattgtggcaaattctgtttttactgttctattacggtgctcttacgttattgatgccagttaatagaact

SEQ ID NO: 103026 - DNA, 1081 bp, Homo sapiens
acacggtgaaaccctgtctctactaaaaatacaaaaaaattagccgggcctagtggcgggcgcctgtacccccagctattcgggagcctgaggcaggagaatggcgtgaacccaaagtggagcttgcagtgagccgagatcctgccactgcacttcagcctgggcaacagagtgagactccgtctcaaaaaagaaaaaagaaataagtgaacaaagaattagctcctttcatttttaaggatgtgaagacattaaggaagatttaaatgaagaaaggcatatgaaaatacccagctccgtatcaacttataattaaaaagcagtaactaccattttttgagctcattgtactgtgcaatgtgctaaacacattccagtatttgatttaattctcttaataaccctgcagagcaggtaataggaattccattcaacacatgaggaatttcagagaagccaagtagcaggcctaaggtcacacagcttccaaatggtgatgttgggatttgaattcgatctgtgtgaaaagtctgtgcaagcaaaactactctttacagtaggctccagtcactatatcagtcacttcatttgcatttatttgaagactgttaagactgattttcccatttgtttgttaacaaataacattttctatttgtaatgggcctgtggatgacttttgcccctttatatgttgggattgtttctgattatcatatgcttgcacaagcttctcatatattaatcatgtattgaacctttctcttcctctgaatatacttaaggcagcaagtgacattcatctcccatacctacaaaattttatacttggatatgctttaatttctcattttctgcatgggtcctttacattgtcatttttcttcaggtctgttctataaaatgtattcagacttttattcagagatatctccttattctggggctttttgcattaagaaacagtataatgtcatctaactcttaagaactacattgtattaatgtgcagattgaatagctgttaactcttaggttttacattggggtagtagatcagaagttcttaagaaataattgc

SEQ ID NO: 103027 - DNA, 1048 bp, Homo sapiens
tcttttttgcatgtttgtttttgaaggcctatctcccattttgttaattcagttaataattgttccttttctgaggctctctaagcttccaaaacaggaatctgctacattttactaaagggccttactattgttcattcagttaataattgttcttttcggaggctaagcttccaaatgaggaatctgctgcattttactaaagtgccttgctaagtggtaactgtggtggcaaaatgatgtatatgctctcaattatatatacctggcacacttgaactaccatgttaggaatatattaaggttgccattaataaaaatttctaacctttgaagtagaattgaaatttaattttatttactccatgtgcacattttcctcgtttagtcagttacttagattcattgaggagagatgtatttgataatgttctcacgttaaacataaaaaaaaagtaaatttgaaatctagcttatagatttggactttattaactcagtcaaaacataaaatgaattgctggaattcacatggtgggaaaagtatcttagaaataagatagtaggcatttgggagcgagataaagaaatattaaaattttcatgtagatttggctcatgttggcctttaatgataaatgccaatttccttctatttgagtcagcaaattttagaacattttatgaatattaaggttcttcacatatcaggcactataggaataaatggatagttaaaatatgtgtctgagttaatacagaattgtttctcctgcctttttgttttttctttctttttttttttttattttttattttaaagacagagtcttgctatgtcacccatgctggagtgaaatggcatgatctcagctcactgcaccctccacctcccaggttcaagcaattcagcctcagtgtcccgagtagctgggattgcaggcacccaccaccatgcccggctaattttttgtatttttagtagagatgggttttgccatgttggccaggctggtctcgaactcctgacctcaggtgatccacccac

SEQ ID NO: 103028 - DNA, 1715 bp, Homo sapiens
agtgtgtgtgtgggtgtgtttttaaatttaactaataggcaagatagcatcatatctccatgtgatttgtagatatgaatgtttactgagcttaaactacctgttgttttggtccctcacataaaatgttaattttgaaattacaagttcttagaggtagatttttgtagtttttctttgaaaatatgcttataaagaagaaatacacttcttcaagctgttttcattagaaggaagaaatttagccaaatttgaagtgatggaagatagtgccacagttgggtcactgtaacaaattagaacacgagaactttttccaacatttgttggaactagcgactccagattggcgtagaaaatacagttgacttacaggtattgatggaggcctctgagatttctgattcacgttaaatgaaatagaagctactgtcagcaatttcctaccttttatggtaatatgtatacattcatattactttaaaaacagtttctgtttgttctctttacttgaggactcacaatgaaccatttctgatcttgggcccccaatactgtttctggttagctgaagaaggaccaaattgagtgtatcataaataagtcataagttaaaaatgaccccagaagtctactaagatttggactatctattatgtttctttggatctccaggcttttgttattacagtttacatccctcccctttatcattaagagcaatatgctggttgctcagctttagttggcaaagtgccagttgtatttctgccatacctttcttggaattttgtgaagttaaatgagaaataatagaggtgaaaatgctttgtaaagtacaaatatatattgttcaaaagttaaaccaagtttcgagacattttcttgataaatgggtagtgtaaaggcaccagagtatttgtaactggcaaattttttgaataatgaaagtttataaaatacaggtttttaaaactgtataataatctgtggtttgtcttcctaaacgtattaatttctaatttgagttgtgttttcatattgaacacagttgtgctgaatggtttggatatgcttttctatatcatctatattattaagattttagcatactaaatttctgcagttactactgacttactcagtttctgtattctttgaaatttcagtatcaggttgggcagctttactctgttgcagaagctagtaagaatgagactggtggtggagaaggaattgaagtcttaaagaatgaaccttatgagaaggatggagaaaagggacagtatacgcacaaaatttatcacctaaagaggtaagcggtgttcacatttgacgccttgtaactacctggcttacttatgatgcatgtaactagctaacttaactagtagatgtgaagtacatttttaatttcagtttgataatatattgcattttaattctttggcagaacctcctcctttatttgtaaattagaaaaggattatatctgcttataacaaaaattcagataaaaacttagtccctgctccttgccatcaaatatttgtaacacagagagaaacactagaagcagcttagagtttatctttctagatcattttctgtatatattcaaaggaatttttaaaacatagcgatgtattacttgtatcaattttagttttctacaacaaatggaccatatgaatggttttgcagtttgctttatt

SEQ ID NO: 103029 - DNA, 1025 bp, Homo sapiens
taaacttgaggaataattgaatagtgggggaacagtttctggaagcgtttattcaatgagattcaagacacgtattctgtaagaagcatcataaaaacaaaatgcacagtatataggtggagaatgaaaccatactaaaaatttagtcagggcaacctgaccagacaatctgcaaataatacgttctgtaccctgcaattttcaatgttgagttttctcttttttctttactcacaagaatctctgcagctgctgtttggggtcctgggaacactaaatgcaaatgatcattgagacccaggaatgatagttttagttccccaattatggtgtaggcattgcaaagaccctcttccataaatgacacccttgtatttttttgatttaagagacctgtctctgttatcattggatttaaggtaaaacctcttcagagatctgtgtttaaagctatttcatatgtaatatatatattttttcttttgtctttttagccgtgtggttttgccatgttctgttcaggaggtgagtttttcttgcttctgcatcattttattggtatatgtactgtactttgatatgttactctaaactcacattttcgtagtattgatttaccttttcattccaccttatgtgacaaaattaattatatgaatgataattgcaaagaattgcaaaatgaattaaatgaatgataatgaatttcttgctacactgccttgttttggaagagtctaaagaatgtagtttaacctcctgtctagtgcaggaattctttctccaacatcccagagaaatgaggctccagcctcaacttaagtactttaaggttaagtagcttgctgcttagagaagcagcctactttactgttggacattttaaacatttgtgtttgaaccaaaatctgcttttcctataatgcttgactcttgtttacagtttatcccatttgagcaatgggaaataagcctgttctgtcttgtagtggttaatccttcaggttttctgatggcagctctcc

SEQ ID NO: 103030 - DNA, 1069 bp, Homo sapiens
tacaggcgcacgccaccatgaccggctaaattttttgtatttttagtagagacagggtttcaccctgctggccaggctggtctggaactcatgacctcaggtgatccgcccactaagtgctgggattacaggtgtgagtcaccgcacctggccctctatttatttttttataagaattaaaatgttagaaatgactttcgaggtgggctgtttcccttcaagttattatttaagcagtagatgaagttaccattaatgtaaagtcctggttttaaagaactagttactgattccatttggaaattatttttatgaggattttcagacatttgaacattttcaactggcactgaaagttgaatactgcttttagaataacaacagaaaatcaaagcctgtatgttccttttcccttttacttgttaagcaaatcttgaagaagttacttgactcattgttctgaatgtcttaatcagtcactttaattttttgaaagaatttccttgaaagtgttcttaaataaaaatagggatcttcctgttagtgagtgtaaaattactcagcagtgattctttggttttgtgaaacttaagggaagactaactcttctttctctatcccttccttccattccctctgcagtccatcatcttggttcaggcctttgtgacagttcttgcctagcctcccaaaagatagctttccccacttctcctgcttgtcagtgttttcaaccacctgcagatgacttcttcaggtcagcagtagttgtcacttacctcttggaccaaccttttgggattccttattgcctgatgaatttaatggatttcttaccatagtattccaggtcctgataatctgctcccaacctatagctttctagtcttcctctccctcattttatgctctgggacagtgagcaagttagtgtatactgagaagagaaatgattcggaatttttaggtatagaaggacttacaaaaagtttattcttgatggagagtagaaattagtgaccattgtggatttgagagtgttcattgtttttgaatcaccgttaccaga

SEQ ID NO: 103031 - DNA, 1018 bp, Homo sapiens
gtttagatgtatttattgacggaaagattaggttgctggaaaacatgaaatctatataataaaataatcctacattacatctatttacaggataaaaatggcagaatgaaagaattatgagtggaactagagaataggaaagacatgaaccaacgcccaaaatgagaaagaaggacatataaagaaaaagacaaatacaagtgaaaaaaatagactaatggattaacgtccctgtcgtgtgacattttctggtatgacagctgaagatgttgaaccgtatggtgcagttttgcaaatagtgtatgaagtgggttgtaagttttaccagtaattgtctatagatacaaaaaggagccaacctctttttttttcttttagtgtgatgttccttgttctatcttcgaactctcaaaggtagcctttacacagatgttcaaactaattctaccagtgtcatatgtctaccaatctcattacttcccttgtatgtacttctagagcaaagagctcattacagtaagaatgatggtaaattttactgaggcaaacaaagatttctgaacgcgagcagtgtgtgtgaaatgcttatgcactagctgatagcataactctggtcaaagaaatttggtcacttaaatattataattgaatttagcccctaaagtagctgttcttaacctggaatctgaagaacagcctgttggtggggctcccagggaatttgtgaaccactgaaattatatacataatttcatgtctgtgtaccgtgtacatttatttttcttacttttttttgagatggagtttcgctctgttgcccagcctggagtgcagtggcaccacctcagctcactgcaagctccgcctcctgggttcacaccattctcctgcctcagcctcccgagtagctgggactacaggtgcccgccaccatgcccggctaattttttgtgtttttagtagagacggggtttcaccatgttagccaggatggtctcaatctcctgacctcgtgatc

SEQ ID NO: 103032 - DNA, 1008 bp, Homo sapiens
tttgcttggttacctttagaatcaattttaaatagtcatgtaccacataatgacgttttggtcaacaatgtcatacacaatggtgatcctaagagattacactaccatattatactgtaccttttctatgtttagatacacaaatacttaacattgtgttacagttgcctatggtattcagtacaataacatgctctaaaggtttgtagcctaggagaaataggctggtagcttaggtgtgtagtaggctgtctcagctaggtttgtgcacctgcactctctgatgctcacacagtgatgaaattgcctaatgatgtgtttctcagaacatgttcctgttattaaatggcatgtgactgtatttgccacaagtatattttactttcagaattaaaagaaagtagatgaagttactacactattttttctagcctatggcattttcactaaggacaacacacattgctactaaatattggtacagctaaaaatttcattaagtacttttaataacaactttcatttgtatagtctgccttttacaaagaactttcatgtatgctcttgcctgggtctcaaaacagttctttatagttgggatgactttcttttcgtttttgagacagagccttgctctgtcgcccaggctgaagtacagtggtgccttctcggctcactgcaacttccagctccgcctcctgcattcaagtgattctcctgccttagcctccagagtaactgggatcacaggcatgcaccaccacacccggctaatttttgtatttttagtagagacaaggtttcaccatgttggccaggctggtcttgaactcctgacctcaagtgatctgcctgccttggcctcccaaagtgctgggattacaggcatgagtcactgcacctggctgggatgactctttattggatatatctgtatatgtgagtctgcatgtgtctaattcttaggtaaaacacattcacagaattcaaaaaagaaaaatgtccatt

SEQ ID NO: 103033 - DNA, 1096 bp, Homo sapiens
ttgcactaaagaactattaaaggaattttttcaggtggagggaaaatgataccagaaacttgattctatacaaaggaaagaagggaggccaaaatttaaatatgtagataaatataagtgatatccctcattttttcatgtattttgaagattttatttagaagatgtttgactaggtaacacagcagtgataacagtatattgtggggcttataacatgtttaaaaacaatacattacaataatagctcaaagaataagagggagaaatgaaagtacataccgttgtaagattcttacattatacataaagcagttaatattatttaaaggtagactgtactaatttaaagatgtgtactgtaaaccctagcagtctttctcaactggagttccttatttcaaccatgaaacacagaaaatgatttgagtaactgctgtctcaattctcctaagaatggaatgtaaccagtactattctaggatgcgtgggagaggggttagatcacaacatgcagtggacacgttaggacattattgtttaattctatcatagaatctcagttgaagagggctgtggagagcaaccattgagaaagaaaaagggagagaaaagggtggggagagagcaagagagagagagaatgcaccagcgagcgagagcacatgaacaagaacacaaagtcaatagaggagataaaattagatcctaaaaaatgctcacttgatccagaagaaggcaggataaagaggggaaaaaggaacaaaggagaaatggagttccaggttttagtcagccattactttaatcaggtaattactttgggagaggccattataggttctcaggcaaggaaagattaacctttaggggtttgaggtcctcagcttcattagaatttgcttgtatgtctttatcctatttttcagagttccattccctctatttcttaattagttttctgaaatcttgaacctgtggcttcagaagataaggacatctttcaggacaatcatagagaagctttctggttcctttctctgaacgtacgctggaatttaaagtgttgagataataattttcttttcctcaagtt

SEQ ID NO: 103034 - DNA, 2085 bp, Homo sapiens
gcctggctaatttttgtatttttagtagagacaaagtttcaccatgttggccaggctgctctcgaactcctgatctcaagtgatccacccaccttggcctcccaaagtgctgggattacaggcgtgagccactgtgcccggccccataaattctttatattgcttaatgataccatcatttacctggtcactcagataggaaacctgccctttgatcctggactcctcttctgcagtccctcttctactcagatactaggacttggtgttacctccttaatattttaaatatcacacctagctcctccctatgtggagtaatcttctacctgttcctaccacaatacacagttaagtcatcatttttcatttaacaagtatatattggatactatgtgccaggtactgtgtggttggtgctgaggttacagttgtgactaagacagcaaagttcctgaccccatggagctttaatctgcatgtaggagagagcaaacaaataaatgtgtaatgtataatatgatgttagaaaataagctagtgcattgcagtaacatttcattgtcacctagtggtgatttaggcaatttgcagtctttgtttattggaatgtgaataaaatctctcttgaagattccatctataattaaagttaaataccagaactataactatttatctgagttttatatgtgcaaaaaataaatttacttcaattgatttggaagtctgaacaattgttttcattacattgttgaaatatattccttaaagaatttgattgcatatattgttttatatgattgctttttatttaagctatatttagaaaatgtcccagaagtggaaatatgtagtcaatatatactccccctcaagagtatttataattttcttttcatataatattttgttttcagtccattctctgaaatatctgtgtaacctttctataggtatctttaaaatgatttgagtgtttcaggaaaaaaacaaactatagctactgagttgagtgaatactggagtacttaaatcccatctcagtatttgacaggaaggatgtatatttgggtgtttttttacccattttatgctgttcttttgggcctgctacatttggtaatgaatcagtcaacatgtttctaaaaccagcagctgaaccatgtaattaataactctcactgggggagtggcagaacattgatctgggcttgctgggtgagctaactaccatcacacctgtccccatagtcaagttctgccagaagatggtgccaggtcttttgtggcctttgaacacaaacccgagtctttcccataatatccacatctttaaaagactctggtagtactaatggagatgaacttggcagtctgaaatgagaagaaaaaaggatcctagcgtctaacttattgcaagtaaatggcttctctctggtttcagttgtttcatttagataaatgcttcttggaagatgagacaacaccatttgcatttatgaatttaatcatggtagttacagcttaactatctggcttcagttttgtagaaatatataccatcatctacctcttcccctcctttcttgatcttgcagccattctctgctgagcacatttcagtagttggaatagagaataacaggtgtgtcaggttaaaatgatgattagagagacttcattttttctcacagtgaaatgttaaagctctgtttttgttagggagttatagctgatatttcccactggctatggctactcctggataataggaaaggagctgttgaaaatctgttggaattgccctatcaaatgagttggagcataagatagaaattattccatattggcccagggctgttctggaaaggcagttatagcatgttaccatgtagccatctcctatgcgcaagttatgataccaaataattttgtggctattcctgagtaatgtccccgctatatataatacaacttaatttcctcttctaaaaaaattattagctgaatggagaatgtcttgtagctagttgacatggctaataatcagttgattaagggatctaggataaatgtttgtag

SEQ ID NO: 103035 - DNA, 1035 bp, Homo sapiens
atattatgctttaggacatgtgattgccctgaacaaagcacaagctccactagttcctaataaattattacatctttcacatctgttcccgtcttttctctgaagtgttcatccaagagagcacagcatcaactgaaaatataagaattgtgggaagacattttcctgataaatgcatagacagttgacttgttgtgattagaggaatatcgcaggagcagagggttggagctgaaaactgactttctgcctctactgccagtgtctccttttgtccttttcctcctctccttgcaatttcctctgagagaaatcatgtgaccatgtcaccatagtttttaatgccaaatatctaagtgtctttaaaatgcagcacaacacttttaaaggcaaatagtgaagtagtttcaactgacatttccattatagctgttcttagtggattctaaacatcatacataaatgtggctagccaattctttttaaaaaaaatacaaaccattgagctgtcttttcatatttaatgcttcatccattgaacatgcaacacattttttcatagaaacatacattgatctgaggttatctacaatagtccatactagatttttctagcatttatattttagaaataaagccatttctcatagttttgtaacatacccgagcatttctgggctaacatcagttactctgttatctctagtactctataagtccaaactgaagaaaaatgttaaactgccaccattattgcaattactgtcaaattgttgttttacttagaagtgaaaattgtgttctaatattgtgtatacactatttggtttttcatcttaaaagctttattaaatccatttttattcatttattatttaataaatacctactatggctaggaacagtctatgatgacttggaaacaaagatcaacaaggttcaatctctgcccttgaagagctcatagtccagagaaaaaggtggatgagcgaatggagaaattacaattacagcaataacaaattgcttcaaaag

SEQ ID NO: 103036 - DNA, 1028 bp, Homo sapiens
tcagggaaattgccaagccactgacttcagctgactacagacaagtaagtaagccccatggaacccagctcagatcaaagatgtataagcaaaaataaatgtgtatggctttatgctacccatattttgtggttattttgtcacagagcattattatagcaatataaaactgatacaatgaccattaagcatctgaaaattgtctacttactaaacctataaaaacccagacttcaccagaatgactacatgatggcatctcaatgacaacgtgagttatatgcacaaaaaccactgttctccaggtgtttataaacagtctgattttaatacagagttaaatatggaagctttctaattataccacttttaaactcaaaattagaaggcatcaacaatattgaattgctaggattatattcacttgagaaaactgagtaacagttgatctctaggtgcatgtgggggactagtagtgtattgtactacacactgggccaagtgacctacaatatgtttcctatgaccaatttctgtgatttcttactctatatcttgaaagaagctagttacctaactacacagaaatactggtttctagtgagaagaaagaacagttggatttctattcctatttcctggcaaggtttctccagtaggtttctcaagagtctaatcttggcatatcaatgtggaagaaagtttataagctggtaaatctattccttttaatagtcactcaggacactaaaacagctaggtgccagggcaaatcactctgtagaaaatgggaacaagacaagcctagtatctgtttctggaatttggtgggagaaggaccaaagtcactgccgtcttttgatcctttacctatgtcaattcttttgtaaacaagagaaataaaatgtaacaaaaagtaaatatggatgtctgacagtcataatactgaatatgctaacatgtataaaatattttttagttcttcagaggaagatcatcatataaattaaacctagtactattaatcc

SEQ ID NO: 103037 - DNA, 1064 bp, Homo sapiens
gagcaggtttcctttagaaattgattctaaatgtaccaaaagtcaatctaagagagagaaacaattcacagctgcagatttggctagaacatttatgtttagggcatttggacctctgattctgggttccaaactaaataatggtgttttctaaaatagctcccagtccttttgcatgtgctttcagcatacaatatgacagaaaatagaagtgaaaaatagaagtgtagttttctggagaggtaggaatatttactcccagctgatcaggtaaaacacattgtgacatgaagaatgtgttctttgctgattctcaaggttttattttatttttatttttaatataaactgtcaacaaatagaagcaagaggaaattcacttgaaaatatcagaagataaaagaaatatagcaaattatactgctggtaaaaaatccatttttaggcaccaaacaaacaggcattggctgagaagcttgctgatggcttcttttgtttctctttgatttaaatccttatgcctgtaatctaattaacatcaaactgagttgcaagtatagtggcctgtttggttcaataataatacatttatatgaaaggttaatgaaatgaatttttcctccatccaattcattaaaaattgttctacaatcaacggttgctaatggaatagatattaaatattcatgttcataaattttctgtgtcatttctgattttccttcatttctgcctccatacattgaattttacaagtataagattcttaagacaaaaagctgatttagaggttaattgcacaccattaattcttttatcaaggaagcagtgtggaaagtggagagagaatatgacagtagacttgtctcactttgtagctctgtgatttggggcaagttttgtaaccacctcttttgtgcaatagtcatcataagaacttcttgcagggtattgtgagggttagtgataaactatggaaagcacccagcacagtgtctagtacagagtagctatcccacaaatgacaacttagaaaaagttttggaaaataaaatacctacata

SEQ ID NO: 103038 - DNA, 1911 bp, Homo sapiens
ttttgtaggagaaagaacatagaatgcgggatcaaaaacttgattttatactaccatgtattagctctatgttcttaagtcagtgtttcttagcttttcatgtttgtggcacattttctaatactagaattttggtgacattgctgaaggaaataaaagactcaaaacagcactaacaaatcagtaatggttcagtcgaattacagagtatcacagagtcttgatgtctatcagaagcatccgtggtttgtatactatttacttggtcatcctttcagcactgttttgctgtaagagctgttcactctctgcctgtgctgtctcatgtaattaggatgcaacattatgtatggtttcattaaatacagtctcattctttgtgagcactagctttgtggtgtgttactactcttgcctcttattcatgacaattccgtacagtgaatttgtgttttcacctgttaagtgaggacagtaagaactgccttacctacatcgggactcttgtgaggatcaatgagctttaaaggatacaaaggttttatgaaagttatgaagggctatatagaactctaagggatttttgttagatttttgtttgttcccttgtctctttatcttactagttaatgagattattgagatcagggactggattttttttctttttaactttatcgccagcatgtagctcactgtttgctatataaaagatgttcaataaatattcattaaattgaaaattaaaattattgtttttattcttaatattggattagtttgccacacagccagccttctctgtgtaaagcagtgtcaagctgtggtctggtacatttcattgtgtacagaggaataaggtgagtattggtgcctggtagttttggatggggagcagggacagaaagacaatcatagtcgtaagtgccctcttttgggaagcattctttctaaatgtagtaaagtggattatcacatggttgctgtgtgcaagttgaatgcagcattttgtttagtctggttggagaaattctgagtggttttattattatagtgtctctattggagactcttccacagccttataaatttcattttccttaattgggatggggagggaggaagaaaacagcatttacttggcattcttgccttttagagctgtgggttattgattcagggtcctagaatagtaatgcttggaagtaaaggttcccttgggagcaccaatgttaaagggcaaagggaaaatgattagaatttaaatctccagactccactgaatttgtggcttcattaaaaaggggttggggagggggacagaggaaatgatctgggctgctgctttgggctttgcttaaggcttacatccacaaactgattactcagaattacaacctttacaagttgagctatgtggcccagtatgaacagacagccagtggacagattgcttttactaccagttgtcagattgggcctttcaatactagtgaaatcgctcttattttctaacggagagtgtaacctttggctttggctttctttgaactagtgcaatctcttctgccagttcctggaaaatgtaatcaccaaattacacacatacttcattctttgatgtgtcactctttagaaattctatttccccaaagtcaagtttttcttttagactgtttatctgatgcccagcattactattttaagtagtatctttcctgacctattagcagaggggagcaatgtggaataatgggaagaacattggataataatgataaataagttttgctaccaaatagctatgtgatcttggacaaaccacttaacctctctgagtttattatttgtctgcattagtcatagttgtgaatatttttcacattcttagggcttctatatgaaatttat

SEQ ID NO: 103039 - DNA, 1053 bp, Homo sapiens
ccgccacatagtggaggatgcatggttgcatggtggaggatgaactggaaaggagctgttctggagaagggtagcaggaaggtctgctaagcaacctgaggcagtttgtaatagttgtaaccaagaagtgacaaaggctgtggccatctggcacagcctccattcatcttctaaagaacagatcttcagatatctgaaggcagttttgtgtcctttagcaaggcatatatttggagaacctgtgtaatcccagcttccttcaccaactaaaacaggggataagcctcagtgacgtgtcaacccacttatagaacttgccttactattctttgttcattacttctagtgaccatagtatttttattacattgaaattgtaatactttaaagtatttgaatattttgaaataacattgatgtagggtttttattttaggcaaccagcagggtatagaacttctggagagcaggatcctcgaacctgtatgttatgattctgttggctagatctcagaatggcaacaaggaatttttggttttggttgtttctcatatctcttgtaaggaaaacttgaataattcaggtagtacatttgtttctccttatacactgctaggtatatagtggttggaactattcttcttaaggcactattttcactgcctatgcaaccacagagatcatcaatagtaaaagctattaaactgacattgtaactgttgctgtgaaaccagtactttcctgcaggcattatttcatcctgtgcctttttggaaaggatgtagttctcatttagttgtcagggaacatggtattatcttgtaagcattgctttctgatgaattttttcagatcttctttgcagaacctctttctgagtttctcaggaaggataagaacgttcttctgaatcagaattcttttccaagactacatattaagaatggactcttggaataagctttcttttagatctctagatgtgataaacatggctattctgtgagtaggaatgccttttcataagagttgaacaactctgtagttgcttt

SEQ ID NO: 103040 - DNA, 1023 bp, Homo sapiens
attctaaaagaataagagctgggtgcagtggctcatgtctgtaatctcagcactttgggaggctgaggcgcgtggatcacttgaggctaagagttcgagaccagcctgaccaacatattgaaaccccgtctctactaaaaatacaaaaattagccaggaatagtggtgcatgcttgttaacccagcaactcagctggctgaggcacgagaatcgcttgaacccaggaggcagaggttgcagtgagctgaggtcatgccactgcactccagcctaggtgacagagcgagactctgtctcaaaaaaaaaattaaaagaataagaaataaaataagctttactgatcttctgatatgatttgtcacttgagctttcctttgctgaaaggtcaaagggattcttagtggtgcccactcactgttgaagtcatttgttcactttcagtgtgttgtggcgtattgtagtttacatcataaaatatccaccttaaacaattaattttattcaaaagaagaagatgaaaaagaagactgtagtataggttgtagcatgatggagaggatggactctgaagctagactgcctgggcatgagaattctagtccagcctctcagcagctgtgtagccaagttacttaacttctctgtacttcagagatctcagctatttaatgtgaatggcacctagctcttagtgtgactctgtagttataatgtaaaatgcttacgagagttccttgcatataaaaagtacttaatatgtttttcctcgtagtatgataatactccatagtctagctggacatggctcactaagtttctttcccctttctagagggccttctcctcatgttcttcttaacttgccttccttttgttactggttatactttaagaactaactcagccttctcctccttggtgaatccttctgtaagcagttcttctattgccaggcatagatggccataccctcctttgactatatttttataggccacagttgtagccctgtactgaagctg

SEQ ID NO: 103041 - DNA, 1024 bp, Homo sapiens
ccccatccagtgtcatgattcttttattcatataaccttattggcctggaaaaatatactttcccgtttttacctttagtcaagagactacatcatgcatcacatctttatcttatatttgcagaaatgatagtaattaaaatgctcatctcataggaacatgtttgtttataattctgaagctatttctgctctttaaaatccaaggattagtatcagataacactgtgtaaataagactgcagtcaaaaccttcaggaaagctgctgctgattggattttttcattgctcatctaatgttattttactgttcacacataataaaagaccattaataggaatatgtcgacataagctacattaattatgtcatttgagagtcatatgatatatttatcttgttatacttgtcacattaataaaatgtgaatctggctctcaaatgatttctctgatggagttccatttaaaagccttgtttggaagctcatttgtgaggattatgccctgtagatttgtgtcttagaatagcttattacttttacaaaagaatgtatttcaagtccctatgctttctctatgatggagtactttgtttctgtattataaggctaagtcttaaattttaatatgcctatactaaattacttagttacttgccagaatgctgtgctagttggtattattatattattcattttgggccacaatttatttaatagtataacatcagactttaaaaataagtattgtggacaaaagtagttatacagagaagtcttagaaatttcatgatagtagtctttcttcaaatccattctatactccattcccagatcagtgcaaccaagagacccaggttttggttctggcggatctcttgactcttggccttgggggagtcacttaatctttcacatttgactccccactgttatagttagtgcctcattattatcacttgctggatttattgcaaatgtcatcctaatgaattttctttttctggcctcttttttcccc

SEQ ID NO: 103042 - DNA, 1053 bp, Homo sapiens
tactgtgttttatatcagaactgaaatagaaatcatgtgtgaggtgcatgagaagatattgtgcatttgttttattgctagagaatctaacaaaccctgccttagcatagcctggcgaattgaaaggttttctttgatatctaattgatggcattttgtcctctgaccctgtgtcttttctacttcatcctgaagtcaagaatctcttatatattataatagttctcatcacagagcttctttcagtgagattgattccattcactttggttgagagaactatatattccccacccccacctccaaccccaatacagacagaacgaggaaaactcatagaagaaaccatataattaagcaatttaaacagatgctgcgtattcctaaagtcccccatttcttctatatttgtaattgcatgtttatgagtagttttaagatgtctgcaaactctacattcataaacgtctgctttttctattttacccaatatgcagtaactcatgtggttatgtctgtggaaacccctctgggtactggtattgcttgaaccacggaagtattattcttggcagtcaggtggatttctggactctggaagattctgtttcaagtgttaggattcactctgcagtatttactcactctgtgatgcttaaattgctataccagaaggttgtatttattcactgtattcataatctcatatcatcatgttgtaaagatccagatacaattcttcagagttcataaaagattaaaaaataagctgagccatcaaataccatatgcttatttggtggtagcttgacaacaattcttgtttcttctacattggaaataggagctcccttggaagagattagatatccaactctggtagggcaccagtaagtctttacaaagattaggtttattttcttactcttgccagaatactcacatgatcagatcattgccatggtttctggctcagtctgctaacacatttgtagtgatacagtcacatgccatgtgttttaccaaacggtttcataaaaaccatttacccta

SEQ ID NO: 103043 - DNA, 1049 bp, Homo sapiens
attttaacacataggattgtcattgtattttaagattagactttaaaaattttatctttgtagtggtggtgctaaaatcgttgaggattatatgaaacaacctttgcacctacttttttggcctgggttgaggatattgagaaaagggttatgcactggttgttgatgttttttaaacagttcatggtcatagctgagatatattaggttagtgtaatacatactgttattaagaaaaagattagtttcatcttactcggcctaattagctttgttccatttcattggctcaaatgtatccaaacaagacactgcaagggccgtggtgttctgaatagagtgctgtgagatactgacatattttattttgtcttacaaatgagctacagacaatgataattatagaaatgtattctgtggtcttacttataataaattcatagcatcagtacatgcccataaataaaataaaccattcaactaagactgttttctcaactttttatgccgacattagtttgctagttgtttatttttgttgtctagtatggaagacaagtggtagctcgtgacacatattttaaaaatttatgggccgggtgcggtggcacatgcctgtaatcccagcactttgtgaggccgaggtgggcggatcacgaggtcaagagattgagaccatcctggccaacatcgtgaaaccccgtctctactaaaaatacaaaaattagctgggcatggtggcatgcgcctgtaatcccagctactcaggaggctgaggcaggagaatcgcttgaatcctgggggtggaggttgcagtgagccgagatcatgccactgcactccaaaccggagtcagagtgagacttcgtctcaaagaaaaaaaaaattatgagagaaaaagttttaagtagacagaattatacattaaccttttttgggggaggaattggggaaagctgaccacatacacccttttgaatgaagaaggataataattaagaataatatttgtatattttagttacaattcactttttttgtatttttac

SEQ ID NO: 103044 - DNA, 1186 bp, Homo sapiens
gaaactcttgactgctggaggctgtgattgacccactgagagcttttaggcatgtggatgtgagtcagccaggattgatggagcattgactgctaattagactcctctgggaaggtagaggcgggcaacacataatgccttcgctgtgggagcttcatcaaggggatgattcttggacggacatttttcctccctctttccacaggggcatgctagccctgtcattctaggagtttattatccttcagacacagctacttatgtttttaattccctcacaggatgaagacatgaagagaaagtttcaagatcttctgtctgaggaaaatgaatccacagctctaccccaggttctagcccaggtattcgtattcctgatgatcactaaatgtagtctgggcttaaggagctgataagcaaagatgatgaaattcaagattttcctgagtagcaattgcttaacattgtttcagttataatgtagtagaaactctgttttaacttgattcgctccagcacccttagatttaaaaatgcaggatatgtttaatatctaacacataatagaccgataagcacagctagggattgtcatccaaaaggtcacctgcaaggcaatttcgaaagactctattagaggctcaaatataaatttgttgaacaaattaaaatttgggtcagtagttgattccttgattacaattttattctttaaagttctttgtgagtataagttaattccagtcctgcttttttgttgttgttgttgttgttgaatggtagctgtcctttttcccactgtttcctccccccaattttttttttcttgagacagagtcttggtttgtcactcaggccggagtgcagtggtgcaatctcagctcactgcaacctctgcctcctgggttcaagcagttctcctgcctcagtctcccgagtatctgggattacaggtgtccgccactgtgcccagctaatttttgaatttttaggtgagatggggttttgccatgttggtcaggcttgtctcgaacttttgacctgaagcgacctgcccacctcggctttccaaagtgctgggattacagctgtgagtcaccgcacccagccttcctcccaattttatatatgggaaaacaactaaggcacaaaggttgtcttcccgcaaaagaccaagacttggggc

SEQ ID NO: 103045 - DNA, 1500 bp, Homo sapiens
atgtgctgtggtgggagtttcttcccaaattccatggtgttttctcctgtcaattctgttcttattttctattgttagtttcacaccatttgagaggcactggaaattattaagagcatgcactcaggtcctgggtctgctactacttagctgtgtggccttaggcaagttatttaacctccatctccaatttctttctgtgtaaagggaccctcaataaaccctaccttaaaaggtttttgtgagggttaagtatcatgtacacaagtgcctggtacctattttagtgagcaaaataaatgcacttgtaactttttagttacaaggtttcctttgagtaagcaagcatgtaaaaactagatgtcattagttaccttgtattttataatttatcctggcaactttagttccctgaagagaaagtagaaaattaaatgtcaaataacataacataggtgattgtgttaaatgtcagaatatttaaggaataataatgttgtaatatacaggccagcgtgcatttgttgcttgctggagtagccaagttttatttctgacaagtctgcagttccagggagcctctccctcgctgagtaactgtcacctatccatctgtagatgtcagagagagtttgctgtgcatcccaagtatcttagaattgggtagaagtttagctttaattagtccgaccttgagtctagcaacaagagagggaacaggcagtgaagaggtcgtgactgacgtcccagcagcaggagacagggagtgtcattatcattcctggtcttctcacagtactctgaatacagagagtgaggaagattagggggccctgtctgctgactccgtgatgatctcagaccctctctgctctttctgaatggtggcctgttaattctggcatactcttactgataatatatttatccttttcactgtgatttgcccaattgttgctttagctctggaccttgtcaagaagttgttggtagtggatccaaaggcacgttttacgacagaagaagccttaagacacccgtggcttcaggtgggtgtgggacagtgcctgctagcataaaatacatgggaagccctgctgcctgagagacatgagacagaggacagaaacatgtttactttgttgagtgtttaatctaattgttttagatgtatggggggtatcttggaggatgggttacaacctgttttatttttttttttgagacaggttcttgttctgtcaccctggctggagtgcagtggcacgatctcagctcactgcaacctctggcccccgggttcaagtgattctcctgcctcagcctcccaagtagctgggattacaggtgcatgctgccatgcccagctactttttgtattttttgtagagatggggtttcgccgtgctggccaggctacaacctttttgatattactcatggctgttggatgtacacgctcactttatgtcctgttctggttccacttggctgccccga

SEQ ID NO: 103046 - DNA, 1049 bp, Homo sapiens
ctcatgaggctgaggtgggaggatcacttgagctgaggaggttgaggctgtagtgagctaagatggtgccactgcacttcagcctgggggacagagtgagaccttgtttcaagaaaaaaaaaaaagagaaaagaaaagaaaagaaatatggcatagtatgttggtgtttgttcatttttatatgctatttcagacaatagttttttcaaagacaaagtctttgcattgaggaataggttaactcacataaacagatatatatttgtatcacataaatagatatttacaaatatatatttgtataggttccctttaaaaatattctcaggactgcaataaccaaatatatcattttggtggaatttttgtgtttatttggtatgttctcaaaacattttctgttacccatttgaatttttattgaaattgacaccttacatttctgctgtgtgaagagttgtttattatcttaaagtgaaatgaaaggttaattgttctaagttgcttttttcatttccctgctttttaaagatcttctcaaacaaatttgtaaactttaccccaacagttttctatgattttggagaatatggttgtgtgtatcacggcttacggtttcacccagctgtgagatgtgtgtgttggtaactttgattctacttaagtatctactgcatgaatctgagggtcatgcctgcctttctgtgtagtaccttcatgaaaacggtattatacaccgtgacttaaagccagagaatgttttactgtcatctcaagaagaggactgtcttataaaggtaagaaattggcattctgtatgtggctattcctgtagattcttgttcagaaacttttaattcctcaaataaaaagtgggagcgtaaaaaggatgagaatctgaccctttcactgttaccaattattttagagatcaggtgatactgctcttatccagattcgaatgagcatttattgagctctgttgtgtacaagtgacctttgtgcttagagagagaggaggggtctaaatggacgagtgggctgggtat

SEQ ID NO: 103047 - DNA, 1072 bp, Homo sapiens
acccagctctcaatgttgaaacagaaatagaaattttgaaaaagctaaatcatgtaagtattattatatgactcatacttagatttatctatctcaaaatatgagaagagtataaagcctttcagtataataaagataatattggccaggtgtggtggctgatgcctgtaaccctagcactttgggaggccgaggtgggtgaatcacctgaggtcaggagtttgagaccagcctggccaacatggtgaaaccctgtctactaaaaatacaaaaatttagctgggcatggtggcacatgcctgtaatcccaactacttgggaggctgaggcaggagaagtgcttgaacctgggaggcagagattgcagtgagccaagatcgcgccactgcactccagcctgggcgacagagtgagactgtctcagaaaaaaaaacaagaaaaattaaaagaataaataaagctaatattaacctgggttctttaacttatgtgtacattcacacacatgcctagctgtcatttagctgggaagagttttaccccaaaatgttactgagtgaacaataccgtataaagatttcatgattaaataaacaaatgatatttcttctgagttagttcttgaccaaaacatatagcaattattctatctcatagacacaactggttatattagagaagacagtgttaattttagtaaatttggtttagttatacctgaagttttaccacttttgaataccttttatttggagtaatccaaataaatccaagggtatccattaagtatgacaacatcctgtccttatatctgattaaatggtgtctgtggcctagttcttatctttttgtgcaatgatgactatgtctcaatgaaaaatgtgtctcacttttaaaaagtgagaagaaaaattagagggtgggcttaatcttatcttgcttttttttgtttttttcccgtttcttccttaattcataagtgcccatgaaggcataagctcattaggcaatggcattaaactcaaggcaagatctctctcctgtccagctaatgatgatcttattctggcat

SEQ ID NO: 103048 - DNA, 1137 bp, Homo sapiens
tgtattttgcttttccacaaatgcattatagcatagacttttgcctaatacatcctttttgatgactgagttttcatgtcatcaactttattgtaatttacttaaccatttctctggctgatcatttaggtaatttcttattctttgctgttctgggtaatatggcagtgagtatccctggtttatggattagccatagatttttaaaattttaattaaatcattgaaatagcctttctttatagcagccatttattttactactcttttgtaatcaacatttactgtatgggagagatggccaaatgcattggtctttccacatgtgactcaacaaagtaatgtaaaacacagcctctaatcacattttccctagtggccagctgtttctggctattatactttcacattctttaaagatcaattttttttccccctagacaatgccattctcacatggcaagaggaatttcctttttgtgttcactttgttatagatcttttcccctatgattctaagatttgtttcccattttggggagaagaaaataccaactagattgttaaaaactgggagtaaaattttacgttttgatttcattatttgaatcagattggacctttgtgaccatcctgttatcagagtataccctgacttggtaatgagtttagcggcttacaggaagaggcaggctcttaaaattaaacatctgggtttcttagctgaagttcattttacataaatatgtaattctatctcctctttgcttgtggagggtgtagcccaggaagctgagttacttgattcatccttttggaattgtaacagaacaactttagtaccctgaagcctcctcttgtcagagtctcagtaaatatgcgaggctgctgttgaagttggaacctgtatctgctctattagcagaaatttgacttcacattttctttatatagtttaattgaacaccttcttgttcatgttttttgtttatcattttaatgaataaaaatagttccatagctaataagtagggtttactaattaaaatgaacacagtggaaacacacttgtttctgactgtggagactagggcaagtggcttctgttttctgagccttggttgccccatctgtaag

SEQ ID NO: 103049 - DNA, 1562 bp, Homo sapiens
gtgatacttccatataatggaatattattcagctgtaaaaaggaatgaagtaccacaaatgttatggcattacgctaagtgaaagaatccagacacgaaaggctacatattgtatgattacatcaatatgaaatattcagaataggcaaatcaatatttagagaaagtagattagtggttgccaggggctgggggctgagtgctggggacagggtagagtgaggagtgactgcttaattgcttaacaggtacagggtttccatttgagctaatgagaaagttctggaattagatgctgatggttgtagaacattggcaaatgtacttaatgctactgaattgtacactttaaaatgattacagtggtaaattttgtgttatgtatatttaacacaataaaaaagatgtcttggtaagcccctcaactcaccccttcaaaacccacaatagttataatagtctacttcataatgggtaattgatgccctagtagccattatcttgggctgacccaagctttggaggacagatcctactcaggattaactgtgttctgggtaatggcttggagagcattcctcctccatgagtagtatcccatttaactgcaaatctctgtgagaggttgctgaaagtaggctgattgtgtaatacgtttggtttcttaggtaatctgatttgatttagggtgcaacttatgtcatcaactgcttatgcacttcctttgaagatggagaataagaaggaaagaaatttatccattaaagttattcatttgcagattctgtttaccgttatttgtttgttttgggcacttatttttgaccagggaggactgtttctagttaatgtttttctgacctctcggatacgtagtttctctctcatttttctcttagtatctttctgggaatttcacaatccagggctacagtaagacccatgtttgtattgctgggctcagaaatggaatttggagctgacttagtgtttttggctgttaagcccttgacattttacactggtgaagtttcactgtgtcctctgcaaacagggacaatggaaaggctgttatatggaatgtctgtaaattctaatacttgaagtggacccaggagtggtaggtctcataattaaaaacattcagacaatcactatctttgtttttccctctagtggtgcctgtggagaggtaaagctggctttcgagaggaaaacatgtaagaaagtagccataaagatcatcagcaaaaggaagtttgctattggttcagcaagagaggcagtaagtaccaataaaaggctgatcaccttttattaacacgtcttcataacttcccaaaataatcttagattgatgatttttaaactcaggaataaccccctgcttagatggatgaatttgtgagtatcaaagaacatggaaaattttggggcatctttgattaatctagaaacttttacttatagataatttggttccaaaagtatttaattgtacataataatgagcatagtgggaagtttttttttttcttcttccaagttcaaagtcgttacaa

SEQ ID NO: 103050 - DNA, 1008 bp, Homo sapiens
taaaagaattggacaaatgtaagcttttatgagccccccagctcaattttattgctttttacttatttgtaaccttcagataatttgtttttccctgtagtttatggctgtcagataaaaaactgatctggtgacaatgatctggtgaaaagctcagcccagaagaactataggtctgggctgttaggacttttaatttttggagagcatgtttgccctgtttttttttttttcttttcttttgctgttgtaataggcccatcatttactttttaattttaagtcttgtgccttgaaactcacctttgttgttggacactttctttttgaggtcgtgatgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttggtaagaccctttgttgtatagtatcacgttttgttcagaaaaacacttacagaaagttgtattaccaggtggaaggttctgattggagttgtccaggtttttggcacgttgaacaaataattgaacatcatgcatgaacaagcaatgaaagcatagatttattgaagtggaaggcaatagaagctaaagtacatgtcacaggatgggagcaggcctgagcaagtggctgcagagcccttgtagcaaagtcttctggggttcaagtaccctctagaggtctcccactgtttacatcctatgtaaatgaagtgctggctcacagcccattagaggccaaagtgaattggagctc

SEQ ID NO: 103051 - DNA, 1033 bp, Homo sapiens
acctggagccgcacactctccgcagcctcagccagcagagtggcgctaaacctgcagatacaaactccaccctcagccaatcaaaaccccctcccctgccgccggaccaatgaggagcagcagatgtggccgtcaggcgccgcctcaatgcctcctgggagttgtagtttagaagggagagcggaacttagaacccgggttcccctcgggtgatcccgccccctcgactccccagccaatcagcaacattagtctggttagacgctctctttgcttttccccacgagtgaccacggctagataggccgccggccagatgtggcgggggagagccggggctttgctccgggtgtgggggttttggccgacaggggttcccagaaggagaccgctaagctgcgatgctgcgtcgcaggcgggaagcaattatccccgctgttggaactgcggcggcccatggggccccgggcgggaggacaggttcttctgcccacagtgccgagcgctgcaggcacctgaccccactcgagactacttcagccttatggactggtacgagcgacggtttcgggaaacgggcccgggcgagagacacgtcgaggtctggcctgcgagaggggaggacggatctggctggcggaagagaaggcgggactgatgggggggcggaggtctagagagcaggcgtgagagaagtgtcttgatttctcaggaggaaattgagaggcggggactgagggaagcaacgttgaggtgtggagaagggagacgaacgggactggaggggcgggcgctgaagttagaggaaataggggggccgaggctagaggggagggagatttgaggggcggtacctacgggaaagggaaggagaagtcgaggggcggaacttgaggaaagggtacttgaggggcagggcctgggagactggaagacttgaatgaatagggtgagtaaggtttaaagttgggttgatgtatttaagaaaggactgcagaagtgtgatccgagattagggagtaaagcatgaaaa

SEQ ID NO: 103052 - DNA, 1083 bp, Homo sapiens
gctggtattacaggtgtgagccaccacacctagccaacttttggtttctttacttcccacttgacctttccagagccaaataagcaggaatgactttaaggtcccacattgaacacttactgtctgaacaggcagaatcttacaggtgcatctttatttggcaaagagcagtagaagaaaacagtttagtgtggctgtgagaatagcaggaaaaatacgcagtattttccatcttgttactacacacttgtcaaaaaagctagttttttaaatacaaaaacttgattggagataggaatgataaacatttcatttatattagttgggattttcattgaattttttttctttttttcagttgtccagtaagaaagaaaaggataactgaagcagagctctgtgctggtcctaatgactggattctttgtgcacatcaggatgtagaggggcatggagtaaatcccagtgttagtggcctttccatacctgggatattagatgttatttgtgaagaaatggatcagacaactggagaaccacagtgtgaagttgcccgaaggaagcttcaggagattgaggacaggtaaatgggcagtgtatatagctggttttttgctgttctcttgtaataactctgctcatataagctagttctgtttatcatttggtgataccttgatccttagcctctcagaaagactaagtcagataattcaaagtgtattcgtttttgtttttttgttttgtttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtctcgatctcttgacctcgtgatccgcccgcctcggcctcccaaagtgctgggattacaggcgtgagccaccgcacccggcctgttttgttttttagatggagt

SEQ ID NO: 103053 - DNA, 1027 bp, Homo sapiens
ttcgttaaatgaaatgttgaacaaccctctgagtatagtttttttttgttttgagacggagtcttgctctgttgcccacgctggtgtgcaatggcacgatcttggttcactgcaacctccgcctcccgggttcaagtgattctcctgcctcagcctcctgagtagccggattacaggcatgtgtcaccacacccgacaaatttttctatttttagtagagatagggtttcaccatgttggccaggctcttctcgaactcctaacctcaggtgatctgcccgcctcggcctcccaaagtgctgggattacaggtgtgagccaccacacccggcctgagtataccttttatactcaggtatagcctcattttttgcttgttctattgctgtattacttactgcttttatccttttttatttttaaaattttgtccaaatactagaatatataatagcttgactaaatattttttctttcttctgctgccttaattgatttaggataattgatgaagatgaagaagttgaagctgacagaaatgttaaccatctccccagtcttgtcctttctgataccatgaaaacaggtttgaagagggaatttgatgaagtttttacaaagaaaatgattgagtctatgtaagttttggtacctgatttctatttaattatgatcttggagggaagacccaatgtctagattctgcccaccctgtcctcattagctctttttatctcctgatccccaggcaattggagattggctttttcctagttcattaggggtgagcaaagtgctttacaagcaggagtttgaagtatggggaagtggctgccttgcctacttactctttggttcctttgaagacctgaaatggactgcagtctgctatttggaaatgagatgactggcaagagagcccactctcaagttcctgtgatacaggaaccacattttaaaggctcttgtttacctggctttctaagtgacccaggaacaacactgcggcctaggaaaaaaaataaag

SEQ ID NO: 103054 - DNA, 1013 bp, Homo sapiens
caggcgtgagccaccgcgcccagccaagggtatctcattattttatgttttatttttgcttcgtctttgggcccatacaccatccctgccacagtgtgtgtgtaacatagtcattttgccttaaccatgaagcttgttttgttttgttttgttttgtgttttgagacagggtctcactctgtcacccaggctggagtgtagtggcatgatcacagctcaccacagccttgacctcctgggctcaggtgatactcccacctcagcctcccgagtagctgggactacagtcacctgctaccacacccagctaatttttgtattttttgtagagacggggttcaccacattgcccgggctggttgcaaactcctgggctcaaaccatctgcctggcttggcctcccaaagtgctaggattacaggcatgagccactgtgcctggcccataaagcattatactttgtacctatactaaaaggcatctgagatactttcagcatgtttgtccagtgtttccttttcatttataatgatttagtatgagctagctgcctacatgtaatattaaccacaacttaaaaaaatttccaacaatcaagggctctgcgttttcatattggatttttaaatacttccaatcacagcatcattacaaccacttgatttggttaaatatacatgttgaagtgtgcaatgttatgtatttgaggggcctttctaaagatcagttggagccaggcatggtggtatgtgcctgtagtcctaattactgggaaggctgaagtgggtagattgcttgaccccaggagttaaaggctgcggtgagctatgactgtaccactgtactccactgtggacaacacagcaagaccccatctcttaaaaaaaaaaaaaaaaagaaagtaaagatcagtttgtgtgttctaaatctcctgttttgctatcatcagtccttaagatactaggtaatgttggcttttcaacctacagcttttgttttcatgtcctaaaatt

SEQ ID NO: 103055 - DNA, 1013 bp, Homo sapiens
ttgcgtaattgataagcccagttattcagtaatgtttacaaattaattgactttgatagttaaaagattatgaggtaacccatctgcaatttgcctgtgggagaagcatcctttagttcatcttaaggaagtgctttatcagctaaacccaacattgataactttggtaatttttttaaaaagttatacttgtattagcaagtttttttttttttcccccaccgcaacctccatctcccgggttcaagcaattctcctgcctcaccctcccaagtagctgggattacaggtgcccacctccacgcccagctaatttttgtatttttaatagagaccggttttgccatgttggccaggctggtctcgaactcctgacctcaggtgatctgcccaccccagcctcccaaaatgctgggattacaggcgtgagccacggcacgcagccagcaagttgtttttaaatgttaatatagaaaacagtgaaggattagctgaaaatatatgagcaggtgacattgaggtttactgaaatagccaatttgactggtgcttagactattgtgcagtaaacctaaaaggtagtggagaattgcttcctgctagcaggaagccttcatcttcttgagtacccaaaccaggcttcaggtgtcctttgaggatagccaggtttgaaatttttagtttctcaggaagagctcttctatgtggcaggggctgatagggcaaaataaaatgacaatttctttattgctacagagtatcctctataagttattaaacgagtgtaatggtataatgcccttccatcacacaacaggacaccaccccagttttgttttctgggtttcttccccctttgtaggaatcagataccttttgtagaaaaaaatggcttatgccacgtaaaggtgaatttttagaaaccaccttctaggcgtttttggaacccttactgaaatccctccccttgttacagatggcgtagaagtcacaagtctgttaattggactgtt

SEQ ID NO: 103056 - DNA, 1067 bp, Homo sapiens
tctatttttttttttcttttttaaatggagtttcgctcttgttgcccaggctggagtgcaatggcacgatctcggctcgctgcatcctctgcctcccgggttcaagtgattctgccgcctcagcctcctgagtagctgggattacaggcatatgcgccaccacacccagctaattttgtatttttactagagatggggtttcactatgttggtcaggctggccatgaactcctgacctcaggtgatccgcccacctcagcctcccaaagtgttgggattacaagcgtgagccactacacctggcctacaccaaaggtattctataatccactttgccttgctgcttgggattctctgaatcctgccttttttctactcattcactttgacctccccagagttagtctttgtaagttgggaacatagcatttaaatgctaaattggcatagaatgatttcatctactggcataggtgaaatttttataaataagtaaagtcctgtaaaaccttgtaagatttccaaggaaaagatgctatgaaggatgaggaggttatcaagtctttgggagttgtattaatatcactaggattttttcttgaagaggtttatttatttatttatttatttatttatttattttttgagacagagtctcgctctgttgcccaggctggagtgcagtggcgcgatctcccctcaccgcaagctccgcctcccgggttcacgccattctcctgcctcagcctcccaagtagctgggattacaggcgcccaccaccacgcctggctaattttttgtaattttagtagagacagggtttccccatgttaggcaggatggtctcgatctcctgacctcgtgatccacccgcctcagcctcccaaagtgctgggattacaggcatgagccaccgcgcctggccgaggtttattctttgatgaaacaaattcttgagtaaatataattctggaagagattaaaacccttccaaagtggattaggagataataactaactaactttccagtgtttaggatggtgcctagcatatactaaatgctta

SEQ ID NO: 103057 - DNA, 2997 bp, Homo sapiens
ctctgtgaaggtaatgttcaggacaaatttcaagaaaactagaaaaccattctttacagctgaaatctttccctaaccattgttatttccacttttaagtcctcaagagatgagaaaagggaggtaaggcttccttatacatttcctgcacaatgaaacatttttcctcctccaggcaaagattcaagcagaactggcaaatatcttatcttgctcttctcaataataataatgttgttagataataaagttctatagcaatttaaccctagaatctttttgaaaagtaattctttaaagttgagaatcacagctgtctagcaagcatttccttgggcacttgaagctgtttattcactttggtctttcctcccaggggaatgaagtgaggccagtggccgggtctgctgagtccgcagcactcagactacgtgcacctctgcagcaggtgcaggcccagttgtcacccctccagaacatctccccatggattctggcggtattgactcttcagattcagaggtagggatcattctgacttattaaagagctatataaccagttaattccatctgtttgatgcttgacatccctaactagacagatgagggttgaagttagtttttggtggggttggaggtgaacatcaactaccttcctagttccaggtaatatagaacatggagtgaagtgtagataaatgggtctggtgggtcccgaggtcatcttatcacataatgactaatttacattatggaacccagtacaaagtgttccagttagattttccattgtattctgacagttgtacttcatttaatttttgcctcttacagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaaggaatgatccaatactgttgcccttttccttgactattacactgcctggaggatagcagagaagcctgtctgtacttcattcaaaaagccaaaatagagagtatacagtcctagagaattcctctatttgttcagatctcatagatgacccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatgcagcatccttgtttgatttcttctagggccgtaagtcttgttttctctccagatgtttatctgtgtgctgtggtaggaattaatccaactgaagtgagcctaacgctttttaaagtgactgaaggcttttccaccttaattactgcctgctttaattctggactgccataagtgatataagctataatttgagcagttactgtctttctgagacagattcttgagcctaactgaccaatatcacagctagtaagtggaagagctagaaccctaaccactatttgctacaccatcttataaatgttaaacaaggacacaccatcacatatcgagattctcttgcccttattatgggaattaagagcattttctagactgaaactccctattttcaactctgccactggtaagctgggtaacccaggggttatatataatcacttatttcctcatctgtaaagttggataatggtatctctaaaggttaagattcaaagagacgatgcattataagcatttagtatatgctaggcaccatcctaaacactggaaagttagttagttattatctcctaatccactttggaagggttttaatctcttccagaattatatttactcaagaatttgtttcatcaaagaataaacctcggccaggcgcggtggctcatgcctgtaatcccagcactttgggaggctgaggcgggtggatcacgaggtcaggagatcgagaccatcctgcctaacatggggaaaccctgtctctactaaaattacaaaaaattagccaggcgtggtggtgggcgcctgtaatcccagctacttgggaggctgaggcaggagaatggcgtgaacccgggaggcggagcttgcggtgaggggagatcgcgccactgcactccagcctgggcaacagagcgagactctgtctcaaaaaataaataaataaataaataaataaataaataaacctcttcaagaaaaaatcct

SEQ ID NO: 103058 - DNA, 1011 bp, Homo sapiens
tctttaaaggaaattgtttcttagtttatcactctgtgataagcgtcttgaatataggagtcaaagttcagaacttggttctatttctgacttcaccactaatttgccataggctctggtgaatccctttccctctaccgaccttgccttcctctactgtgaaataaagtgttgtgatttgaattaagatctttgagatcaactctttgcagctggaaaatgttacgacttgcctagtgtgttgttcctgtttctagcactagggggcaatacaagcagcaccttgcaacacattctgctgttaaaattcctgcagtcaggttagagttgatgcagaaagatgattgctctccgctttggttctcccacctcttctgaaactgtaagctcacaaatttgagccttctcccagactagtgagagacagaaactttcatcaaagggaacaggactggctggcccatgaaatcttggctccatcacttttgagtctgttgtggactatgtatgtggttagggagatggcatgtggctaatacattgtctgtgagtgacaaatggacaccccaaaggaggaaaactgaggtgtagacttagattttgttcagaagagaaaaacaatttagtaacaccatcttgctatgatgttggactgagatcagtatgtggttggaaggtccatggaggctgtgcatagacagcaggatccatggccatgaaccctaggagacctgcattgaagtcccagcttgtccaataaagtgctgtgtgaccctgggcaagttacttcccatatgagaatcaaccttctacctacacaagtaggagggacctatacatagccaacacataccccgtatacattcctaccttgaaataagttacattctaaaagaggaaagacttatgtgcattttgttgtgtgttttatagcatgtactatgttggatcattacttcttttaaggaaatttttttttttttgagatggagtctcgctaattcacgccat

SEQ ID NO: 103059 - DNA, 1067 bp, Homo sapiens
gagcggaagctctgggtggtccaaatgtggtaatagagatctgtggatttttttcaagtgtgttttctgttgcacgttaaattttttttttcagctttaaaatgtaaccttggtaagttgtttactcaagaaaattcttaatgagttttctttctttctttttgtctttttaacattttgggtgtggtagcaagtagaagcagattcatcctaaccaaatatttgcaaatatctgaacaaagctattctggccagggaaggaagactccacggaggaagtgggaattggatctggcttttgaaggaggggttcaattctcagaggactagatgaggaaggaaaaggcatgttccaaaaaggggcagggaattaaaagtttattttctgggtgactgggaacctctgagcccttgagcacgtgccttagatatgttagtttggcagccagcagtctgtgcatagagggtgataatggtgttggactcctctggcctgcacgtggcgagactcaaagtttccagacttcttttgggggcggtgtctgaattacagtctccggggctgcagaaagatgaactccatcagaagatcctcaaggtcttccccactccttcagtgcagacttcatacagagaaactgtctaggcgacacctgtgcaagaactggacacgacccaagctgcaaactgcccctgaccatcccggccttccccgttcgatcctggaggtgggggtgggaatggagcgcccagagcgggcgatcaagcttcctgggaactgtgaattggggcgggggaagcaggaaggacgaggcctttccagaccaaatggccctaactcctgcaccggaccaggacgcgtggcgcctccagagaggacgcccatcgcccggagcaggttgcggtcccggttcccgccgaactctagcaaccgcgaggagaaatgtctgccgtagggggcggagcgcagcgggggcggagcgcggacgaaggggcggagcgaggacgaaggggcggagtagaaacgacgggcggggggcggagcgagaataatggggtggagcaag

SEQ ID NO: 103060 - DNA, 1937 bp, Homo sapiens
aggctttgcttttccatccatgcatgttctttttgggtgcggccaggtttgtctgaagggctgcacaacgtcgggttcttccccggaacctgccgtccgcctcacctgggcgccggtgacccttctgcggggctctggacaagcagcagcaggcaggggaggaggcggagctggtcgaggagtggggatcgggggttccctggagtggcgatggaaggcagccctcgctgcatgcttcacattacagagggtgggagggataccgcctgcccgtccctcggccaaagactgatgcgaaggacctgcaaatggggagatggcgtatctcactgacaggacctccaccttggaccaaatgaaagagatctacattccaaaggaaactggctagggagacctttaagccgtgcctactctttggaggagggactctcaactgaagcttctgcggatggttagctgggtggatgtcttcccgcttccttggccgtgattttatcaacttgttactagacagccagcgcactaataatggcagttaatatgcgcgcctcggatgggggcgattcgtaaaggttggcttgtctttgaatctttggggtgatcggatgtctgcagggcctaagctttgtgggccttctgtgctttactcttgggtgagttatgaatgaaaagaaggggactccatggaatgattgcatagcagcccgcagcgtagacagcctgttccgtggtgtccttttccttccttgggtgcagactcaaagccctgccttcataggacagggagagctgtgcagcttgactccgtagaggtgtgcccttacaaagctggaggaggtacccaggcccatgcgattaatcagcagcattgccttaccgggctcttatccccatccgaaaacttctgtagggtaaatagaagaggaaactccttcattgagccctttgactatctatgttaatgcttttggacttaaaaaaagttgtaattatgatctttataagttttagagatgatgctttgctgaagattcctaaacatttaagtcttgctccttggcaacttcttgtctttctttgaggctttcattgtgtcctgatggttttagaaatgtttgatttacagccttctaaaaaaaaaaaaaaaaaaaaaaaagacgctctagcgtggcacttgactttttgaaggagacttttgaagtttgcagtttttatctgcaatgttttaacgtgtcactctttctcaacagtagtttgtctggtgagcgagctatccattatgaggagtgttatgctttggagataatcttgggttcaccatttaatacaaaattagcagtttaaacaccatttgtaactattttatccttgtgagtagagagataatatgtgaatttggcagaaggaatctattctcttctgaaactttttgaagtgcttatctaactcttttgtagtccattagcctagccaaaaaaaaaaaaaagtcaatagttgctaagtaaagtgacttaaatggtatttaataagtttacttgttaagcaatcactaataggtgtccttaattcccttatagctgcagtaatgttggtgagtttatctgagctgtctgaatagtcatttcatggtgcacctcgtatctttagtaactttattgtggtagctgacttgttgaacctccctgtttctgcggacagagtgcagtgtggctttcagggatgtgtgtgtacaaaggctagcatgcttttatgagttctgcaaatactgtttgattgaaggaattggtgtggaccttgtctggcagccctgaaaaagttttttgtaaggaaggctgatgatgttttagggccgctgagagggaatataacattttcttttggtgagaaatgagaaagcagaaggaataaattgctgtccagctttggattaatca

SEQ ID NO: 103061 - DNA, 2441 bp, Homo sapiens
tggtggtgtgcacctgtagtcccagctatttgggaggctgaggtgggaggattgcttgagcctgggaggctgaggttgcagtgagccatgattacaccactgtactccagcctggacaacagagcgagacactctctcaaaaacaaacaaacaaacaaaaactgtgatttgctgcttagtgttttatcgtctcagagcagagttcattttcctataactaaagctaaatagtagcactatagcattgcttttgttatttccactggggttctgtagcagttttatttattcatggtttaggggagaaaaaacctgtttaggagtgtcacctttaagaattctaagataaggaattcgtttgtattactgatttttaacccccctccttattatatgccaacgaagagagagagagagagtgtgtgtgtgtgtgtgtgtgtgtgtgtgtgtgtgtatacatatatttgtatagtagataccttatcatagtctggtttgcctagataattctaactagagtacctgttcagtcatttccatgggttagggtaggggaagcctagttaagaattgtgtcagtttgtcagtgtcagagagagagagagagtgcaagagggagggaggtagtaattcaaaccttaggattcgtcatcaggaatcttggttcttctcctttgcgttttaggcttaaataactatcccaaggtcaccaatgtaatctgaatgaagaattttttttttaatgtctccatctgtgaaagttgtggtgaaaacaatttgtgggtatgaaatgctattagttacttttattatcttatgtatttatgcagtattaaagcctgtttgcttgtaagagtgtcaggcatacagtttgaatgctggagaaattaattacacttctcctgtagttctgaagtgtgggactttaaagggttcttagatatattgatacatatttcatctttgaaccaatttgttgctgttaatgagatcattatctgaaactttcagacttggctgtgcaactcacatggttggtgatgttaaataaaggcccgattaaacaccggctagtggtatgtggattggttaaacaaagaaaatttgcattgctagagatgaaagattgttttaaagtcgaaatgcattttttttttgcttgaagtcaaatatttagaaaagcttgagaaattcatttgtagaaggaatctgaatgacaggttctgtgtaactttaaattcagcctttctgggtcctaggttaaatgctgaatggacttgaaaacagagagaagctgaggacatttaagaactaagtcagttcctttagctattaggggtgggtagagagctgggtggtgggttaaaagggctgatcaaggtccttaaatatccgatgttaagtaaaggtatcacagagagtaattttaggaaactaattcctctgctttgtttccctgtcagtgtgcttctgcagtttagcatttgatcaaacactttcttttcatctccattttaagttaacttaacaggcctgcctctaaaaattgacttggtctaatagaacaattgtgtgctgacagctgacctggatttagacagaaagggattgcctactgtcttctcagatgggccttcataggttaaaaccaagcatttgattcagggggaaaactggggctgtattttgtgatgttatacattcttagagccccttattttctattttgttccctgagatctcatgggagttactagtacaattctgaataggaatgaaattggagttcagtgtagagctgtagattaaagggaaagtagtgatggtttcctcttatttatacagagcactgccaagcatgtcatgttttggttcttctcatcctgacactaacatgcaattagcaactattgttaatccattttacagaggagaaaaactgaggctgagagaagcaagttgagttctctaacttcacatggctagcagatgacaaacctggattgaaacccaggtctggccgggcgcggtggctcacgcctgtaatcccagcactttgggaggtcgaggcgggtggatcacaaggtcaggagttcgagaccagcctggccaatatggtgaaaccatacaaaaaaaatacaaaaaaaattagccaggtgtggtggcacatgcctgtaatcccagctactcaggaggctgaggcaggagaattgcttgaatccgggaggcggaggttgcagtgagctgagatcacaccactgcactccggcttgggtgacagagcgagaccccgtctcaaaaaaaaaagaaacccaggtctgcctgggttgcttgttcttgtttttgccaagtgaacagaacttggctggttaggattttgacattaattcaagtctaattttgaacaacatataatataggggttcttaacctgagggtca

SEQ ID NO: 103062 - DNA, 1447 bp, Homo sapiens
gaacggttaccttacagtacagtggggcatgtcctatctggtaggaaacagcctataggatactgaagaacacctgggggagggaatcgggccctggtgctaagtttagacctgtctgtcactgtatgagcattctggccttttccaactcatttttacctacctttgaggttaaagctgataacctctttgaagagaggtgcctttatacctttctaacggaataggaaggaggtagagagtagaggttctttgttctatttgtagcttgaatgagatgttttaaaatctgactttcagtggctctgtttactcatgatagtgtcaaaagaataaggtcagctggcccattgtggttcaaaggagagcactttatttttattgcccttaagatgtgttgtaagacttgatattaatttcctcctctccccagcagccagtgtaatatagttgtttagaaactcagtatagagtttgattctgtgaaaacgaagtttgatcctagaattttgatgggaaaacgtatgttagaatggggacttctggcctcctggtgcagaagtgcctgcatttaaaaaataaaagagccggcgcggtggctcatgcctgtaatcccagcactttgggaggctgaggcgggcagatcacgaggtcaggagatcgagaccaccctgactaacacagtgaaaccccgtctctactaaagatacaaaaaattagccaggcgtggtggcgggcgcctgtagtcccagctactcgggaggctgaggcaggagaatggtgtgaacccggcaggtggagcttgcagtgagccgagatcacaccactgcactccagcctgagcgactgagcgagactctgtctcaaaaaaaataaaaaaataaaaaataaaattaagagtggggtagtactcaattaggtgtgtgtaagttcccatccagcactgtaagaattttattataacttaattttctacttgagttaatttggctttgctatcttgtcagcaaacatttattgaatgtttactgtagataccgtatagagaagaaacatcggttttatgcacccgtggtataatttgtgcttttcaaatgttatttttctgatttattcgagagtttgaggctgcagtgagccttgcagctaccagtgtgagccaccgtgccagcattggtaattttctttctttctttttcttttttttttttttcgagacaagttctggctctatcgcccaggctggagtgcagtggcgtgatcttggctccctgcaacctctgcctcctgggctcaagccatcctcccacctcagtctcccgagtagctgggactacaggtgcacatcaccacatccagctaatgtttgtattttctgtagagatggggtttccccatgttgctcaggctggtcttgaacttgggagctcaagcaattcacccgcct

SEQ ID NO: 103063 - DNA, 2125 bp, Homo sapiens
cagggctcaagtgatccacccaccttggtctcccaaagtgctgagactataggcgtgagccactgtgacccactgtatgtttctcaaaaatacaaaatgtcgtaaaagtgaaagtctatatattcctatcatttagtaaatagtaaaatactggctttttttttttttttgtctgccataaggatctgaattatgactaatgtctgcactgaagggaaggtacctggcgtggcatctgggtgcctcccttgtaggtgtatcagagcatgattcaggagcagcaggttgcccttgtattctgggcaggaacacggcgtctgtccaggcagatggccatgctcagaggcctcacggtggggaccgctgtgctgtcgtcacaccctgtggcagcagattgttgcccaggagggtgctgcttcagttgctggtttctgcccttcctctttcctgtcgagcaggctttctgcttctgaacaggctggattcagaaaggccgaatgaatctgtccttgaattcatagtgacactgtcagttggtggtgggcagagatgcaagttgagcccaagcaccagactctcaggggtgcatttaagcagcaagcatataggctgaaaacagcttccaggtattttgttcgatcgctgttaaaaatctagaaagtgtacataaaaatgggctcttctaaaaaaaaaattaaaagatctggcatcagtgggtccacagtcccatgaggcaatagcctgccatagtggagtggcagctgccccccttcagcaggtacacaggccctccagtcacaagtccttatcgcattgcccagcttacttccctcactgacagttccatttacagatgcctggccctgtagacactgtagctggccatcctttctgtctctggaagttccaaagttgaaagcttttaacttgtgcttggcaagtctcttttctctccttccccaaccaacctgagtgtgagatgtccatcagtggaccccatgagtctcaagttatgctactgaggaaggcccagctacccttgatgtgaccagagggctctttttgctttggtgtaggtgttgaaggctgaagtctggagccattggcctgtgccttcaggatctttgctccttctctctttttggctccatggtttctcaactctgagacttaattgtttgtgctgaagggcaccttgaaaatgctgtgactccggccgggcacggtggctcacgcctgtaatcccagcactttgggaggctgaggcgggtggatcacgaggtcaggagatcgagaccacgatgaaaccccgtctctactaaaaatacaaaaaattagccaggcgcagtggcgggtgcctgtagtcccagctactcgggaggctgaggcaggagaatggcatgaacctgggtggcggagcttacagtgagccgagattgcgccactgcactccagcctgggcgacagagcgagactccgtctcaaaaaaaaagaaaatgctgtgacttagctctccttttgcagtgagggaactgtgggcaagggcatctagcctttggtcttaagagctgggattagaactcagaacttggggttctcgggggaggggtggtctttctagaatggcattctgctgcgatggttgaattccagaaaatcttccatgtgcctgttgctttagggttcctggtgtactttcacttacagtatcttagttcatcctctcatttgggagtgccttttctggattctgccccagaaggctgtctgctgttcaggtggtctgaggcggagtcttgctctgtcggccaggctggagtgcagtggagtgatcttggctcactgcaacctccccatcctgggttcaagcgattctcctgcttcagcctcccgagtaggtgggattacaggcgtccaccatcacgcccggctaatttttatttttatttatttttatttttatctttttgagacggagtctcgctctgtcggccaggctggagtgcagtggcgcgatcttggctcactgcaacctccgcctcccgggttcaagcgattctcctgcctcagcctcccgagtagctgggactacaggcgtgtgccaccacgcctggctaatttttgt

SEQ ID NO: 103064 - DNA, 5303 bp, Homo sapiens
atttgacattgtgtgtttagcacctttatgggatttctggaatatcgctgggtacctggagacttggcatcttttcagaaagtacatcagtcttggagtaggtggtgagcagacagctaatggcatgtaaagaatgttgcaagcttgacttgcaaagctatttcaaaatttaaataaaggtagcttgtggctgagttgaagggaaatggtggtatcttcaagacaatgcttggcttgctctgcctcttgctgacttccctcttcaggcctgatgctgcccaagctgtttccctgtctctcattctctctcttttggtttttctttttctttgtttttaaaagagaccaagtctcactatgttgcctagactggacttgaactcttgggctcaagcgatccttccgtctcagccttccgagtagctgggactatgcaggcatgtgccactgcagtcggctctcacattctctttcttcccatcagttcttcccttcccttcagattcatccttctaaagtagtgtttggtcacatcagtctcttgatcaaaatctttcgtggcgtcctgttgcttactactgagctgtgtgaagaggtgacctagctgccccagtctctcattgttgcctccgggcgtgggcctgtgtgttgctgtccttgttcctgagtgggtcctgggctttcctctctcagtgcttttctttcttttttagggggatcggggagacagaatctcactctgtcacccacccaggctggagtacagtgacgtgatctccgttcactgcaaactctgcctcacgggcttaagcagccctcctgccttagcctcttgagtagctgggaccacagaaatgcgccaccacgccctgctaatttttgtatttttagtagagacatggtttcaccatgttgcccaggctagtcttgaactcctgagctcaagcaatccacctgcctcaactcccaaagtgctgggattactggcgtgagccaccgcacctggcctgtgcctttccttttggattgcctgctgtaatacgtgtcttcacctccacattttcaactcccgtctttgctttccactgtctttttcctgtcctagctcctcccatctgcagccaaactttcagtccttcccatgaagctttttcctgggttccaccagtgtgttcctttgaatcagagcactccatctccctattgtcttggatgtaaaacatgtaaattatttaccgaaccggaattctcctagatcacactactttgggatagcatagtgagagggatgtgaaaggggtgttaatgtggcctgcagaaaaaaaggcttggctttttttctctttttttaggtggggtctcactctgtcacccaggttggagtgcagtggcacgatctcatctcactgcaacctccgcctcctagtctcaaacgatcctcccacctgagcctcctgagtagctggctgggaccacaggcacacaccaccacgcctggctaattttttgtatttttcgtagagagggggttttgctgtgttacccaggctgctcttggactcctaagctcgggtgatctatgcacctcggcctcccaaagtgctgggattacaggcgtgagccactgtgcccagccaagacttgtttttttgagggagaattttctgtgattgtcgcaactatttgcaagcagctttcagacatggtgtgtcctgattattccaaatagttgggatagtccagactctcaaaataatttcaccttgcctgtgcttcctggaggtctggagaaaggagacagtaggaggtgacaccctctggctccttccagtctggcgtgtgcctgccctgggaacattgttcagaacatgctggagaagagaatatcacagcctgactgtagacttttggggatgtgttttatttaaatatgtaaaatataatattttggtgtcacttaaaacaccgggacttttggaggcgtagtagaagttctatgtagcttcagaatgacccatcagaaacaaatgtatatgagtctttacttacatttgtgccatattgcttccccctatatttttttccctttggaagctctggcatgggccttgatcctgtgtttaagcgctgtgtgggaagcagaatttaaaaggactgtagtagtatttctaaagagacttaacaggctacatgtgagagaattttagatttcaatttagcaaacgtttgattttctagtctttatggggctgactgtaagcatttgggaaattattgaattattgcttagttctgtataagttgacatgctgaggttttttttttttttttttttttttaactgtttttgtgggacagtggtgattacatgggcattgggactttcaggaatattccagaatctatgatatgttgtatttcacttgtgctagagggttttcaggctgccttttcatggcatgttcactccagaaatgctctaatgcccatcaataaatgtcaccctcatcctaggaattagatgaagagattatagttttgaagttttggtgttattaggcttaaatctctaggacacatataaacacacttgtggtattaaatgtgccgggtgggtgatttcaagttccagtggcagtggtaatttttgcatttcctgactcttgtgtttaaatttgcagtctcaacattgcatcactgtaagttttcacatttaatgaatatttatgttgagccaagttctatacgaatgtggtggtttctgacttgattatagcttgctgtgtactgtggccaggagtgccctacagacaacagagttggcacacgtctcagcatgccaagccccggcggatgtggttagggaccacggtgactggggcattggttgccataccaaccttgtttttggaagggaaagctctgaaacagcaatgggatgggggcagaatagttttgaatattccaagtaaacttattccctatatgttccctgcaagaagatgctatagaaaactataattcttactatgtgctcagatagcatgagttaattttctttcttttcttctttctttctttcttttttttttttttttaagacagtctcattctgtcacccaggctaaagtgcagtggtatgatcttggctcactttagcctcgacctcctaggctcaaacgatcctcccacctcagcctcccaagtagctgggaccacaggcgtgcaccaccatgcccagctaattttgtttatgttttctagagatgaagtctcagtgtgttgcccaggctagtctcgaactcttgggctcaagcaatagttagtttacttttgcaaggctgttttaattgtccttttgcaaaggtgtggaagttatatggtgggcctttcatgtgtgaatttcttccctacttgttggagggtaaacaggggatcttctatctcttcctattacagaccttcttctctcaactcctgccaacctcccttgccctctggtaactaacctagtgatgactgattgggggagggagaagggaaagaaaaacaggaaggataaatgggggactcctcctcccccagctccttatttatattcctcactttcccttataccaagatggggtttccttgctcctccctattgtatataagcaaagatcacagtcgaaggtgccatcacccataagtgggatgttagggtgccctgctcacgagcttcggcagacagaactgggatgagaggaaggaaacatccctggcatctcacactggaatgctgttacctctttgcaaatggtgccttgcatgattaattctatggtacttggtattgtgcagtaaaatgtctggaagggaattgatcaagtctggtaagccagatcagagcccagaatggcagagtgggatgtgacttgcaggtggcatctgctgttctagtgcctctttacagaagatgatccaagtctctggaagctgccacctgtccaggttcaacagctcaggcagtctgttgttgtggagggcttgtcctcaagcctcatcacacaaaaaaagtaaaaaccccacccctttgaaaagaaacttactgtttcagaagagggaggcagtccaatgatttaatctttgcttgctgacttggagccaactccccattagattgtaacctccttccgggcagggttggtgtttcaatctatttaacatttttcagctgggtgcggtggcttacacctataataccagctttaggaggctgaggtgggatgatcgcttgaggccaggagtttaagaccagcttgggcgacatagcgagactgttcctacaacaaattttttttaaaaaaattagccaggtatggtggtgcacatctgtagtcttagccacttgggaggctgaggtgataggatcacttgagccctggaggttgaggctgcagtgagctgtggtagtgccactgcattccagcctgggtgacacagcgagacctgtctctacaaaaataaataaataaataaataatttttttttaaatgcagaaaacatttcccagttcaactcaaagagcctctttgtttgaatttggaagagctgtcccttcctgaagatacctgaattctattttctgctcatcggtcataatgtgaatctaggatgagcacagatgtgaacggcacctcctagagttgtgcggtgcataaggccaacgcccagaaggcactcttccatctccctgttggctgacgtggcacctgagttgttcccccttctctaatgcttctccttcagcaattgtgatttgctgcttctgatttctgtagtcctaggaaaccagggaaccatgtttgttagaattatgtgtaaagttaggggacagagacatcaagggggtgtgtaagtagtttagtatgtggctgctttggctgcttttctgctttttgctggctcctctttagagatcagctgactggcgcatggagtcctcaaattttgggggcatgtaataaatgatggatggacctttttttttttttttttttttgagacagagtcttgctctctcactcagactagagtgtgtagtggcacgatctcggctcactgcaacctctgcctcctgggttcaagcgattctcctgcttcagtctcctgagtagccacgattacacgtgcgcaataccacgcctggctaattttttgtatttttagtagagatggggttttgccatgttgcccaggctagtggctaggcgttttatggtgcagaaatggcaccactattttgtgagtattcctaatc

SEQ ID NO: 103065 - DNA, 1026 bp, Homo sapiens
gagatggggttttaccatgttggccaggctggtcttgaactcctgacctcaggtgatccacctgccttggcctcccaaagtgctgggattacaggtgtgagccaccgcgcttggcaagttaactttcattcacctggtttgggtataagttctctttagttcttcaaactacaacttttagctgactgtatttaagaggagttgggaggacagagcagtagttttccactttgctacgcagacacccagcatttgccaggccttttttttttctttttttgagatgggatctcactctgttgcccaggcaggagtgcagtggtgtgatcttggttcgctacgaactccctgtcctgcgctcaaatgatcctcccaccttagcctcctgagtagctgggactacaggcgccctgctgatttttgtatttttcaccaggttctttaagcatgttgtaaactttgcagaacaaattggttctgggtttcctttgatgggagaggctgcagagtgctgagtctggagccagacagcttgggtttgaatcctggctttggcagttacctgctgtggaaagatggctttgcctctctggatctcagtttctgcatctgtaaaatggagataaacttttcctagcgttgttatgaggattacatgagttactcacagcatgcaatttatatttagtggggatgaggttgaagaaaatacataatttcatgctgctcctcacatatacctaacgtttatgttgcagttcccaagtggttgcaaattcttattctaaaatggtagcttatcaaagttaaaggaatccaaaaatgccatttactgagaagagaagtggtcataacataggaatttttttttttaacatgcttagtgcctttctacttgcacctatgtcccttctcccctagtgtgggggtctgtgggctccccagggtagtgcttaagcactttgcaagaggtgcaggctgctcatttctccgattcccagttccctctgtttcctgggagggacg

SEQ ID NO: 103066 - DNA, 3563 bp, Homo sapiens
gggtgctgattgctcctctggatccagccggacgcatggaatgctgcaacatactaagcctgtgctctgggggcctaattacgtgggacttggggcaagcacaagtgacttcagcgcttggtttgatccagcgtgtgatttttgccaaagcaaatactttattaatcttaaccccccaaattagacacattgactttttctaaaaatgggaatgattggagagcagaatttttttttaaatcccctccccatcctgaacccctcctccagcaagactgggctctgcattcctctccttgaatggagaaggtgagttccatcactgcctacctcctcctctaacattcctgaaactaggtgctaggaaattgcccctttctgaaggtgtgttttttgtgtgttttccgcaagaggttccactccttcctacgtcaaggccaaagaaaggatttgccgtcctgatggaactttcctaactgggaacttgtcctggatttcttgggattctgatccagaatgtgtatagggaaaactgttgggtgacttcccatggtgaccttgagtgtgtctgagaggctcagccagaatttcttgtgtggcctgtgagtgagctagcaagccagcgaggtcagtgggccttcccgctcaacaccctgtctctctcctcaaagtgtcttgggtaaagggcatactcacagggtggaattaatctggcgttagagagtgagcttgttcttatctagtctaaactggaaaaaaaaaatgcatttaaataagcaacctaacctcaccccagaaaacaactcctagttaaccttggctcctcttcactcggcctctgtctttaagtctgagtgacctggtgggattgatcagctttgaagtcctaaggtgctattttaatactgttcttttacgttgcaggcttcgagactgatttaactagattctggagggagcttactttacagcattcttaagagctcgaacaatcttgaaagagttaaactctaattagctcattcctaaggtatttaatgcccttattaaaactcaactgctcgttcacttttttctttagtgaatcagatttcttgaggagctgagccttcgctcctcagatcacaggctcacatgttgaagctggcagtgctagaggctagttcctatctgtgtgacagcatttttaatttaacaggaccgcctttgatgttcccaaatatttataggcagctttagatcatttcagtgtgtgctttctttttcttctctctctctctctctcttttaactggagcaaaagttcttcctcatgcaacagccttccttttatcctgtttagtttatttttgtttcctttgcagctttggcgaaggctgtctggctgcattcacacacacacatgagattgacccttctttttgcttctttggtaaaggctacctctctgtatcctcctgcctgcttgagattgcttaaggcacttctgttcatcccttgactttcttcaggctgagttttttcctaatctggctcaggaatctgttctttggctgacctgagagctttcagactatcatgcagacctgggcattgtgtgaaagtgtctttttttttttttttctgagacagggtctcactctgtcacccagactggaagtgctgtggaatgatcatagctcactgtcaccttgatctcctcaagtgatccttctgcctcaacctcccgagtagctggtactacaggcacctgataccactcccagctaattttttcacttttttatagagatgaggtcttgctttgttgcccaggttgatctcgaattcctgggctcgagcaatcctcctgcctcggcctcccaaagtgctgagattataggtatgagccacctcacctggccttgaatgtgtctctttatggatgaccaggctgtaatatcctactctgcttgcctgcattgacactgatggggcctcagcaagttatgatttacagtgtatgttttgcagatactgttttagctggggcaggaaattcagatagacagaattctgtcctgatcatttcaggcttgctctgtttggctctgttagacttcttggctgaaaataacagagaatcaaagattttggtctcagggatgggaaaaacagggctgcaacatagatttgttaagccattaagaaaaagaaaaaggaaactttgtaccaatcaaaacaaatgatagaacagaggatagtgcttcctccagcttggcctctgggtaaacattctgcttgtgaaacaatccaaattactgaattctcagctgctgttacttacctgggcctggcagacagaagaccagaagatatcatggcttcttccatcattgctggctgtgcctcctattaggtggaagccttttagtgctgaaggtctcataggtggttgatgaaatgtgtgaatgaatgaatacactattcttgggaccttatactgtttttctcactagatccttaagaggattctgagcgataagatatttcatatctgtttttttagatgaggacactaaagtgcagagaggtttatacagctggtgagtgaatggagaagctggcctggagctcaggactgtgtcttatagcctcaccatgaggtaattggaggcaggtaaatccaatggcagtctgctaacctcttagagctaaaaaagcctgttgaggctaagcatggtggctcacgcctataatcccagcactttaggaggctgaggcaagtgaattgcttgagcctaggagtttgagaccagcctgggcaacgtggtgaaacctcatctttacaaaaagaatttaaaaattaactgagtgtagtggtgcacgtctgtagtcccaactactcaggagattgaggcaggtggattgcttgagcctgggaggcagaggctgcagtgagctgagatggcaccattgcactccagcctaggtgacagtgatctgtctccaaaacaaaacagaaacctctcaaggctaaaatctactgtatgttgcattgtgagagttcagagctgaccagattcttgccatgtaaggggcatagtggtggagagtacatccctgagaccagataggcctgtgttttgcatctcagccctgctactgacagctctgtgaccttggccaggtcatccaacctctctgaacctctgcttcttcatctataacatgggacagatagcttgtacgaccaaaagactatgaaaattagatgatatatgtaaggtgtacattaagtgcttaacacatgttcggttggtgtctgttgctacaaaattgtgactctcaaagggttcatagtcctgcaagaaagcatcaggtaaaccacctattagaagacgacttggcagctacaatagagagacgtgctggtgctgagtaggaacccagggcagaaaccactggcttggatttttattttctttcattcagcagatatgtattgagtgcttaccctgcgctggcagagccactggatcacactgattgctgccagctccccctcacctcccaattttctc

SEQ ID NO: 103067 - DNA, 1262 bp, Homo sapiens
ccatctcagctcactgcaacctccgcctcccgggttcaagcaattctcctgcctcagcctcccgagtagctgggactacaggcacacgccgccacgcccgtccagttttttttttttttttgtattttagtaaagacagggtttcaccatgttgcccaggctggtctcgaactcctgagctcaggcaatctgcccaccttggcctcccaaagtgctaggattacaggcatgagccaccgtgcctggccacatggagtcattttcacataaaatgccaaggtgccaaatggcacagccacactgcatttgaccatgtatcttacatggccttgtgctgtccttcaactctcattttaatcttatctaattttctccaatttctctggtctcttctacatgaaaactttatggtccttgagaatgtacaagcgactcaccaagggagcaggtggtggccgcatggttccccacagtgcccagatggtgtccgtgcctttcatggtctggttccatggggatttgttgataagattttgctttcatttggttttccaacccagcagcatatttagatttgattactggtactagcttttttctctgcagagtttcattgtctgagtcactggctgtcttgaaacataagtcccattctccacacccctgtacccctttgcaatcagtggggatggttatgtggtagaactttttccctgcccacagcgcatggtgcagagtggtgtcagcacactttcacttgctgagttgattggtaacatattgaatctagaacaaaagatacaattgaaaagcatttgtggttgtctttgtatagttacaagcctctaaaatagatttgaggtcatttctatgtctttccttttgaattagcaagcaagctttcagagggaagtgggcgttttctaaatgcactattgatttgaagctaacatgatgctctacttttggatcatgaaaataatgttaattttttatttggctgtttggagggaccactggagtaggtcatttatattcaactcttattcatgctttctttaaatagcatgtttaatttcacattaaaactagcttctgttcagctaaaacaaaaactgaaaagatggtttggaagaaagcaaaatgacagagaaaatgcagcatgcaatggaaattggctgcaagtcatctccataaggtgattgagaatgaagtgaagctcagctttctttccaaagaaccctcaacaaccctctatgtta

SEQ ID NO: 103068 - DNA, 2738 bp, Homo sapiens
tagatttgtctgggtggagagcaaagatgaagctattggtctagtagagaccattggtccccagatgagggcctggtgtctccgttgggtgttttgtttgtttgtttgtttgtttttgagatggggtcttgctctgttgccaggctggcgtgtagtggcacgatctcgactcactgcaacctctgcctcctgagttaagcaattcttctgcctcagcctcctgagtagctgggattacacgtgcacgctgccacacccagctaattttttttgtgtgtgtgtattttagtagagacagggtttcagcatgttgcccaggctggtctcgaactcctgagtctgcctgcctcagcctcccaaagtgctaggattacaggcgtgagccaccgcgcccagcctctgttgggttttttaggcacacttgtctgaagaaagtcttttgattttgagccactttttagagctttgaagctcttcctgattttaactattgctacctatggaagagttgctctttgggaatggacagcaacttggggctaacagcttttaagcatggacctctcctgggggcgtgttgggcctgtttactaaccttactgtggactccgccttcagatcaggatgattttcatggtatttttttttttctcagaaaataatcaaaccaaaactttcccttgctgatacagagtgactatgcaaatcaggtctgcatgcttatcttcctagaaatgtagttcagtgaaaagaaaacagcgccttcctttagcccacatactttcctcattcataaaatgaatcagatgaaacttgatttcacccaggctggagtgcgggggcgtgatctcagctcactgaagcctccaccacccaggctcaagggatcctcctgcctcagcctcctgagtagctgggactataggcgcatgccaccatgcctggctaattttttttttttttttttttttggtggtagggaaagggttctaccatgttgctcaggctagttgcaaactcctgggctcaagggatccattcacctcggccttccaaagtgctggaattacaggtgtgagccaccatggctggtcacgcccagctaatttaattttttttttctagagacaggggtcttactatgtttcccaggctggtcttgaacttctggcctcaaatgatcttcctgccactgcacctggcctgatttgtatttgggagcctcactttctccattaactttttttttttttggagacagagttttgctcttgttgcccaggctgagatgcagtggtgcaatctcagctcactgcaacctctgcctcctgggttcaagcgattctcctgcctcagcctcctgagtagttgtgattacaggtgcccaccaccacaaccggctaattttttgtgtgtgtttttagtagagacggggtttcaccatgttgaccagattggtctcgaactcctgacctcaagtgatctgcccacctgggcctctcaaagtgctgggattacaggcatgagccaccatgcccagcctctccatcagactttggatctggaagatagtaagaaaaaaagcaaagtaacttagttctgtcctttcctagaggacgtaagcagtcttggcctcttcatgatggtccactttgttaccgaattattgggtacaaaagtgaggtctgcaacaggctttggatgtttcaaggtgtgtctggctgtggtttgctttctgagtgccagctttaatgtcctcttattttctggcaagggttgatggatgtggcactgaatattttctgaatagtgttcacagaatcaccgagtgaatgctggcctcctcctgcatgtctgttgagggagggcttatggaccagtgggaaagtcagatgtgtccctgagatggtgacagtataacatgcataggctgagtgccaaatgcttggggcccagagaaagtgcctagaaatcagagaaaggtcttgggggtggacctccagctggactcttaaggaagattggtgcttggatttgctcctgctggctcttgctatggggaaggcatttcttgctgagacccaggctaggctggcaactagtggagctttttctagcttgtgtagacctggaggctgcctggcatagaatgtgcccatggcagggcggggagaaagaagaggccaagtgaggtgcggctgggagacaacagatctgctatgctctctggtctgtcatttaagtgggatctattggattcagcctttctgagcctcagtctccacatctgcaaactgggtgtggggctagatgagattcctggggggaattgggggatctgcagctgtgcctctgaaggatgtctggggacagaagtgtaagtggggaagaagcacactaactggggaattggggagggaaagaactttggagggcaagttaggggagggataagaggggctttgaatgccagaaaagggtatgtgacttttatcatggagaccagtgggtcccatagtcagaatataggtgatgtctatgtgcatgaccgtgtttttggtgacacaactcccgcctgccctgtgtcctccagcagcatggtatgtaattgcagccctcactgcacagcagtcggcaggcttattcaggggcagttttccagcagtcactcctctcttgagaacagtctggaatgtaagggagtaagtgatgttctagtgacaaccttgaattcactt

SEQ ID NO: 103069 - DNA, 1855 bp, Homo sapiens
gagacggagttttgctcttgttgcccaggctggagtgcaatggttcaatctcagctcactgcaacctccgcctcccgggttcaagtgattctcctgcctcagcctcccaagtagctggaattacaggcgcccaccaccacacccagctaattttttgtatttttagtagagatggggtgtcaccatgttggccaggctggtcttgaactcctgacctcaggtgatccacccatctcggcctcccaaagtgctgagattacaggcgtaagccaccgcacccggcagggacacagttttcgaatccttgccgatttgagtctttactgagcggcttgatttatcttggcttgggaagttgtggatttttagaacattgggtacacttgtattaaaatagatgtatactttcttaagccaattgcacatttttctggagtatgcccaagatgagcttttctcaaggcatcgcctgaagaacagcagtcctgcacaatgttctgtggtgaaagggttctatgaggatctatgctatgcattaatggtggggctcagtatttgagaaatactgttgatcctagttttctcttagagatatattctgcacagtagtgaattaatggctctgagaaattctgttgaagagcggtctttcactttatttaatctggtacttcccaaatgtacttgatcacagaactttttctcaaaggactcaaggtgctaggggatatggagtggcgggtagccagtattaggttagtttagggtctgcactggttcagttggtgtcctgttagattatgaggatggaaggccaacaccaagttaactaccagctttccacagggccctgggatagagtcatcaccacctagaatgaatggcctgaacacctttgaactgtggtaggactatttcttccatttcagcttagatttgtggtcttctctataattgggtgatggggtatagggagttgtagtataaaagaaccaagaaacagtgcttctctttgaagaatttaatttctactggaatgggaagattcatgaaggagttaaacagtaccaccgtccaagtaggtatgaaataatgtcaagtagcctgtcttgtaggcattttgtagcctgtcttgtaggcaggtgggggccacaggaagcaggggcagcctttattgtgacttgacttaccaaactttgggtactgtgatggcgggcagataagatagaggagtccccccgacccctgcagccctaaatgcctcttcgtttgccccgcctctgtgtgtaatgtactatgtgtgaaagtctcttagactccccgcaaggtagacattttagagttggatgaaatgcatgataagaactccttctggtactttccagatgtatttgatcccagaactcctttttctcaaaggacccaaagtactggggaacatttggttccttctggaaggagaactccctctggctgatctgcaggcccccactgctgggttggcatcctggatttcgaggtggccaccttctgtgactcttaggccttgagcttggctatctggttttggagacctggtgccttggaagtgctgggctgagttgaatggaagtgcattttccgggttagtctaccttggttaatgcagggaagagtaaataggctctgctgactctagctgcccataggaaggatgtgtgtgacataagcggggctgagatatcccccattgagatgctaagaggaaactgagatgaggagtttaaattcttctccaaatatgtgtcatatttcatagactgttgacatagagcttttttttttttttttttttaaactttaaaagttggaggcc

SEQ ID NO: 103070 - DNA, 1358 bp, Homo sapiens
cctttggttgctataacaaagtaccactggctaggtggcttaaatgacagacatatttactcatgattctgaaggctagaagtccagaatcaaggtgatcagggttgatttattctgaggcctgtctccttggcttataaagtgatggttttcctatgttttcacgtggccttccatctgtaactgtctgtgtccaaattttctcttcttataaggacaccactcatattgtattagggcccacctatatgacctgctttaacttggtcacctctttatagaccctctctctaggtagtcacattttgaggtactgggggttaggaccttaacatatcaatttttgagagacagaactctgcccataacacagagccattaagacatgatgaccctccagatttctgaaggtgattttcttgtcacttgtcttttccttgctgagaacccccagttctttccgttctttatatgagatggttttgaagtccctcaccatcttggaatcttctggacttgccttagttttggaaggacaaagtggaatactttggactacccgtgatattatagatagaattcattctaatgtctgcccaagcaaacaattttgatgatttccgaaaaagattaaaaggctaaaaatcagactgtacagtttcagtaacagctttaagatatttgtctttaattttgcctgagtaggtctgaccactgacacacacacgggcaccgcccccatatcccaccccatgcatccagtgctaactttatgtcttcttttgacttaagcatttacgttagagttagtaagtgctcaaggtctaagtttgttcaccacccttcctcccttccttcatacttttttagttttaggaaacctagttgggagggttatttcaaaagaataaatgaatgtagagatttttattttttaaatttaaattacatttaatttttttgagatggggtcttgctctgttgcccaggccagagtacaatggtgccatcacagctcactgcagcctccccctcctgggctcaagcaattcttccaccttagcctcccgagtagctgggactacaggcaggtgccactgtgcccggctaattttgtttatttttttgtagaggcgaggtctcactaggttgcccaggttggtcttgaactcttagactcaagggatcagactcagcctcccaaagtgctgggattataggcatgagccaccatgcctggctgagatttttattttttaaatgtaattgctgtctggagagggtagaaataactcagttactggagtataactcattttaggttcataatgtcatgccaacctgtagtgtagttagat

SEQ ID NO: 103071 - DNA, 2598 bp, Homo sapiens
aattgtggagctccccacaaagagaccctcagtgctgttcactcttctgctaaattgtggtttgtaagtcctgactgatagttttgacaggctttttctccttaccgtagtctctttagatggagtgtgacgctcttggagttcctttctttgaagatgctttgactataccgcccaggatttccaaattgtagcctttagatgcctggaaccctggccccacacagctgttaggccccctctattctggaggcccgacaacattaaaaataccaactatttatagcatacttttcagtgtcagtaaattataggatgcccttgccagtggatggggtgaacgctcatctgcctgccactgtgtgattgcctagaagcgtcggccaggtggcaggagctcagccccacctgaatgctcccaggtcctcacctggcactcccacaggaaactaaggactgccaggatgtcttggggttccagtagagtccatgtcctttgcgatggagtggttggggataaaacacacacacacacacacacacacacacacacacacgacactaggtatgtgtgctcttgagagaagcccattctgatctaactgccaactcctcaggaggctgtgttgtcagccatctgtgcacagaagtttgctgcatcactggtgagctggggagtgtcctgtgtggtgtccacttaatcttactaggaaggatcccctcatttcaacaaggtaactgaagaatgttaaatctaaatttgggtaagatatactctctgtaggctgaagaatttgaagagtatataaaagctcttatagctgggtgcctatagtcccagctacttgtaaggctgatgcgggaggatcctttgagcccaggagtttgaatccagcctgggcaatagtgagactccctctctttaaaaagaaaaaaagcttttaaaaaggccaaaaggacatagggtctttatcttccctcagctgccccttggaaaggatctcctggcttgccattcagagtacacagtgaggggaggccccctccacagggtaccatttagaacaggctcagtcgttagaacactgcagagggcgtgctgtcccctggccaccaagccaagttgggcttttggggacaggttttgtggtggtagcttttgggttcttcatttctttgcctggactgaacagtgagcagtgctcaagaggcctgttctgttagctggagtttccattgaagtgctaactgctggatcctttgaacctctagcctgggagggtatttataactagctgtttgcgtgcttagaggaactgaagtcctgcctttctgtagtggtttaagagctgtgcccttggtgtgggctgaaaggcaggcctggcgaagtgtggggactcaaatgcccaactccccacgaccttgtttgccttccccctgccctgccagcccagcggcccttttagggttaacttctctgctttggaagcagctggccagtttacactcctccctgggctgtacaaaaatacttcctttgaagtgttaggagaagcggtgaagggtaaaacctggtgaagaataaaacctggagtggggcttgaatgcatttctcttccagggagtttgctgggtgactgagccccacagccttcctcgtaacctatagagctgagtggttctcctcacatagttacagcttggagcctagttgcagctggcatgtgcatgtgtgggtgcgtgcgtgtgtgtgtatgcacacgtgtgtgtatgtgtatctgcatgtgtgcgtgtgtgtgtgtgtgtgtgtgtgtgtgtgtgtgtgtgtgtgtgtaaagtctcctcaaaaggagtatttcttttcaagagagatagttagaatacagccaccaagcttgcctggtggctggaatccctttgaaggcacttttccctagggcgggtctgagtcagggtggtatcctggggtatgtgcgaagctacaatgtttccacttcgtcctaaagtggccagccctgttcttgctccctactggggtaggaaagctgccactgatcccatctctgattcaggtcaaagcacagcagcctaaaagaacgctgggcatgaagtcagtggtgctgacttctcttaaccttgggtttcccatcaataaagttgggctggtggaaataccggattgggggcaccttgagaaagtgcaagacacttctctactgtaaagcctgcagttgagcagaaatggcatttaggataaagaggccaaagagaagaatgccagagcagaaatgagacggaacaaagcttgaatgtcttcttaatccttgagtatttgcagccaaggaggggttggggcaagatgggaggagaggcagctgttattttctagagaagaatgccaacctgtttctccccacagaggggaccacacaagttatttctgaactggagtttgcagtcccttctttcctggaaaatgccttcatatggatttcttacatcttattacactacttcctatctcccttagacaaggagtgtcccttagacagatctaaaataataccatagagctaacatttattgttggcttttgcc

SEQ ID NO: 103072 - DNA, 3807 bp, Homo sapiens
attgaatagatgaggaaagggaggctggaaaaagtgagatgacttatccaaggtcctcttacctactgatgcaggtatggaaatacagacccggttagacttttagcctctttacttttttttttttttttgagacggagtcttactctgtcacccaggctggagtgcagtggtgcgatcttggctcactgcacctcagcctcccgagtagctgggattacaggcgcgtgccaccatgcctggctaatttttgtatttttagtagaggtggggtttcaccatgttggccaagctggtctcgaactcctaacctcaggtgattcgcttgcctcagcctcccaaagtgctgggcttacaggcatgagccaccacacctggccccctttactcttaagagatgtaagttacaataagcgatgagggggtgaaatttaattctgtgccccaaacctgatcagaagctgtttttaaggaaagaggtggaacattgaactctgttcattctggctgttttgactcatgttatattcatcagtggacttttattttattttttgagatggagttttgctcttgttgcccaggctggagtgcaatggtgcaattttggctcactgcaacctctgcacctaccctggattcaagcaattctcgtgcctcagcctcccgagtagctgggattacaggcatccgccactatgcccagctattttttttttggtagaaacggggtttcaccatgttggccaggctgatctcgaactcctgaccttgggggatccacccacctccccctcccaaagtgttgggtttacaggtgtgagccaccgtgcctggcctattttattttattttttgttttgagacagagtctcgctctgttgcccaggctgtagtgcagtggggcaatcttggctcactgcaacctctgcctcccgggttcaaacgattctcgtgcctcagtctcctgagtggctgggattacacgtgcccaccaccacgcccagctaatttttgtatttttagtagaaatggggtttcaccatgttggccaggcttgtctcgaactcctgacctcaagtgatccacccacctcggcctcccagagtactgggattacaggcgtgagccacagcacctggccagcagactcttattgatcagttatatttcaatacacatgagtgcgttttgccttgcggttactgaaaagaaacttttcttatttctcattctctgtgttgactttacaatagctatgcttttttccctctcattagaaagggttgggaagatggctgctctgtaactgcagctttgttacggttgaaggtcttggtgtcagggattgacgggtagcctgtaccccttggaatccttagctgtaggctttggtctttccccagcctagaaccagacttggcacttacttcaaggggcttgagatcctgtgcttgaccctccttagctcatgggggaaaccaaggcctgggaaagtttgagtgatttgcccccagtcacacacggggctagacccagggccaggctggcaggttcccagcccactggccacatgcttctccttttcacctgaatttcaaacaggagggaagatgaaagggatagaaatgaccagtcagaggagtaggagggctgtcatttgcaaacagtttcttttgatctttgccccattgtttaaaaaacccccaccaaaccacaactggtagcatcagcacatggttccctccggttcattgaggggcagtcatttctcttttaagtgggaagccccccccacccctagtagtctgtttcacttagggctccatacctcctctccccttctgctactcggctgccagatgtgctccccttcacaaacctttcagagctttttactgcttataggatggagtctaaccccgccttcccctaatattctaaagcccttgacattttgtgcccagtctgtctttgcattttggcatccaaccacagagccccttgcctctagtcaaagggctcctccgaatgagctttggcctttatttgcatctttgcccacattctgcccatctttcaatgctgctgcctccaggaagctctgttggactaatgcagcacccagttgcctctgctgcctccgaacctgaaacaatctggtctggcaactcatttgacacttaatattgttttgtgttgtttaacttgtagatgtgtctgtctccctaactagattgtaagttcactgaggtcaacagcatgccttctgaactgcttcgtattcccctctgaactgtttcatattcccccacagcattccacagggcctaggttgtatgctgtgcaaagatctgggactgaaatgctattatctttctaactgttaataggaatggaagaaattagtttccccaaaaaggaataaaatgattaactagagagatttttaataggatctgtgctacgttaggattaatatataggttgagtatcccttatcctaaatgcttgggaccagaagtgtttcggattttggaatatttgcatatacataatgagatgtctggggggtgagactcaagtctaaacatgaaattcatttgtttcatatacaccttattcacatagcctgaaggtaattttatacagtatttttaataattttgtgcatgaaacaaagttcctcttaagtacttatgtgtggaatttccacttgtggtgtcatgttggtgctcagaaagcttcagatttggaagccttttggattttgcgtttttcagttaaggatgtttaacctttactttaaatcgggttacttgaatgaatcagggaattttagtttgttgtaattatttttttgtttgtgtaattttgctggcaaacagtctatagtgaaaattttgacctagaccccttcaagatgaaagtaaataaatgcatgttatttaaaatttgctgttgttgctatttagcaccctagatgcctgtttacttttttactttgttgttcttataactttttctctaagtaatttcttggatccgtattcgcactgttacaattgtgttcttgaacatacttctaatcttttttagccattatgataatatattttgttttcttgaccctttctgtagtttgttaggttgatggcttccactggaattttaggtttgacctcccaaaggtggatccacctgtatgggaaagatttgttttcccttctccatcccctcccagtccctctgcgttctggccttgggtgtatgaaattctggccttgaacacacctagcagtcctggcccatgtccgtttcccagttaactcttttgtgcccgatctatatgtggcatgttccgccacagctgtgggtggaatcatgcttgtgcccccatataaccttttccttcttagcatttttttcttttcttactcctgagttaaacgtgtagcagaagaggtgtaaagacacagggccagcatgaatagtgctccctttttaaaatgtggaaaccggcttggagaagttaagtgacttatccaaggctgtacatccagtaaggagaaaaactggccttgtgacatagccccagggatgtgctgtgccccgtgatggccccatatgttggtgttgggagttcagtggctcatcaagtgcctgtagctcttaaaggaaaggagttgataaaatgaagcaacctggggcgcttactccaggggccatttctaatctgatttctgtaagtagtggatttttgagagtgggttcttgtatttcctcctggtctgctgtgttcatggg

SEQ ID NO: 103073 - DNA, 1063 bp, Homo sapiens
taaaaagtaggcaagagggctgactttggtcagtcattccttgggtctagaaaggaagctcatctgtcccttccctagagtatgtgagaggcttgcccaaggctggtagtcagatcccatcctgttggaaggagagaggggtctccaagaatatggctgagtgccaggatcaccaccacccctagcctgaatattctcccagtctctgtaaaaatcatagacatgtggctgatttttctggggtattcccagttaagatggtatccctgcctttagtagttgatcagtacacaaatcagtgaaaccctgtaccatacatacctccatgagtgaaatcgtggtcatattctgttttcttgcttagcaaatcttgctgacagatagatgaagaagcctgccaaacggagtcagcttgttggatgctgaggtccttcccaagatcttccctacatcagaattcagggtcagtggggtctgaggcactactcaacttaagtcatagtgactaaagtccacttcagcatcttacagatgtcccaaccaaacccagcatgtgtaaaaccagatttctcttctctccacaaacctgtttctgttaggttcttttgttactccagctaaaaagctggtgtcattctaagctgtttatcctcaatgaggtgtccccttctctaaccccatgatgcctctacccatgcacattgaattgtctgtaagttactggaaggcaagactggaagggtttttccttcccttttaaactacaaaccaggtttcccccatcttctgtaaaagcaccccccaatattgtgaatttcaagcatgcaggaaaagtgagagttttgcagtcgacacccatatacccactatctatattccaccgttaacatttcactgtatttgctttcttacattttttatctatctgtgcatgtgatggggttttttgagacaaggtttgcccaggctggagttcagtggagcaatcatgaatcactacagcctcaacttcctgaactcaggtgattctcctacctcgtgatgggtttttgatatttgaaaa

SEQ ID NO: 103074 - DNA, 1008 bp, Homo sapiens
atgtgtatacaaagtgagtgacatcgtgaagattgtgccaccctggaggaaaagaagtagtcatttcagtgcaacactttagggtcttctggaaagtaagaaattatatttatttttgccagtatgcctcttttgttcttccagtgattcgtcagcaggttgactaaaattagagccgtctgctagtcttgtcccatctaatggttagataaatcttgcactgatgttcataccttgaaggacccttttttgtggaacttcatgtgttagagaaactgaacctgtgtaaaatggagcagatccaattgctctttgtaaccttgctccctgggcccccaaagaagctagaatctcccagttttggccccgtaggtgaagatgttactttgggagtacttgtgtaacctgaagaagactgaaagtatatagcagttctcatgagggaaaccctgggattattggcctaagtctctcttcagtgcagcagaaattctgctgttagaccggcattactgtcttgacaaaaggggaaacaaagaggctactacattgttagggagccccatccatctgtccacccatctgtccatctgtccacacacccatctgtccacctacccatccgtctgtccatctgtgcaacaatgcaaggtactgggaatattgcagtggaaaagacaaaaacccctgccctgtggagccaacattgtactaggcaaaccagatcctagcacattgtcaccctagaatcaggaggactcttcctgcccagttccactgggctagacatgtaaagagaatatgtgagtaatagctaaactttggtcttactcagctaaactttggtcaaatggcaaaatacaggtgaggttcctatggacagagaaggcagatggcataatggggatatgctgagctcagtgatgcatcactgtagacagcttgagaactctaggcatgggccagcttgggacagaggccatggaagagacaggtgtagtgcgtggc

SEQ ID NO: 103075 - DNA, 1625 bp, Homo sapiens
atcttccaaagtacatcatctgacattttagaatacagacttccctttcatagcaaacctgtattttaatagcttgtggttttaaaaatatcatctaaactcatgaactaacgcattcttctcaattatatcccaactctaccatcatcttctctttcttctccttaacttctctggaaattattggaatctgcttttaaacactggggggattgtatattatagttgtttaaaaatgaatcaatttaagtttgagcaatgtggtaattcaaagcagttttaggtgttattgggattttttataaagagcattcctgagcctgaatgaagcagtcagttttcctgatgagccatgagcccattgcattaatgtttgagtctcctggtgctcatgataacgattaaggagttaatgttacctctgccatgtttaaacattaaccaaagggcttcctctgctattatctgttatcaacaattacttggaacattttctggcagtggagctttgtttttcctccgaggagatgctagaacaggatgagaatagacattaggccacatcaaaggaagattcttgattatgtccaaagaaactctggccttgtgggtacagagagtttgcctccttaatattttgtaaactcctatcacacccccacccccaccccaccccccccacacacacacacacacactcactctctctctctctctctctctctctcccctccctcctccctcctccccctccccctcatctgggtctgaggaagagggctgcagtgattatttcattgtatcatggtgagtggtacctcttttcttatttgggatactcattagagttgctcggtggagatggaatgatggtggggtgcagttaaacatggctgagtgctttctgcttaaggacctgatgtattaatgctctccaggtcattcatatttgggggaaggaacaaagagggtactgctctactgcagatgtgttcatttgcttattaacaaaaggctgggtgacccagaaacttaaaccctgagaacaaaagtactttccagcttccaaatgggaagatcttggagactcttgagtggctcctctggagtgctttctttaccacctagctgtttggagctgtcgtgcctaatagcttctcagcctagagggccccataaaattttagtctgtttctgtatagagtgctttggagtggccgtttctctctgcctcttatttactctcaaataccctttggaaaaagagctgatgaggtgcattgagacttggcatcaaaagccattcattgatagccatcgctcaactctcttggacttaaattttgttaaacaacaatcacaaaaagtcttaaagaattacccctgtttcccctgaatgttgaagtaagaaagaaaagaattactcctgtaatgcaagaagacatactcattaaaatctaaacagcgaaaaagtatatcgattaggttgggcgcggtggctcattcctgtaatcccagcattttgggaggctgaggcaggcagatcacttggggtcaggagttcgagaccagcctggccaacgtggtgaaaccccgtctctactaaaagtacaaatattagccag

SEQ ID NO: 103076 - DNA, 1156 bp, Homo sapiens
gtagtctgagctactccagaggctgaagcacaagaatctcttgaacctgggagatggaggctgcagtgagccgagatagtgccactgcactctagcctgggtgacagagcaagactctgtctcaaaaaaaaaaaaaaaaaaaaagtatattgattaaaaaggggaaaccctcccatcctgttcttcctgtagatatcactgggaccagctgggtttccagtttttttttctgtgcatttctctatactcacacatggttttgcataaatgggattatcctatacacctgttacttgacttgctggcccaggacttctctgaatgtagggtatgctagatgcacgataacacagccccatcatggcttgtaattcaggcatttagcgtaagctgctgggtttcacttttcttctggaagcttcaggcattgccctgctttctggatgtgctatggttctggattcttcctttctttttctcttaatagggcttgtctaggatggaatttcaaaataacttgattctttccatctgagacacaagcacacaaaccctttagcagaaggtttttaaggttgcctgtgtacctgccctttgcccctagaggtcccactgtgagtgccccagtcacatgatccactctggccttatgggggcagcccaccctggcgcccgtgtggtgaagcctactcgttgtcaggtttccagtcattcctctctgcccttagccctgttgttctgtggctttgctttctgggtgctctgcccatgtcctcagttcatttctctcattccgggttctttgcctgaaatatcctcactaggctccactctttggggtcaagactgctgtctttgtgcacttggaggctagcctgtctctgttgaagtaatgtgtgggtagggtgcccacaccaacatccctgacacagatctggccagccaccttggatcagcctgctgccttctcccatctcctcttagatttgttcagttccaccctttattggctgcagaaaatgattctctacaattctttcactgtggtttatgatagaatccattttcttaaatctgatgtaggatcactttccccagcagcaaggtaattctcttagggtcttcaaaatggctcccctacccgaattcccgacca

SEQ ID NO: 103077 - DNA, 1035 bp, Homo sapiens
atagttttagatttgtggaaaagttgcaaagatagaacagagggctcctgtatacccagcacccagtttctcttactgttaatatcttacactattatggaacatttgtcagaacaaaggagccaacattgatacattactgttaactccacattgttactgcttttattgaaaatacatgaatgtattttcataggattcaaatatcagaaatacataatgacagagtgcctcttcactcctaccatcccacttcctatatatttcagagtattttttatatatttatatacacatgtaattatgcacacacacccatccatcttattttaagacatgcttttttcatttaaatatgtcttgaaagcttttttttttcagtatacctagatctgcaccattatttttaatggacaacacattgttttacacccttttaaatatatcttatctattttaatctagcagattaaaggtgaggtctggcacacctcccttttatcttaaagtggaggttagagattatttgccctcctttgtggagtacttagcgtattctaggcactgccaagcacttagcgtgtattatctaacctagttatcaaaacagtcttactcataggtatcattatccctgttaacagatgaggaaactgagggtcagggaggttaagtgagcaaaaacttttgacgactttctagctgaagcaggctgtctctggtactttgggtgacatgagctgttcagcttagggtgaacattgcttggtttatggagtcttcctgagtgccacacctagtgccagaatatgaaggtgaagggtatgcttagggaactcacagtcttatagctgaggggagatgtatatataaaacaaatgattatgtgataagtattacattagagtttgtaagatgtaagatgggtttcggataccttaaaaaatccactagaagtaaggcatgtgcttggaaccatggcagaacagatggaagtatagcatcagatttggcaatcagacccgagttctaatt

SEQ ID NO: 103078 - DNA, 1204 bp, Homo sapiens
ggcaggagtgagtctgattctttggatagggggttgggttggatcttttaaaattaatttctgggtgtgaactgtaaaagagacgaaccagtagggatttactctcctccgtaatttactattgcagccagaagcctgatggtttcagcacccccacccagaaaaaaatttataaaatgaccaaaatgttacagaaatttatttcatggaggttgttcattttatggacagttgttccattttaagcactttgatcaccctcctgattccctttttttttcctccccctttttggacgtcagttctctggcatgtttagtgacagaagcaaaagggctgtaggaaatctttcttcatgtaaataagtacctatgtctctcctcatacttttattttcctctggcattaaaatgagaagagtagggtaggggacttggaaatcctatcactgcaaaaatggttggcttagatgccggtggtggtggtggcagccagggagggaaatcaagagtcctttgcatgtgcctgggtgcacctgcttgtttattagatgcgtggctgtaagtcatctggagtagtgcaaatttgtatttttattgatttgaattcagagaaggtttttggtcttaatttaactaatttatttatttttcattttagaaattcaatttcagcttcaccctaattgtcactactaaaatcctacatatgcaattctaagcttaccaaactgataaaataagatgactttattacttttattttttaaaatttctcgttttccttttctcttttccacttggctgaggacaaatatagataaaatcttggcctattgaagagccagtaaaatgttgttttatttttgtttctaacctgggatgttttatatctgcaaaatgtggtgaagacagacccattcattaaaaacagactgctcaactgggcaccatggctcacacctgtaatccgagcactttgggaggctgaggcgggtgggtcacttgaggcccaaagtcctcaagtgaccagcatggtgaaagcctgtctctactaaaaatacaaaaattagctgggcgtggtggcgcatgcctgtaatcccagctactcgggaggctgaggtgggagaatctcttgaacccgggaggtggaaggggaggctgaggtgggagaatctcttgaacccgggaggcggaggtcgcag

SEQ ID NO: 103079 - DNA, 1041 bp, Homo sapiens
ttttgggatgtagacattttggactaaggatttagagatttttttaccgagacaggattgtatgcgtactaagatgtccttaaagctggtactttccccttttatcactaatggctgctatttccagagctgtgggctttatctgaccatcttgcaggtatgttgaaagatttgactagcacttaaaaggtatgttcagaaaatgctattttaagtgtttcttctttaccctatttcccccttgttgaacagtgcaaaactaccaggttttatgttccactgggcagctgctgctggtctgatgtttttctctctgtccctcctcctccttctgtctcccctcccccgggggtcctcccccagtgcctccccctgccccattcttgctccggtctgaagggagctgtacctttgtggttcttctgcagctgctggactttgatggggacatgcttgctgcctctacacttgcttcccttagcaaccgatcctttgacgatgacctcttgctgtttgcctgttgtctctcatgttggattatagatgagagatttaccaggctgggggtagaggcctgctgttagcacatttcttttagggttcccagcgtccctcagcctgtgttttctctctctaaaatatgaggtttggagagggtgcatgtgtgtttatgtgtggcggggatattagtgccgaatcaaacagttttaagttcatagggttgtcctagttgtgagctaattttgaagtagatgctgtggtggttactgaagctacttgatttacttctcatttttattataatgtgattaacacacatggggggggaggggtgccatttgttcctctttacactttccaagtgtttgtgtgttggcactaaacttgtttcctggtgtaatctgagctctgagaattgccaaattacctaaatctccacacattttaacacatttattttctcccaaagcattaagtttttgttttatttaaagtagcagtattcctggacatgtggctcttattttgcatggacagctt

SEQ ID NO: 103080 - DNA, 1022 bp, Homo sapiens
agggatgctcaactggtccgtataatgcaaatatttgaggatctggtcccaagcatttcggataagggacaccccagcctgtagttttataagttgagaaaacttttgttttaattgactcttcaccccccgaaaattattttgagaatattttgtctaaagctaaggacttaatagatgaaccaagacaatgacttttctctgtgtttcttcttgttgttgttagaatgtgtttgtgggtttgtgctttttaaaattaaagcccccttttttctttgtgtgagagatggctttggggtttttaagttgcagtgttatctgaaggaagttatatcgcttagcaggaactcagtacaataatgtgtcatccttctgtaatcatgtaatgatgcctgacttcaaaatgacttactagtatttgggaattggtgtttggactggttgtttatgagaaagtccaggtagaccgtccatttactaaatacggacgaatggcaagggacttgggagctttctgtttgatggtggttgaaatcactagttatggatgccatctttatttggaaatgtttgtaatttgggaagaatgagaagtgttagcagatgatggttctatgaacagtttgtctaggagcatcagagtgggaggagggtgttctggggactggggagtgggtttcatttgtgtttggcagtagctggtgatggctgttgatagttgaaagatctatggtctctgttgaggagtacttgaccatgaggttggttgagtgaggaggtgagtagctatgagatcacaacctgacaggccttacgcttcctcagccttcactgtcaacaattgcttgggaaacctgtaagaatggggagaagagaaatatagcagccatatcttgggcaggtattgagagggtagttcaaaatgttggaatatgggtaaaactagaatgctgcacttctattgggctcatcatttgggagagactagtgagggtagagttggttctcttaagttggtttag

SEQ ID NO: 103081 - DNA, 1448 bp, Homo sapiens
caaatgtgctgtttcccttatttcatgttttgagttttaaaaagacagtggctctttagggccttcctccatatctctgtttctgaggatactccttatacttagaacgcttgactgatgtctagttcaggcccaggccagtggctggcaatgacctcattcttgccatgtaaatccttactgaatggcatgagactccaacttagcagttcatggaattgtaaggtgagcccagtttcccagccaattatgactccatctaaagccgtagctgggccattaatgtattttgcgccttgtcctcttttatatcttgccaaactctgagagtctactgtatagctactggcaacaggcctctgccaaaacagtctatgaatgtatcattttacacctcatttttccttgtttccccctgtgatggcaccttgcctgtgtttctctctcccacatctttctacccacttaaaaaaattattcatttaacttattcctttattgtggtattatagacttttggcttctgtagttatttagtgtgaaagagatactgaagaatgaaaatgctaatatcttcttatagcgcccttcctttttcaaccactagtggttctcctaagggccctcttctgggttgaattgtgtccccccaaatttatatgttgaaaccctaactcccagcacctcagaatgcgaccttttttggagattgagtctttacggaggtaatcaagttcaattaaggtcgtcagggtgggccctaatccaatatgactggtgtccttattaaaaggggaaatctggacatatgcacacacaccaggaacgtgccaagtgaagatggaggcagtgattggggtgatgattccacaagccaagaaacaccaaagactgccagcagcccaccagaagctaggggagaggtgtggaacagattccctcatagcccccataaggaatcaaccctgtcgacatcttgattttggacttctagtctcaactgcaagatgacaaatttcttttttacccagtttatggtagttcgttaaggcagccctgggaaatgaataccaactcaaagctgactgctgtctcccatggccctgtggttctcttgctcaccttggacctttgttctacaggtcacaccacggctggtctcccagggtgacctgtgcgcctgccatgtaaggttcctcctcagagcagtgctctgtgactgctcacgctaatgaagaatgcaaggttgaggactgtgttttctggaaagatggatagagatggtttagggactcagagataggcgactccatgtacctgctcccatcccgtttgcatgtacctcttcccctgtgttgatgagaggtattaaaatcctgctggcctccacttgctcctcttccccgtggagcaaggagcactgagccagcatgggtatatctggcttt

SEQ ID NO: 103082 - DNA, 1697 bp, Homo sapiens
tggtgtttttttttttttgttttttttttttgagacaaggtcttgttctgtcgcccaggctggagtacagtggtgcaatcatggctcactgcagctttgacctcctgggctcaaatgatcctcctgcctcaccctctggagtagctgggtctacaggcacgtgccaccacacccagctaattttttaaaatgttttgtagcgatggagtcttggtgtgttgcccaggctggccttgaactcctgggatcactcaagtgatcctccttcaccagccttccaaaatgctgggattatggggatgagccaccatgctgagcccctttaaaatggtagttttttaaaggaaatattatcaagagtttgtgctagttatgtttttccaacccatgttaaaatgaataaatgtctgttgttttaaaaagtcctcctgtgtaccaccttgcagcctctgtggatcagcagtggactcctggcctaccctctgggaaacatgaatgtggtgtatagtttttggatcatgttttgtggagcagcatcctcactcagcatagctgtgctttggttggtctcacgcactgaagtgttacttaaggtttggattatgggaaggacttttactactaaagacgttggaaaaccatatgttttgggaggctgaggtgggaggatcacctgagcccaggagttcaagaccaacctgggcaacatagcgagaccctgtctctattaaaaaaaaaaaaaagagccaggcatggtggctcgtgcctgtggttccagctacttgggaggcctaggtgggatgatcacttgaacccaggaggtccgggctgcagtgagccaggttcacatcactgtactctggcctagatgacagagtgagaccttgtctcaaaagaaaaccacatcagtaagccatcttctcgtttgcctcactaacatcctgttgaggtgtcccacaaaccaaacaggatgtgggggtgcggaggattatcccctctaggagcaagttgccccatctggttgagggagaggtggttctgtcaccagtagagcatgttgagtgctgcagagatggctggcgacggggatgtctggcctggcagatgtcaccttcaaggagggagtgtgctcattgcaggctgctttctgggatgggagtaggctagtaatgtgatgtgtggggccttccctgaaatagaaggcactggacaggcatgtagtatggataaggtagagagggtgatggatagttttggctttccttgtgaggtgggcatgctggtggcatgttttagattttccgaatggcctttgtttccatttccttttttttttttttttttttttttaaagctgcatccttttgcatcgaatgaaaccccatcaagggcatctcctaactcttcttccattctcttgtccagggctggtgttttttgtgtgtttgtgactgacaatgcagcatggagaatttggagaagctagttttgccttttctcctacaggaagagggactcgtctgcaaagaaaggggtctgcctttcagtcctttgaagccacctggtctgacaaagacagtttccctgtccctttttggaccttgagctgagcaaaaaattacttagttgctgaaagcaggtcagtgtagaggacttcctctactcctgctttgacttcatctgcaagagagctgaga

SEQ ID NO: 103083 - DNA, 1034 bp, Homo sapiens
tggataaaagcaccactagccctagtttcagttttgccctttcagacatgtggaaagtgcaccagtatatctcaaggattttgtactgaaagcttcttaaagagctggtcttggtttcaaagtttggcttgatgtaccatactcaagggaacatagttctttttctccagatatttaaccttgtctgacatcgtcttttggcttcgaagttcccctagcttctttgtccattaacaaaacatgaaaccacatgaaaccatgatagtcagtctcactgggctctgaggaagttgaagaaagttcatcttcatatttaaacataaaaccagttgtttgatacctggtaccagagatggccaggtatatgcattgcttgttggtagcattttgccttagtaactattcagaaatgcaagtggaatgttgagttcctcttctagaggttatatctgtatctgggagaaaattggagcttctcagaacaatcaccctggttattgtgtctgccgtctctgtaacacccaaatctatatcacactctgatgccacctgggagctatttttggttgcgaagggtggtgaaagctgctggttctttctcttaccgtgtgtccctgagtcatccccagcccacgtcctggatggctcccagaacagccgtctcagacgaagtctcccttcagatgtccactcctcagtgcagggggcctgtggggtctctcttggtcctgatgaaatccttctctgccttttccagtgagaaggacccatagaatctgctggaacacttggagaaagggacttatttccagcagtgcataaaatttttgattaaaataattcacgtgtctgtttataaaaagacaaagcgtacatcatggtttataataaaaaagagcattatcttgtttcaccttcaccacccctgattgctattcccagaggcaaccattttcaattctttagtggcttcttttgtcttcatctctgtgattctttctaaatttctgtaactcttatagtcaattgcagaa

SEQ ID NO: 103084 - DNA, 1052 bp, Homo sapiens
gcctgagctgttgacataattggctcatccctcttgctcatcctttttctagttggaggtctcagcatttcagactactcattgtttaataactgtagaacattctagagtgggctgaatcctgcacgggcaccctggaggaaaggttgccccacccatggcaccgcagaacctccattggcccttcaggcaaattccatgagcctgaaagtttgtgcaaagttagatcccagggccctctatctcatatcttggaattcccaaggggtgggatatctctcacccactataaagacagctgctggccgccctgtgctcagcagtggtgacctctcacctgccttatgagcttgtgcaacccctttcctgttgtttcattgaattgtcaaggaactctcatttttggcctgcaccctttgccctccactcgttgctgtctctggagtccaagaataccactgctccaagaggttacctgcctgcctaaaataacttctttcagtgcacaatcttctgcctaaggacctgtaatgctgtcttggtgtccagactccatcctggtttttgagcccttctctttccttctcagtgtagacagtgacccttcctactcatcagactggatgcatccttttctcccctctatatcatctcttagcaactcctccccgggcttggaactgacctctctctctcgttttgccctgatcagtctaactcttccttctaagctcactcgaggctcagcagctgcgcaaagcctccccaaacattctagcaactcttgctgcctgcaccaaactcatgttacgcttgaataccacaggatttagagctggaaactttttttctaaggattttatctcttagtctttccctgtcagatggtcagctctcagaggaagggaagataaagtaagcaagtggtggagtgggaaggcactggattgtgaatccaagggcctggtcacctctgggtgtgccacatactggctgtgtcttggaaaagccacttatcttggatttctgttctcatctgtaaaacaagtagg

SEQ ID NO: 103085 - DNA, 1027 bp, Homo sapiens
gagatttggggggtttagaaaggcattaaggggtatagattttatattaagtaacctccaagagacatggggaggcactcagtaaccaaacacattcacatttgtatagcaaaccatagagatcttcacattaagtgggataactaaaatctaaatagcctcgtgttagttcacggcagctttgcctccagatgagttcaggtccattaagttttgctgccaagtaagttatgggaaaatgtttcggttttagagctttttttggtttcagaatggcagacagcaattatggtcctgtattagaacttacctcataggtggttaggaggtgagatgagatgcaaacgcctcacacaagagtaagccctcaataaacgtttgctgccattggctaccatcactccatttagaagtactaaaaaagactttttagccaagagggtcagcattactttgactgcagtataagatagaaataaatttactttggaaagccactcatcaacaatcttaaaatatgacaggtaacaacctgttttaaactggattttgtttagactgcatcattttgttaaaaggagaggttcagagaaggtgatttgaattttggctgggagaaaggtagtctgtcctaaggatagtggtactgactggatatcttttatattctcaaaagctgccattctaggtaccatggggagagagctggggcaaaaaactgtcctggttcctaacctcttgaggctctcttgagaaatccaggagagacaaggggtggttttgaagcagggtgctagagagggaagactttccagacttaaagtagcccctgccagtgtctcctgaaagacctttggctccaggtaccctcacaggtctaatctttttgtggtttttgcatccctcttgtcttctgaataacttcaagtcacttgtcaagttctcctgccctttagttggaaaaaataaccccacaggaattattagctgtttgctttacagttcacaaagttgaatcgaggtgttt

SEQ ID NO: 103086 - DNA, 1864 bp, Homo sapiens
gaagtcactcagagaacccaactatttcctcctctgcctggaacaaccatgtagtggttttacttggagagttttgtatgatttggcctgctagcctgtgatgccagggggaataaaaaaccctaggcatatattgaatcattaagtgcttcttaagtttattcactcaccaaatatttattggatgcaggggcccagaagctgagcatgtggttctacctgcttgcaagcagcagcccccacgtttctctggagaggctggtggcgggcagcatttgcacatggttagtcattgcagtttggctttgagtttacacctgaataaaatcattagcacagaagcttgggccaaagaaagacagttttgcatttgtttaaagcctgggccagtgtaggaggtgcgatgagtcaagatctctctctcttcctccctctctctcctgccgcccctctttctctcatcatcttcttaaagtgtggttgttctcagtctcaatttcattaactttgacaactgcgttttcttgttttatgagccccccgggggctggtagcaaaaaaataggttaaaggaaggcaaagttatccccttgggcagcttagtccctgcagaattcatgattttccatccatttcttggctctgaagaagcaggcagtggacagaggcagaaaaggcataggaggaaaacagccaagctagcttgggggtgggagctccttcctgtggatgttgaaacttgttgaaaacccacgaagggaggactctgtccgctgcaggcgggccaggcattcggaaaagcctgtgggagaagaggggtggcctagacacaggctaaccccctccccaccacccaccctcttcacctacccgcgtacttacagacaatgccacagggtgaaaccttgaaataagagaggatgtcctaaattaaaacacgtaaatgcctctccaagagttcaaataaaatttcattttaaaagcaaaaggcataaacttgtcacctcagtttattactgagtgcttttgaacttctcagaaaagaactctataaactcatgagagaaatatgatttatgatcccctccttctcttcttttccattctgtgggaggaggtacagtcaggatcagctagggaggcagcgttgggatgagggcaagaccccacaggggagcagcaggccagggcgccaggccaggcccagcctcagaccaggcatgggcgcatctctccagctttctgagcctctctcctgtacttaatgtggagaggctgttgtgggttccttgttcttctaatattttgagcttctgtatcatatttaaaatctttctttgatattctagttcggagagattctagttacagcattgaaaaacaggctctgttacctgtggcagtttaagtcctaagaagttaaaatagaataaaattgacatttcttagagtttgctattaagtaagggtcttggccaggcacggtggctcacacttgtaatcccagcactttgggaggccgtgccgggcagatcacttgaggccaggagtttgaaaccagcctggccaatatggcgaaatcccatctctactaaaaatacaaaattagctgggagtggtggcatgcacctgtagttccatctgcttgggagtctgaggcaggagaattgctggaggtggaggttggagtgtgctgtgatcgcaccactgtactctaggctgggcgacagaggaagaccctgtctccagtcaatcaatcagtcaatcagtcaatcaatgtaagggtcttaaaccatccccaaagcaaaggagtctatgtttatgtcccgggcatcttaaccctccaattcaatcagtgtttatt

SEQ ID NO: 103087 - DNA, 1062 bp, Homo sapiens
aaacagcatgggccaggcgtggtggctcacgcctgtaatcctagtactgtgggaggctgaggcgcgccgattgcatgagctcagggatttgagaccagcctgggcaacatggcaaaacaccatctctacaaaaaacacaaaaattagccagtcatggtggtgcatgcctgtggtttcagctactcgggaggctgaggtgggaggattgcttgagcccaggaggtcaaggctgcagcgagctgagattgtgccactgccctccagcctggccaacagagagaccctctctcaaaaaaaaaaaaaaaaaaaaaaaaaaaaaaaagaagaacagtatggtcaataggcatggccttagctctctccaaggcttaatagtacaatgtggggaaattgagaaaaagataagaaagggagtttcatgtcacagagacccagccttggctgactgacctcagaaagggtacttcattcagttctcggtgcattctcctctgtgcagcagggctaatgctgcctgtgtcattgtagtgggggctctgtgagatatttgtagagcacttagctcagagcctggcttatgggaaatgttggatgaccatgtagaagtcagccatcacatgttgggtgctcgccgagtgctgagagctttacctatagcgtctcctttaattaatgctaatttgacatcctatccagattcccattttaccataagcaaatcgagtcctagagagttctctacataacctgaaattgaacagcttacaagagccaagatctgaaataagacccttctgcttcatcaatgttggtttcttctctttgcctccttttgtcttcgccagtttttctagataaaaatcagatgctcacctgggcacggtggctcacacctataatctcaacactttgagaggctgagtcaggagagctgcttgaggccagaagttcaagaccagtttgggcaacatagtgagacctcctgtccacaaaagaataaaaaaaaaaaaataataagctgggcatggtggcacgagcctgtagtactagctactcgggagg

SEQ ID NO: 103088 - DNA, 1026 bp, Homo sapiens
aatcaaactaattgaaatccaaggctgggcggggtggctcacgcctgtaatcccagcactttgggaggctgaggcgggtggatcacgaggtcaggagagccagaccatcctggctaacacggtgaaaccccatctctactaaaaatacaaaaaaattagcctggtgtggtggcgggcgcctgtaatcccagctactcaggaggctgaggcaggagaatggcgtgagcccaggagcttgcagtgagccgagatcacgctactgcactccaaactgggcgacagagcgagaatccatctcaaaaaaaaaagaagaaatccaaagatgtttgaatttcttcactaaatattagccagaacctgatatgtaccacagtgatggagtgtggttggtacttaaaggaaaaagaactcaggaagaatccaggaagggggcagtcaccttatgatgatgaatgggttttgccaaacctctcagaatttgggcttttgttttctgaccattgtctcactgagttctctgatgaaagtcaaagctcgtaaaattacagtgtaggtgttaatctagcacagcagttctcaaagtgtggctgggggctggtagggattctcaaggtcttttctaggagcacccacaggatcaaaactgccttttttttttttttccaagacaggatctcactctgtcacccaggctagagtgcagtgacactatcttggctcactgcaacctctgtgccccaggctcaggtgatcctcccacctcagccacccgagtaactgtgactataggcacatgccatgatgcccagctaatttttctatttttaatagagatgtggttttgccatgttgcccaggctggtcttgaactccagggctcaagcaatccaccttccttggcctcccaaagtgctgggattacaggcgtgagccactgtgcctggccaaaactgttttcatgtaatattattttgaaattatttttattttttcgaggcagggtcttactatgttgcccaggctggt

SEQ ID NO: 103089 - DNA, 1034 bp, Homo sapiens
ctataatcacacaactgagagtgagaccctggctctttaaaaaaaaaaaaaaaaaaaaaaaagtatgacccaggcacggtggctcacgcctgtaatcctagcactttgggaggctgaggcgagcggatcacctgaggtcaggagtccgagacagcctggccaacatggtgaaatctcgtctctagtaaaaatacataaattagccgggcatggtggcgggcacctgtaatcccagctactcgggaggctgaggcaggagaatcgctggaatcagagaggcaaaggttgcagtgagccaagatcgcaccactgcattccagcctgggcgacagagcgagactccgtcaaaaaaaaaaaagtatgtaaagttcttggaatatgtgaatactcaacaaatatcactatcaatttctaaacatactgctaccaagcagatggaagtcccttttctaaggtgagcaagatgggtttcttgttgaggaggaagtttggaaagctcttcatatttattttaaggagcacttgggtagctatctcctacatttgattaaaaccggatgcaagcaagaaacttagtaaaggaaatcagatcagaaagaaaagattggcatgatgtaagtggaaaaactcagggaatacaagttttcttctaaggtcatatgtatgatttgaaagtcacaaaattttaatttgatgcttttcatctacaccacctaaatcttccatgaacctcttggttaaaaggctatattaagcacaatacttttaaaaaactagatcagagacatttttagctataaaaggctaactgaaaccattatttgagatccactgggaggcttaagagagttttgaagatagagtgagttaacagaacaaataatgtgtctgtcaagccaaggagcacaggcggctggccacctcccaggactgggggaagcctagctctagacactcctccctgccactgtccccatccattgaaccaggctcttgatgcaacaagggtcacaaatgaggctaaatcagagaac

SEQ ID NO: 103090 - DNA, 1027 bp, Homo sapiens
tcccagctactcaggaggcaggagaatggcttgaacccgggaggtggagcttgcagtgagccgagatcgcgccactgcactccagtctgggtgacagagcaagactccgactcaaaaaaaaaaaaaaagaatccatttgatgtgcacgcatctcttaagaagtgactgaaggctcgtgcctgtaatcccaacactttgggaagtcaaggcaggaggattgcttgagctcaagagttggagaccagcctcggcaacatagtgagaccctgtctctacaaaacattaaaaaattagccagatgtggtggtgcatgcctgtggtcccagctactcgggaggctggagcgggaggcttgagcctgggaggtggaggctacagtgggtggtgatcctgctactccaacctgggtgacagagcaagaccctgtctcaaaaaaaaagaagtgactgaattacataaagctggatctcttaccagccccctgcataccccaatccctctgtctttgcttaggttgggctttcttttatgaataatagaaaataagaaaattgcctgttttgggcaatccaggtgtgtttcagagatttggagttaaaaagtcaagtaaatattttggcaacccaacaaaggtaagaaaagaagcatgcacctaacgggcttctcgaattacaggcttgtccaaacactgccttcctcaagagacgctggtcagggacaaagcctgccctgctgtcaacagcaaggcccggctgagaagtgggcttgcttctcttgctggtcctggccctgagccagataggacgccatttgactttgattcagtctgacccaagagaaaatataccatcagcaagtggaggatctttcctccttaacagactttagtcatattgcttcttcttccttgctgaaaaaaagcccaggtagatttttctctcccgttaaattggaaccctgaagttaggaggcacagtatctcagatactgtcagataacaagagccaccttttcagtctctgtaact

SEQ ID NO: 103091 - DNA, 1029 bp, Homo sapiens
tcagacctttgtgtgtgttttgtgtttgaatcacggctgctctccctggttctcaggctgggaacccactgcgcctgtttccatggtcactgggaagctcttagcgccatgtgcttcaaagggaacctttcccctcccagcactcgctgctgcctgccccagccaggctcacaataagcggctcctccaagccaggcctctgaccctcacttgccaggaggaaaaccttgcctttgccaagcaaggctgtgcagcctcacagaaatattcctcagcagagcatgtggatgcacacacacttgtggcacatcagtcctcacgtgcctacttgtagatttttatgagatatagagcttatagattggtgagagagtgttaactttcctcacatccctctgtttaggaacctttctgaaattgaagaaaagagcaaagcctaagccccttgtaggaaaagagatgagcttgtttggggtaggaggaaaggaggaagaagacccatgtcttttgggtcagcagagaatggaattgaagaacttagctctgggcttcctctccctgcagctggggtggtgagggtggtacctgttcactcttccagggccaaggatgcctgagcagttgcccaccaggcttgaaatttggctttgcttatttgttgaataatgcaggggaatgaagcctctcacatctgactggagagagtcagtggtctagtgatcttggagggctgctacatgatgacactggaattaaaaggtgactgtcaggccaggcgaggtgggcggatcacctgaggtcgggagttcaagaccagcctgaccaacatggagaaaccccgtctctactaacaatacaaaattagctgggcgtggtggtgcatgcctataatctcagctatcgggaggctgaggcaggagaatcgcttgaaccctggaggcagaggttgcagtgagctgagattgcgccattgcactccagcctgggcaacaagagtgaaactctgtctcaaaaaaaaaaaaagactgt

SEQ ID NO: 103092 - DNA, 1383 bp, Homo sapiens
ctcggccgcccaaagtgctgggattacagacatgagccaccgcacccagcccctcttcttaaactgaaactccatacctattaaacccaggctcctcacttctgcctccccacagcccctggcaaccaccattccactttctgtctctaggaatttgaccactccaggtcttttgtgagtggagtcgtgtatttgtccttttgtgactggcttctttcacgtggcataatgccttcaaggttcgctcttgttgtagcatgtatcagaattttattcctttttatgatggaattatatatatcccattgtatctacataccacgttttggttattcattcatctatctatggacacttaggttgtttccaccttttgattactgtaaataatgctaccatatatattctgtatattgatcccttacctgatatacatgaaatagtctttctcatcctgtggcttgccttttcatcctattgatagtatcctttgatacacaaaagttttttctcatttttgtttgtttgtttgagacagagtctcactctgcacccaggctggagtgcaatgctaccatctcaactcactgcaacctccgcctcccaggttcaagcagttcttgtgcttcaacctcccaagtagctgggattacaggtgtccaccaccatgcccaactaatttttctatttttagtagagatgggtttcatcctgttggccaggctgatctccaactgctgacctcaagtgatccacccgcctcagcctcccagagtgctgggattacaggcatgagccaccatgcctggccaaaagttttgactcttaatgaagcccactttatccattttttctttcgtcacctgtgctttcggtgtctcttctctttttttgtgcttgctctttaattcatcttcatctaccttttttttgttttaaacacatagaaggttacacaaacatatcttcctactcagccttggtttataatttactgttgccctaagaatttcagaaaggaaaagaattcttgcttccctggctaggctcttggggtcttgatgtgcaagaagaaatgctgttgtgaatacaaagaatgatgaggaagtatacaaaaggtgccctaggctggctgcgggggtccagcaggctggctacattattctgtggtcaacctcttacaaatggggtgctcctgtccgtctccgtggccagctgccaccagccctatggtgtgaatggcaaggaagtggggactggcggctggccgaactccaggatgcagccttggctggcagagaaccaaaggcagagggggaaaaacactcttgagtatgagagaaataatgctagctccgaaacctataattcgcaagtttaaaa

SEQ ID NO: 103093 - DNA, 1901 bp, Homo sapiens
gtgatgatatggagtaaattgaataatactggatttttggcattgctgcttcattagcatgaggcactggatggggcaggcgtggaggcctggttaggctgggcgcaatgctctaacataagcaaccatgggcctcacagaatattggtggtagcctttcccaggatggtcttgcattgctaataatgctaaaaatgtctgtgttcagagaaaaacattatgaaagtcttaatagtctcaatattatcccctaaatagcttttccctggatttttttcatctgtcctggtcgtttctgtgtcattgctgtaaagtcacacagccaaagtcacacagccattccgagtattgcagtgacaacagcaaggatcccagccaaaatcttgtcctcaggaagagctgagacatgttactctaattatcactgatggttttattgctttggggtcatgtctcaccccttaccccctcacttagtggcatatttgatgttgttcagtcatctgaagtcactcatttatcccctgaatgtccccactggttcccccagtggcagcagtcccccggcctgcaggagttgtagtgcaggcttgggtgatgtgattcctgatgtaggtgagacccctgaaccaagagcagttcagcagctgcagctgctcagaagctaggcttacacaccatctccctgccgctccgtgtttgacagaaagcagagatgcttcagcctcctagctgcacttaaaggtagcctggatgcagtgagcttgactaagtatctcccttttgtagctcagtgtaaaatacagactctgtttttggaattcattcatatgtttattaagcactgcctgtatcccaggcagtgtgctagacgctgcagatacagtacttattaaagtagacaagttcactgcccccatggggctcctggtcagtagaggagacacagagacaactagcagcaagtaaacacaaagacaacaaacagggcaactgcagattgtgatgcagctgcaaggccaacaaactgggtgagtggggcttttctctgcataggctgcctcgagccaagagctcagagtcaaggttcctgaaagaagagagggaaagattcccacagcccactccccacatcagagcttgcctgcctccgctccgtcatctgttctttgacacatctgcaacctggggtgtgctctgatgcttcctgtcattctgtcactttctaacccatcaaacagcactttgctaccatataagtattagtatctgcctcctgtctgctaagaaataaaatgaaggcactcaagtcttacagaaagttagctcctttattttaggtatctcgttaaatattctctacttgattattatgtgacagttgcttttaaatcctctgaaagttgcataatatgctatgtgatacgaaaggatgtatatataaaacctttatttttctaataattgcctataacttaccagtttgaattgttttaacgcttattgtagcctaagaagtccaaagtttaattgaaatccagttttgttttttggctttgggttaatattcttccttccaggctgggcacggtggctcatgcctataatcccaacactttgggaggccaaggtgggcagatcacctgaggtcaggagttcaagaccagcctggccaacatggcgaaaccctgtctctactaaaaatacaaaaattacccaggcatggtggtgcacgcctgtagtcccagctactcaggaggctgaggtgggaggatcacttgaacctgggaggcagaggttccagtgagctgagactgcaccactgcactcccgcctgggtgacagagtgagattctgtttaaaaaaaaaaaaaaaaaaatccttccagacttctttccctc

SEQ ID NO: 103094 - DNA, 1054 bp, Homo sapiens
aacaaaaaaactgaaactggcttggctgatgaaagttgtatcttatactgtgaactgaataatgttgcaagagattaagtgatcattactaaatgatgcccctggtactagtgaaggttgttgtcatagttcatgcagacctgcacagtgtatcgacctcatgttcacatgaagatctagatacctgatcaacgaagtgtccactcagcccctgtcaggtgcattctgggaggtgaagtggtatgtgactgccttgaaggaaggtgaaagcctagagacagattgtaatggtttagaactttctctttagaaaatagtgaataaggaaacaaggctttgctggggcagggggtgggagctctggcaaataagaggttcttctagaacccacttcctttgttctactaagtaaagtcttgctaacgctgaataattatagtcaagaaagcctgaatgaggccatccttttacttgttcaataaaggttaatttaaggacccaatgggacttgagatagagcttgaatttagggatttttgcaaattacctgttaaagccatgaaaacagaagtgtatttgttccttaatatgtgcatgacctcttactatttaagagtgattactgattaaccagggagtttcaaaggagatgttttcatattcagatttaaagaagttgctccagctcagagaactggcttctgttggagtgagctatgaacagagtagggctgctctatctcagagcattgttcattcacctggagaaacttccttcctgtgtcaagcacctgtagcatgctaggggttgtgcctgcccagtggtgcactaaagccacctctgcaatgttttcatccaagaaacatgaagtaggaaggaaaagtaacacttgcctagaaaggaaagttgtctgctccctatattctctatgaaattgagacagctattctttgcccccacaaatggcctttaggacagaaccattgagtgtcaaagacaggcccagcctctggagtatacttgtctatttccatttccaaaggtgagatgttt

SEQ ID NO: 103095 - DNA, 1056 bp, Homo sapiens
tcacatagaggctacgctggtatagaaattgttctagaaaaattgggcaagattttgcagagaaaggaggcttttagatgtgtccttaagcattgaagcgctttgagaggtaatcaagggtccaggacagcagttgaggtaacatgaataacctatgcaacagctggaagatgtgcgtatgccttaacttttcagaaatgggggaactgtgtgggtggagcatctggtgcttggagggcagatagtgtgggaggggagggcggacgggcagaccggatccaaactggatccaaaggagagtcttgaacattataaggaattgagacttgaatctgagaaggatgagaagacagctcagggcatcatgtatggaatgaactggaaaaagattggagacagagaaactgctgcattacagggtagcagggatgcaaagggagagcccacttgaaaatgattctttatggagattggatgtggagagaggaaggggaaggggtagtgagagaagaggaggaagatttgggtttctagatttgtatgatggtgattcccttaacctgagacaagtaatgtaggtttgggagaaacttggtgactttgactttgatcaggactagagccctgactctgactttgaactggagccctttgaactctagccctgaaaagggtcagggctagagatgaaggttgagaagtcattagataggggagtgtgtattcaaaccaggagtccagaatgagcttgtccagaaaagagtatagactaggaagagagaaggggtacagcataggacttaaaggaaaacaagtaagtgagttgggaccatgtaagagtcagtgaagggaacccgaagacctcagagagaagaaaacagaaataggctgaggagcacaaagcaatgtaaacaggttggtagagtagcaatagtacagatgacaacacgggtgaggtagcatggccctgtgcattcatttagcacaggtgtatcagttagcttttgctgcataacaaactgcccttaaaacatagcaccctaaaaacaacagtca

SEQ ID NO: 103096 - DNA, 1053 bp, Homo sapiens
cgcatgatctaggctcacggcagcctcctgagtacctgggattacaggtgcaggccaacatgcccggctaattttttgtatttttagtagagacggggtttcaccatattggccaggctggtctcaaactccggaccgcaggtgatctgcctgcctcagcctcccaaagtgctgggattataggcatgagccaccgcgtccagcctctagttccatttctttaacctagtggattgcaagcccctcactgctttccagcccgaaaggggcattgatgggattgtgaacacaggacagaaagtagtattaatgattattgttacaccccggatgcgtggtagggatgcttgggagcacctttattctccagctagcattagctgtcgggctgaggaaggctagcttgatgactctgccacttttctccttccccctccatcatcagcaccattgtgatgactatttattgagtaccaggactggaacgcatttgggagaaataaaagcatagatttgacacagccttcattctgttagcctatggaaaggtgattatagcacttgttacttgaattagacccgaaaatatagcacattttagggtctaattcaatataggacactctgcgtttaacttatgttttacagcctaactcatgactgctatggccaatatcccttctccacacccccagaccccatcactaaaattccttctagtggcagaaccgtcaccacttatcacagataagtggatattagttgggcagttgacatacaagttctgtgacttggttagctcagttcagagtatgtttgagggcttacttcaagaaagcatgtgtttcattttttaaaaataggtcttaaacctgaaaatggtgtccttgagattctcatcgttctctatttttatcctgttatcgcagaagacccatctggaacttgcattccattgctgtctcctactcaaggcagaggctcctatgcaagaccctgggactcctgtggcatggaggccaaaggcctggacccaaaagtcaggaggacttc

SEQ ID NO: 103097 - DNA, 1029 bp, Homo sapiens
gtacacgacgggtgggagtggggaggaggagggctcctggcgcggggaggagccgcgggaggggggatgttggccgcagggcctcggagttctgagctgtgtttgtggcttcagcgctttgatctcctgccagggaaacctggaaggtcaggccgggctgcagccaagccctggagcgaggagccggcgggtggagctggcagcactgcgccacccaccctcacctcccaaccccccaagcagtgaagcccgcctggccgccctggcctctcgcccccgctcctgccgctgcccctgcccctgcccctctttacctcctgtgtgttggtctcctgtaggccgtagattaaggggctccaagtcttgaaagtaagctagccaaatgccctgcaagtttggcttagtaaaatcatgtatgttgtatatactttaaaagaaaccagatatttttttaaagctgtgtgcgtccctttcctccaccctcctcatccccaccctagtacaaattacccaagaaccacaggtgattccccctgctggttcgtgagtgttagggtctagtttgcctctcctcttctaccaccaccaccacccccgttcctggcaccaggattttctcaccggttacccgtgtgctcttggtgtgtgacctcatttcctatggaatgaaaagtttctgtcggaaaacagggcccttggtgaggcaggccttgggagcccccttgcccagcgagaatgtcctgtgtcatgcagtgactcatgcttcagagaacagcagctgaccagaatgttcaagagcctggtgcctgggtggtcactactaagtgaagaactcgaggaggaggaaaggaaaaagtgaggagtaaggatttaaaatccacttagtggcctccagagggagggggataacaggactcaaagagcctgggctctctggcctggggtaggacccgccaagagggacctgtgggcgtcaggcgtggccagtccctaggaccggctgggtgctctccatcgtgttaaccgccc

SEQ ID NO: 103098 - DNA, 1593 bp, Homo sapiens
ggaaactgaggctgaggctgaaagcaattgagtgacttgtccactgttggcagcatgccagtggcagaggcaggaatagctcccaggattcattcctgactcctagcctagcaatctggtgatgaaacagggtgtggtggacaatcggcagagactttcaatgcattgaatctccattcaaaaagaaagggtcccctgcaagacaaagacagattgtccagagtgccagaacttcttaaactgccaaggaacttgcagtatactgaagattttactgaagttgtttttggtactgtttggtgctaaatacaaggaattggtttgttgtaaaagctatagggtgagactgccctctagtgggccagtggagctattggtctagctgtgttctgggcaactttgctttctcacgccacatcaatgtagagcgattattcctacggaaaggaatttcaattttattctttctcaagcactgtggcccatagtaactctgttgatctctaagcactagccatcatttgcgcgtcttatagaaggctgggtttgccttctatacatacacacattagaagtgtcttacttccctaacaagattcaggctcctaaaagccaggacatgcatgtatgtatgtatgtatatattttgtggagacagggtcttgctctgtcactcaggctagaatgaagtggtgcaatcacaacccaacctctacctcttgggctcaatcaaacctcctacctcagcctcccgagtagctgagactacagttacgtcctgccacacccagctaatttttctgttattttttagataatggggtcttgctatgttacctagactggtctcgaactccagccatgctatatcttaagtcttgtttttccacagcttctgccttgctgtccccttagctggacatggaattagaaggttctttgggatggaaaggaatccttcccccacctcccccaaaaagaatcccgtcacttctcatttgttcctaaaacattctaatctcatccctctgatcagtagttccccaagtagttgaatcatctgaatcccccagaaagcatacacaactcagtttcctgggcctgactccagccctgctcaatcagtctctgtggtttgagccaggaaacctgctttacaaacttcccaagtggcttttgatgtgtagccaggtctggcagccaactgcttcaaaaccccatttacaattatttttcacagctcccaccaccgacagtgtctccagaggtcttcagcttgtgtcacttattaaaattaaccattttgagactcattcagaaatactcaatatattcttctaactgggtgacatgggaaggaaaaaggaaccgcatgagatggaccaaaggcacttgctttggttgccaatggctctgaaacaggaaatactgaaaccaatacctctgtactgactgggcaggttgttgatgtgtaggttgttttcagtatttgggctggataggaagacaaaagtttgttaagttatcaattatgtattttcccctattataagtcatctgacctcatgattaccatacaaggtaggtgaaatt

SEQ ID NO: 103099 - DNA, 1005 bp, Homo sapiens
acggggagcagagcctctattccccgcagacccccgcctacatccgcagctacccacccctccacctggaccacagcctggccgctcaccgctgcggcctggagcaccgggcctactccccagcccaccccttccgcaggcccaagttgagtggccgcagcttctccaaggcagcttgcttctcccagtatgagaccatgtaccagcactactacttccagggcctcagctacccggagcaggaggggcagtccccacctagcctcgcaccccggggcccggcccgtgcctttcctccgagcggcagtggcagcctgctcttccccaccgtggtgcacgtggccccgccctcccacctggagagcggcagcacgtccagcttcagctgctatcacggccaccgctcggtgtgcagtggctacctggccgactgcccaggcagcgacagcagcagcagcagcagctccggccagtgccactgttcctccagtgactctgtggtagactgcactgaggtcagcaaccagggcgtgtacgggagctgctccaccttccgcagctccctcagcagcgactatgaccccttcatctaccgcagccggagcccctgtcgtgccagtgaggcggggggctcgggcagctcgggccggggacctgccctgtgcttcgagggctccccgcctcccgaggagctcccggcggtgcacagtcatggtgctgggcggggcgagccttggccgggccctgcctctccctcgggggatcaggtgtccacctgcagcctggagatgaactacagcagcaactcctccctggagcacagggggcccaatagctctacctcagaagtggggctcgaggcttctcctggggccgcccctgacctcaggaggacctggaaggggggccacgagttgccgtcgtgtgcctgctgctgcgagccccagccctccccagccgggcctagcgccggagcagctggcagcagcaccttgttcctggggc

SEQ ID NO: 103100 - DNA, 1051 bp, Homo sapiens
gaagagaagcaggtggcccgcgggggcggagggggcagcggctgctacactgaggactactcggtgagtgtgcagtacacgctcaccgaggaaccaccgcccggctgctaccccggggcccgggacctgagccagcgcatccccatcattccagaggatgtggactgtgatctgggcctgccctcggactgccaagggacccacagcctcggctcctggggtgggacgcgaggcccggataccccacggccccacaggggcctgggagcaacccgggaagaggagcgggctctgtgctgccaggctagggccctactgcggcctggctgccctccggaggaggcgggtgctgtcagggccaacttccctagtgccctccaggacactcaggagtccagcaccactgccactgaggctgcaggtgagagcaggaaatggcagtaggtcagagcaggagtttccatcagggtcgtcttgtcttctgtcttaggcattttctgaatgacttcttttgtgtccttggttttaaacaccatctgaggctgaagacttccaagggttactcctcagcctggccctcccttggagttcagacccattgagccctctgcttccatgatctcgggatctctccccaagatgcctgcagcctgtcatgtccacagcagtactcatttccccctctgccctgctccccatccgcatgctcacaccaaaaacctagcaccagctgggggtagtggctcatgcctctaatcttggctcacccaaccactttgggaggccgaggctgtggatcacttgaggccaggagttggagacagcctggccaacatggcaaaaccatggagtcggttcatgactcctcatggctgggatattatgtaggagccacttcataaacattctcgttactcagtacaaaagttagccaggggtggtggcgggtgcctgtagtcccagctactcaggatgctgaggcaggaaaatcacttgaacctggttggcagaggttgcagtgagccaagatcaagctactgcactccagcct

SEQ ID NO: 103101 - DNA, 1915 bp, Homo sapiens
gcccccagacctgtccgctacttttctcctccagatcttaggttaggtaacactccagccccctctgagatcacctacacaccttctgttcacttctgtcatcctattgctaaattactttgtctcaaggttcgtaatctctgtgagggagtcctctctgctgcttttcccaaggcctgacgcacaccgggcacccagttaacatctttaatatattgggctttcgtgctacctgagggcttctagaaagctctctacatccaagtgagaggctggctctccaggaggtacctgtgctctcagcacaaatggagcccctctgggaacaggaacctgcttcagccctttagcatacacaggcctgccacatgctggggacagggccacctgagtcccttgcctggtcccatgtgtggtgccagctccctcccctgatgattgttctctctctttcccaggaccgagatctcactcagcagacagcagcagcccgggagcctgagctcaggaggaactcttacctggaaattgggaactgtatggagactccaaactgacttctttcaaaaaacaaaaacaaaaaatttttttagctttgacaaacacacaaaagtggtaataaagagagccctccttgtcaacccaaaatgtgagccccctgtggcaaaaccaccccctaccccattaacaaatcaacagacaaaattctccgagtcctttgcctcttttgataacatgttgttctgttttgtaaagtgtgtgtgcttggggttccgaggtgtgggattgagttctctgctttgtttttttttaagatattgtatgtaaatgtaaaaagttatttaaatatatattttaaagaaccctaactgccaacttttgctgaaaaagaaaaaaaaatcactgctgcattaaatgaaccacatcatgtgtagatactgttgtctccctgaagggagctcaggcctttgaaaagctcagggcttcacctgccttagaaaatgaaccagaaacttgaagtaaagctagttgataggggtacaggctctgaggagcagtgcaaaactgcctctttctttctcgtggcaaatcccaatgtacacgatttcaggtctcagacgccatgcctctccagcccacgcctttaggcaggtgatggcagcagctaggaatagggtgtacatgatccacagccctgcggagccaggtcaagccgctgctatgaaagctccagggtgatggggacgattctgcccagtgtcctcagtctgtcccctcaggtcatggtcccaagtgaaatgacagagttcacagccctggtcttggctgaggtccaggtcatagtaagggcatgttcttggggccctcgacctgaactctgaccctccgggcagggaagaggaggttgtcccctttggttgtcctggctttggagtcctttgcaaaaatattttgggccccctgccactggctgcagaaatggctcgacggggtgtgtggggacagacacccagaaggaatgtacttttgtggccttggtgtccgatggggctgggggagagtgctctccactgacccagcagcacacccatgtgcagtgcgcctgcatctgtgtgggggcagccacaccccttggctgctgcttccttgggctgcctttctgggggcatgtgactggacctacgaggtctgcactgagctccatttgaatgatacctttcctatcccatttcccccacggaagcaccgcttcagggttattcagtcctctgcctcatggctgaaattgctcatctcgtctgcagatgtctactatcctgtctacctaatgcactattatgtattgattctccatgagacagagagagagagagactatcagatagtttacacccaaagggtaggtttttgtata

SEQ ID NO: 103102 - DNA, 1691 bp, Homo sapiens
ggtgagatccgttctccgtcctcgggtgcagtcccttgggggctgctcctcggactgcgccccgcacacctgttatcgagggtgtgagaagcgcctaagctggtgacatgtgatctgggacgccttcatttctcgggccaggagtagcagctgctaaggacagcagcttgcattgcgtggttttagggaagcagggtctggcttttaatatgaactgcaaaaagcagcttctcactgatatttttttgttgttgtttctggggggtttttttgttttgtttttaatgcctttgagtgcatattttcttcctcgtctgaaaccgaactcccaaagtggctttctttagccctggctggaaaaccacctctcaatagccttaagcaataaatagatgagtagagaatgtggcttcaactgggcttattaaagtaagtgtgtctagttttcacttgaacaagtgatagctgcagatggcgaaagaaacccatttaatttttgtagcttacaggtggtagaaacaaaaatgcaattttaaaaccttaaataccaaataccaaccattgccttttttttttttgagatggaattttgctcttgtcacccaggctggagtgcaatggcgcgatctcacctcactgcaacctctgcctcccgggtccaagtgattctcctgcctcagcctcccaagtagctgggattacaggcatgcgccaccacacccagctaattttgtatttttggtagagacagggtatctccatgttggtcaggctggtcttggattcccgacctcaggtgatccgcccacctcggcctcccaaagtgctgggattacaggcgtgagccaccatgcctgcccagcaataccaaccattgtcttttaaattcgtgttggcttctcagacagggagatcactggaataaaataaccgatggtcttattttgtcacacgtaaatcaaaagaaatgtcctctttgaagttgtaagactccaccaatgacagacacccttttcggtggactctgagtggtgtgtagtggttttatagccatggaaactaggagtatctcactttccactgagaacccctgcccccaatccctctaagttggggtgtggcagttgggcagggtcaagtgacccagccctggctgtaggacagccatatacagtgaagagttctagaaccagctaaaaatggaagtttgggtgtttaccaacaaggtacctctttatggatgcagccccagtaagctggctttaactctcagctccttccctgtctcctcctaatccaagcccttttataaaataaagccccttctgtcccactgctcacatacttatgtgctgctagtctctactcgaagttcgtgcaggactaatgcttttaaaatgaggtctaaaaaataattactagtcgagactattattctttaaacagaactgcctttttctactctttatgtaaactctttctattgtgttggtctaacaaggcactattttaaaattttttaatttttcccatagcacttaaaagagattttgtaaagaccttgctgtaaagattttgtaataaaatggtctaagggctctttttccaacattaccatttttaaaaaatgttttaaaagctagaagacaacttatgtatattctgtatatgtatagcagcacatttcattt

SEQ ID NO: 103103 - DNA, 1080 bp, Homo sapiens
atgtgtgacccaaatctccctctgcttctgagcaaaggaagctgcctacattgttgtgcctccggccagcccaggataaccttgctctgggaacagctgtatccatcagatgtgtgccatttacttccttttagtcgactaaggtgtttctttgcttttcacctcccgtctgactctagcaggggatcttaacctgacatctatggtgcttcaaaagtgattcacaatttcctggggatgatccatagctttgatcagcttctcaaagttatctgtgattgaaaacaagttcaggatcactggtatgtagggtccagaacaaagactgtaagcacttttggttatacatttgtgctgcttatgcccaagatcctggtaatgagacttatggttcagcaatgcattgaatttaattattattagtacaggtgcaaaggcagcctcttgagctactgggacagggaaaaatgattgttgaactatataccctgtccctggttctacatacattggaatctcaaccatggcactgttgacgcagctgagccaacatatattttcctgtattgtatgggccacactgtttaccttctgccctctacatacctttgctaacgctctagggcccttgtagttgtctcaaagtcaccaggcctttagtctatgttttctttatccctatacctttctctatcttgtatcaactgaccattccctcctagttgctattgacttattttgtttgttataaaagtgttaaaagcttattcttaaaaaaaaaaacttctccaacaccacaaatatatgtggtttaaatagttaaaattccccattttacctattttccctgaaaccctccccaccaagtcccaagtcccagagacaaccaatttgggtatttgccacttcacattttgctatctgttgtattttattgttcaagttacacatgcttattaaatagttcttttatattttattttccaagttatacatgttaatttattttttgcataaattaaaaaattagtcccaccccattttttattaccttcccctaggttttctattcataggaat

SEQ ID NO: 103104 - DNA, 1002 bp, Homo sapiens
atgacacagtggactttgaggactcagggggaaaaggtgggaacggggtgagggataaaagactacaaattgagtgcagtgtatactgctcaggtgatgggtgcaccaaaatctcacaaatcaaactaaagaacttactcatgtaaccaaacaccacctgttccccaagaacctatggaaataaaaaaaaaaaaaaccagaagtaccattatccactcattccatgatttcagtgggtgacacaggaagtgcttgttcattcagcatatagtcctagagcacctgctttgtgaccgggaccactccaggccctgggaatacaggggtgtgtggaagatatagtcctgccctttagttgctcatagttaatcaggtagagagacaagtaaacaggtgttcagaatcaaactcagcatagactgctgtaggactacacagcagggacacataaccctctttcttgtgggggatagggtggggaggatgggagggccatggggcttcccaggggaaatgatgttcaggctgaaatcttaagaagggaataatattctaagcacagggaatagcatgtgcaaaaacccggaggccagagagcaaagtccagttgggaaacttgcaaatacactacaatttggtctctgtatagaatgtgagctgaagggtagacaggtcatggtggtgggagaggggaagggggagcagcacaggagcagcagcagtgtaccatgtgagaaagtttggactttatcctggggggcaaccagagagctttgagggtttggggaagggctccatttacctcaccagctgctgctgcttttccctttctctgctaccagtcacgctcacttcttgtagttcctgccaaggccacaatctttcttgcttcaggcctttgcacttctgtctggaatgtactgcaaagattattctggttgcagtttgctaactagattagagtagggtaagcctagaaatggagatagaataggaggctga

SEQ ID NO: 103105 - DNA, 1085 bp, Homo sapiens
taatccctattccaaggggaagaccttgtgaagaaggtactgtgctggtgtccccaatccccagggaagcccctggaccaagctgctgggtgtggggcccatgtctgggcctgagcccctcagtcccggaacaggaatgaacaatagctgttagcgctgtgctaagggatttgagtgaagcttcccccgctggaggaaattctgctgtccccatttgcagatggacaaaatgaggtccagagagggtcagggccttgtccaaggtcaccgatgtaggaagcagcagagccaggactggaacttcgcccctactgcggggctctggctctcatcataccacccctgcccgcccggtcctttctttcttctccttttcatcacagcccttggccccgggcccgcttggctgcctcctgcaattagcccctatcactgttccggatcgcagccctgggccctacagagacaaagtcccctgggcccctcgtggcagggggtggagtgtgggtgtaggtggggggcctttgtgggagtggccggtgccaggctgagctggtctggcctgtttctcccctcctggaggcctctgggggcctggaggtgctgagtgggcagaagtgttgggcccaggagggaagtgccgcctcttcccagcccctgccctcaccaaccccactgcccagcctcatccagctcttgggcagcttatcaatgaccacaccccagggaaggaagcccccaggggctgcagggatggagcacatggggatgggtcccttcatctgtggaaacctcgggtcccagctcctctggccggagctgctgcctgttctccatcattcagtcattcaacaaacatcgctgagcgtcctcaggctgagccctacacaaacttggtcccagctcatgccctcctccagcacctgcgtgagtgagtaaagcccagggctattgtgagtggctaatgggtggtgcccaacccctgcctgggcctgagggctgagacccaaaggatgaataagagttggctggagcaagagggaggggctttccaggcagagggatcttcatatgctaagatcaga

SEQ ID NO: 103106 - DNA, 1199 bp, Homo sapiens
aaagtgttgcgattacaggcttgagccactgcgcccggccaacaattttttttaagagacaaagtgtcactctattgcccaggctgtagtgcagtggcgtgaatatagctcattacagcctcaaactcctgagctgaaacgatcctcatctcagcctcccaagtagctgtgactacaggcaagcaccaatggtagagattttaattaaggaagaagaaggaaaaatactgttttttttctctagctcctccctggtaaaaagaaggacagctctggccattgtggaccatcacaggcccacctctcccggcctagtctgggggctgggcatgtgagggctgttgtccacgtgtgtgtgtgtgagggcagatggctctgtgcgtgcctgtatagatatgtgtgagaagatggccaacagtaccctgctgggcctgccttcacctgtttgtgtacatgtgagaagtgtgtgtgtgtgtacacatgtgcctgcatgtgcatggatgtacatgaatgagagcactgtggggccgtgtgtggacatgcccagagatcacagcttcagcctatatgcgtccatgcgagagggcatgcgtgtgtgtgtgcatgtgcaggtgtgtcagtgtgtgtgcaagtgtgaacgcatttgcagggagaaggtttgactgtgactgtgtgcccctctgggcctgctttggtctgtctatgtccatgtgacagagccgatgagtgtgtgtatgtgaatgtgtgagggcacagagtcctgtatctgcaggtatggacttgtgtgcagggaggacggtcatttctgtgattaagtgtcctgctggatttgccttagcctgtctgtgtgcgtttgtgtgcatgtatggagctctgtgtttatgtggatctgtgtgtgcacacggaggcccgtgtgtccatgcgttgtgtgtacatatgcctatgtgtgtgtgcacgtgctcactgcagtgcgtatttgccctgtgtgcctgtgtgtgcatgtgtgtgcgtgtatctgtgtgtttgtgtggatctgtgtgcatatgcatgaacatgtgtgtccatgcattgtgtgtacatatgcctgtgtgtgtctgtgtgtacgtgctcactgccatgcatatttgctcctgtgtgcctgtgtgtgcatgtgtgtgcgtgcatttgcgtgtgcaggcactgtgtgtttgcgagcatct

SEQ ID NO: 103107 - DNA, 1025 bp, Homo sapiens
taccccccagaccaagtcggtgcttgggggcttcccgggcccaccggccccaagggagatgccggcagtcggggcccaatggggatgagaggcccaccaggtgagtgcccgcaatgctgccccacagctcctctggccatcccctccaccaggtgggcccttccctgctcctgacatggccaggatgacctgggccctttcatctacttgcctcttcactcagcaccccaccacggagtgccctgcccacgcctgggctccatgaagtcctctcttatgttcactgacccacattccctgggcacctacacttatcaggctctgagctgggcactgggtggggtcagacatgtccctgcccttctggagcttccatgctgctgggagcagggctgggcagaggagaagcagcaatgcttgccccatgtgaccagggtttctatgaggggttttgggggtttgggagccccaaggaaggaagactcagcctggacgaggtggagaactaggtgctgtgctcatccccctgttagactaccaggcagcctaggcctgtggactccggggccctctctcatgcccactgctccaggctgccttgtcctgtcgctcaaggccaccctgggcctccttgcctcctgtatacccacaaatccgtgtgattccattgcaggtccacagggccccccagggagccctggccgggctggagctgtgggcacccctggagagaggggacctcctgggccaccagggcctcctggcccccctgggcccccagcccctgttgggccaccccatgcccggatctcccagcatggtgagtccccctgggatcccagcaggtggaggtgggggtggagtagccatcagcacagtgcccgctaccatctgccacgtgccttctgtgtgccagccctgctcacgataggccacatgtgacccagtcctccagcaggcgccgttgtcctcctgtggttacaggtgaggaacactgaggaccagagagggaaggtggcttgcca

SEQ ID NO: 103108 - DNA, 1053 bp, Homo sapiens
gggaacctggccctaagggagaccctggtgagaagagccactgggtaagctctggcctggcactggcctctccctgccttctcagccctacatgctcaagagagtattccctccccaggaggccctgggagtgggagcatcccatccacatccccactacagcctggtctcccaggcaggagccttggcaattatcagccccaactccttcccccatcttgttgctcccaaccgggcagggccagccctatcagcagaccccatgccttctgtctcagtctctgtccctgtctccaccttccctctgtggcctttccaggccagggtggctctgccttttcctcctgggtggtttgggctgacccaggccagactgcatcccctgcctccatagccccctcccagccaaggcttagcttgctcccttgtctgcagaacaaagggaagaatgaagacaatatctacacaggagaatgggatagaggacctaggaaaggggcctagaaatgatgaggtacataggagccacgtggtaaaaaggacagggaactagataccaccatacacatcggaaattcatgaagcctgtgaagagacgcctcgaaactgctatgtacacgtttgatgtggttaatgaggccaggtgacctagactcctctatacttaaaggacctatagtttacacaaggtcctagacaccatcacatacataggagacccatgatggatgagaagggaagcctagaaactctcacatatacaggagacagagtaaatgagaaggggacaagaagggggaactagaaaccacacaccgcaaaatctcatgattaatgtggggtcctagaaaccttcacaatcgtccgggatgccgtggctcctacctgtaatcccagcactcttggaggccgaggcgggtagataacttgaggtcaggagtttgagaccagcctggccaacatggcaaaacccccatctctaaaatacaaaaaaatacaaaaatacaaaattagccttaaaggtttgggctaaaaatacaaaaattagctgga

SEQ ID NO: 103109 - DNA, 1697 bp, Homo sapiens
tgaggcatacctggctctgtttggctgagtagcttcaggcagatcccttttcctttctgagcctctgctgctgaccagggtgacgctattccatgctggtccacagtgaggagacgggagggaatggtggccagcacacttggcatggggcctggcctgtggcgtgggcccacccctggctgcttttggttttccttgaccggccgccctgccccgggcagacagatgcagctggggccttccggtggctggaaccctcagagcgacggctgcaggtgctgcaggagggcgtcttgtgcaggaccttggcggggtgctggcccctgaggctccttgccaccccgggtagcctggcggagctgcctgtcacccatcctgccggagtgaggtgagggtgatgggggggatgccagtccaggtggtgggcactgtggcagggctgccagtcaggccctcttctcttcccactcctccaggcctcccatccctggaccgccttatgtggcctcccctgacctctggtcccactgggaagactcagccctgcccccaccaagcctgaggcctgtgcagcccacctgggagggctcctcagaggcaggcctggactgggctggggccagcttctccccagggactccgatgtgggcggccttggatgagcagatgctgcaggagggcatccaggcctcgcttcttgacgggccagcccaggaaccccagagcgcaccatggctgtccaagtcctctgtctcctctctgcggtaaggtggggtgggcagaggtggggtcccctggtataggggccggggtggccctgacactccccacttctccccccacccccaacaggctgcagcagctggagcgcatgggcttccctacggagcaggcggtggtggcactggcagccacaggccgtgtggagggtgccgtgtcactgttggttggaggacaagtgggcactgagaccctggtgacccatggaaagggtgggcctgcccactccgagggtcctgggcctccctagcccaggcagagagtggggcacaggcaggcccttgggtgctaagggctgggctgcatgtgggtagcccgagctcctactctgtctaaagagggccacagtggggagcaggggcacctctggaggcaggagaggccccccagcatgctgccctagtacgtgtttagaataaaaaccagtttgtttttcaacctggacctccttggaggcagcagttgtgtttgactcttctgtgttggcatcagggggatgaatgaatgagtgagcaccaaatgaatgaccagttgtgggagagctgttccctgatgtccagagacacaggcttcctggccctgcaccttgcagcctatacctccaggaggctctgtcctccagcacagagcattctccaccgcccatttctagccctctccgtcgtagcctcattcccagctgcccccatctaagcacacactgagaccaagctgcggggaatcaggtaggggcctttattggccagcacacatctacctcctggcatctgtcacaagcatttgcaggagtaggcggccccttcctctccatgtccccatccccaacctgagatgcgggagggcctgggggctcagagggaagaactgaggcaagaagcccccggtgatccagtcagaggattgggcagcctgacctc

SEQ ID NO: 103110 - DNA, 1016 bp, Homo sapiens
tctcagccaggtatgatttagtaaatacagaagcagagtaccttcatggtgtctgggacatagtgagtgctctgtagcgggttgtcagtgaaaagactgagtggcacgtccagtgtattctgtttaataccacagaggcgtagccacagtgtttggaagtccttggtcccttccaccaatgattaagtgctggctgtgggaagactggctcctggggaggggaggtgggctcagcaggtggccctggtgtagcgtaaccttcaacctggcacacctgggacagccttggatgttggggccactaacctggcacataagccccttctctctcccagtgcaccggctgctgacccatgccctgggccacacggccctgccaggcctgctcctgagcctgctgctcctgcccactgtgggctggcagcaggagtgccacctgggcacgctgagattcctgcatgcctcagccctgctcgccctggcttctgggctgctggcagtgctgctggcaggccttgggctgtccagtgcagccggcagctgtggatacatgcctgtccacctggccatgctggctggggagggacaccgccctagacggccccgtggggcactgccaccgtggctgtcgccgtggctgctgcttgccctgaccccactgctcagctctgagccacccttcctgcagctcctttgcggcctccttgccggcctggcctgtatcctttgcctgagcccagggcccgtggggatgtgtgggttctgtgggtgggtgcctgggaaggaagtggcacaaaggggtgaaggcccaagcaataccaaggagccgtgcacacacattccaggagcttctctgagtcttcctctgggacatgctctgggctgggacctggggtcttatggcctggtggaggtgccaattacaatgtaaagggctacgtgggctccctgtaatatcaatgccattcttcgcagaaatagaaacaataaccctaaaatttatatggaaccacaaa

SEQ ID NO: 103111 - DNA, 1039 bp, Homo sapiens
tattgaggccttctcgatgggccagttggtggctacagacgcctgccatgattagtgcggattgctatggtttatggaggaagagttgtgggccagggcctgccttagcctattcctttttatttcatcatactctgaggaaaagaatttatgaatttccattttacagatgagaaaggagaggctcatctgtaaaatgaggctcatctgtaaaaagatgaggttggaaacttgcctcaggacacagagcagaaagaggtggagcgcatactgtacccttcctgtggaaaggggagccagggccagaggggctgtgccagtaaggaagcaggaggaggcttacagtggatgggttcaccctcaaaggggatgtctcagtcgcaggtctctgagtatggctcaagatgtgggacttctgcccatctgccctaccccttaccctgtcggcttgcccattgtctggccccaccccagggtcaagggcaactgaaaccatctggagcattaaggctgggaacaggggaggggaggaaggagggaggtagtagtctgagggaagggggaggacagaagagggctagagatggccctgaattcgccctggggggtgagggcctgaacccctctttttgggagttcagggcctatcaggactcagaagtctctatgcctgtcccctgccagtccttaaacagaggtgagtggaatggtaagatggcttatgagcgcatgggttagggtctgagctccactaaggccaagctgctgggcctgcgtctccagcctgtttccacctctgtaaaatagggctgttgataaggtgcttgagagggtattggtgagataaaagctccagtaataacttgttattgttttcttttatccccagcacacagccccaggaccacccttgaccgtcctcaaccaagcgatgcatgccaggggcccccatggccaactgtccccagcactgcctctggcctcctcagtcctgatgctgctgatgagcaccctgtggctggtgggggccggccccggc

SEQ ID NO: 103112 - DNA, 3656 bp, Homo sapiens
tcaggactctagctcccgggcgcgacccgagaaccctgaatccattccgcgcacacccggccgcgtgacccctgccgaccggctggcgcgccacccattccccgcggcccgcggattagtcagcagttgttctagtccgggtcccttcccccagccctcccgccgatctccgtctccctgcagggccgactcttcagcgaccgtccctagagccagcggacggaaccattccaaacagcctagtctcgtgctgagagcctctccggtttcacgctgagacccgctcacccccgctctggccccttagatgctattttggcccgagtgtcacgtcgggcgctctttagagaggactgggacaagagttgcggacgcgaagaacgagtaagcggtggttcatccctcctgaccccacccccgtggcctggcccgatggtcgcgcccggggttgcgagatttgcgcctgcgcagtgcggcgcctagagggaaagcgagagggagacggacgttgagagaacgaggaggaaggagagaaaatggcgtccacgggtgagtatggtggaactgcggtcgcgccggcggtagccggaacgcccaaactgggggtcgttcgtctctgggcttggctgggaagactgagtggagttgccgagagggggttgaggcacccgccgcggcccgacgagctcggggatccgcattcctctcccctcccccaaccgggcgggccggttctggaatcttccggcgcccgtggcgcgcggggggcttgctgcggcgggggcgcgcggggcccgccttggcctccattgtgtggcggtcctcgcgccctgagctccgggcctcccgccacgtgggcggggcctgcggccttcgaggccctgcgtgaaggggaggatttggccaggcctcaagccggtcactatgaaaccgccggggggcccgcaggctgctgtccctgtgaggcctccctccccgttttcagggtttcctgagaaaccaggggaaaaagcaaataaagataccgtggatttgtgggccgaggggtgccggcctatgagcgggagccccgtcatccttaagacccagtcggctggggcgtctggcgctgccgagctgccccctctgtggcttccagccccaagccgaacttctgctcgcctgggctttagacagaatgtgcttccctcctccagggcccccagtttgccgctttcttgggcttctccatttttatcgttattaatccacgtcctcccctcccccaaaaccaattaagtggcttcccagggccctttttctgcaaacgccgagggacatccgttgtataataaggccagcctgggtcgagagacgagaaacgctaccagaaagatatttctggtctctctgacctaggaggaacaaaaggccgagccttcatttgaattatgtttcagcagtggcctcgcacgtttattcgcctgcgttaggccggcaggcctgttgatttcgtaggtcgacagaggagaggggaaaaaaggccagtagaagcaatcttaaaggcacttgcaagcaagccccggttgggaactccaaaatgggagtagagtggtccttgatggaaggagcgtttaagagtgtcgcctagccatcacctgcagttcgcaatctgtgggtacactaacccgcgaaaattggcagggtggagcatttttgccccgggggtattctcaggccacctggttccaggccttagagacagtgggagaagatgagaaggaagacaggaaaagttctgggcactccagagtttttggagtccagaatccagcaacttaaggacagtttaagaattctccccatctgtggtcaataaacaggtaagtgttggctgttcgtgccgggataccaaagagtggataccaaagagtgccggtagaagagaggactgaaataccacagctaacctcccggtgggaagtggtttcctaggtgccctatccaccctcttctgctctgcaaaagcctgaaaaggcaaaacgtgtgcgttgacatttttgcgtggctggacgtgccttttttcagtcaactttgttcaaaccttgttcaccagtaactaccatgtgctgtactgtattagaattacagttgtggtttctgttgacacaaagtaaacacattaggcctggctgggggggccttcagagagtcacataagtaatctggtccttagtttcctttcctgtaaaatacagaagttaggctagacctcttaagcttttgagcccttctgaccttccagcataagcattccacaaatttgtcctatgctgacttcagctcaggtactgtgaagctcaactcaggtagtgtgaagcagcttccatagtgactgctctaaagtgttaaaccgttgccttgggttaataatagaagttttctctcctcgtatgttatctcatgtagaaaagtacgtaaagcatatatatccagtgcaacaaagaattggaatgcagactcgcagcaatctagaacccccagcgctcaatcacagtgaagtgatttttagtgaagtcagtggctcacttttgggggttaaaaacgaacacggttgctgaataatctgaccagtttgtaattgtattaggttggtgcaaaagtaattacgtttgcatcaacctaatagcttgcttgagggcctgtgatgtttgtgtgctctaggaagataaatgtaagttcatgaaacaaatttgctaccttctatagcccaccagttagtatagggccgaatcctgtggtttctcactgataagaggtcattggttgttccatatcagctttgccagtttgatgttttacataactgctcttgcgtaaaagtcgtcttgcaaacgttgaacttacatgacagtgatttacaatcacttctcaagcaaagacctcaacaaaacgtgggttaaaatatttgatgttaaatgattcattgctgtgtttattttgtagatgccacatggaaaaaatgatctgcatttagttttaatgtcagagagagtatgacttgtagtgctattgaaaatgcctttaagattgtcatgaacagattatttttttcattataggttagcctttgggcagttgatttgttcctcttggtgattcagggttttgagttaagagtgtgtacaaaggaaagaaagtagtccagtaaagtacagagaggtaggcagataagccaacgtgaagagatggattcagcaaagctctctcaggccgccgagggattgtgaggctggctttggattccatgaagtggatgccatgaagagctgtcaattgttggttttggatgagggactactttctgattggaaaataaaggaccccttttttccgtcctaatggcagtactgtcttcagacagaacaagatatgtgttcttgtggagaagaaagaattgggcagaattttcaaaaataattactttaactgcctttaaaaaaaaactaaatttatctaactttaatgcagtagcgctctgaaaactattttccgtttgtttttactacttgtagacacctcagtggaccagtttttggtccctttggatgcatgttataaatttcataggaaaaggaaaattatagggaggtttacttagataagggatgaaaatt

SEQ ID NO: 103113 - DNA, 4166 bp, Homo sapiens
ttttgaatatggagccttctataattgtagaggtggtatttgaatgttctctattcaagttattgcatttaattcttttgcagctacagtgcttacaccgcccagcccactcaaggatatgcacagaccacccaggtaatctttaaaataattacatgtagctgcacctccaagtaaaatcagtatattatccagttatctttcagttatccagtaaaacaaatgagtaatgtgtttggaatagtaaaatacccaggcattttaaactttcacagtgggagtgcgaaggactccattgtgccatcataaatgaaaccattcagaagctgataattgactctttataactttttaatatgatttctcaagttaggtgccctgttccatgcttggtccttcttcattatgtttaaatttagtgaatttattcatcatagcaattctgcaaaggaagaggatgatatgaccattctgcagaggagaacattgcagtgcatagatattaagtaacttgccagtggttgcacagtaagtggcggggttagctctaaaaactggcgacctagccaaggagctgctgagctctttccagtgaagagtctgttgaaaagcctaggccaacagattctagaaattagccttctagtgttttcaagataatgttgaattctgaaatgatccatgccataaaatggatactaataactgccatggaaacatgttctaggacaagcagaatgtgatgtctctggcagatcttacataactggtcatttaaacaaacctagagaataatcatgctaatatctgaaagaacaactcttccttgcctgattttaagtattatggatgtctaagttcaaaagacagtactcttgatgtgcccaccataagaggacatacagcgttctggttcattttctttgaagtggtatagtagttttaaagtctttttgtcaggctgaaaatctggttttcaattttttctgacagattttagccctcttcattgctttctctgttcatttgtcttcgtaccttttgtttccaatcactaaaactgtgctacgctaagtgctagcagttaatacacctgtgcccttattgctcttcccttgagagtgtcttgttaatctcatgtatagttaactgaggttttgcctgattatcttttttttcccccttttgagaagctgtgaatgacattgcctacttacctaatgagctttttccgtagctaactttaccataatatgagtgaaccagataagggataacattcatgatactgtgattatttgtcttgttttgttgtttttgttttgtttttttaatcttctagaaaggaatgtttttgattttggttctccaatttagtccattttattgctaaaatacaaaagttcatgtatgaagttcttgcattcgtttttttttggagcaggcatatgggcaacaaagctatggaacctatggacagcccactgatgtcagctatacccaggctcagaccactgcaacctatgggcagaccgcctatgcaacttcttatggacagcctcccactggtaaggcctgccttggagagatttttgggtcgttctggctagggcattggctaagaagcttattagtcatgctttcggatgtatattctggtccataccttggcatctggggaatcctttattcttaggaagaggtattttttctctttcttccctactcttatagtcttgagagatctccaatagaatgtgggtgggataaattccaagagagaaaagaacttttaactgtttgaataatctcacgatgaaatggagactatgtaaaagattttgctaatgctaatactgagtaagaatgagtcttcttaaattgagctgcttaaaaatcaaactggttttcacatgtttgcttcatctgatagtgtaccctctactttttgttttgtgctttccacagtagaagggaccagtacaggtttgactatcctgctcattcttgcatgggaaatgctttccatcttgtctaaccctgtaatgttaatcctttaggtgttttcatttgttgaacccccaaactttctaacatcacacacagcaaggtgctaatgaaaaactgcttcaggtgccatttgcagatccatgtcctattctttatatgattttgggaaaggtttttttatttaatattactttgtttcaagccttaataatagttatttaccttcccaaaggtatttcaggtgatttctccccagctgattttcccctgttccctgaaggatagattgcatgatgagatttatttagaggagcagactgccaccctgcatgtatcatgtttgtctattggttggtttctagtccagacacattttattttctgttttaagtgttatgaattattttaatccatggtatgtcttgaatatatataacattattccaagatactaaaaaataaactattctaagaattagaagaaattgtattccgatactgaggttgggtgggatacatgaaaaacctatgataatttttttgtgttcagtgctgtgtaatgtttcaggctgtctccccctgcccttttattattgctgttataaaagactctaataaagtcttaaagatatcagagctcttattttcaaactgtctttagttctccaaattatatatagtccagttaaggggaaaaacctgtctgtaatttatctcattgagtaccagtgtcctgattttgatgggaagtaattcctaacctcttctagggtgtttctcaaataggatgggaaatgtttatctaaactttctagtggtgttaattgcagctgtgggaagagctggaactaaggttatgcagtttggattttttagcatagaattttgaaattgtgagataaacttcatgtattaaagccattacattttttaaaacaagcatgatgtgaaagttaatgtggcctagatctagccttccgaatccttagatcattttacaggaatgagacggagtgatttataggcaaattaatggttctctagagccatgtatcacattgtcgttggttgagaaatccccatcatgactgtgggcctaaaaagtacaggtcattctagtttagagactagtagctttgatgagctggagattgcacttagtaataataatgtttgtataaaattcacagtttatagagtggccttcttgtctcccttaatcctcccaagaacttttggggtataaaaacaccaaaattaagcctgatgagcaaactgtgtgaacaaaacttagcaggagcctaattggtagtgcgtgggttcaagcacacatgctgcatttttccttacctcatactgcctttacacatgaaagttatcggatagtcattggagggaatacatagaaatacactgttctcttctaggatttttaaaaattaaacttcagaagaaaggggttatataaacctcaattcaatggaattcttaaaaacttcttaatttttacgttgaacaaaagttttggtttgtgtaatatttcttaccacctttttccttcaagttgtcagcacatagtaggtgtgttttctttttttgccactggtcttttgtttttttgtttttttgttttttttttggtcattaaatcattttgctctgttgatttttgttcattttgcttggctgcttttgtgggtactacagattaattaaaaggttatttattaacccagtgtctattgctgtaatctttagcatgacaaggccctaactgttgctgcatagttttatgacatgagttattgccctgatcacttttagttttttgtttttttaattgccctccttgtaaatcttatagacgtgtcatgtagtggggtgtaatcggtatatgaacggtagggtagatggtattagattctaatttaaataaatgaatgccttatgtggttgaccttaggactctgcaaaaacttaagcagttcagatgaacaacatgccaactcaaaaacttttattgcttggggcttcctgttttctggaactatgtatactttcatacacattttaactcagcagttttgacaaggacattactatctctgtgtataatttcagaatttccttttaatatttgaggtagagaagaaaga

SEQ ID NO: 103114 - DNA, 3522 bp, Homo sapiens
ttaattactacccaaattacaggttttagtgctagaactagtacctggatcattttctaattattttaaaatgctatgtcatttgccttttaccttttcttctgggatgttttattcctgcttgagggtattttggggtaagtttgtttacaaacttgttaagacgacctgctagcaaaatcagtacagacttggcaaaaacagacttgtctcctattcacagcattcaagagggggcagaaggaaccctgttttctgtagcatgacatgccatttctgttaggtgtggttttagagcaaatgagacagttactttaccaaaaactaggtacattcagagaacttaggctttaaataccagtttgttgctactcttgcggaagggggaatatttaaagggattcaatatcctgatggtttaaagtaagtggtttacaaattgttctgataatgagtgtctaggcagatctctgaggggacctgaaatctgatgcagctctcctttgttctaggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaaggtaaggccatggtgtccttaatgcgtcagtcttatgttggagggaaagaaagcaactgtgtacacttaaaataatctgtggtttagttccttattagtggttgctttcatatactctcagatgttcactgttagtaactgatgtgctagaacataccacagaaatattctgcatttaacagtgaaattggctgggcgcggtttctcatgcctgtaattctagctctttgggaggccgaggcgggcggatcatataaggtcaggagtttgaaaccagcctggccaacatgggtgaaaccccgtctctactaaaaatgcaaaaataccgggggggcgcagtggctcacgcctgtaatcccagcactttgggaggccgaggcagggggatcacaaggtcaggagatcgagaccatcctggctaacacggtgaaaccccggctctgctgaaaaatacaaaaaattagccgggcatggtggtgggtgcctgtcgtcccagctactcgggaggctgaggcaggagaatgtcatgaacccgagaggcggagcttgcagtgagctgagatcgctccactgcactccagcctgggagacatagcaagactcggtctcaaaaaaaaaaaaatagaaaaattagctgggcgtggtggcgcacacctgtaatcccagctactggggaggctgaggcaggagaattacttgaacctgggagatggaggttacagtgagctaagatggcaccattgtactctagcctgggcgacagaggaagacttcacctcaaaaaaaaaaaaaagtgaaatggtgctatcgaagggtcaaaatgaggaatggcactgaataggttctctggtttcagaatgaccttttagggtaggagaaggctattgtttttaaacccagaagaagagagagagagagtgtgtgtgtgtgtgttttcactcaaaacagcataactgatagaattgtacttttgaattgtacttttgatgcttttatctttgatttcattgaccctgtaaatgggtaaccgctttctctttggcaaaaacatggtagttcacacaggcaggaggggaagggagcatcatgtgagtcaagaaatggtcgtatgacctaattgtctggaaaggacataaccatattcaagaaatcaaacattactgtctcggcttaagcaattgacatgacttccctacattgtatagaggcttaatctaaatattataggcaaataaaaattcttaactgggtaccctgctataggatgagcagagctcataccccatgactggttagcaggtaaacagtataattattacttaacaaaagattttagatctttgctttaggcagtcacttaactggcttgtgtatacagtcttgaaaggacattgaattctggtttgaaagaagacattttaggaaatcaacttctaacctagatatatctgctctagaggtaagaaattagctctgacaaacactcgtgaaattacttttaaaatgcacagtgagtaatcggagccgcttggcaatttacccttggtagaccacctttgcagtagctaagttaaacttagtggcttattcctgaaaggcctcatttccgagtgtcatcagatgtatgaagtcccatttgatactctgatgcaacagtatatccaagccatatctggagggttttatatatgaattgggttttgataagtcatcctttttttttcttttcacttgttaccactttaaaacagctgtctgtctcataatcagtggcaactgctttttcgactggaaaagggtatgggacctatttcagctcaggaaaagttagtacttcacaccctctctggtttttctgggttggttggttggttggttggtttttgagatggagtgttgctctgttgtccaggctggagtgcagtggcgagtgcacccaccacccaggttcaagcaattctcctggcttagcttcccgagtagctgggactacgggcatgtaccaccatgcccggctaatttttgtatttttagtagaggcaaggtttcactatgttggccaggctggtctcgaactcgtgacctcaagtgatccgcctgccttggcctcccaaagtgctgggattacaggtgtgagccaccgcacccggcctgcctgttgattctttggactttgcttaaaatattaatagctctaactcagtctgctgcagccttgatgtaaagtgttagggccaagaggtaatagaaacccctggagttttccttggaactgagattaattttcgtcatttaacagggatacttacttccaggttcatctgagcagggacttgggaggggtctctttgccttactctggtgtttccattacggagactttgagccaagttagattagtttatggcagcccagtttaggaaatgatttttttctggttggttggatggtttggttggttttttttttttttttaagatggagttttgctcttgttgtccaggctagagtgcgatggcacaatctcggctcgctggagcctccgcctccggggttcaagtgattctcctgcctcagcctcctgagtagctgggattacaggtgcccgccactctgcccagctaattttgtgtgtgtgtgtgtgttgtttttttttttttttttttttttttttttttttttttgacagagtcttgctccgtcgcccaggctggagtgcagtggcgccatctcagctcactgcaagctccgcctcccaggttcatgccattctcctacctcagcctcccaagtagctgggactacaggcacccaccatgatgcc

SEQ ID NO: 103115 - DNA, 1033 bp, Homo sapiens
tctgccttccaggtttaaacagttctcttgccgcagcctctcgagtagctgggactataggcgtgtgccaccatacccagctaatttttgtatttttagtaggtggggtttcactatgttggtcaggctggtctcaaactcctgacctcaggtgatccacctgccttggcctcccaaagtgctgggattacaggcatgagccttcaaacctggccaataccagttcttttcaagcttcatttctgtgcaagaatgtatctattaatttctcccatgtaattgacataatcttaatatttgtctttcatacaattccttcattctgaagtttcctctattaatactcagatttcatagttaatcaggcatgtctgaaagattgaaagtagcaaagacaaatctttgagggaaaactactatttttgtgttgagtacccttatcccttcagaaaatcgttaactcgagattattggcgggcaggcttggaactgaatgcctcacttcactctctctatattttctcagtccccatttcactgggtcagccttccccaagtgcatattcttgccacaatacaggaagcatctaaactcccatatttgcctgccttgaatatagttgaaaatgacgttttgttttgttcttttgagacggagtctcgctctgtcgcccaggctggagtgcagtggcactatctcggctcactgcaagctccgcctcctgggttcatgccattctcctgcctcagcctccccagtagctgggactacaggcgcccaccaccaggcctggctaattttttgtattttttagtagagatgggggtttcaccatgttagccaggatggtctcgatctcttgacctcatgatgtgcctgcctcggcctcccaaagtgctgagattacaagcgtgagccaccgcacccggcctgattttttgggtttttttttggagacggaatcttcactctgttcccgagtcgccaaggctggagtacagtagcggatctcagctcactgcaaactccacc

SEQ ID NO: 103116 - DNA, 6428 bp, Homo sapiens
cactctgtctcaaaaaaaaaaaaaaaaaaaaaaaaaatttttttgttttaccctcccatttaatgttttattctgaacacaaaagtatttgctgagttgaaattcaaattgttgatgtgtagaaagtaactactgttttatggatgtctgtgtcacatggtgtgaatgtctcttttattcaggggatttgaaataacaagcctctttctaaaaaagcttttttttttttctcttctctctctttcagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagtgagttgctaagagagaaaaccaaataagaatgaatgtgtttagagtttttttgtggggttgattttttttgttggtttgtttttcttttgagatggagtttcactcttggggctgaggctggagtacagtggtgccatctcagctcactgcagcctccgcctcctggttcaagcaattctcctgccccagcctcccgagtagctgagatgataggcgcctgccactatgcccagctattttttgtatttttcgtagagacggggtttcaccatgttggtcaggctggtctcgaactcctgacctcaggtgatcctcccgcctcagccacccagagtgttgggattacagtcatgagccactgcgcccagccacgtttggagtttttgaacagggggaatactctttgccattgtttgcttttggaatccaggacacatctttagggcatggcattccagctaacatcttggatgccccagtgaagatttcagtgcttttttccaatttgtttttagtatgccttggcaaaaaagaaaagagatactaattgatcagaaaaaatgttttagactgctagccctgctgtctttggggaagttgtatgcagtgagtaaattcaacatcgtttttggcctccctatcagtcattaatgtaaagtggggaggcagctattgcaggccactatgattttgatagtcaagtaaaagctatgtttttttgttgctgtttgtttatatccattaaggggaaaaatggccaggcatggtggctcacacctgtaatcccagcactttgggggaggccaaggcaggaggatcacttgagaccaggagtttgagaccaccctgggcaacatagtgagaccctgtctttttaaagataaataaagattctttaagaaaatagaaaaggaaagggggaaaaataatcctcctcacagaatatttgcagttcttctgtatggagagaggtaaccaaaacacataattatcttcagaatttaggatcattgctctttttaaattacattctatccacggggatttctcaacaactcaaaggagtagtgttgatttatggagctcagcccctagcagtgtgctaaagccctaagaaacctggctctgttttcatttcttgagtttagctcaaaagaagctgcttttggagacatcttaggatatagaaccctataaactatatgttagccagagggctttttttgttgttgttatttagaagaggtttattataggctaactatataaggttatttcagctgtgatgatccagcagttttgttgaacttaaaagagcctacctattaaggatgctttatcgtgatgtaaagaagatggtgccttggttagtgccttggaattgaggattttgtgattccaggagaaagtacatcaggcagtggtgtaaatgctggtccatggcttacagatgtgactctttcctcaggttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatggggtaagagcaaaccttttctccttttacctaattttgtttcatccataggattttcagtggaaagaagggactgaaagacataagaaattaatttctgcatttccatggacaatctgttgagctcaagccatcttctaaaacatggaaatgtcatctttgtggcatatattaagtggcagtttattttctttccctgccagtatacttcgttgggtcggggagaacaaagaatggttttgaaaccagagctttcagttcccttcatggtttccagaggtgagaagcctctgtgggtagtagatttgggatggaacacacacaacccttctaatgaccctaagttgttaactaactgcctttgaatggttgtcttgaaatacctggtgtatatactgcagaaaaggaatgcagctgttttccacagtgtttgtccccaacttctgtttgtactcagaatcgttgaacatatgaagattttggtcccataatccttaaactatagcctgaggtgcacctgattacatagagtttggatggagcaaagaaaaatccaatagcattttgcagagtaatgtatataattatgggctcacttcctactggagatgttgaaagtctaaatcggtttgaccattttgattgatggcacaatctggtttagaaaactttgtttagatcaatgacataaccctgctgcctctgcctgcccttcccctcccttctcccatccccttttccctatctggtgtctgtactttgatgaaggtgagctataatattggtggttaacataatccagaaggcttagttctgtgtgtgttctgtccctatataaactggtaaagaaaaaaaaaagttatgcagaatgttagatatttacatttgatacggtgtgccactattcaaggaaaaattaaatagcattttttaaaaaacagaatgaacttcaaaattaaagttgatttttaacttccatattagcaaatactcttcactactgaaagacagtactattttgcatattctgcataactttaagaaagtctttagtgaaatctttattggaagaaagtcatttgacaacaggcaaaaatttaatgattcggtatgaagtaaaatcaatcttctgatttggaaaatactctattataaaggtttcacttctttttggatgttttaaaatagacatagacacttgaaagtactatcatcacgtctcaaatcacctagaattcctagtatttttaaattgcaaatacaatttcaagtttatttaaatactccagaagttataatcctactaattgtgctagactttgctagtagagggggcccctctttctggatgagaagtctctcttgcagccatagaagagaccatggctttccccataggtttttcaacagactgtgaagcagtctgtcggatcctgtggggatagacgggcatttccctcgttgcccccctttttattgtggtgtggtgatggttttcagtgtcttgtacaggtaaggcactcaatgttgttaacatgccctttttcattgcctcagtattttgatattttcattggctgttaaacgtggaaactttttaacatgctttgtcgcatttatatgctacaggttacaaagtgagagccttgtatacacttcaatacttaaaaagtacccgtactcagtactcagccggcagcataatgaaaagtgggactagacacggtgtccatatggagaggaaaaatatacatagaatatttttaacaaaatgtattcattgtataaatggaatccttctgtaactttggtaactgcatacttgttgtttggtaatgaaccagaggaggtataatactctagaattgtgtaacattaaagtgtaaacttttgtgtttaaagagagagaacattttatggtgtgtacttttaaaaaggaaacaaagctgcatgcaacagcttgaaattgtatattcaggtattaaaggtgcaatactggttagaaaaaactcagggcctcccactggggagctgcctttatttaattttaaagaaaacaaaatctaacccaaaaagtccaattcatatttccctctcccctctttaagtaattttacatggccatagtcattattctaactgatatgtctataaagttgcacccccagtccgttgagccttggtatttgttgtaaattctcctttcacagcgattgttaaatctattcgtgccctgagatgtatggctttatgctgaagattggctggatgcgtcctctgatgtgtgttgtaggaatttaatgtggttgtctcctgcttttattatactgtgacttgttaggaaaccctgggcctcatttggctctcccttgggagaggttgagggtgcacctttatgaacatggaaaggtttatcacagcagttaacccccacttgctcctcccctctataccaagctcttctggtttttcacctgacggggtgggtgtttgggatctattttttcttgctaatttgccaagtattgcactattaataccagcccccgaaatgaaaggaaccaaccacactggtgtgtacaatcagacaagcaaggttgtatattgaggaaatttgagcaagctgccctgaagaaaggcatagtgacaagatgagagagatgcattgtttggagatgtgtttagccagtgcccttcttccccacgagcccccccaaggctcagagcggtactggcttttaaagggaaaggccttcatttcttcgtttatccccccagcagcgctggagagcgaggtggcttcaataagcctggtggtaagtttttgagtattaccatagatagtgtttaaaaaaaaatgcagtcagtttttagaaaactataatttttttattagtttcataagtggtttaaaaatgatctatacaaaagagactaatgggtactgccggcattgtcttaggggttaataaggttaacctatggttacaaaacaaagggtaacttgaagtattgagtaactgcttctgtaatatgggggagaataaatttttaaatttggtttatttagaggaaaaattttgacttaaatttaacactgatttggcacataagcattgagagtgtatttggttaatggtttagaagcaaaccagcaaaggaaaaaagcaaaccctagcaaacctttcacaaatgttaaagagacactgctccattttagcagtgcgggtcattttgagtttaatgaatccccatcaaatggtggtatagtagatagctatgtgtgtttgtaaggtttgtagcttgcaagacgtgcactaataatattttatatgatctttcctggttggcaggacccatggatgaaggaccagatcttgatctaggtaattttgaattctagttgtgcttcatatcgtgctttgtaaattaatggtacagaggtaaatgcatgcgtagagttcagcagccttatagaccagtgtgatattcttgctgtcaaggacagtttgggaaatcctatgtgagcatctactcataattgccttaagtgaagtaaaccaaaagtttgatagcattcttcttagtatgcttggtagttttcttagatttatgatgaatatccttgggcagtagtgatcaggtagttaagaaacccctatagatacatgataataattctcctgtcttgttgtctctgaaaggcccacctgtagatccagatgaagactctgacaacagtgcaatttatgtacaaggattaaatgacagtgtgactctagatgatctggcagacttctttaagcagtgtggggttgttaaggtcagtaaaagcataaccaggtcatctggcagaactttaaaccacagagcattttaaagagattgaattgatgttgagagttgttttctaaggttgcctttgcctgacttctttctaggtatcttatggtttgttcctttttaaaaaagattagcctttttttttttttttttttgagacggagtttccttcttggtgcccaggctggagtgcaatggcgcaagtcttggctcactgcaacctctgttcaagcgaatctcctgcctcagcctcccaagtagctgggattacaggtgtgcgccaccagctaattgtgtctttttagtaaagatggggtttcaccgtgttgggcaggcgggtctcaaactcctgacctcaggtgatctgcccaccttggcgcctcccaaagtgctgggattacaggtgtgatcccctacgcccggccttccctcctccacccctagggacagagtgttgctcaatctcagcctcccagg

SEQ ID NO: 103117 - DNA, 1050 bp, Homo sapiens
tattcagctgaaagactagtcatctgttctaactggaggaagtagtggctgtgttagactaaccaagaatccctgtagttcactcacagcctgtacactgtccttcacggtttaaggataattttctttatgccagtcatgtcttatgtggtggtatcaaagtctgactacccctacgaggtggctgtgctcagtggatacctgtctgggcatagaaaatgccagggcaggcaaaccagcatcagaagatggctaaggcaggagtggggcctatcctgttcacttccacactttggtctactttggtttttatgataaagcagggatagaggagaaaataacttagaattctgaaaaacttaaaagcggagaaacggtgacatttagtgacttactacatgtgagaaattggtacttttcctggattttgcctggacttttttctcccaaattagtatattctagtcatgcctaactatgctattctttgtctagatgaacaagagaactgggcaacccatgatccacatctacctggacaaggaaacaggaaagcccaaaggcgatgccacagtgtcctatgaagacccacccactgccaaggctgccgtggaatggtttgatggtgagatgtactcactggcattcttaatctccctggctatagaatatggcatgagggagaaacttgtgaaccataggagcaagaagaccttccatctcttcctgggggaggtagatggccggtctccctgcagtagtagtagcacccagccattgaccctggatttggagatccctttattttgaggcattagtattacaaatcaaccttgcttaaagtggcaaacacttcctaagcacagattatcagaaggtacagaaaacccttcaaaagaacatcttagccagtgtacatttgcatatagataaatatatatatttaaatgaggccttgacattaatggtgggatttcacttcagacaaaaccaacttgaaagcattgaatgacttggccatgtccagtggcttgcacctgtaatcccagc

SEQ ID NO: 103118 - DNA, 1593 bp, Homo sapiens
tgccctaaagcatgggtgtacatagatcctcttgatagtgagtgtgtacctgttcacacaccacctttccttgtttatcttccttagttcaattggtgatttctgctgtgatgtaattgtatgcaggggttgtggaaaccagaacttcgcctggagaacagagtgcaaccagtgtaaggccccaaagcctgaaggcttcctcccgccaccctttccgcccccgggtaggtgcaggtttcatgagtgtcccctcagcttcctggtgctaaacctcttttcttatttgtgggcttggtaaactgcagttgccctctgcttaacaactttgagttgtcgtgtcctcatttctaaattgtcagcccgatgccgagattgagtgaagtgtctggtttgttctgctgtgagagaaggaagcagagcagcttccacagtgtccacagggcctctgcagccacccactgactgctttcgccctgctattctcaccttaggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataagtaagtgctggtgaaaagcagctgtgggccgccaggcacagtaagaggacagcccttcccagcttggttggcgcaagtcctcatgtctctaggaagcttgtgatagtggttgggaggagccaggaaggggcacctgggggctctggaagggcttcctcaccccttcccattctaaccgattgggaggagccaggaaggggcacctgggggctctggaagggcttcctcaccccttcccattctaaccgaagggccctctttaccttgcagaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttataaagagtcatccttctcggcctctgttccacagtcactgtgtgtctgctgggagcatgctcccaccccacccaggagaggggtgccttccaggtaaacggttggttcagggtttgtgtgaggggaaataagcggttgtgacatggaaacagactctggccctgatgcagcctctgagacccact

SEQ ID NO: 103119 - DNA, 1016 bp, Homo sapiens
tgggcctgctggccccacgcctcgtgcagtttgagcaggagattgagcgggagctgcgtgctgcacccccagcccccaacgcccctgccgctggggaggacaccactgaaaccgcccccgcaccagggactcctgcccgcggcccccgcatgacacccagcgacctgcgcaacctcgacgagctggtgagtcccccagcaccaggtgccagggacccgacagcacagccagtgcctgcaatctgtccctgaacctcccagggtccaccctgctatctgcagaacagtctgccccacaaaaagagtgcacatgttgagcaccaaaccgaggaatgtatacctgaccccaaggaaatgggtagcccacagagagggaggtgccggggagatgacgcagcccagccgggcctgggacaggatgcgggctcctggcacgatcttccctcactttgtgtgctaactgtgcctcaactgagcttgtgcattccttcttctggggggccgcatgatcggggcgcctcctctgtgccctccctgcagtcagtcttaggcagatgtacccacaacctcatggaggctcgaggttgagcgggtgctgtgatgctcggttgagacgaggcatggaaaaacctgggcaaggtgcctggcacacagtaggtgccccagggggctctgcaggtctccccactccccaggcacccctgggaagcctagctgggttgctgctgttgctgggagcagggatcctgtttggaattacaggattcgttctactctaagcataggcgttgctgggccctgcccccaagtctctcctctcccaggatctgggtggcccctgccacccctgagggctggaccaagagtttccttcttatcagaaggtcaggactacaatgtgcctgcctgggaggcagatagcggatggcagtgggcagagcctggggccccaccccctgtcctggaccagggtcactcaaggccccacctgcttatttcctctggcggcaccactgc

SEQ ID NO: 103120 - DNA, 1386 bp, Homo sapiens
aggaaacttcttcttccgtggcttttggggccctgggccgctggaggaagctgctcacttctccctggaagtccccaggacagaccgatgcccctgacagccccgtccaccagccacataccctgctgttcctctccctgcctgttctgcatgccagtccttccgtggtaccccatctgtctctattgtccccctgccccaggccccgggatcagctgcccccccatccccgctcccgccgctactccggggacagtgactcctcagcctcctccgcccagagcggcccccttggtacccgcagtgatgacacaggcactggcccccggagggagcgacccagccggcggctgaccacaggcaccccggcctctccgagacggcctcctgcctgcgcagccagtcccgagaccggctggatcgcggccggccccggggggccccaggaggcaggggagcccagctgtcggtccccagccctgcccggcgggcccggagccagagccgcgaggagcaggctgtgctgcttgtgcgcagggatcgagacgggcagcactcatgggtgccaaggggcaggggcagtgggggctcgggcaggagcaccccccagactccccgtgcccgcagccctgcagcaccccggctttcccgggtctccagccccagtccagagttgggcaccacaccggccagcatcttccgcacacccctgcagctcgacccgcagcaggagcagcagctgttccggcgcctggaagaggagttcctggccaatgcccgggcccttgaggctgttgctagcgtgacccccactggaccagcccctgacccagctcgggcccccgaccctccagctcctgactctgcctattgttcctccagttcctcctcttcgtccctcagcgtcctgggtggcaaatgtggccaacctggggactctggccggacggccaatgggctgcctgggccccgaagccaagccctttccagctcctccgatgaaggcagcccctgccctggcatgggggggccactagatgcacctgggagccccctggcttgcactgaaccctcgaggacctgggcacggggtcggatggacacacagccagaccgtaaaccctcacgtatccccacgcctcggggcccccgccgcccctccggacccgcagagctggggacatggcatgccctgcactcagtcaccccgagggctgagccagattcctggatgtgatggaccagctcagctgtccccagaccccatcccttctccttttcctttgtggccttaacccttctgcatcagggagccccctctgcctcttgagtaccagacctcatgggaccagaccccttgggaccacatggcacaatgggacctct

SEQ ID NO: 103121 - DNA, 1019 bp, Homo sapiens
ctggccaagagagtaaaatctagcgtcttgcttgggatggtcagatcccttctgggagttgaggattggcagcagagacttgggtggtcccagagttttcaaggtagaagcagcttatactccaggcccctggcattagacagagctccttgagggcaggacagggcaaggcctgcctacctgggcccaccagtgcctggcccagaggagaggaacagagctgggcttcaggcctgcagccaggctggggcagagcagagcaattggcctggggctctttctttctgtccagatggccatctgggggaggggacccacagcccatccttctgtccagggtccagaacatgggaaggctggcacggtgagaggctccctgccaaccacagccccagctcccgagtcggaggagctcacctgtcccgcatcagcacctactccccctgccatccctgtggggcttctctctccccagctttggcctggcccccgccacccccctccaggtccacgcgccactcagccccaaccagacagtggagatctccctgcctctcagcacggtgggctcggtcatgaagatggagcctctgaacaacctccaggtgggttccgggcagggcaggcaccccagtccttactcacctaccagccgggccccactggggtcagtagaaggtcgtgtctgcggagtcatgctcttagctgcagatgtgttggggaggcccaggttggggaacgaaggggtgtgtttaccagggaaggccctgggagagaatctgctcagtgacactcttcctggggcctcagaggtggcgtcaagccccagagactgactggggacccccttgtgcctaggtggccgtgaagaacaacatcgatgtcttctacttcagcaccttgtacccactgcacatcctctttgtggaggacgggaagatgggtgagtcatgagggagcccgctggggtgcctgaaatggggctgtggcttgggaacctggccaaggtggtgccttta

SEQ ID NO: 103122 - DNA, 2131 bp, Homo sapiens
gggactggtccaggatctcacagctagcagagctgggactcagaccagttctgtctcattccagatccctgtctgcgcctcctcctctgttgttcccaggtggttggtgtggcctggtggcaccgtcctagggcactggcatccagttttcttcttagcatgggctgagggctagaagcaggcggccctctcccttcactcatcctcacggaggacctgaaagatggacctgctgtgggaatgggaatggggaagaagtggggccgtgtggacagccctgtcggggacagtgaggagactcagtgcctgtcctgggggacagctctgcctggaggctggggtctctttgaccttcctgagacatcctgatgcctccaccctacttctgtgtcccggcaggagtgagagcgcagagagccctgagacagcccctactggagcacctcctggggagcagccagatgtcatccccgcccagggcgacctgctgggtgacctcctcaacctggacctcggccccccagtgagcggcccacccctggccacctcctcggtgcagatgggagctgtggaccttcttggcggtggccttgacagcctggtatgttgtgggccccctctggatgatgttgataatgatcctcagaggagcagtcactgaatgcccctccatgccaggcaccagctgagtgcctcaggtacattatatagagtccttaccatttacccttggaggtgattgtgtagctccctacttatgatgagaaaaccaaggtttagagaggccaggcagccttccctccgaggtcgcacagcccctgagaggcagacaggattccactcccttgttgaaccttcgagtcccaggagaccctgggcagggaggcgcatcctagcccttgccctgatcctggcatcacagtcacctttgccctgtaaggctagggtgttcctggctttgaggaatcagacttgtgtccacttacccttatgcagcgccagctgggaatagcagcccatccaggcctatttgagagggcatgggaggccggggagagaggggagtgggaagacagtagggaggggagtggtgagactgacttgggtatctccctggggcttcctcaggcaactggcaggaccatgtgtgggggcgcctaaacctcttcatttggctgtgctcggctcaggtccgcacggtggcagcacgggggcaggacactggtgatcagtgctgctagggtgaggcaggaagggctgtggtgcaggacaggtgttggggtaaaggtgtggggtagtgcctttcatagagacagggtctgggcctctcgccagacctcacaccacactcctctcggatggagctaccgttgactaatctccctctttcccttctctctcttgtttctctgtcttccttcctggctttttctctctgcatgtggctgcctgttctcttcacctgcctgcttctgcttggagatgggggatgagcctgaaggggtatggttcaacccttgcgtcaccaagccttcgtccttgctcctcccgaaagcgctggcccagcatcccaaggggcgggggcgggtgatgtcacagcagcctccacctgctgagcccctgccttggtccagcatcctggcagcctctgtcttgaccacctggcatccggctgccactgggccccatagccatggattcttgcccagtcctcaccaccccatgacacgtcgccttgtcatcgcggggattgccagccctcagtcccacaacccttctctgatgtcctggagggagagcacccatctgcgtagcatgtctccacccagccgtgtgtcttgggacctccttttatccataggctgagcgtcaatttgggagtgtccccagccctttcccagaggttactcctaaggctcaaggcttgcagggcacgggagggctcagcctctcttctccacccacctctctctgtcttgtttctgtaatttagagttgatatggaggctgtcctgccccctgcccccagtgtcttctaaagagccaggtggctctactcattcccagaccctgatgtctttgcctcttgacgcccacctctgactctttccctccctttccagattggggg

SEQ ID NO: 103123 - DNA, 1052 bp, Homo sapiens
gagttcctaaaccaagggatgaaactagggcttcctggttgcagtgtgggtctttatacgccagtgcccttgggtcacggatttaatgcggcgtagtgactagtagagcagatcagcgtgcaggattccctgtgctatatttaacatagtaaatctcttaagaatttgtccacgtcactgagacatgccctgccctggtcctgagatgtggctgggcagcttttgccaagtcctaatcgcagaaatatcttcctgctacccagctcggggtcttgcctctcccatggggcacgacaaaggctccttgcttggccaggacctccccgcagtgtgcacagcagcacagagtacccagttttctcctttctctctgtcctgtcttctcccttcctcaccatctgtcctcgtatcttttccttcctcctctctgttctggaagggcataggagtaggagtcagaggcagaggattctcgccccactctcgtctttactgacattagccatgtgacctagtaccagcctctcaccctctctgaagtttccttgttcaggaaaaatgtggtgggtgatactcgcggaaggcagaaggatgttgcctttgagggaggaacaatgacacatgtgaaagggctcagctagtgacagctcctgcctagcggtgccttctctgaggcaggcatcgatcatgctggatgcttctcgtctcactctcacagcaggccgattaggtcggtgtccatgttggggtcccaagaccaccctcatgctcaggtttcactagcagtactcacaggactcagcatatattttttaaatatatatattttttgagacagggtctcactctgttgccgaggctcgtcttgaactcctggactcaagcaatcctcctgccccagcctcccaaagtgttgggatgacaggcatgagctgctgtgcccagccaggactcagcatatagctatacccacagcaaagatctatcagcagcagagcagggctgcccggctgggtcataggggagaaggacacaggtggagtctggagggt

SEQ ID NO: 103124 - DNA, 1039 bp, Homo sapiens
tgggactacaggtgcttaccaccatgcccagctaatttttatattttttggtagagacaaagttttaccatgttggccaggcttgtctcaaactcctgacctcaagtgatccacccacctcggcctcccaaagtgctgggattacaggcgtgaactatcacgcctggcctggacatgctattttggtaactaaaaacagaatgtttccccttgtctttcctgtttgccccgttggaatggacggaccccagcatctgtgagcgggtcacccccaggctctcccatgccaactccgctgtggtgctctctgctgtgaaggtgctgatgaagttcatggagatgttgtctaaggacttggactactacggcacactgctcaagaagctggccccacccctggtcacactgctgtcagccgagccagagctgcagtatgtggccctgcgcaacatcaatctcatcgtgcagaaaaggtactgaggtcaccacacgcacgtccatgcgtacccctcggggagcctcttctgctgggaatgggggctctcaaaggaaactgacctgtcaccatgcaggaagtctcaaatagcttaacccagaatagcttaaccaaagtggcagctttgcccccctgagggatatttggtggtgtctggagatactttggttttcacagctgaggggggcatgctaccggcttctagtgggcagaggctaggagtgctggtcagcatcctacagtgcacagaatagcccctcacagtaactgtccagcccgaaatgtcagcagtgctgaggttgagaagccctggcttaacctaactaggaagcaggctatgtaaagactagcttggtgattaaactagatattgtcttcatagtccacgagctgtcctgaaatgggctgtcagattttgtgtatctgtgtacatttcttcgggggacagagtccgtagctctagtcaaactctctgaggttggaaccttgaggtctgggggagaggtacatcggactcactccaaatgctgtgccgcccacttc

SEQ ID NO: 103125 - DNA, 1086 bp, Homo sapiens
tcccgagtagctgggattacaggcacgcgccactatgcccggctaattttttgtattttaatagagacaaggtttcactatgttggccaggatggtcttgatcttctgacctcgtgatccgcctgcctcggactcccaaagtgctgggattacaggcatgagccactgtgctggccaatcctcagcattttaaagtgctgggattacaggtatgagcgactgcacccggcctacaagtttccatcttgttaattcctgtcctaacagtcatccctcactgttgcctggcccacctgaggccaggcgcctgaagcttccctcagccaacagcataggatgtcttacgtgcctccctccggttcttttggaagttagatactgggaattgtcccctgccagggtagggagggatcactcatgcttgcctcctttccttaggggagatcttcgagctgaaggcagagctcaacagtgacaagaaggagaagaagaaggaggcagtgaagaaagtgattgcatcgatgaccgtgggcaaagatgtcaggtgtgcaggagtaggcctggtggcagctagaagctggctgacaggggagggtttatagcttgggtccacttcagtctctcctttagggtgtctagggacccatgtctcccctcatacagctcccttcataaaactttcttcccaatagaaggttttgtttacacaggaatcatgagcccagacactgacaggtcaggtggttatggagtgagttaactggagtaggtgggaaaggcagcaggcaatggagtgggtgtggcatgaaccctctcagaaactccagaggatcagtactggctggggaagaggacccagtgtggccaggtcttctggtttttaaaagaatgggaaatctgggccaggcgcggtggctcacgcctgtaatcctagcacttggggaggcccaggcgggcggatctcgaggtcaggagttcgacaccagcctggccaatatggtgatatcctgtctctactaaaaatacaaaaagtagccgggcatggtggcgcatgcctgtagtctcagctactcgggaggctgaggc

SEQ ID NO: 103126 - DNA, 1042 bp, Homo sapiens
tcttggcctgtaaatgctgaaattgagggggggatcccagcccagaatgctgtctccttagcaaagtgactcattatactggccagagcagtttctgaatcaaaaattccccgtaattaaccactttaaaaaatttgccctgacacttccaaagatggaatccaaaccctaagctttttcttgcctaaatttgctggctttttttttttgagacggagtctcactctgtcgcccaagctagagtgcagtggcgcgatctctgctcactgcaagctccgcctctgggttcatgcttctcctgcctcagcctcctgagtaactggaactacaggcacgtgccaccacacccggctaattttttttatttttcatagagatggggtttcaccatgttagccaggatggtctcgatctcctgacctcgtgatctgcccacctcagcctcccaaagtgctgggattacaggcataagccaccgcgcccagccgctgcctgctttcaaatatgattcgtgtacccgatcagattcatcagagaacaaggtctcagcccctttggcctctatggggtagggatacagtgcatgataacagccaagcaggtgccaggaaaaacaccagtctttctcatggcatctatgagtctgagccccgttaggactgaactgtagggttttttccattcctgcggagagaatgagaaatctcttgcactgatatccatccaagaggcaactgcaagaccaggtaccagcattaggtgctcacaatggagaaaggacacgaggagatagctgccctcagtacatcactaagctgtaggtagggaatcattcatggtgaagtgaggtgttttgttttgttttgttatctgtgttttggggtggctttctaaagcgtttcacttttctccgcatctcctcccttctctactttaatttcctgcatatgaaacaacttcagagggatacatttctgcatcatcagtcccattgggccctctgcagagggatatgtgaaacagatactgcggaaaaaagctg

SEQ ID NO: 103127 - DNA, 1054 bp, Homo sapiens
agcagtccccaccccccactctttttttctttttttgagacacggtctcactctgtcacccaggctggagtgcagtagtgcgatgttggctcactgcaacctcctgcctcccaggctcaagtagtcctcccacctccgcctcctgagtagctgggactacaggtgtgcaccaccatgctaatttggtagagacaggatttcaccatgtttcccaagccagtctcaaactcctggcctcaagcaatttgtccgccttggcctcccaaggtgctggtattcacaggtgtgacccacaacacccggcttgatctccccattttaaagagggaaattgaactatggagatgaagtagactcagttcagcatactttccttttaaaggttgtcaccaattttgagacattggagaaaaattgaaatactatacttagtacccattttcttatgtttttatttttttcattctcaaaggaggtgattttcttatgttttaaaaatagatataaattcattttattagcttaaaacacagaaagatagtctatatttcttgttcctaaaattatatttagatatatgaagacaaaatttgaaaaatattgagaactttttttcctttaagcctaaccctaacttcagcagctaaaaaccaaagtctttagatggaaatgttttttcttcttcccttttttttccttaggacctaggacctctttttccctctcttagatcatgttacatctttgtccctggacactgtttccaaaagtctcaccaagggcttctttatacatctagaaaacataagagagaaagctactatattttaggctttattgctcagttccttttcttttcttttttctttttttttttttttttgagacccagtttcgttcttgttgcgcaggctggagtgcaatgctgcgatctcacctcactgcaacctctgcctcccgggttcaagtgattcccctacctcagcctcccgagtagctgggactacaggcacccgccagcatgcccggctaattttttgtatttttagtagag

SEQ ID NO: 103128 - DNA, 1105 bp, Homo sapiens
acctagaagcttcctcctcagctggaattgtccacggacttttggcagattatactctggggcatatcgcagaccgcagcccatctgtcgctctcttgtacctgggactcagcctgtgttccttgcttttttttttttcccctttacaatttttttaaaacatttttttttcttttgtagagacaaggtcttgctatgttgcccaggctagtcttgaactcctggcctcaagcaatcttcccacctcggcctcccaaagtgctaggattacaggcgtgaacccaccatgtcaggcctgttccttgcctttttaaagctgccgtccacattcctgatttattggtatcttctagtttctcccttattttcttcctagcttatcccttactattttctctgcaaataactccacagactcttttcataaacttaagggtgttcttgctgatcactccgcaaagctaagcaaaactctatccctaggaaggagcagggctgccagacttccaaaggaactttgtccctgtcggtgtagccgactctgtcctttctatggcgttcagcagtgtctctgatgagaataggcattaagcatctattttgggtcaggccctgtgctaatcacacttttacattcactgtcctatttaaatgaaacttagtgtataagtcttttgcctccttggttaaatttatccctaggtattttattatttttgatactattataaatagaattattttcttaatttctttttctgattgttcattgttggtgagtagacatacaattgttctttgtgtgttgactttgtcccctgctgctttactgaattcatttattaactctagtaattaaaaaaaacttttctgccagtctgggcaatatagtgaagccctgtctatacaaaaataagatttaaaaattagccaggcatggtggcgcataattgtagtcccagctactcagaaggcaaaggcaggaggatcacatgagcccagaagttggaagctacagtgagctatgatcacacaggtgcactccagtcttggggacaaagtgagaccttggtctctaaataaataaataaataaaagggtttac

SEQ ID NO: 103129 - DNA, 1041 bp, Homo sapiens
gctgaccactcgctgagcgccagccacatggagaccaccatgaaacttctgaagaccagggtgcagtcccgcctggccctccacaaacagtttgcatccctaggtaagctgatgatggggcagtggtttaagagtcactcagacaacacacggacaacaacaacttagcctttcactcaaaacttgaatcctgatgacaaatacaagacctggattcctggctttacggagtgggcatcttggcagagccactggggagagctccaggcctgtccaggcagaggaccgagctcccccttagagccatcagtgctgtcctgcctcacagaggaggcccagagccattgggtggcacaagtttgtggactggtcggggcagttcatcctaggtcatgcattgcagattttgatgtgcattcgacacatatttagtgagatcctgattcatgccaggcactgagcatagtgctgggggaagaactgagcacagtgaacccctgcccctggctctgtggctcacagtcagctttttgaatatagctatccagggagcaactcgcatatcccttccccaaggcctactgacctcgtgttccccagggtgaggctgagcctatgttttcttctaagctcccaagtgataatgatgagccactgacttaggtggtggcatttgggggcttcttttagtttattcactcagtaagtggttgtcaaatgcttaccatgtggcagggggatggggtcaagatttttctgacctaaaagagtctctgggacaggcgcagtggctcttgcctgtaatcacagcactttgggaggccaaggcagacagatcacttgaggtcaggagttcaagaccagcctgccaacatggtgaaactccgtctctactaaaaatacaaaaattagctgggcatggtggtgtgcacttgtattcccagctactcaggaggctgaagcaggagaattgcttgaacctgagaggcggaagttgcagtgagctgagatcgcatcactgtattccagcctgggcaacaa

SEQ ID NO: 103130 - DNA, 3001 bp, Homo sapiens
tttgttgctagtataaagaaatataattttgtttacgttgagcttttatccacctattagttctattagtttatcatgtatcacttttataaataatgatttacggtcactaagtagccactttttcctgtgtggactggctaaaaaaggaagaacaaaaatctgtctcttgtgtgcaggcttcccttccggtgcaggagtacctgtttatgccattcgaccaggctcacaagcagtatgagacagccagacacctgccgcctcccctctatgtcctctttgttcaggccactgcgtatgggcaggcctgtggtgagtatggggcctgggtgaggacaaggggctatgggagcagcagctgtggccgagtgaatcagttggaagcagtacctgctcaggaaatttctcagtcctgcccgaagccctcaggtgacagaagctttcttccctctgcattgcccagcatggctgctctgaccagctggcctaaggctggattaacctgatgggtatttcacaatgggtggctttgagtcattcgtgagcctggctggacagctcttgggtgcagaacccaggcagcctgtctgggctcccaggtgctcaccccatcaaggcacgcttggcagttagatcagtgcctcttgctctgcttcagggtgggggtgcctggtgaatacaggtctcagccagctctcccaggctttcaccatgccttgaatcaggctgcatgtctttgttgtgaatttccaggttagatgatatgtcctcattaagcttgagggcagcctgtgactctgctagggttttgagaaaattttggagactctgccttttgccctaatgcagctttcacccagcacctacattttctcccccaccccaccccacctcatcagacagacatacaccgcaccagtgcttgcttctcctcccaccttgggcaccaacacattactgtctcttcttgtgtcttcctcgtccttctggtcctcccctcccctttgttctccctcctgtttccatcatcagctcatatgaaatcctcccagccccctagacagggtgagtaattttcttttcttttatgtttaaaatcggcctgttccattctgatgttcttgtagaatgctaatattaaatggctgaaaaaaatagtctgttgtttgccagtgcttgatgggagcaactagttgcttggggtgaagggtggtgattcacatagggttgccatagataaggcagtggtcagccacttgggggaagtttgccatccctccttagtgtggctaggcaaaccgtttcaggctcttgggaccatatgtacccttaagaatggagttggacggtggtggcctgtctgacctcacaacgctagaccctcagagggggtctcaagacatcactcaatgaggtgtcatacctggtgtatgcaacaggctgttagctcatgtgctggagaggccaagcttaagttgaacagacctggtcttgaatcctggtttatcagccttatagctgtgatgtctagcttctctgagccttaagtttctcatctataaatggctataatgtattactcctgtagggttgttgtgagtattaaaaaaaatttttttttttgagatggagtctggctctgttgcccaggctggagtgcagtggcatgatcttggctcactgcaacctctgcttcccaggttcaagcaattctccctgcctcagcctcccaagtagctgggattacaggcacccaccaccgtgcctggctaatttttatatatttagtagagacagagtttcaccatgttggccaggctggtctcgaactcctgatctcaggtgatccactcaccttggcctcccaaccagacatgagccaccacacccagcctaaaaattaatttttaataattttataattaaaattacaagcatcagctcattcagtccccaccactaatggggcagctactgtttttcttttttcttttttttttgagacagagtctcactctgttgcccaggctgcagtgcagtagcatgatcttggttcacagtaacctccacctcctggattcaagcaattctcctgtctcagcctcccaagtagatggggttacaggcacatgccaccacacacagctaatttttgtatttttagtacagacgggattttgccatgttggccaggctggtctctgaactcctgacctcaggtgatccacctgcctcggcctcccaaagtgctgagattacaggtgtgagccactgcacccggcagctactatttttcaagtccccttttcatagatacagaaactgaggctcagacagtgacataactttccaggtcatgtgtttgagaattggttaggcagggactcaggtctggaactggactgcaagatccaagttcctattcactgtcctactgcctcccagttaagtgagacaatggcagccatgtgcttggtatagtgtagaatagagaataagcacttaggtgagagtcattgtttctgggatgtggacaggtgtggatttctgggtgagaacctctaagacaactggcagaggagttccatgtggctttaggccctcagtttgaatttctgtgctttggtgtgcaccaaaaaagagaggcattcactgctagtttcaggtgatgctggtttaggaatttgtacttaagttctctgttctcagtaaatgacggaaaaaaaagcttaagtgtcccaccttgtttcccttcatctggagcaaggacttttgcccttccacccttagtcagcaaggagctgggcagaggtgggagaaatgcagccccagagctggcctactcacactgcttagcagctttcctcagcagctttcctaacagacttcttcttgccccccagataagacgttatctgtggcaatcgaaggcagtgtggatgaagccaaggctctgttcaaacctccagaggactcccaaggtaatgtggtggttgggatt

SEQ ID NO: 103131 - DNA, 2714 bp, Homo sapiens
ccatgattctgaggcctccccagctatgtgggactgtaagtccaattaaacctctttttgttcccagtttcaggtgtgtctttattggcagcgtgaaaatggactaatgcagatgggaagttgcacttaacagcacggacagtatgatcccgttttgtttacaaataaaatgtttatttatccacaatcttcactcagtttcggactgagaggcgaaattataggcaatttttccattttctttttgatactcctctgtatattctgaatctttgataccaggcatgcattactctgcaatcagaaagcaaaagaggtttctattttgaagagaagaaaagcatttaatttaaggaccagatcttttagagacctgactgaggcttcattgttactgtttttatctaaaaggagatgtcagccaagtgtccctgatcccagcagggagacttttaccccatgcacacagagcctttatccttacctctacaggaaggtaaatactacagtgaggaggccgaggtggatctgcgggaccctggcagagactatgagttatacaagtacacctgccaggagctacagaggctgatggctgagatccaagacctgaagagcaggggtggcaaggatgtggtaaggagtgggaccaggtggccgtgaacctggtgggtttacatagatgaggctgtttttgcacctaccagggcccttcctgatcttgatcttctgtcctagccatgatcaggtgattggagcctgagggctcccaaaacctgtgaatttattggaacttcttatcaccattcagtcaccaattacaggaatgaaagtacaggataattaattttttccctactaatttgatcattcatccaattaatatttattaagtgccaggcattttgctaggtgttgagaaatgatggtacttatacatttgcttgatacaaagatggatgtgtacaagtaaattgtagataccaaaaatgaaattatcattaatagtaaatgaataaatgaggttttaggggcagagaaattaaacaatgtgactaaaaactcgatagataagttttttaaaatccattttttcccccaggaatctcacgtatttgtgcttatgctgacaagttttgttagaattattgcattcaatctattctagccaagctttatggctataattctgttattttccatttaagttatcctgtaatgttatttatagaggtcaaattttatgacaagatgttactattgctgggatctctgtgtaggatctgtagagatagattgtgcctttgctgcccttattccatcttcaattcctgttactctagtccaagcagaaattacttttttttgcccgagattcttaatcattttccttatacaatcatcctcttattttcttcatgacccttctcatggttctgagctccctccggtgccgtttttggccccagatgaggatgggtcagtggtgaaggactgaaggaagctgagctagccctgtcgtcagtgggctttactgttttctttgcccacaggcaatagaaatagaagaacggaggatccagagctgtgtgcatttcatgactctaaagaagcttaaccgattagcccacatcaggttgaagaaaggaagagatcagacccacgaggtagtagttaaaaggtttaattttaaccttcctccttcctcctccccatccccttctttttttttttttttttttttttttgagacagagtctcgttctgtcccccaggctagagtgcagtggcacgatctcagctcaccacatcctctgcctcccagcttcaagcgattctcctgcctcagcctcctaagtagctgggattacaggcacctcccaccaccatgcctggctaatttttgtattttttagtagagatggggtttcaccttgttggccaggcttgtcttgaactcctgagctcaggtgatccactcgcctcggcctcccaaagtgctgggattacaggcgtgagccactgcacccagccccatccccttctttattccctttacaccttctcttagtttgctgaccctctcctctgctccatcctgacttgccctgctcacttctgatcgtattttcctttcaggctaagcagaaagtagatgcctatcatctgcagctccagaacctgttgtatgaggtgatgcacctacagaaggagatcaccaaatgtttggagtttaagtgagtttgggaggacagggctttggcacatgtggtctttcggtaactgctttttcccatgtagctcactgtaagtctgtttcttttttttttttgagacggagtcttgccctgtcacccaggctggagtgcagtggcgcaatctcagctcactgcaacctccacctcccgggttcaagcaattctcctgcctcagccttctgagtagctgggattgcaggcgcccacctccacatccagctaatttttgtatttttagtagagacggggttttgccatgttggccaggctgttctcgaactcctgacctcaggtggtcctcccgcctcggcctcccaaagtgctgggattacaggcgtgagccaccgctcccagcctaagtctctctttaaaaagaaatctgatgagcttagaaaactgtaggatctgggagaagggcaaattgcaagggtgaatgtgggagaattgcaagccgtg

SEQ ID NO: 103132 - DNA, 1051 bp, Homo sapiens
gaaacaggagaggcattaattaggtcggtcttttttaagaaagagaatttagacagtattgttgggcaagactgttagagtagtcctggagaggaatgtggagggcctggcctagggtgttgagatggagacacacatggtgcctggatagctgggtgaacacttgaatgcaggtctcctctatggagagtgtggagcaggatgtgggtggaggcagggcagggagaggttgaagtagatgattccgaggtcagtgggagtgggtggtgatgcctttttaaaagagaaggtggagtttgttttggacaggctgagagatgcttccctgttgtattacagagggttaaattgaggctttgaggggttaaatgactttccttgagttaccaagtctgtaagtggccagaactgctagtttgacttcagtgttatgactccagaagaatctcaaaaactttctcctcttaacaggaggaacaaccatgtcatcagaatcgagcaaaaaacggaagcccaaagtgatccgaagcgatggagccccagctgaaggaaagcggaatcgatctgacaccgagcaggtgagatcagtcagggttgccatgctgctgagaaattacatctcatggccaagcacctggctgtgtgtttgcagcagctcggggtcgcatctaccaggtacaactttttggtggcttccacttgaccaggtgactgggattcctgtttcttcactaaagctgagtgtccacatctggtttagctgcagcatctccaaaaccaacaagcctgtattagacatgattatacctacccagagaatgtattccagtatgatatgtgtctccagttttcctgatggtcagaagaaggtagtccatctgcagcatggcactggagcttcaggaatccctcggtgtgctgctgagacaataccagaaccatgtgcccacagaacctcttttgtggcctgagagctcatgtggtcgtcaggttcttttcttctttttgtctgtttctctgtccttgaatctgtcaacttcatttgtgactt

SEQ ID NO: 103133 - DNA, 1790 bp, Homo sapiens
accaccaaagtcctgtcttatcccataatttgagggatctggtgctcttcatgggcccttccacgagggcaatgggacattcctgtcgcagcatctggggcctcctcctgcccactcaaaggccagcatgtgtgggtggggccaggggaggttgttggcttgcttgagccccctgtgtgacctctgccttctctctccgcagtccccctggtgcgacacatggagtctaggatcatgatccccttgaagatctcgcctctgcagtgatgctgcctacacctccacctccttccccttctccctcaggcaaccccgacagacagtggcactcctggtcctgctgtcttggttttgtcttggctctgggaggactctgaggggcagtgctcagttcagacaagggggaactgaaggctgacaagttctgaggattacagctctgcccaggccctttctactttccctgcctgcctccctccccctgctagaagtagtttctgatttccctgaatgaaagatagtgatcttttaggccttcatttatcttctaaaattcctcatctcaaggccaccagtccccagttatcacccttggaaatcctctgtttagcttagttgcacaaaaggtagtatgtccagtggctagaggtggggtgggaagagaggaggccaggccaggccctcaggaattccctggtttccactgggccacccacttgctggacagtctgagccaagtccctcctgctggagaaaagcctggaactgccaaaacaaaaaaacaaatacaaacaaacctcgtcaccacggtcaggaggaggttcagacattctgcccagaggggctggggaaagggatgggagccaggaaagatttaggggcaggagacagacacgtaacaggaactcggaaggtagaacttagaattcagaacttgggtttcaattgtagaatttggaatctggaatacagaattgggaagaagaacagagatgacaaaagaccacttgaagagaggttcctaatactagacagatggagagtggcttggctgtttccccctgcatattggggttgaaaacttaaatgtgtagttccagtccttctatgcagagtctctcctgccctccctccttcctgcaggcaaatatacaagctagaccctgttccctcaccctgtatcctgtctcccctaattgacattctatcagcccaaccctcattctgcagggccacctggtgtgtggaggtggcgggaggggtcagtgactctgggggtctcctcagtgacccccatacctcatcatgaacccttgggtagcttgattctgcctaccatccaggaaaacttgtgctggaattgctgatggaaacaattaaatatttactataaatcagtgtcttttcttcatctgcaaggaactttagcaggtgcctgaggcagggcacagtagagctggtgggcttagtcccacatggcagatctaccctcctggagggtactgtgttcttgagctattctcaacagtcagtactggttgggtgcagtggctcacgcctgtaatcccagcattttggaagtccgaggtgggcagatcacttgagtgaggtcaggagttcaagaccagcctgggcaacatggtgaaaccctgtctctactaaaaatacaaaaattagctgggcatggtggtgcatgcctgtaatcccagctacttaggaggctgaggcaggagaatcctttaaaccctggagtcggagtttgcagtgagcggggattgcgccactgcact

SEQ ID NO: 103134 - DNA, 2279 bp, Homo sapiens
tataatcacgacactttgggaggccgaggtgggcaaatcacaaggtcaagagatcgagaccatcctggccaatatggtgaaaccccatctctactaaaaatacaaaaattagctgggcgtggtggcgcatgcctgtagtcccagatactcgggaggatgaggcaggagaatcagttgaacccgggaggtggaggttgcagtgagctgagatcacgccattgcactccagcctggcaacagagcgagactccgtctcaaaaaaaaagaagaaaaaaaaaaaaggcagggagagatgatggtgaaaaacataggggatctacattggtctaggtagacaaataatgcctctctgaggaagtaaaatgtaagctgagagctaaaggatgagaaggagccagctgtgaattgctaggcaaaagcattccaagtagacagagcagcacatgcaaaggccctgtggtggggaaaggccttcggggttttgaggtgtggcaaggaggccagtgtggagtgagtagggaagaatgtggggagatggaacaggagagggggaatgagttgggatttattgtaaatgcaatgagagactatttgtttcaaatagcagtgacacgacctgatttttgttctagtatgatttctctggctgctgtctgctttgttaagagtgcttggtaggcgagcaagagagaaagcagggcttcaggaagccattactctagttcaggcaggaggggatggggcagtgggatgctgagaagtccacagaagatttgttagtctagaggtggaaccaacaggacttgtggatgaattgtctgtgtggggcaagagaaggagaagggcattccagaagagctcccaggctcgtgcttgagctgctgtgtgtcatctcctgagtctgggaggtctagggaaggagcaagtcagtggggtcaggagcgtaattttggcccttggaattgttactttttttttttttctttgagacacagtcttgctctgtcacctaggctggagtgcagtagtgtgatctcagctcactgcaacctccgcttcccaagttcaagtgattctcgtgcctcacgctcctgagtagctgggattacaggcatgcagtaccatgcccaactaatttttctatttttagtacagagtttcgctatgttggccagactggcctcgaactcctggcctcaagcagtccaccagcctcggcctcccaaagtgctgggattataggcatgagccaccgcacctagccggaagtgttaacactaaaaatgctgacacaccaaagtagagatgtcaagtaggcagtagatggatataggagtctggagcccttgggagtgtttgcgactagaaatataaatgtaggcaatattaacatatgtactgattggatggatgattaaagcagacagtgtttgctaatagtctgagggaggcatctagggaggaggagacagcagtgcagggtttaggggacagtgggaagagggccctgtgctgggtaagggatccagtcctctgtgcctgaggaatgagcctgtgcctttctcacagcctataaagacctgcagtctcgggaggagactcgaaacgctgcctggaggaagagaggctgggatgaaaatgtctactatacaggtgagtgaagcctttggaggtcttctgctgagaaccctgtctgaggatggaatcctctctgcaaggagatctagtctttcttgattacctccagtgatggggaactcacttttaagacaatgagttaatgggtttctatccaagtggcacactccataggataccagcaggcctaggtgagtactctaggggatgataacatagccagggccacgcctctgcctaggagatgtggattagcaaacgcccattgtgaccttgggcacggttctttacctcgctgaggctgttccctcgtctgtaagatagtgatggtgatagtgcttctgtcagagggctataacggaagattctacaaactattttattattttatattttattttattttatttatttttgagacacagtctcactctgtcacccagggtggagtgcagtggcatgatcttggctcactgtagcctccgcctcccaggttcaagccattctcctgcctcagcctcccgagtagctgggattacaggcgtgtgtcaccatgtccagctaattttgtatttttagtagagacggggttttatcatgttggccaagctggtctcgaactcctgacctcaggtgatccg

SEQ ID NO: 103135 - DNA, 1021 bp, Homo sapiens
ggaagttacagagtctgagtttctagactgctggcagccagctgcccttagctctagcttgcctgtgtgatcccctggggaccttcctccgctgatgggcccagccatgctcccaggatggcaaaactgttcctttcttctcctccacaattaattaggtttctttgttactaggaattagattagtttcctggggtggccagcataccgcaaactgggtggcttaaaataacagaggtttatcctgtcacagttctggaggctggaagtcacaaatcaaggtgttgacagggctgtccttcctcctaaggccttaggggagaacccttccttgcctcttccagtttctggggattgctggaaactcttagtgttccttggcttgtagacttgtcattctaatctctgcctccctcgtcacatgctgttctctctgtgtgtctctgtcttcacatagtgttctcctgtgtccagatctcccacttctgataaggacactagtcactggactcagggctcacctagtataatctcatcttaggtcgattatacccacagagacctatttccaaataaggtcacattctgaggttctgggtgggcataaattttgaggggacattgttcaactcagtgcagataatatgatttttatttatttttatttttatttatttattttttgagacggagtcttgctcttttgcccaggctggagtgcagtggtgcgatctcagctcaccacaacctttgcatcccaggttgaagcgattctcttgcctcagcctcctgagtagctaggattacagatgtgcatcaccacgcccagctaatttttgttttagtagagatggggtttcgccaagttggtgaggctggtctcaaatttccgacttcagatgatccacctgcctcagcctcccaaagttgattatttatttacttgagacggagtctcaccctgccacccaggctggagtacactggcacaatcttgactcactgcaacctctacctcctg

SEQ ID NO: 103136 - DNA, 1050 bp, Homo sapiens
ccatgttgcccaggctggtcttgaattcctgaactcaaatgatcctacctcctcggcctcccaaagtgctaggattgtagacatgagccaccgtgcctggcctttcagttttattcatttttaaattttcatttatttatttatttttgaaaccaggtcttgttacccagtggggagtgcagtggtgtgatcacagctcacacagccttaacctcctgagcttaagcaatcctcctacctcagcctcctgagtagctgggaccacaggtgcatgccacaatgcccaactaatttattttaaattttttgtagagacgggatctccctatgttacccagggtggtctcaaactcccgggctcaagcgatccttccactttggcctcccaaagtgctgggagtacaggcatgagccacagtgcctggactattcacttttctattttggcatagatgtcacctcctcctggaaggctgccgagatttcctccacgcgggctgggtcaggcaccttccttagctctccaggcctcagtaattacctcctcacgccctgatcatgtacccctatagctgcctgtttagttgtctgtctccatatatgggtgaatccccaatatgcagcacatatttgtggaataaataggagttcttcttgtctgagctggtgtcttacagtcccaggggcacccctagcatgccccatcccagcctaatagacacatcaaagttggcaccagctataagaacccacacatgaatttggctgactcacagcatctcagccactcaaagggacctcaaattcagacccacactgtccaaaatgatagccactaaccacatgtagttatttatttatttatttttttgagatggagcctcgctctgtactgtcacccaggctggggtacagtggtgcaatcttggctcactgcaacctctgcctcctgggttcaagtgattctcctgcctcagcctcctgagtagctgaggttacaggcgtgtgccaccacacttggctaatttttgtatttttagtagaaacagg

SEQ ID NO: 103137 - DNA, 1033 bp, Homo sapiens
agactttttttctttttactgcagagatagggggaaaaatctcctgcactacttgctgcattgctcaattggctggatgctttggaagatttttccacttgaaagatttgttgtttgtcattttgagaaagtgggtgctgagtgtaatttgccaggaggctaaacggctatgttatttcttatctaggctggaattttactctaataattcaatctatcagtaagaaaagccaaataggaagttgtaagagatcctaatactatcttatattgaaaacaaagcctccttctcctgttgtttggcattctaaatgttttcacatacctaagtgagattatgattgtattaaataccaacattgcagatcattccagcatacaagtggacgtaagttgtccataacagaaggaactttctaaaggggaagacagatagaacaattctggcattttcagtaaaatcttaaatcctaggctccctaggaccaggcaaaccatccccttcaaggatgtaaactctggagggcagtgtagttgtacagggtaatagttctatactctatattagtgcaacaagaaacttctattcctgtttcagaagtaagactgttatctacctttttttttttgagatggagtttcactcttgttgcccagactggagtgcatgatctcagctcaccaaaacctctgcctcctgggttcaagtgattctccagcctcagcctcccgaatagctgggaatacaggcatgtgccaacacgccctgctaatttttagatttttagtaaagacagggtttctccatgttggtcatgctggtctcgaactcctgacctcaggtgatccacctgccttggcctcccaaagtgctgggattacaggcacgagccactacgcctggcctgttatctacctttttaccgctgtgctctcccatgggttttttttgtttgtttgtttgtttgtttgttttgagatggagtctcgctctgttgcccaggctggagtgcagtggcgtgatctcagctca

SEQ ID NO: 103138 - DNA, 1908 bp, Homo sapiens
tataggtgtgaaccaccacacgcagctctgatttactgggtgcccacgttgaccaggcagggaacacctcctagcagtgatcaaggactactttggacctaggttctgtaactgacttcatctttaagtggggaaacagaggctcagacaggatacatagcatgcttaaaggcttagtgcagccactatctattctgaaagaggcagaataggacagggacaggtaggtagtgagagaatagggagaatagatgggcacaccctttaacttaatatcgaccagtaaagcctgcagttgcttatttgaacctcacattgaggctgacatgtaagttgagcaaatcttaactcaagcttcagtttccttgttggggccgctgaggcagcatagcctagagattacaagcatagacttcagagtttgattcctggctctgcctctaaccagctttgcaaccttaaagctccttaaccccctcacatgcctctgttccctaactgtaaaatggtgaatgtaattaattcttcctgcatagtgttacaagaattaaatttgagtaattactggtaaagtacgtagaatagtacctaacacaagataagtgctatatataatggttgttacctaaagaaataacagcctgggcaacatggcgaaaccctatctctacaaaaaatacaaaaattagccggttgtggtggtgtgcacctgtggtcctagcatctcgggaggctgaggtgggaggatcacatgagcctgggaggtcgaggttgccataagcttcctgattgcaccactgcactccagcctgggtgacagagtgagaccttgtctcaaaaaataaataaataaaataaattaaaaaaataaaaaggaaataagttcagtgcctgtcgttagcttgctccctttctcagcctctcctccacttcctcacgcaccctcttgctctgagcctattatcctggtccctccttcacactgccacatctttgcataggctgttctctttgcctggaatgccattctcatttgttgcttggcagaactgaactcattctccttctaggctctgctcaagggtttcctcttctttgtgtccaaagtcaccacatagcttctaagtgatgggactgagatttgaagccaggtcatctgtctttcaggccagccctctttccactaccctatgctacccaaataggaagcgtaaaagagaagtaggagagaaaaagttagaaacctggagagaacttaggtatttggtaaacaggaaaaagaaagtggaaagaagagatcatttgaaggacttcctcaacttaacaactatttgcctatggcattattttattgcatttggtgtatgatactatctcaaaagcattttgtaaacttgccagtggcttacatttttgccggatgaatgacatgactaacgatccgtgctacattacctcagtgtctagtttgtcattttgaatcaagtggacattttctgtaagtgaatcattttcacttgctcatgatataatgagaattccttacctttggcttaaaatgaggcttatgttataacagttaagcattgtctagttgcatatttaacatagtcagaatgctcctgcctgtattcagcctggtgtcttataatatttggtatgcccacctagatagcaattggtaacatctttattctgagactctttcatgtatggattttgaaaagttagttaactgttcagacgacattgtttctttgacttttacaatccgcttccctctcactgacagttcagttttggaagaccctgtatttttttttttttttttttttttttttgagacagagactcgctctgtcgcccaggctggagtgcagtggcgtgatctctgctcactgcaacctc

SEQ ID NO: 103139 - DNA, 1064 bp, Homo sapiens
atattggaggctcatgaagcccaggttaaagaggcttgtattcatcagatgcgatgaagagctttgaagtttttactagaagtgtgatttaaagtggttggcatgcaaaatgatttggaacgtttggggtttggggtagggagagagaggttggaagtaggaaacaattagaaggcaaacgctttgggcaaggtatcacattgaaacctgaacagcagtgggacttgctgggggttgggacaaaactaggcagatgtaagcatctagtgaatctagagattagggtgttctgtgaccaagaatgagcagaagacctgctaggctcaagattcaggagattctcaggtccaaagccagtcctcagtctccgaagtcagtcaggcagaagggaagttggatcaagctggccagagttgagctcaggaagtcagtgcactttctcttgtctggttcctgcatcgttttacttgtgtaaaatcatcaagatccctaaaccgatgtctgaacaccaggcttctaggcagagctccaccgtgtgaccttgggcgcatcacttatttcccccaggcctcagttcttctgaaagatgaggggaagaactcacattcaaaggccctcagctttagcgtcttattttaggtgatctgggcagaagagtctcactgtgctcctctccctttcatatttcctgctttggtaggaagtcatctcaagacttgagtgtataggcatgaggaagtctgctagaggacaggaagaatattgcttaaagaataagagctacagccctgatggaaggggtaaattggcctgggaaaagccctgcctctgctacctgcttcccaagtgaccttgaacttaactctttaaacctcagttgctgcatctataaaatgagaataatagtatcttttttatagggttttttttgttttgtttgtttgtttttagacggaatctccctctgttgcccaggctggagtgcagtggcacgatctcggctcactgcaacctttgcctcccgggttcaagcgattctcgtgcctcagcctcctgagtagctg

SEQ ID NO: 103140 - DNA, 1097 bp, Homo sapiens
tcataaactaaagcgtttgaggttttaaaaacccagaattgagttttctcagagctgctaatctttctagccagctggtgacgaggcttctcaattcttgttacaggatgatgtgttctgtcctcctgtctgtgctttgtctaatttagattctaaatccacatgtttaggacatttttagcgtgtcaaaatttattaccaaagtagtgctgacttcagggaaaaatttttaatggaatctttagtcactcatgttgacacaaggtgcttgtcctagtgcaggaatctgtgtggcaccactaggtggtgccagactgcatcatttttaaagacagccttttctcttccaactcttttgccactgttctcttttttgcttctttgccaaatttggaccgagctttgaaaacttcatataaactttctcttagtgagttatgttgcttatagcttttccctccaccttgcctgttttagtcttcttgtttcaatagttttgatagtttgacattcagataaaacttaaaactgaagcccaaagtaattactaaatgtatctcgactgatctgtggttttaaattcaccaacagtgcatctccctacttgcttaatcatattgattttgagattaaatcagtctcataaatatgttagtcttcagcccacggtagttctcatccatctgcagactttttttttttttttttttgagatggagtctaactctgtcaccaggctggagtacagtggcgccatctcagctcatggcaatctctgcctcctgggttcaagcgattctcttgcctcagcctcccgagtagctgggactacaggtgcttgctaccacgcccagctaatttttgtatttttagtagagacagggtttcaccatgttggccaggatggtctcgatctcttgatctcgtgatccacccgcttcggtctcccaaagtgctgggattacatgtgcgagccaccacgcccagccccatctgcagatatttttaccagtcctatccactcatgcctgtaccttctaatgttattaaagtcagttttattatcattgatgaccatgagacttaatcaaaaggtc

SEQ ID NO: 103141 - DNA, 1219 bp, Homo sapiens
gtaattcatttggttttgaaagacttaccagagtttaaaagctccattttgtggcttcccaaggtgctgtgatttgtttcttactagtctcctttgttctgtggaaaattttcttctttggttgtttgagatttagatttccttgccaaggtatttttagagagaggaaatcagtatgtttcaccaaaggggtaaaatatataccttaaggcctaattatgcaattacatttttaataacgagtgtcataaattcttgcttcattgcaatcattaattggaagactgttctgctcagaagcctcatctagttatcatgattatcatcaacatcgtcaaccaaccacaagcatcaagcatttatggagtatccacagattatgcagcacttgccagggttctgggagacttaatctgtgtgtgtgtgtgtgtgtgtgtgtgtgtgtgtgtgtgtgtgtgtacacccttgccttcaaggagtttgtgatctgcagaactggaggaaagacagaaaacttggggaaagacaagtacctcatttttcaatatgtgtaaagcccatactgattcatgtatgtggcattgggggacatggacagcagggagacaaagggatagatcttagaaaggtctagttacaaataaatggaagcacataagtttgctgacatgggaggacataggctgggttgtaataaggtagggtaattggttgaaggagggaggaagaaattggtgaagagttgaaggcagtaattaaatagatttggcataataacagagatgattggagaactgggagaagaaaattacttgctgtagttgattatggcagaaactgacagggcaagagattacagttgggattttttgcaaagaggagctttcaagtttgtgacatctttttttttttttttttttttttgagatagtcttgctctgtcaccctagctggagtgcagtggcgtgatcttggtttactgcaacctctgcctcccaagttcaagcgattctcctgcctcagcttcccaagtagctgggactacaggtatgcgccaccacgcccaactagtttttgtatttttagtagagacggggtttcaccatgttggccaggctggtctcgaactcctgacctcaggtgatccacctgtctcggcctcccaaagtgctggagttacaggcatgagccactgcgcctggcctccaagtttgtgaga

SEQ ID NO: 103142 - DNA, 1105 bp, Homo sapiens
ataaacatgagactcatcccactagtcctaggttcttggagccccacaggtattgttgcaggatgcatcattgcttcgaatcagtgactgaacaacccagttcctaatcagcgtggagagtcagaattgtcacacgcactgggctgaagctgcatattcagtactgcattgaacattcagtactgcagataggataattatgctgtttgtcagatactagaaaagtgcaaagaacattccttcactttgcaacagcttggacccaagtggcagacctgctgttccctcaggctggcgtgacctccctattgtcagccccttcaccacagctcaactacccccctggctttcaagatacagctcaaacagcatctctcctcaggaaagaccttactcccggagacccaggcccgagttgtgttgccactgtaccctgttctgttagcacttaccaggttgcatttttgtgatccatttacctgtcttccctgtcagacatgaacagggacagtgtcttgtcctcaattcatcatttttctcctgttttgagcacaatgaccaggacgtagtggatgctcaataaaggtttgtcaaatgactgatagtatggttagctcagtgagaattgatggtgccctttgtgatctgtcatccatcatccttggtgtgaagcagggctgggaggctttaaacagtgccacttgagaatctaaggagaggtggcagagttacaattaacaataactaccccttactgagtatttatttgctatgggccaagcactctcttagggtttttaaatgaatcaatgcacttaatccttagatcaatctgctaagacgagttctgtttattatcccctttgcaaagcacaaggaagttcagtcacttgcccaaggtcacacagtgacagtgcagagattcataccaatggagacaaccatcacttatctatattccttttagactagttcctggaaagattaagccctcatgtcctgaggcatccatcttaggtaacaatttaacttctctcttgtttctagaatggtattagtgtgttccctacttgggagaatggagaaaatggtcaccagataactt

SEQ ID NO: 103143 - DNA, 1370 bp, Homo sapiens
tttccacatagcagatggaatagctgagaaaagagattgccattgcttcaggttcttttgaaagtgaggctataggataaacacactacagtatattgatatctattcgtcacctgggtttagataccaggagtttgaatttgctctgggtgactgggtgagtagcttcccctttggcctcagttaggcatccttgacaggacagacctgtgattggactgtctggtctctcatggttctttttctccatgatttatgactttgattatgatttctttatattaaaaaaaaacttgtagtaaaaccagtcttatttaaaggaatactagccttttatcaaagggcaaagtaatgatttaaaaaaaaaatcaacaacaaaatttcaagggaatgaatgtccctagaagctagccatctccccgagttaacttaagaggctagactctcctaaatgaggatgcttatttaccagctttcctaaattagcagctttggagatgttaaaatccgtaaggaactgtccaagggatgtattgtgtatgctttgcagtgattaagccattaagctctaattggtattttcccactcatgggtttgtaaaggaagctttaaaattatttaggaattcagtcctcatcagctgtcttagtgtcatccccacgttttggaacctgagagtggagagtgcagagaaaaggttttattaatgatttttgctcacagtgtccttccccattggtttgttattgcagatgaagtggaaagggaaggacctctttgatttggtgtgccggactctggggctccgagaaacctggttctttggactgcagtacacaatcaaggacacagtggcctggctcaaaatggacaagaaggttgggctagaactcgatgaaactggtggggctgacgtgagctttccagtttttccctgagcaggcgcctagctcatcactggggcgctgtagctgtatagtagagaagggggcacattcctgaattaagtcatgcagaaagcaggacgtagagatgctaccagtttccttctcctcacaggctctcctgggcaagcagaagttaccaggattagactgctgctggccctggcttctttacccattgttaccagcctgattgcttctggctttatgcctttcagtttatgaataaaaacttcatgaataaaaattactgttatcttcatatacttaaaaataaccaatttgtgtcttttagagagtattggggcttgtgttctttagggaattttttaaagtctttttgaggaacaccatagtctgacatgaagtaatcattaatatgatctaaggaatagagagtgcctggtccccagggtgaaagaatg

SEQ ID NO: 103144 - DNA, 1408 bp, Homo sapiens
atctaaataatcacatgggaatccctgctggttgtaagttcaatggtaattcccaatgatcatgagcatctaagtgccactgggggccactgtcagtgagggtgtcgtagaccagattttgaatctccttggcattgccatctagaatttgggcaggagcatggagagttatgtgtcaaagacagcaaaactttttgtatgtttttcatgattcttagcaaagtgaattttaatgatagctgagtgtaggccaaatggatattagactgggggcatcaggagccgtggaacttgctgctcaagggaaatacatcatgacacatgttaatggagccttgtagcctgtcacatggcgtgtttatgtcttgaaattcactctggagagcagatggttcaagctttacaggggtgaatggaattgttagaagatttaaaggcagtggtttacagactgtgcttcaagtattttgtggggcatctctggaggttccttgaaacaaagggttgccatgatggacacattttattctgttgctcagttaatgtttagatgacttcataatgatctagttcatcatctctaagctgtattttttttttttttttttaagacagagttttgctcttgttgcccaggctgcagtacaatgacgcagtctcggctcactgcaacctctacctcctgggttcaagagattctcctgcctcagcctcccgagtagctggaattacaggtgtccaccaccacacctggctaattttttgtatttttagtagagatggggtttcaccatgttggccaggctggtcttgaactcctgacctcaggtgatccacccgctgtggcctcccagcgtgctgggattataggtgtgagccaccacgcccagcgctctaagccgtattctatcacggacctaaatattggcagtaggcaccaagaaaaaagaaataaaggaagattccactacttcagataattaaaaaaccttccacctaccataaaggacagtgtccaagactgctgagtgatacatttctagtttttaactattctgtggccctgagaacatttatgccttaatcctagctctgctcacttcttggggctattgattaatttgtttcagaaacaccataggaagtgaatattacctcttgctataggtgactttgtgaatacttcaaactgtaaaatcacaactttcaggaaatgtgataaatttagtgggaaaaaaatttaatgcacgccttgcaaaggcttctttgagggtagcacaggaggaagtgccaatatagtgtgtttgtcttttgctctgcaattctgcaggtactggatcatgatgtttcaaaggaagaaccagtcacctttcacttcttggccaaattttatcctgagaatgctgaa

SEQ ID NO: 103145 - DNA, 1048 bp, Homo sapiens
agaggagagctggctttcctgctgtgtttatttcagtgtccccctgccacgtcatgcagttgtcttgcttctgtgtctggaacatcccaagttgcaccattctaagaaaattaagtgcaatgaaatatgttaattcaacattatggcttaagaattatatttcctggacctcacgtgtacttaaaagttgaatcgatcaaattttattgcttccttttcccttagagcagcacgttgagagtgatggttttttctgcaatcataactcagtggccttggtgacttttgtcttgtgttaatacttaaaagtagatccatttcctctggggccatgcatattcaaaggggctgaggctgtagtcatccccagagctgctcttgacacttcttgagttcatagcgctctgtcacacagcctctgttgtaactacagagaccgtttttactcttcagcattgatcatgaagagaagagataaggggtttttatgcatagccgtcataccagtaacttctgtgactgaactctccacctgtctgcatcagtaaaaaaaaaattgtaccctttgtcagaaaattattaacaggctgctctggcagccctcattagaacgccgtgaggccatctgttgtgatcagcctacacacctcacttccactcacagagtatcatgtctcccttgttgctcctttcaggtaaagaagcagattttagatgaaaagatctactgccctcctgaggcttctgtgctcctggcttcttacgccgtccaggccaaggtaggctcaaagaagaaaaatgtatttttcctgggcgttaatttgggtcatgggatcactcctatcttctctttctttgggttttctgtacttcagagagacttgccccagaaagtgagatgttatgggacttgtggacttgaagaaccactgtcactgttccagtgtttgtataatcttgtgtgtgtatgtgtgtgtgtgtgtatgtgtgtgtgtggtgtgcagaaattataagtatcgttctaatgaattagaattcattctaagtg

SEQ ID NO: 103146 - DNA, 1863 bp, Homo sapiens
tgttgttaatcacaactttcacagttgtgatttggtgttttaattcaaaagctactgttttggaagtgactgctttctttgagggttagaaaacatgcccacatttccatacaagtgtcacattcttgttagcacatcacccatccatctcttacaggattatgcaactcagttcatagatataatcagctttgtattttcattcaaggataacaaactagcaaggttgaaatcttgacttgtcatcggaattgaattgctccctggagctgggagggaatgagattggtccagctctgttcagaaatggcagttatctttagaatctcaatcgcctgctctccctttcttctttccagtatggtgactacgaccccagtgttcacaagcggggatttttggcccaagaggaattgcttccaaaaagggtaagagattaaattcccttttcaggaagacatagcagatatgtggtctaaaagaaagctaaccaaaggacttgaaggaatattggaagtacatagcaatttaattttaataaatattttgtaatctccagtaaacagtgtgggatctctgttaagaatattaaaaagcaaaggtttttggagttagtttggggtcaccaggactagcatggcctgtaaatgttttttctagcgtggttgttttttcagatgcagttgagcatcattgattcccaaagaggaggctggagcagagtgtattcagcttggggaattgagctgtttgcagtggcgaggggcggatagaggagatgaggtaggggtgggcattgtggtttttaatcctcagtgttgttcatcttattcattagccacagaagcaggcccgccctcccttttgctcctgccgattttacagccctcactcatctgtcactgggtaataaaggcccgtttctcacctctcactctctttacctgtccctcgatggcttctgagcatgtgaaggcctgagatgagtgagcattgcttctgactgagctccgctgtcagaggtggtctctgtgatgtatcgcccaggcagggacaggggcactgccagatgagggttgcacctaggtctgagttatcatgcagctttctgagttgctcctccaatagaatggtgccttatttacacgccctctctctgtgtgactatctccctgggtgtagctttttaaaaatagctttactgttttgtaaaaatgatgcataattataaaagtggcaaacaataccaaatttacttcatgtgtaggttttttattttgctctattttttggtaggtaataaatctgtatcagatgactccggaaatgtgggaggagagaattactgcttggtacgcagagcaccgaggccgagccaggtgaggcccattcattgttggtttacattcctttatgggcttttttttttttttttgccttaaagaactgcaaaactaggacatgcttgttaaacaaaatgcagtactgaagtctataaaagaaaaggggagagctggggagctgggagtaacgttggtcttcagttttgtgtgtgtccttttctagtacgtatgacataaagtaggtatgtgtactgcctgtcaagatatatagacctgtactcactggtaattaagtttaagatttttttttttttttgagacagagtcttgctctgttgtccaggctgaaatgcagtggcgccatctcagctcactgcagccttgacctcctgggttcaagcaaacctcctgcctcagcacccccagtagctggcactacaggcacacgccaccatgcccagctagtttttctatttttagtagagatggggtttcaacatgttacccaggctggtcttca

SEQ ID NO: 103147 - DNA, 1045 bp, Homo sapiens
tttttagtagagatggggtttcactgtgttagccgggatggtctcgatctcctgacctcgtgatctgcctgcctcggcctcccaaagtgctgggattacaggcatgagccaccgcgcccagccaatatattctttaaaacaagagttgttgggacaaaggatgtgagcattttgcattttgccaggtaccaccaaattgttctccaaaaaggctgtacctgtttatacatgcctgtcgacaagtgttatgagagtgtcccaccccccacccccagtctatcctcaacaattgtttttatcagtctaatttttgtaatctaaaaagtgaaaagttgtattatgttagaattccattcccttgattaggaattggtcatgttttcattagcctttaacatttttttctcttcttcaaatcagtttcctaacacttttttttttaaacttaagtgcaacatgcatatggaaaagtagacaaattataagtatacaacttgatcaattattgtaaggtgaaaacaccagaggaagaaataacctgtgtctccctacccccaattcccctttcttcctccccaaaggcaaccagtctcctgatttttaattccagattggcgttgcccatcttaaactttgcattctgttttttgtgtctccttttactcagcatcatgttgtcagattggggtttgtggcatgtggcaatagttttctcattttcattgctgtatagacttccactgtattagtatattaaaaattatttattcattctactaatgatggacagttaggttgttgggttgtcccctgagttttgctattacaataatgtcaaacaatttcccaaagtaattgtaccaatttacgtcaatgtgcatgatttctgatttctccaccttttcaccaacacttggcgttctctcaggctgggtttttaaaaattcattgagagcatttggagattggagagagaaggaagaggacaaggtcatagggagacttgagttaaaatatttcagtatgatacctgtttgggagtttt

SEQ ID NO: 103148 - DNA, 1397 bp, Homo sapiens
acattgcccaccaggctggtcttgaacttctgggcttgagcaatcctcccacctcagcctcccaaagtgctggaattacaggtgtgagccactgtgctcagcagttcttcattaattttaaaggaattattgagcatctgctttgtgttagatttcatgggggaaacaaagatgtagaaaatccagtcttagcattcaaggaagtcaagtaactactcacctgctataataaataagtgccgtggaagagacatgatgacaacaaatgtagtcttccacatacaagcacattcaccctgaccgtctgaatttaatctctataagaacactgctgtaaaggcaggggctgtgttgtcaatatctctgtgtcacatcaggaagcagagacacagaaggatcaagtgacctgtgtctgagtgaagtagcagagattaggagccagagttgctgatgccacagcccccgcctttcagggaggcccagaggctgagtcctgagagcacaggggcactggggagagggaggctccactcagtgacctcctggtacctgcacagccaggacacagactagagagtgaagaacaggaacagcttatgttgctgcctgcagagccccaaacctgagcatatttcctgttttctctttttcatggcaactcaaggaagggaacaccaggcccctggtttccagtatatggttgggatctactcagccatgcttgataagacagactgagccccttaattcaaaacattctgactttgaagtttttgttagtagttagcccaggagataagcagttaggtatttcttttttaaagtacttaaattgaaagttccacatgacataaagctgtatgtgtgccaccgtatggtagtttttcatctcccaatttcataaagtctgtttattgcacgtccacacatttgtgtgctaaaggctccctaaacacccgttcttcaaagaagccaaggattgaaatctcccatactatggcctgacacagtaaactctaatatgccctctccgggggacaggcgccatcatgttccatcatgtcaataactcatgcagtaagcagaccccaagctgacttgacataaaagaagtagtcttggtagttatgcatgacagccatgctgtcaaaacagaaatgttagtttattttaaatgatccattgattctttgtgtacgccctggcatggtgcagagcctgcggtttccccactacttgtggtttcccaatgacagctccagggtttgacagcaaagccaaaaataagctcacaaaattcatgaatagcagcctacacaagagcaacactgcttctaagttaacttggctgaaagctaaacaaaggatcattttctgtcctcagtgtactaacccct

SEQ ID NO: 103149 - DNA, 1031 bp, Homo sapiens
atttgattctattaacagcttttaccaaattattcccatgttcagaaacctgtggtgagctcaggtatcctgtcacatcaaacctaaacccttcttttttttgagataggggtctgctctgttgcccagcctggagtgcagttgtgcaattacagctcactgcagcctcaaactcttggcctcaagcgatcctcctgctttggccttccaaagtgttgggattacgggtgtgagccaccatatctggccgcctctgacttttattctcactgccagcccctacacccaccccttcctccctctcaggctaaacctattatatcatcttagtcaccaaaaagctaataccacacacacacacacacacacacacacacacacacagctcatttccctgtctctaccttatttctggttttgccctgtgcagaatgccccttcacctgccttttagctaccctgttggattgttcttctaagatcagcttcactctctcttgcttatggtggatctactctgaacctccacatatttgtgatttgtaccacccagtgaagcactaatatttgatgtgatttcttgagtaattggctgttgttagcctagttccaactagatggtgagcttcatgaaggtgggcccatgccctcgactacagtagccctccagtgttggcctcagggttgggcccattaaggatgcttattttaggttgtcaagaatcccttcccacactcatgcctaagatggtctagagagcgtacctttagggtcctgagcttccacagcccgagacttggtgctcctaattccctgaggtttagtgcctggatactgggaagccaggacaaggcataacttcatgctggtctgtggccagtgtggttgcgcatttgtggaatttccaattgctggtaacattccaggctgtcggactgaaactgtgttctgcttcattcttccagtttactattaaaccactggataagaaaattgatgtcttcaagtttaactcctcaaagcttcgtgt

SEQ ID NO: 103150 - DNA, 1147 bp, Homo sapiens
gggataagattgaagcaagaagtaattaaatgtgctttaattatttaaggcagaaaatagtgcagtggtcacttctgggttctgctttttgaactcagttagtaccctgggatcacagaggaatggcactgtcttgtgcttgttccccttattaagctcagcatgtggcccaattaatgcagtgatccagaaggcaagggaggtagtggtggctttgtgctgttgccttaaggacacggggctgtgtttcccgcctggctccctcctgtcctaggcctggctcaggagttgtctccacatgaggctgtgcaagtctgtgctgtggctgttgcagctcccccctgtgaaatacaatgtgtgaactattgatgcatcacgtagaatgattccatcttctctgtgggtcagaggcaagagtggagctattgttgatgaaatcagagatgtgagaggggtccatgtggattagaaatggtgagatggcttgcctgcccagatgagaaagctgcttatttctggggctctatctgagggaggaggtcctgcattgcatcccatcggccatggggcagagccacctggggtttcccaacaaaaagcaacattggcaaggtagccatttcagtgcaccgtgtataagaatgcctccttctgccaggcgcggcggctcatgcctgtaatcccagcactttgggaggccaaggtgggtggatcataaggtcaggagttcaagaccagcctggccaatatggtgaaacctgatctctactaaaaatacaaaaattagccaggcatggtggcgggtgcctatagtcccagctactcgggaggctgaggcaggagaattgattgaacctgggaggcggaggttgcagtgagccgagatcgcgccactgcactccagcctgggtgacagagcaaaactctgtcccctccaccaaaaaaaaagaatgcctttttctatccgggtcaagactcaacaggtttttattgtttgttcatttgttcattcaccactagactgtttttcaagtggcacagctttcaactctgcaactggtttagaaggacggggtggggggcaataagaatgaccctggctacctaaaggaaagggaaggaaaaaggtcccaaaaggggagactgg

SEQ ID NO: 103151 - DNA, 2323 bp, Homo sapiens
cctgatggagcagaaggtgctggaagccgaggtgctggcactgaagatggctgaggagtcagagaggaggtgagggggcaccgggcaccagactggcgaggaggctggcgaagggccgcagaccagcctgccctgaggctgagctctacagcagttgtcctcaagctgcttgcccatcttctgggccgtggggaggctcctccttggctgatggtgactggtgctttatccattttggggctggcgctactggttgggcacaggaactcagttccccctccaggggggcctctctggtcatacttgtgtctctttgataagcccctgtccctctgatggccgtgtgtgcaggaaaacccctgagcatatccacagaccgctttcagctgaagagatgtgaggaggctctttgtgcatttaaaaaaagtgtggttcttttctgctttcattcagtggggctgcaggagaacagcagctgcctacctttaaagggaagctagtgcctgcatcccccagcctttcttggcacatgggggaggagggctaggatgatctctgtgactgggatgtcccactcatggccaggttgaaggatggaactgttgtctgtacttttgaaagactattctaggcctgcaaccttcagataaacactgacacattccccacagcttttggctctgttgatttagagcacttgaatttggcttttagctaccaaggtgcattcactacagttttcctcaccacgctttgcatgtcgttctgggaatatggttcctttttgcctgccctgcttcaggccccttactgtattcgggggtcactccctgtgcatgatgcaggttgggccaggtccctgcaccaggcctcacatgccgtgaccacctgagccccataggatgaggatctgcaccagggtgcgggtgccctcagtgactgggctcatctttctgctggagaaagtgggcacaaggcccactggtgttttatccgggggctgtgaagacgcagttcttgcacattctgccctttgcgatccaatataagaactttgatcctccaggttcttcctttgcccagctcactctcacccaaaaataaagcagagaaagctgctggtgccctctccagctcctctgtctcctggctgcagaaggtctggtttctctcattccccaccagttttcctgctcttccagtttagatttaccaactcaaacaaaagtcctcaggaatgttgtccttgcttggaagttctgatttcatgtaaatatccctgtctcactgtcctttttcacctctttgggtgccatcctcagggttagcccaggtccctcctctgcaggggtggggtggtgtcttttcctgctacctgccctcttctgtgaagctgacatctcatcctttccttgcagggccaaagaggcagatcagctgaagcaggacctgcaggaagcacgcgaggcggagcgaagagccaagcagaagctcctggagattgccaccaagcccacgtacccggtgagcctgggggccaccagctggggctgccttagtcctggtgatgttctctttcctcccggcccttcagttcatctggcggtgccttcagggtgaccattcaggcaaacacatggctggatgagaggtgcagagagcctgcagttagggactgggtagaacatcctggtctgccatttggctttggactagttagttgtctctttggttgcctggataacaggcaacagggccttttccagctctggaatgtttttctttttctaagtaatatagtcccaaattatcctcaagagaatttgctctcttgcctcttaatgctgagctgaatgtaatcttcaactatcagtatataccatatatcataattatagttctgggaagggattggctgtacacctcagagtgaattactgccgtgcaagaacgagcagccactctcagtttggggacagagagtcagacttccattaaatggggtcacaaaatgaatagaagcctctttccttcctttcttctgtgcattcagtttggcatttttttttttttcatatttgttcagtgtccacatagtgccatgcagttggaagtctctatcctgacaggtgttctcagggtgcacaggtgcctagaggaggaggacacagcccaccctggaggagcaggagaggctcagtgtggtgtctacactgatgcttgaagggggagcaggaagtagccaggtggagaagagaacatagggtattcagggtgagggcacagatgcacacatggcccagactcacacacagcacagtca

SEQ ID NO: 103152 - DNA, 1125 bp, Homo sapiens
tgtgtggatggattgtaatttatttaaccagtccctcatggatgagtatttagtctgttttcttttgcaattttgaacaaaatgacactgaacatccctgaacacaaatcttgacacacacacgtggatatattggtagaataaattcttataatagaactgtggggtcaaattttcgattttgatactctccaaagaagtcataccagttcatgctctcactagtggtgcagcaactagtacgcgtttttgctgaaaatttttatgatgtgtaacatacacatagagaagtgcccaaattacaactgtacagtttgaagaattttcacaaactgaacatacccatgtacccagcacccagatcagaaaacaggacatccctggcacccaaggagccttctctcagcacccttgcagacggtctgcctcaggccttgagaatgtctcaaatgaatgttccaagcctctgctctttcccagacactgtcctagactcaatacgggatccaaggatgaaaaagaggcagattgtttgcaggaaacttgcaaatagtagaaagaagatacagccaaaaagaaatcttttacagggtggaatcgcagaagaaccattagagaaccgtaaacacagcgttaagggacagcaaagaaaagggttgccggctggctgggaggggctagaaaggctttggtgagagatcgtggtgtttgagaagggccttgaaagagggatggagcatagggaggagaaatgggataggcaggggtacagagatgggaaggcagtagtccaggggataataaacaatactgtctgtgacttagtagggcaaatagtaggagaagccgggaagctagattggggtcctctttagatgaccctttgtgctgggatgaaagtccaaaaaaaaaaaaaactacaccacccctgcttcaggccctactccggttccattgtccaagcccaagcccctcggtgggccggtggggagccctttgtggtggtgcccatctcccaccccacctctccacactgcatggcagactcctggcaccctcactgggcactgccccacccattgccatacttcccgtccggcagaccttctcctggcactgccttgg

SEQ ID NO: 103153 - DNA, 2101 bp, Homo sapiens
ttaagccaaggggtgttatacccagggagctgccttactttatgagaaagcagaatgaaatggaggctattgagaatggactttccctctagtcttgtggtgtctttaagtggcaaggactataaaaccaaactgaatttttaacttttttcatacttaaaaggaagtgtctaggaaagaacctctttgttttaaaagagaagactttattactttgcaaatggtttcatatctttctctactggtattttgagctttcagcattgtcgagattcagaagctaaattccatactaattatcagcccaagagcatacctctctcatttgggccaagcagaagggtcctctcataccaaataatgctctgctcttaactgatagcccaggaccaggttaacacctataaaataggtgttattaagataagactgtccattgagtttaggtgatactgatacagttaattttttattctttacctcagtctttaaaataggcttccagttttatggactgtctctgtttttagtggttaagctgtatctgaaaactccaggggatctgtttctgcctgccttcgttgttgggtacagtaggcagccctgacttctacctctcgactccagtcacaactggcaccgggtagagaattccttttaatagtgcaacctagaaggaaaggcatttccacattccacattcttctttcctctggcttctgtaatttactgggcttcccttccaaaacaaaattattaaacagtaaaggggagttcaagggaggcctcggtcattaaggaaagaggtaaaacgatggctgagccagtgagccagtcagcccttaaatgaactgcctcagacaccccatctcaccccttacccccagccttgtcatctgggtcccaggaacagtctcaccatttccactgctgctgcaatgagcagtgccctcagccacagaaacctgcagtgtgagagctggagagaccccgttccaagccattaaaacaaacaaaatcactcatcacgatttcaggcctatccaagcattttgcagatggcacttatggcattgttgatatcacagggtatgtttttgtttttcttcattttattttgctggtttagcctcaagcccaaggcagaagacctatctgcatttgagccctcaaagtaggttgttcccaggtactctctatgtggtgatggtgctgccctctgtgatactaacccgtgcatgagcttgcctgtctctgtcctcgggccacactgagcccttacgagggcaggtggtgcctgggtactggccgcagcatgctttgagtctaaaagtaggcacccaccctgtgaagccagaccagcctccagggccccagaagactgcctcgttccgaagagcatgtcatggggctgtaggaccagccattcttcccatctcgggtcattgttgggctggggaaggttatggcttcttgtccagtcaggtgtgtctaaaagtcctttgtcttggtggcatactcctagcatggaaatggggtcaatctgggcactttggagactggtgtgtttaactcaagatcaagaccttttatgcgttgacagcctctcaagacccatggtcacacctggcagcttctggtagtggggcaaaagggttgcttgtgctggctcattttcctttagagctttccctttctgcacacatcccttttcttttcaaataaagcaaacccagagcacagggtctgatatgtgagtccacggggagtggactgtctgttcatctgtgctcagccacctctgcttcagcttcctctccataggctgagcagagatgtggtcagagtgaactcacattggaacagtacactcacggcaccctggagaggagcggtcactggttgctgagtgaattaaccgaatgtttgctgcttttctcctgcaacagttcattattcctccagcatgcctaggcagtggagagaatgtattttgcccaataataaaatgacatcctgcctctacttctcacctaatccccagtagtacccatgccaacaagccccacaccacctgacagcagcataggatgtgtccttt

SEQ ID NO: 103154 - DNA, 1034 bp, Homo sapiens
agtcagagcagtgctagcgatcaaaagccgccctggggaacctggaattgtttcattctcagtgggagcgacacgtgtcctggcatctgagccttccgagtgaggggagtgagtctggccatcaggctggggttgagggacacagggtgccttgagcctggctttcgtgccttcagagccacagtgccaatgatgggagtggtggcttggtgtggcgtaactgtaccaccataccttgatggtagaatgcagtcctggaatatatacattcagggtctttctttcatcgcttctcaagagaggggtttcagtctcccgatcctgagctggtctgagtgccagcaaacaaagtcatcacttttgtgcctgtggtctcccaaggagcacaggatttccaaggaaattgacggatgagaaatcatgggggtggtggagcttagaaagcttatttcattagtaaatggtttgaaccgtcaaggtccagctgtggtttccactgatggaggaacaggaagaagaggagccttgacatttatctcaagcgccagcagcttctcttggatcaggaagacataaaagtccaatgtcatcttcaatttgtgcaggctccccttggagttgcagagccagtgaagtgaagtagaacagttaaaaaaacacccggggaagtgataaatcacagagagagattgcatatgcgggaaaggtgtctcccacaattaaaacaagtggccagagcctccctggcgacctctggtctgcattgccagccctgaagatggctcctaaattacttaagtttaataggtagttaatatagccaaccctccttatgaccccagtgggctgaatggctctgcttgctttaggaactgggcgttgtatggtagagcatcttggccttgacataaaaggtagcatactggctccccagccctgaaccttccctgctagagcaaggcaggggtgagagggggaaggaaagaaaaaggagtggggagtggggtggggagcaaggattaacagggagcagt

SEQ ID NO: 103155 - DNA, 1036 bp, Homo sapiens
ccctcggcactgaagatgtgtttcagtgcagctctcctcggcaccggattcgttgctgcaacagtgggagggaagagccagatgcaaactcgttctgcgagcccgaggttctgttctcatgatccttgctgtgatttctcttttgatgttggcaattttaaaatgacatcagtctatctggacctttttcctaaggctcttgctcagaccactcagtagatagccgccacctgcccagtgaggtgaatcaggcccattaggccatttgtcaggggaaggaacagaggagcagcggagggccccgccggccagtgccacagggcagcctgcaaagcaggtagacaggttttcaggcagcttttgctgctttgggtccctcagggattaatacacaaaaagggccccttgggtattcagtggcagatttctcttgagagcagataaagtcgctaataacaaattggatttgttcattggggtggacttggcctttcgttccacctctgtgtaggataagtgtgtggatagtgctcccactgtgcacatcaccatatggcatttgggtgcagctgtccctagccagactgcagaaaagcttgatctgggccggacgcggtggcttatgcctgtaatcccagcactttgggaggccgaggcaggcggatcacgaagtcaagagattgagaccatcctggccaacatggtgaaaccctgtctctactaaaaatacaaaaattagctgggcgtggtggcatgcgcctgtagttccagctactcaggaggctgaggcaggagaatcacttaaacccaggaggcagaggctgcagtgagcggagatcgcgccactgcagttcagcctggcaacggagtgagactccgtctcaaaaaaaaaaaaaaaaaaaaaaagagaaagtaaagaaaagcttgatctggccacttagtacagccatccccctttactggcccttcctctttgcttatttggaagggggaaggtttcccacaccccaaaccaaagattcttttggaatttgct

SEQ ID NO: 103156 - DNA, 1210 bp, Homo sapiens
gggccacccaaaatcctcaggtagcagtgaggaggaacagttgaagatgcagattgcatgcctgggttagagagtgccggctgggtaccaggttcttttagccagcctcttctgtctttttaagtagacagatgtgtctcctgaatctgaacttgtttagattgggtggatgtgtctgtttttgtcacaccacacacaatttggggagcgtaaggaggcccagctctgccagaatggaactctcctaagttctcccctgccgtctcacagcctgctggctgtcacaaacagctggcagttttatggacaagtgggcaggggaaaagggaccctgccggggctgagtctcgatgttgggcaggaagtaaaagccaggacccaacaagtggatcagaggggggatgtgaagatgaacagtcagatagcaataaagcctcatagatctgccccagagaaagaaaaggaagttcgtctcctcagaatggaattggattagtgacagacttgagcagccggttcagtcgagagagaacttaattcctcctgtgttattcacacggctgattctaatcagatgtgaagagacagctggaggagagcagcgggtcagcccatgcctggtgcggaggcttcatgttcttgtaggcatcttcagggaactggcaggagcgctttgggttggagactctgagcagggcccttgggtttatagcctgcccaaggaactgggcctggctgcgggactcccatggttggaccttgtctagattcagtgaaagttttgaaggacagtgcatgacagacgtcactggtcaggttcaccagagcttggctcacttgtcttcagaaggattcaaaggcagttgaccagacttggcaagtcccagactggtgcagccactgtcctcgagaccctggttgtacaccctgaggtgcttctgcttcattacctgctgaaatttggagacctcttcttcctggataaccttcaagatactcattgtgcatgcgaggaattccccgccctcctggggggactccactccccaggcaggcaaggttgggcaaggggagggctgttgctggattgccaaagggagcatggacatttttgtttggaattcagggtgggaatgggactcaccagagtggcttcagtgctcaactcacagtgcaacataggacaaggtgaaggccttcttgggaggcc

SEQ ID NO: 103157 - DNA, 1047 bp, Homo sapiens
catcacgcccgcttcacagtgaggaactgaggctagaggggagcaagtgacctgcccagggccacacagctggtcagtggcccagctgggccttgcaccaggcagctgactgtgcctgtatctgactcaaagtggctgttcttttcagaaacctgagcggagatactgggctcacatgctttcatttaaaccctctctcatttttgccccagtagttatctggcagctaaatctcttcctcctttcttccccagtgaccattctggttcccatcatcacagggcacataactcctggcccttctcctctgattacatttagggagaagcccatcctgatgcagctcccttctagagggagttccatttaggcaaaaaagcgctctccattcccatcagaaccgggctttccaaagggctctgaaattggttccactgaagaaggcagctgagctgcctccccacattccgcttgttagtcgggaacttcaaggccaaaagatttggcaggatttaaagagttgctctcaagctgtctcattctgagcacactaatgctgtctgtcttctgatggtgaagtggtgggtttggagtctccctcccctgccctttatggagccgccgatagtaccgaggactcttcacatgcagactcgaggggtccagagaatgggccagaccatcttgcctgccccatggcaacctccagaggaaagaggctcagagaggtcaggggtgtctgcagtgagctgctgatggcagagagtgagctctcggaccttctcagccgggtgtggagctcttgcctctcccgcgaacctcagtttagttatcttcatagcccacgtcctggtcgcttaacaaacattgagctcctgatcggcacataacactaagccagatatttgggggatatgaagatgaatggtacagactccctcccctccacccccgcactcctgtgggaagtcccggagctggaaatggaacacagtcacacccaaggcattgatttcaggagtcagcagagagcagggagtagggaga

SEQ ID NO: 103158 - DNA, 1434 bp, Homo sapiens
gccaagcccggaggggatgagcagcctcagctggtgccgccacagacagcacaccacagaggtggctcagggaccttggtagatgggaatgtgagaatctattaaaataggcagggatctccggtcctctgtcaagaggcaatgctgacggctttttcctgctggcgtgcctctgcccaccagccttccccttgcacatcctcatttgtcacctcctaatttgaattattgggcaaatctggccgcttatttgggactgacagccaacttcttgagcatctatttgaacagccttccctttcgctcccagccacctttgaggtgagtccaagtggcaggacaggaccctgtgtgacagagcggaggtcttgtgccctctcagcttcttctctgctttcttacagctcaccttgcagagcgccaagtcccgagtggccttctttgaagagctctagcaggtgacccagccaccccaggacctgccacttctcctgctaccgggaccgcgggatggaccagatatcaagagagccatccatagggagctggctgggggtttccgtgggagctccagaactttccccagctgagtgaagagcccagcccctcttatgtgcaattgccttgaactacgaccctgtagagatttctctcatggcgttctagttctctgacctgagtctttgttttaagaagtatttgtcttcctttgtctaatgtgggattcctgactcccttcgtccaaggcaccggtgtgtgtgtgtcttgcactccagagctgacctccaccgcccagcctgggaagtcattgtagggagtgagacactgaagccctgagaagccagtgccatcatccccaccccgcccagggttccggaacattcattcccccaccggtgaggacctggcatgcagcgaagcagcccagcccggcggatcccaggccagcacgcctgccggcttctcatcgtcagggagcccgcccagagctcgtgacgagcaagtgctgggtccccgccaggcaccccgaggcggcgctctggctggcagctggtggggaataggcagggcagctgtggctggggagagactttaggcagaagctgtgatgcaggctgactgccagccgaggggctgggtagtgccgtgcgggagctgatggtacagggcactcgctgtccccctccggccaccctagaccagggtccgagaggcaggcaggagccactcatgtcttccccattgcccgacgcccatagacgctccttcctgtgtggggctggggtactccctggtcgtactgcagtcagcacccgtaacccggctatgaccagggatctgtaagccctgtggctccacaggtgctgcttctcactggcccagactctgagctccaccggcccagtctgcacggcccatctgcttcaccttccc

SEQ ID NO: 103159 - DNA, 1346 bp, Homo sapiens
tagctaggctggtctcaaactcacacctgggattacaggcatgagccactgcacccagccccttcttgccctttcttttctccatggctgatgctgctgtggccagccagggcccttgagatccttccagtttggctgttatgcaaagcaggtgatttgtcttaatcagataaaagatagaggctatgggggcctcaagatttttggagagcagaggtggtctctggcaattccatctggttttgagaaacttagcagctcacagagcacagagatcctgccttcttcctactatcaggctgacctaatggggttgggctgctcggcaactgcttgggtcaccttgccccaaggaaaccagccctgggtgccacccagccacttagggtctacagggtgggactccagacctagagcgtaagtatggatgttgtggccctgtgtcttcctagtgtgacccagccaggagcggaagcttcaggcgtttgtaaagtgaggtctggctctgcctcctccgttttttttttttttctgtttctgtttctgttttttttttgagatggagtctcgctctgtcgcccaggctggagtgcagtgtcacgatctcagctcactgcaacctccgcctcccaggtacaagagattctcctgcctcagcctcccgagtagctgggactacaggcgtgtgccaccatgcctggctaatttttgtatttttagtagagatggggtttcgccatgttagccagactggtctcgaactcctgacctcaggtgatcctcccaccccggcttcccaaagttctgggattataggcgtgagccaccatgcccggtctcttctcagtcttgaagcccatccctggatttccaccaggagttactttcctcctgacctgtaaatttgttctttaacaatggctgcaggtgggagcatatggtggtttataaaaacgctgtcgggctttgtttccttctttagctgccgtgtctacttctgaagtctgggaagtgccaagccacgcggcctcaagggagctggctggtgtttgagctgtggcagaagcacctggggctccagggagcaggctgggaactgcaggaccttgctcagccaggagcacttccccctccttgaggcaggaatactgaggtgcctccccacagatggagaaggtggagaggaggatgggcctcaggagcatctcaagccccagtagcaggagaaagaaagaaagagatgcctggttttcacagactggttcctgtggctgggatgactgcatccttttttttttttttttgagacggagtttttgcctttgtcgcccaggctggagtgcaat

SEQ ID NO: 103160 - DNA, 1069 bp, Homo sapiens
agagcagcgtcctgaccatggtggtttcattacgagcccttctgctggctctcaggcagaagccccacagcaccgggaccattcatgaggtcactgcccagctcatgatgtccgtgaggctgtccttttggccagtagccgtgtgcagctgtgtggcacagatggcttcgttcatcctgatcaaggccccacctcagccacagcagtccccccaacctgtgttgtccaccctattattcatgtacctgccaggccctgctagatagcaccccgtggcattacataacacttcatgagtggctgtgtcttgtaattttggggacaggtttctctctttccctctcttttttttgtcaaaagcccagagactgacaaccagctgcagtgtctaagtgttcctcactgacagggtggggcctcaccacccctggagggagcagcgttggcagggagacagcctggcccagtgaccctgggcccaagccagcccctccagggctttcagggaagcgccatccattttcaaagatgtcaaacgtcacttcttcctgtagggcccgagtcctgcctcctatcagggccagatcatagaaggctattttctattctggggaacgattataacttaaatgattgttttaataaaaattctaagctggaaaatacttgccttgggcttcctcagtttgcctgttgctcaggccattgaggcgtcaagaacacggctgggtggtggggctgtcttgtggttctgtggagaaacgagccctctgctgtctctcactgcttgggccttcacctctggccccttgtctttggtggcaaaagaatcacctccttccacagacctctaatgacaccttcgccagggaactgcctccctcttcctggggcacttggggggtggcaagggccctgcatggcgtcccagcactccatttcctctctgtggtccctgcccatccgtgatttcagaccagagaactagggagctgggctgggtgatccttccagacatttctgttttcggcgttccaggctctgggggtgcatgcagagcccctggggc

SEQ ID NO: 103161 - DNA, 1039 bp, Homo sapiens
cggctggggatgccagggctccccacatcacgtaggaagggcccctggaaatgccaagttgggagagcagctcccagctggggcagattcttcccctcagaaggtggtgggggcagctcccagccccagtccagagtcccctccctgctgtgtccagtgcatgctgtgtgtagggtggagaaccctgcaaggcagggctcagggaaacaccccaccctcaggagctcctcagggcagggaaggtatggggagggggacaccagggggccaagagctgtggatactcaaggatgacctccactgggctcaggggccccgtgaggtctctcccccagcgttacaggggagcctgacttggtggctgctgtgtgtctgccccaagcgtgctgcttctgaccctccggtgacaggactggtattagccaccttcggtcctgtccaggctggagcacatggatgcaatttaggatgctcgagagtgcctgggaaatgctgagtctaggatgggggtgggttgggcaaaccttggttttcaggcctcagacctggagatcaagatcaaggttctagaaagagagaagtttaaggcaggggagggaacatgaagagtgaatgcctccccaggacccctcacccccgaactcctgaccaccccgccaccctcccctcccctcccctcccacctcctaaccacctcgcccccctcccctcccctcccacctcctgaccaccccgccaccctcccctcccctccccccacctcctgaccaccccgccaccctcccctcccctcccccaccacctcctgaccaccccgccaccctcccctcccctcccccaccacctcctgaccaccccaccaccctcccctcaacccccacctcctgaccatcccatgagatggcgaaggggagaaaggtgcagggcagatgggggtggggagctggggcagagaaggggtcccatgaggaccgtgggtgaactggggatgggggtgtccgggccccccagtgctgctcagagttaagaacttggcctc

SEQ ID NO: 103162 - DNA, 1054 bp, Homo sapiens
tggccactctcaatgaaggctccactcacagactgggcaggccaagtgtcagccccagagccctaccctggggactgtctgcctggaggtctgactccttcctcctctcttcggccagaaagggctaagacttgcagccaccccattcccacccttgggtgctcgagtcagctgatggtgctgggaccagcctcagtgttcctggaggactctgctgtgtgtgtatgttggaaaaggtgtatgtcccagccatggtgggcacacagaggggatctaagagagtccgtgcctgtccctcacagggcctgggtgggcctcaggccagctctgtgcagccacattcctaccctgccaactgccctccatgcctccccagggccacaggtccccagagaccttttccagaccttcaaggccttttccacccagctctccctgccagcctgcccttctggctcagcctcctgcacaccctcacgggcctgggccctgcacgctccagcctcttacccccgcagggcctcccctcatgttgcatctgggtccctgagccccctgtgctaggtaggtactttcactgcatcctccatcaccagccccccttttataggtggggaaaccaaggctcagagaggtgagcgattgcccaaggtcactccatgagctgaaggtgcagagactcaaacccagcgccgcctggctgggaagccctcatcttaactctgtgcttcccacctccctgcctggtcctcctttccgctcagactgaccgccccctggatttctgcggcaggcacgtactgtctgcagcattccatcccgggctgcccagctccctcttcctggcacatgtggctcctccgcgaatggcgtcctcccggcagagggcctgggtctcgcccagaccgccctggggcaggagcactcatgaggccctgcagaggcggagagggcagagggggatccgtgccaggaatggccagccctggcattcaaggactgctgaaagggacctggggccgccagagggcttttagggcacctgcagccaaga

SEQ ID NO: 103163 - DNA, 1153 bp, Homo sapiens
tggcactgacagtgtggggctgtgccagtttcttggcccaggaggtagtacaggggccctcccaaagttcagccctggaggagccccctggctggaggctgctcagagccttcaggccccagctctgcctccttcctcagctggactacagttctaggctctaggctggggtggtggacaatgtggccttggtagctgggcctctggtgggagggccagaaggtggggggctgcagggccacctcagatgcccatcctccacgagcttctgcctttcctgaaaatccctgtggaaggaagaactgaggccaagtctcggggccctgagcctcgggttcctcacctgtgaaatgggctggcccagcaggtacatggagaaaagggggtctgggttggggtccaacgagggtcagaggaaggggcccaaggagaagaccaggggcctcctcaggctatgccaggcagcaaggcccaggacaccctggcttcccaccctcccccaggagaaggctttctgtccctgcctgtgccctgtgccctgggcagacctcagggaccagggctgggttggctgtgtggccccagataggctgctgtctcaaggcacagggtgcccgctcctgcccaagggaccacagcagcgactgggtcctgggggttcctgtgcaaatccctccttaatttcccaggagcccctggatggtaggaagagtgagtgctccttacaggccagggtggggacagggtggggctggggaccatcctcagagccaccacccggccctccacagccaggccacagctccaggtgaggaccgtgggtgggtggggagggctcgctggatacccaggccctgaagtacacgcagatggcggcccagggagccggccaagggagaggtctgcaggcggcggtggtgtggggcgggccacgggcaccgcatgcggtggatggggcatccaggtggcgtctacttcatgccactgcgcagcacctggttggccgcaatgagcatgacactgatgatgaaggcgatggcgaaggcgcagatgagactcttgcgcacgcaagtctggcggatctgctggttggagcaggctgtggccgcccgccgggagcaccggggagacagaaggggacatcaaagcgatg

SEQ ID NO: 103164 - DNA, 1052 bp, Homo sapiens
tttaaaacaatacatgccaaatatagaaactttaaaaaatagataccaaatgaaaaaaatctggacataatcctattaagttttcttttcttttttgaatgaggtcttgctctgccacccaggctggagtgcagtggcatgatctcggctcactgcaaccttcatctcctgggctcaagcgatcctcccacctcagccccccaagtagctggaactataggcatgcatcaccacacccagctaatttaaaaaaaacaaactgtttgtagagatagggtcttactatgttgctcaggctggtctcaaactcctggacttaagcaatcctcctttcttggcctcccaaggtgctgggattacaggaatgaaccactgcgtccaacctaaagcaacaaacttttattttctcatactgtttctagggtcaggaatctgggcgctgcttagctgagtggttctggctgagtctcttgggaggttgcagtcaagataccagccagggtggagtcttctgaaggcttaactgcggccagagggtttgcttccaaatgtattcacgtggctgttagcagggggtctcagttccttgccacgtgggccaccctgcagggctgctcacagtgtggcagctggcttcccccagaccaagtgatcagagaaagaagacactgagatggaagcagcagtgtcttttttttttttggagatggagtctcattctcttgcccaggctggagtgcagtggcgatctcggctcactgcaacctccgtctcccaggttcaaacaattctcctgcctcagcctcccaagtagctgggactataggtgcacgccccacacccggctaattttttgtattttagtagagacgaggtttccccatgttggtcaggctggtctcgaactcctgacctcaagtgatctgcccgccttggcctcccaaagtgctaggattacaggtgtgagccaccatgccctccctgcagtgtcttttataacctgttcttggaaatggcataccctcacctctgctctgttctcttggtcacat

SEQ ID NO: 103165 - DNA, 1046 bp, Homo sapiens
gccaaggagtcttgtctttttctagttgcactaggaggccattgaagggttttcaggagaaatgcgacaagatttaatgtgcactttaatgtcatcatcctggctggtctatggagagtggaccgcaagggggaagttattgtagtagatcatttgagggaagatgggtggttatttatttgagatggagtctcggtctgtcgtccagactggagtgtagtggtgctatctcggcttactgcaacctccgcctcccgggttcaagtgattctcctgcttcagcctcccgagtggctgggattacaggcgcctgccaccatgcctggctaatttttttttttagtagagacagggtttcaccatgttggccaggctagtctcaaactcctgacttcaggtgatcctcccatcttggcctcccaaagtgctgggattacaggcgtgagccaccatgcccggcctgatgggtggtaatttaggttagggtgtggagcagggcagtgatcagatttgggatgtaatttgggagggagggcagacagagcaagctagcagatgtgtgtagggtgcacaggaaagaggaattgaggaggatatctaagttttttttgttttttgttttttgtttttttttgagacagagtctcactctgtgcggctggagtgcagtggcacaatcttggctcactgcaacctctgccacccatgttcaagcaattctcatgcctcagcctactgaatagctgggattacaagcggatgccaacacgcccagctcatttttgtatttttagtagagacaaggtttcaccatgttggccaggctggtcttgaactcctggcctcaagtgatccgcctgccacggtctcccaaagtgccgggattacaggtgtgagccaccgcgtccagctgacatctaagttttgacctcaacaatttaaaatcaacagaatgatcttaagttctgttttggccacatcagtttgagctagccaacagacatcaagtggaggtgtctagaggcaaatgaggacatggatctgta

SEQ ID NO: 103166 - DNA, 1080 bp, Homo sapiens
gaaaagagactaggactcgcccctcgacgtctcgcggaaggtacctggctccccggtggctgcagctccgggctcctcctcctgcgtcctcgcgtcgcgtactgcttgctgggattcgtagtctcgccttggccatcagttcgcccttcccagagagctttgggaatctaagccgggactgggcggagggcggggagaaggtgatggcgcgcgagggcttctgggagttgtagtttgacatattctaacagccaggaattctggagaagaaaaattgggtaataaatcttatcagattatctgggctgtcctgatatgaaccttttgagtttttttcctcattcccaggataggaatacctctgtggttcaaaacacgaaggctgagattcagaggaactacaaatcccataaagtgttgcacgtctagggcctttggggaacgaggtcggccccagcgcaggcgcggtggcgcgagttggactgtgaagaaacatggcggccgcgacgttgacttcgaaattgtactccctgctgttccgcaggacctccaccttcgccctcaccatcatcgtgggcgtcatgttcttcgagcgcgccttcgatcaaggcgcggacgctatctacgaccacatcaacgagggggtgagggcctgtgccatccctgaccttggacccgcctgaggggtgacagtggagtagaggtgggatgggactcagtatacttttaccaggaagggggtaaggggtaaaccgtcggcgtcttctgtctcgagtccgccgtctgtccccttggcttgatgtgaattctaaaacgttaagcgaggttaatatatttcattttgcaggggttgtaagtattgctgtgtgccaccctacatacccacttgcccattatcagaagcaaaaactaaaggctagtgagagcaaaggacttactagctgcacaggaagccaggggcaagtcagggccagaaacgggacccctgtctctcagagtttcaagggcagatttgagcaggcgacggtcgtgaaaaggacgttagacaccttagacgccgtggctgaagtttcagacggc

SEQ ID NO: 103167 - DNA, 1006 bp, Homo sapiens
gttttcaggtggaatgttacagcgattccccaatacagatccaagcagagctgtcccgactgaagagaggactggagactctcccggccccatttcagtctccccctcaaccccacctcaaattctggtaacctcagagaatccaggggctggagcaaatctggcttgaaaggcttttggtttttcccaacctcctgagccctcctggcggccccatctcacccaaccaggttccctcctccttgtggctcttgctcctggttgaacctcgtctttgatctcatttctctccacaccctcaggccattcaccatccctcaggtgctgagaaccaaagtgcctagagaagggcaggaggaggatgacgacgatgaggaagacgatgctgacgaggaggctcccaaggtacctccctggcaggtagcagatgaaggggagagtgcagttctgaggggtgaatcagaagggcccctcacccctccctatgtctggccctgaggcagccccagcatcactggcagggacaggaggagtccctttgagcccaggatgtctgcttggagagctactggcttagaactaacttctgctgcccactagtgaggacctaggggacagattaaaggcagggcctctgagccaccagcttcattattaggcccaggagcctaggagtcaggagaagggcagttagcagcaccatacccaggatggcaattcttaaaatcagagaggagttagagcccaagggccctgggaggtcatctggatcggtaagttagaaaattctactttttagcagctaaactttttatttgaatgaaatcttaactagaacctcaacgtacagaacagataaacgcggtactgctcaggtgacagggcagcaacctgggatcatgccccacaccagggtgacaaattcagatgtttctggggccaggtcaccaacggcaatgagtagcggggcctggtggggactgcgctgagcagtgggaagcacgtg

SEQ ID NO: 103168 - DNA, 1013 bp, Homo sapiens
gaaccaagttcattccctttgtttccagggcttccgttcagcacatttcgtgttgactggtctgtcatctccactacactgagttcatgagggcagatctctatcttcttcatttctgaatctctccccaactcagcctcataccctgcccggcacagagaaggtccttaataaagactactaaaaaaaaatacaaaaaattagctgggcttggtggcacacacgtgtagtcccagctactggggaggctaaggcaggagaatcgcttgaacccggctggtggaggttgcagtgagctgagatcacgccactgcactccagcctgggcaacagagcaagagtccgtctcaaaaaaaaaaaagatgtgaagggaggcaaaccctagcccgccatgctgaaggctgcagtcctgacctgccctggctgccaggcagatagcctgacagactgagatggactcagacgcctgcctctccctgcaccaaaagccagttaatagaagatttttatggaagctctgtttggctttgtgtcttttctttttttttttattatcttacccttgatacattccagagacccgatttcacagctaagctggattttcttgcctggcatctcatattgattttcccctgcagggctagaagctacattccacaggcctgggtatgtttctgacaagccaggttttttcacaggtttgcaaagccgtgagttgagaagcctcagtccctgccgaagctgtgctgcagctcacttgtgacccaaacatgttccttctcccacccaatgcacccgagtttcctcacctgtaacgtgaccagagttgggcttccaaacattttcttccagtgaaattttacatggaaacttgagctgtggaagagacagaaggctgctgtagtgaggtgggggtgataggaagaggactgggaacccccttttcttataccccagatatccctatggctcccttgagctcagtcagaaagccacatgtggccttactg

SEQ ID NO: 103169 - DNA, 1191 bp, Homo sapiens
ctgcctgcaggttcctccgggactatgatgcactcttccccgtggccgaagacatcagcttgctgcagcaggcctcatcagtcttgtatccttctaccatagcccactacgacagggcccagcttgactaggtcagaggtgagacaggctgctggaacccagaggagtggaaagaggtttagccccagaacgcatgggtcagccagctgtccgaggtggcctgccaaggtcccagccttgccttttctagaggagatggctgctctgatgcttggggcaggggagatgcagtgctattttccgtctgtgtttcctgagtatctgggcctatgtgaccaagatggactcagcccctcctcacagcaggaggggaggtggacaagtaaacaggcagttagatagagtgtcacgtgggaagatttcagagggcaggaaaccagaggtggcgcctcacccagcagagctctgggtgggggtctcagatggaaatgatgtccaagcagaagaacagcagaaagaatgggagagcaccaagccaggagcaaggacaaggacaagaatgttcgcagtggacagaggacagagaaaacaggctccttagagccacagacgtgtatagagtacagggggcagtccttaaggaggggtctcccaagaggaggaattggggtgttgcaggtgaggtgaaggccagcaacgtgcacagccctggggtgaccatcactaagaagtttgggctctgtcctgcaagcgctggggagcgcggaaggttgtgaagcaggaagtgacatgggcagttctatactttggaaaagctctgtctggcccagggaagagaatggactggcccaggaccaccgtgaggctcgggccagtgaggaggctgttgctggcatccaagcatggatgatgagggtttggacaagaagcagtgagggagtctaaggggactctcagatttctggcttgacagtgcccagggttgttaacaaggaggaaggacagggaggagcagccagcttatgggtcatttttggtggttgcagtagattgctcagtcctgcttcagggaaacctgatggcccacagcctttgcagaatgccctcagctggttggacaggaagcccagtggcagtggccctaccacgccctcctcctggcagtcagtacaaaagaggagctgctggctc

SEQ ID NO: 103170 - DNA, 1031 bp, Homo sapiens
atcctcaatagcttcccagcctacttttcagagttgtcatgagaaccaggaaagtgtgtaagaaacttagaagaaagtgttttgtataccctcttcaagatgtgaaaaacctatggacttaatattcttgtcctgcctcggatgttccttctttgcatgatgtcttcagattcaagagttggttttcctttagcttagaagagggaactgtattatcttagaactggaagtaaccctagcggtgattgggtgtaaggccattggagtaatgacctgaggcttagagaggttaggtgactcacccagatcgtgctcctgaagatggactagccagactttgcctgggacctccagtgttcttttcctcctgtgtaacatcctgcctgtttgggaccctgactgttttaatgttgtctcaggtgctctgcagatctgtatgtgtggacagaggagaataatgcagtgtattcttttggcaacaggaattaaaggacattgttctctacctttgtgatacctgcaccacactttgggcctttctggatatcttccctttggcttgccagaccttccagaagcacgacttttgttacaggtaaggcggtagttctggctgttgaaatagagatactggcttatgtactaatttaacaaatatttactcatttaacaaatatttactgggtgcttagaatgtaccagtccctcttccagcctggggatgcagcagtgaaaacgacagataagcctcctgcttgtgtggcgcctgcattttagaagcactcctgtttttggccaagaccaggatagggcagggaaaaaaaatacacacacacatacaatgggctgggcgcgttggctcatgcctgtcatcctagcactttgggaggccgaggcgggtggatcacctgaggtcaggagttcaagaccagcctgaccaatatggtgacaccccatctctactaaaaatacaaaaattactgggcatggcagcatgcacctgtattcccagctactgaggaggctgaaac

SEQ ID NO: 103171 - DNA, 1048 bp, Homo sapiens
gtgatctacttggcagtatctccattcaccctgggtttctgaactgctttcatctgagaagggacatttcaaaggatgccattgctattccttacatttttattatttctttaggagatcaaaagttacatcgtcactgtcattagaatcagatgaaggtgaggaaagggacttagaagaccccaagaatagagtatgaaatttgatctatactgatgcatgtaaaacctcgctttactcaggctgcagcactggaaggatcatgagagggtgcctccccagtgcgaagtggttgggatgctttggagaacatggtatggccctgggggttgtaagaggagacctctcctaatgcctgggtcaggaggcactgcgtggaggaggtgacacctgccttatggtggagttagctctaggaaggcactccaaacagaaggcggggacagggatggttttctgaggttgagaatggtgtgagggaggagtgtagtgtagggaagggggaaagggtggcctgggataccagcagaggccagatctcacagggccttttgtgccatggtcaggagtttggacttaatcttgagggttttttttaggaagaacagagtttggtggggagatagctctgtctttccttgcctatcaggagtaggaagtgggtgcagatggtctgggcacaccttcacaggttatgggatcagcacccatctggaggtgggaggtgctgagcaagtgcgggctggtaaaactcagctttctggaatcaagaaatgcagtggcatccaggaaagtgcttacagaaagtccagccacctagtgacttgcttactcacccagccccatctggtttttgaactcattcatttttcaaatcctccagggtccagcaagggctgcatggtcatcgataaggaaaccaaggacagacctgcccaaaggcagagaacacctagaattcagagcatcctgaccatcagccagccttagatgctgggattacagggggccaagaaccctggctgcttaagggcattggcatttcaca

SEQ ID NO: 103172 - DNA, 1037 bp, Homo sapiens
ccccccaactcagcctcccaggtacctgggactacaggtgcacaccaccatgcctggcgaattaaaaaaaaattttttttagtagatggggtctcactatgttgttccagctggtcttgaactcctggcctcaagtcatcctcctgctttagcttcctgaacagctgagattacagtgtaagccaccattctgccttgggagtgtattagtattatgcaattggccatgcatcagacataggaatggggaagtttcctttggcgacgaatgtaagaacagcagtgataactaagctaacctttattggagagtgttccggggacctggcattctgccaagcactccacatatgttatgtcaattggatcctcacagcagccctgtgagataagtgctgtcatcatccccacttacagataaggaaactgaggttaaaatgtaggggacttgcctgagaggatatgactaataagtggcccagctgggacgtgtgtaaacgtagacctgactctcaagctcttgctctgcaactccctgcttcagggatgatggcactgtgtcaaaaatgtcatgatttgcattgttgctgagagcaggtagggacagagttcagagagggctcttctgggttgcaaaaggaacggacattagccgttggatcccattagcaggcagaggggagaaggtttgatcaaaaacaagcagttttttttagaggttcctctttatacgcacacacacacaaaaaaataagaaaaaaagagaaacagaagcactgtgggacgttacagagggagcgccccagtgaattcctctttgaattgtagctcatggagctgggcctggcacagaggggtgctcaccctggacgcccttgccagctctcctcacctggagactgtaggacacagtcttcgaaatacctagttacaaaactgagttatcccttataatggtcactttcctttattctttcctttttttttttttttttttgtgtattgagatggagtttcgctcttgttgcccaggctag

SEQ ID NO: 103173 - DNA, 1073 bp, Homo sapiens
caaaacaaaagtaatatatgaatatatgttctttttttttttttaatgggaaagtctattcaagccacaattcaccaccccccgcccccatcagagataaccactattagctttggggcgtcatctccccagcttcttttttaaaaatcaataccagtgtgtgaatatacttacactttttaaagaccgaaaactatgctctggtttttcttcataacaaataaatcttttgccttttactaaaaaaggaaaatgaaaactgattatattaaacagagagttttgtatcctgctttctcttcccttaacctttccccgtgtcattaaatccactccgaaaacatggattttaattaccgcctagtgttcgctgaatgcaaccatgccctctttgttagatacacttggttctttatgcttaaaagctccttggagggtcaccggttggaacagccaagtgttgtcattgctgtgggttggcaaatgggccctcgctgactaacctctgccacgttaacacgtggtttttggatccgtagcaccccgagcagaaggcagaccggtattttgtgttatacaaaccgccccctaaagacaacattcccgccctagtggaggagtacctggaacgcgccaccttcgtagccaatgacctcgactggctcctggccttgcctcacgataaattctggtgccaggtaacattctatcaaaattaacgctaagacaaagcacatgacatgccattggttggttgctgttgttgtttttcttcccctaggaggtgcttttttgtctacttctttcactggatccttaacagcaaattgtggttcggattgctctgtcttgtatcacaatcttaatgtttacacacctttcaaagtgtcaattttagaatcttgtgtttagcccttggctcattcatacctccttggtcccttggggtcggagtgtttggaatagggcagggctgatgggcattgagtccctgcacagtccacccacaagcccctggggcctaagggataaatcctcgctctcctctgtctcctggtttaggtgatctttga

SEQ ID NO: 103174 - DNA, 1120 bp, Homo sapiens
taggctgttccatgagtgcagagccggggccgccgatccagaccagtggggtgtgtaggggcagggaggctttggcctggtgggagggtacgtgcagcccaggagggcttcctgaaggaaagggcttctgaactgggtattgaagggcaacttaacactagctgggcagagcaacaggagaaggctggacctggtaggacaaccttagtatgcagttctggagtcttgagagatcctgactcttacactaaccacaagtcacttgaggtggcaacagtatagcagagttagcaagtacaggcttcgtgttcatttcacacatatttgaatatttgtctttgtgtctttgggcaagttattgaacctctctaagcctcaaatccaaaagcgataataataggaccagctttgcagggtggttgtggggattaaatgagatgcctgtgaatgagcactgtgcctggaacatagtaagcactcaataaattgttattacaatggtgatgacagcagggacaacaacagcagcactaaattgggggtatggtgggaaggcagatgagttgagggagacagctgcctgatcgaagaggggtcttgctggcagactgaagagtgttactctgaaggccacgggcagctcctgaaagattgtactaagatatgtgtccaccctatatttgtccctttagtcttggcttggggcatgatctctagccaaagggtagttaccacaccaccttttcagggtaattggtagagctaatgttggttgaggatctatttgaatagcacatacttgaagacccaaaagaaatagtcttgtggccaggcccggtagctcacgcctgtaatcccagcactttgggaggctgaggcaggtagatcacttgagcccaggagttcaagaccagctcgggcaacatggcaaaaccattttttttttttcccagacagagtcttgctctgtcgcctaggctggagtgcagtggcgcgatctcggctcactgcaacctccgcctcccgggttcaagtgattcttctgcatcagcctcctgagtagctgggaccagctaatttttgtgtttttagcagagacggggtttcaccatgttggcca

SEQ ID NO: 103175 - DNA, 1228 bp, Homo sapiens
gcgcaacccgggtccggcttcccggcggtagtttgctcggctctgggggcggggccaggccgagacttcctgtctgctcctgcggaatcgcagtttgaccccggaagtgcgggcgctcagggagctgtcaccgtggtcggcggcggcggcggcggcggcggcacagagccggtggtggagccgccgaggtgagtgcgtggctggtccctgccagatgcagggcaagggaccccggaggagccgcggctatgccttgggcagccttggctctcccatcctctggcctccattgcggggcccacgcttacgctacctgaggggttgtgagccgcctctcgagacttggccgccagggtcaggagccacgggttcgaagttcggccccagagtggcgttggaccagccacgatccccccacgtcctcacacccggggcttcagtttcctcagggttcattcattcgttcagcaaatatttgtggagtgcttcctatgtgccagacacagatctagacattggggatacaaagaaagcaagacagacaaggcttctgccctcatggagcttacagtctagtgggaggagatggtcaacgacaagcaaatgcacaaggtcattaaagctatgacagtaactgggagagtggatactataggcagagccatcagaaggtctctgaggagagtagtatttaattgagagactagaggaatgatgacaaagaggctgagggagcagtagccccggggatgctcccaggccatattgcaattgggtgcttgtagggagctccccctccctttcttagcttttggcttttgctgtcctgcctggcaggggaatacagtggtgggcacagacatagtcatgattattgtttgtccttttggagctcaaagttcagattgtccagttaatttattttttccccccaagacggggtcttgctctgtcgcccaggctggagtgcagtggcgtgatctcgtcccactgcaacctccgcctcccgggttcaagcgattctcctgcctcagcctcctgagtagctaggattacaggcatgcaccaccacgccctgctaattttttttttttttttcggtagagacggggtttcaccttgctagccaggatggtctcgatctcctggcctcgtgatccgcccgccttggcctcccaaagcgctgggattacaggcgtgagccatcgcgcccagccctgcctactta

SEQ ID NO: 103176 - DNA, 1032 bp, Homo sapiens
tgtgggagtgggaatgggagctcggcggccgagctcggcccggaccctagatgcgggggaggcggggtcccgggctcgggctgccttcccagacctggcggggatgggcccgtgcggctctgggtgtgggacgtaccctcggagcgcccggagttattcccacgaactcccgggaggtgggtgtgcgcccttcgccccctgccgggtctgtggcggtccatcgttgccggatactggaggtcaggggccatgggagccccggggcgaacggtgcgggcctgggccttgtggaaaggaggagtgaccgcccgatcgtgcagcagggcatccccctgacctggtagtacttaggtgggtaggatgattgggggcggttggcgtaactgagggaaccctggtcagactgctccgcaaatgattacagtgttatttctccggtagtaattttgcttgatgtatggcatttccggacccataagatgatactgtaggttgtattttggactggaaaacttatgtcaaaattatggggtagattttttggccacattaatagactcccctggaatttgataatctcacttgtgagttttggacatggactgctattacatattgatgttcaaatgtcctttccagacccaggcctaaattcttactgttgtagtatcttgattctgacatctatttttccacaacccaaacaaacaaaacaaaacaaaacaaaaccccaaaaccatatacttttctagttaaggttcaactttctcatatgtgaatggtaatgccataagaggcctgggttgaattacaggagattattattatttttttcaatgtgaaatgtttgtgatttgtccatggagaggtggtggggaccttcccctttcagattcagggctgttcagtaggacaggagacattgatggcatgcagaaagtcttccctttatagggcctatgacttgggtaggctagaagagcttacagaatgacactttttttttttttttttttttttttttttaagaca

SEQ ID NO: 103177 - DNA, 1142 bp, Homo sapiens
ctttaagaatttaagaggtggagaaggggaagcatgagaaacttaaagagatgcaaattgagcatctcttaaaatataatggatttatgtaggggaaacagatttgttgccaaaagttaatttgcaaacaagttattaggaacacacttgataaaattagatgctgattaattggagatatactgtatccagagatatattgaaggatccagaggaaataaacagagaaggagagggagtaagtcggcttctggctcataaaggggtccactgaagatgcttcccaccattatggttgctcctaaaccatctgactcagatttctagtggagggtaggatgggtgtgttagcaatcatttgagacccgggttgtgaaccaggaagggttactatgtattgtgaaaagttcttgagatttgccgcaggccatgaggagtggtaaagtcagtttaaaaatctgctgtagttctagttaacacgttcacaccttcttcagtaaagtggaatgctgttaccaaaggaagtattcgtgttttagaggggggtgtggtgaaggttcttacaagtttggaagaggtggaagaaaatgttgttacaattgtgtagagtagtgaagggctttggtaaatatcctgtcaaatcatagagtagtatttttagagttgcacccagctgtccattagaagagccagaggccttgtctgttttgttccctggtgtccccagtatccagcgcagttatccgcatattctgtgccctcagatattttttaattaagtgaatactattgatatgggaaaaagaacagttatggtggtttatagcagtgttagttattaaaagctacctgatattttgcaatggattaaagagccaatttttgatcaaatagggctctgggtaggaaagaaaatgaaaatgaagagccagctttcagtgcttattgtttggaatttttgagattcctttaagaaattgttttctaaagactgtcatgaacattatcgagtcccctagtttttgagtcttaatgaatcttaagtgtttcagatgttagttacttttttaagagcacagtaagtgcaaaggtagtatagaatagtgggaagttctggattgacagacatatattctgattcc

SEQ ID NO: 103178 - DNA, 1046 bp, Homo sapiens
aagtgggtagatagtaaatcttgggttcaagcctgggttgttattcttcattacccatgttgtttctggcaagctacataacccccctgagctccagttccctcattagtgaaaggaagaagagcaacttttctacttttctaacagactgtggatcaaacaatagtgtatatgaaaagcattctaaaaatgtaaggggctggtattagaatcgtattgtattagaatcctattttatgtctttgaagaattggcttgtggagcagtggtaaacctagtctgtattgtcaagtgcagaatttaccaatatcactgatatggcaacagagaaggtttctgcttctgtactctggctggagaaacctttcagcacatgtatcctgtctgccagtcggaatagtcacaatgttgcagggacttcagaggaacctgggatgtctcacatttatgccaaggtctctacttggaatagacttggctagatttcacccattttcttatgttggagcagtggtagaaggtggtaggagcaaggagttcagcacattctgtgtaaagttctaaggctgtgtttttaagtagcaggtggcagtgtcatagggtaatgaaatcaatgtacttatttaaaaaagcattttcagaaagagaatatatcagtacattgcataaagtaaaagtaaatatagacacagaggtattgtcttgatgctgatagctgcagatattcagaatgattctgttacaacagatggtagcaagcttttctgatttcacttatctggggtctaaatctaatttctttagtagttaatactgttttgttttgtttttttttttggacacagaatcttgctctgtttgcccaggctagagtgcagtggcacgatctcggctcactgtaacctctgcctcccgggttcaagatttgggaaacttttgtttctttttaaaagatatttttatgtatgtatacttggttgccgtgtaaaatgtattttttctttttaaaaattataattttcattttttgtagagacagggttttg

SEQ ID NO: 103179 - DNA, 1041 bp, Homo sapiens
tggaatgcagtggtgtgatctcagctcactgcaacctcagcctcctggttctagcaattctgctgccttagcctcctgagtagttgggattacaggtacctgccaccacgcctggctaatttttgtatttttagtagagacagggtttcaccatgttggccaggctggtttcgaactcctgacctcaggtgatccgcctgccttcgcctcccaaagtggtgggattacaggcgtgagccactgcacctggcccagaacggttttagtgttttttaaaaaaaaaagtagagatgacctgtaatcccatctggatgtaatgtttggtatttttgttttttttcttatacatatctattgaaataattttaaaaagaacaactttccctgtaaaattgatattcccttaatgagcatttagtgtttataatatggatgcatcatagtttatagcagttctgtgttattaatggatattgtcaatttttctcttaaagcagtactgtgatgaactcgtttggacattgaattgcattgaattgttctattattttattatttccttaggataaattctttttttttttttttttgagacagagtctcactttgtcgcccaggctggagtgcggtggtgcgatctaggctcactgcagcctctgcctcccgggttcaagcgattctcctgcctcagcctcctgagtagctgggcgtacaggcgcatgccaccacgcccggctaattttttgtatttttagtagagacagggtttcaccatgttgaccaggatggcctcgatctcctgacctcatgatccacctgcctccgcctcccaaagtgctgggattacaggcctgagccactgcacctggcccaggataaattcttaaaagtgggtttattacctgggcgtggtggctcatgcatgtaatcccagcactttgggaggccaaggcgggtggatcacctgaggtcagcagttcaagaccaggctggccaacatggtaaaaccccgtctctactaaaaatacaaaaatcagtcgg

SEQ ID NO: 103180 - DNA, 1025 bp, Homo sapiens
ggattagcctgagcctataacaaactttccatgatgattcttagattaaaagataatttttttcttgagttagaataagttgcttttgatctgtggctgcctgccccccaacccctataaattatgacatcaggaaacaaggctttttgtattagaaaaaaatggggaaattaatttcagttatttcatgtgggtcattggcagagaaagataatactaaaatcttagagactgtgaaaagagattatattaagcaacttgagtgattacttttttgccagttaaaagaaatgagataatttatattgaagatgattgctatatacagtgctttgcacaaaaggccacatatctctttttaccttaggtaacatgatgtataagctactttcacatatatcttcttaggtcatcacaaggatttgagatcatcatttaatcaggactgttgtgacttgcttgagaccacatgcctagtgtttgacatcatatttcaagaggtagactgaaagttctgcagaaatagggactggtggctgttctctcccttactccctagcagttaatacattgcctggtacagagtaagctgtcaatatttgtggactatttaaactcctgcatatttatttacacatgtaaataagttatagcattgtaaaaccaacaggtatattttccgtagtgagattgttccttcatcttatgtgcacagaaaatattttcgtggaagaggtcttgaattttagatcaacctttcacatatccctttactttctcttaagatactttcatggtgacaaaaaaaatactcttaatgtcattcctttcactgtgtgtgtaactcctgtggcaagactgtatatttgtatgtatgtatttgtttatttagtaggctgctatttataaaggaaacatactcattagttggtctttgcgtacataatggttcccaaaacatggactccatggtttgctgtgagtgaatgaaaaagagcaggtatgattcccctcacctttgtcat

SEQ ID NO: 103181 - DNA, 1033 bp, Homo sapiens
actttgaaggagtcttctgaaatgcagtgttttggccaccattccagctctacaggaatatggtttcatgataaagccaacaaagagcacactggcagcagtccagcagctgactcaccaaggagtaatgatagacactttgaaaggagtgacctgtctcaggatctcacatttcaaagcttcgtgctatgattacattggtagaaggcagccaagaaatctagatgagatcttgcttgtacctcctaagagtaatggtatataggtaggaaggacttccacagtcggatgcaagtaagattttttttcctaacaaccttgtaaaacctgggggtgggaaacaagttgaggattcagaatgggagtaaccgtggtggaagctttccttctacggacctggatgagaacagccttatagtgactgagggtaactcaagaagctcaatgccatattagttttctagagctaagggaatatacatagtttagtagtaagcacaagtatcgtgttcatgtcagacactgtagctactgcttcctgctagaacagaccagaagaaaccaaagcaagaccagaatcatttcagttttgaggaacagaccctttccttactagcattgcacactttaggagtaaaaatagaatgaaagtggatttgcttcagtactctgaaatagttaactgttgattgttttggtggattagagtgattgcagctctgtttctaaattgaatttcatggctatacgttgttctaggtggcaaattaatcttttatcagtaccacaaattgattgttggccctttgcggaaatagcaggaatatgtctttttcattttgttgaagggtagctcagagataaaacatttacataatctgaaaatatttttcagagataagactaagtgactgtgtataccacagtgatagattgatccactttgattattgtagaactttctatttctcagtaaaaagtgctaaacatggtaaaattatgaaggattgcttttagctatttgctgtattct

SEQ ID NO: 103182 - DNA, 2213 bp, Homo sapiens
ttctccagaatgtgcttcccaaaagttaagagtgcttttatttatttaagaaatatgttaatttttcttttcttttcttttctttttttttttttgagacaaattctcactctgttgcccaggctggagtgcagtggcacagtctactgcagcctcgaccttccaggctcccacgaccttcccaggcccaagccatcctcccaatttagcctccaccatgctcagctgagtttttatttcttgtagagactgagtattgccgtattgcccagactagtctcaaactcctgggcttactgtgcctggcccacaagaaatatgttactttttttgagatttttgtataatttgagaacacagattatttgccctactcccccaacccccagtgatacagacctggtttcattgcactgagagaaaaaaattagtttcttaatttacgttgcgtttctgcctttttgagattgagtgctttgacttttctcttgtttttgtatttgctgtatatgtgttgttcctacttaatttcttatatggtttaaacttgcatctgtaaattatttattagctagctttatgacttgggcaagttaccttatctctctgctccttagtttccctctttataaaatgaggataataatattacctactttgtagagttgagtaagattaatgactaataaatggtgaagcacttaaaagagggctctatacatgttggctgttaaaattataagcgaggacctggacttctcccctccattaattgtaactcttcatttttataattttttcataaatagtatgtctctcagcatataacagaactttgtattaaggaataataaatatcaccatatatgtaattctttattataaacataaatttgcttcttgttaaaaacagagtatcattttcttgcctcagatcgagcttgaaagaaattagtagaaagtgggcccttttggccgggtgcggtggctcacgcctgtaatcccagcactttgggaggccgaggcgggcggatcatgagatgaggagaccgagaccatcctggctaacacggtgaaaccccgtctctactaaaaaatacaaaaaaattagccgggcatggtggtgggtgcctgtagtccccactactcgctactcgggaggctgaggcaggagaatggcgtgaacccaggaggcggagcttgcagtgagccgagattgtgccactgcactccagcctgggtgacagaacgagactccatctcaaaaaaaaaaaagaaagtgggcccttttctgtgttttataggtacccacacaccactgaatgtaggtcatcgtttaaaatctgagtgtacatccaaatccagtgcagttatgtagaacaaaacagtttgtatggaactagaagtgttactggaaaggtaaatactgtagttggtagtaaactgatcagttaaagtgatggatcagcaaagatttgggggttgctggtttttatttaacactcagttgtttcagagtgattactcctgaaacaaagttatttcgaacatagatgtgttaagaaatttcatattcctttccacttaaacctcttgagaaaggaagcatttcttcagggagagttagctatgtgagtgctacatgaattttagtcattactgtggcgactatatgataaccaaaagtaggagtctcacactttagtttcaaatttgtgctgttattgagtaaatttttaaaatgagattgccctctttcttgctaaactgtcatatatataagcccattaaattgacttttatgcctcttttccttttttttttttttaacctgttaagactttttttttctttctcatatttacccctgcctaagcaaggcctcaactctccacggaaatctttagtaaaaggcaaaaagatttattcattatgaagagaaaccagagcatgtgtgacaggactttctgtaattataagttagtggttcagtgccaggggttagattttcttaacttttatgtttagtaggattattgataattcctaagttgtatccttaaatcatattttttgaacattagggatctgcgtccaacacttaattatactagtaaaaggaatagaacatgcactggatttcttgtttttgagattctttcattcctgccctaccccaggcaggaggtctgtctgcagtggaagagaatgaa

SEQ ID NO: 103183 - DNA, 2046 bp, Homo sapiens
actccatcatggtaagactaatttaactttttataaatacaaggtttgcatgataaaggctattatagcctacttcataaattaatacattgcattctgcgggcagtgttttgcaccatttgtcctggcttagctgatattcatgttctaattgttcattacaggattttgtgtaaataaataaatgtttagcctttgtaatgggattgttaatagtaccctggatctgctactttaccaattgctccctaatgcctacagttgattgccaacactatctcactgccccctgtaactgcagtagtttgagctttaagatacaatgtcactaattatggattattctgttcttgttctacaatatcccaatatcttcagcaaaggattctgtattggctcccaccagctggtatttactagaatgtggaaataattcaaacaggaggactgtgcttttgaaaacctgctttaacattagaagaggaaaagtgattgtaaatggctatttttcatgtaagggagggattaaattttcatatctattgtttaaagaaatctgtagccaaaggtgtctgtttttagttgggtcattgtttaggactatagacttcggttttgtattcttagtaatattaaccccttcacctcccctgataacccaagaaaagatccttcgtataagattttaaaaattgcaccagaggagccaagtggctcatgcctgtagtcccagctactcactacttggcaggctgaggtgggagtattgcttcaccccaggagttcaaggcccaaggccagcctgggcaacacagggagaacgcgtctcttaaaaacaaacaaacaaaaaaattgcactgggatttgcattaaaagttgcaatacatacctagtatgttttctaatcataatgtgcaattttaaaaaaaagtgtaatttttatctgccttctaatttgagcctttattgttcaccagtaggtttatttcactggaacaagtctttgtgccatatttggcatcaccaaaggaatagtgccagtatttattgacaaatgaggacaaatagtttttccacattctattgccatcattgttactaggtaaacaatagaagcttataaaaatattgtgcatttaatacctttttggtttccttttatacttgtcaaaagtcatttatacataaattgacatactgtgtccatgatatgtatggataagtaagatctttttgtagcttgaatatcttatgagtaaatagcatttcctaactattaaatgggatttgaatagctgtcaagggattacttgatacagagaagttgctaatttattttgaaattgtaaaatacattttcccctctgaaatcacgaaatgcctcatattgctaatgcagtgagtttaagtgtttaatttagaaaaaattagtaactgctggttgcctcatattgctaatgcggtgagtttaagtgtttaatttagaaaaaattagtaactgctggtgttatttggcatgagatgaacctggaagggaagtgttgaggggcatcatctgtacttggcactgtttagaactttctttagaggtgtatagtgctttcttacactaatattccagtgtatgcctgaatagcacttttcttcttgtactgaaaaataagtccatggtgttaagcaggcatctctaaagtggccatctgatttaaaatagcttccataagttttaattaattttgcatgttttagtttctctttttgatagcaggtagtagctctctgaagcattccttctgccttgaaacatctttctttttcatatatttgccgttttcctttgtgagacttaggcttataatacaataaatatttaagtgccacctatttactaggcactgttaggttataggctctgtagatgtagtggtgaacaagatctccgttgttactcagtttgtagactatgaaggaaaaggagtaagggttggagaattactcatgtattaaatatatgttgctttttggaggcaaatgaataaaatattt

SEQ ID NO: 103184 - DNA, 1041 bp, Homo sapiens
acctcttggctagctagagttggacagttttcaattgtgatgacagcagttaaaaattcaaatctgttccttttcattgttgagttgtatgcttaaagaatgcatctgcattttcattcagctttctggtccttgtcgatttttgatgtctgttattctgcataaaactgtgtggcaggcgccagaacttttaagaatctttttgtttacagatggggagacaataacattaacattcattaacattcaaaataaaacattcttatactgataagcagtatgcaggttagctaggtttgggatactgatagatatttttttagtgtagtttacttccaaatgtcttctagaatttatgtttaatatctcaaatacctacacagaataggaatggcatgcttatttatacatgggcgtactcttgagttctaatggcaagccagccttcaaattaagttgtcttcctggaaaagaaacctcttaggcaactgtgaagggagagggataatataaaaaggatggagtttagaaatttgtctttttgtggtaagatctagaaacaaagcatattagaataagcagtgtaaattttgcacctttcaaaaagatactgatgtttttatcatgaaataataaaaacatattattgtctaaaaaaaaaaagccaaaaaacccagccaggtgctatgactcatgcctgtaattccaacactttgggaggctgaggcaggaggattgcttgagcctaggagttcaagaccaatgagaccacatctctacaaaaaaccacaacagtaaaaatgagccgggcatggtggcatgtgtctgtagtcccaactactcaggaggctggagtgagaggatcgcttgagcctgaaaggttgatgctgcagtgagccacaatcatgccactgcactctagcctgggcgacagcgaggccctgtcttaaaacacacacacacacacacacacacacacacacacacacacacacacccccccccccccccccgaggccctgtcttaaaacacacacacat

SEQ ID NO: 103185 - DNA, 1063 bp, Homo sapiens
cagctaatttttgtgggtttttttgtagatgatggtttcatcatgttgccgaggctggtctcgaactcctaggctgaagccatctacccgccttgagtaaaggttttttgatacaagaaatgattataacttggagttcagcttggattctgacaacttactagatttttttccccctcgggagaggatggttgtttcttgcttaggaaatgataatattttagcagcttatctgtgccccacagctggcagagtaatgcagtatgctgatcatgaagttgcatctggaaccctgaaaacttccagaccttaatgtttccaaagagatagaaaagacacatagcttctggtgtgtgtgtgtgtttttttttttaaaatcatgttagttggaggtctcattgaaccaggacaatgacagaattttatatttatatttgttttatctttttcaatgcatggtcatcaatagggaaaaagtcacactaggagcgttgagccctgtgaggatatcacacctgaccctggaatggcagttgtgtaagggtaggaactttgttttgttcattgctgtatttctagttcctagaatagtgcccatcactcagaaaaacacgatgaatgaacatccaccacttaccacagtagctgaatgtagccatgcttttaactctctgctcgtctgttttcatttatagttgacttcaacaacagaggttttagaaaatttgagcagggagtaagactaacctatagtagttttacacagtgggttttggttaatgctcatgattaatttctcttcccaccatagaatggtcttacccaacatgctacagaattctagtttctgatatgtgaaaagttaatagacataagaaaggaaacactaacaagctgaaaaaaatcacctaaaattgtggcggttgtaaatctacttcttaaaattttgcacctcttgaatttttaaaatactgcctctacactcaaatttttctctggatctgtttcttaatattaaatgcatgtgtaaaaaaatctattttaacagcgaaagtgaaaagat

SEQ ID NO: 103186 - DNA, 1050 bp, Homo sapiens
gactataggcatgcactgccatgcccagctaatttttgtacttttagtagagatggggtttcaccgttggccgggatggtctcgatctcttgaccttgtgatctgccctcttcagcctcccaaaatgctgggattacaggtgtgagccactgtgcccagcccacttaattcctttctatggccaaataatttgccattgtttagatatgccacattctgtttattcatccatctgttgatggacatttggtttcagtgagcctagatcttcacgccactgcacaccagtagcctgggtgagagtgagaccctgtagtggaaaaaaaaaaaaagaggaatgaagtactaatacgtgcttcaaaatagcccatcccacctttgggctactttgaataaatctgctataaacatgtatttgcaagattttacatggacatgtttttgttttcttggatatatacctaggagtaagattgttgagtcaaatggtaactctgtgtttaattgagcaactgccaggctatttttcaaagaggctgcactattttacattctcactagcagagtatgaggttacttgtttactttttacatctgtatcttatttactgagtgcatgcattactcgtatatctaattttaagaagtattacactgcttatcagactaacagtaatgactcaatttcttccttttgtactgttggtataactaccactgtggggttcacattttacaagtcaggtgctgtaatgaaccctgaatatttcctaaggattggtcacatctgcgatttgtagtgttttttgtttgtttgtttgtttgttattttacataatacccagagtggtctaatgctctttctagttttaaaaggaacctttagcaagtacttgattctgatgggttgcacagtttcctgtgatcttggctttttcttatggatttggaattcctatagcagttttaacttttctcagatacttaaagcagcacctcttactttgaactattttaactatttcttgtctcctctggactgtaagttct

SEQ ID NO: 103187 - DNA, 1057 bp, Homo sapiens
ttttgcctcccctcctcttttttttttcttcttccccctcttcccccccacccccagacttcaccataagggaaagaagagagccttgttggacactgaagaagggacggggatttctcctcctaatctgggcctcttgtcatggtaagtacaaggaaataagagtaaaaaaaaaaacaaaaaaccctgtgtcctgacaattaagtgaacactaataaattcatacttacccatttttgtttttgtaagaaattatttctttttctttcccagatctcttgtgtcttttcttttcttgtttacttagtagtaatagagtactccaatatacagagcagtttcatttctgttaactttaatcctgtgagctagatgttgtctcttatttttcagtcagcaagtaaatggaatcaagactaaaacatacagttctcggactccaggtttttaattccttttctaggaagtagcgtgtagtgaaaactgtgtgtgtgtgtttgtgtgtagacaaattgtaagatggtaatctgcatatttacttaaaaatttttttaaattgacaaattacatatatattgtgtacagcataatgttttgaaatacatatataccttgtggaatggctaaatcaagctgattaacatatgtattacttcacatagtatatatgctttatgaatttatagaagcaattccctaccttccctgttttgtctctttaaggcagtattttgatcccatagtaggtggagcagccctgcacaccccctcctgtatctttaaccagaaagagaatttaatggacaatttaatgacttacgggccatttcgggcccagctcaagcagagaagatggagcaacaagccagccacattttcatcaatcctgaggaaatgtaaacagtgcttcaaggcttaaaaaagaaatggtcctctgtaatattgtccttcttctaccttgtgatgtttcctagatccaaactgttttatgctgatgcacagagaaggaattgaaaaggctacattaatttcaagcttcattagggacgtatggaaa

SEQ ID NO: 103188 - DNA, 1061 bp, Homo sapiens
cagacagtactcttgttcctgtctgcattggaggagactgtcctcctctttgcatactaaacacaagttgttggaatgctatttgcaactcccagagccacattttggctagacttgatacactgtaagaggcaaatggcccactcctttttcaaggagtaaaagtattcactattattttaccaggtttgccttgaaagcctagaaattgctttttgaagccaagggttgaattaggatgatttaagggataggaggaggatcctcatattatcctgaagatttggcaccctgtctagatgcttttgcttctatctgtctcccttctctctatctgctgttgtacataatcctgtgtccagtagagtctgtagaccagattggcaagggggaaccattccagcttgttcaaacctcaagccccatttggcaaacggggcttctaactgattttttgaagcaaatctgacatagttattatagctttagcatccttgatcactgtatggccttctccctcctttttgatacttttgggtctattctacttagtagagagcctggccagcagctattgccccattgtcttttctgtgcaatccacagtcagcttagaactctagtctttttcaggagcctcattggctgacactaagccataagcccactctgtcatttggggcaaacaatagtctcccactggcattctgatctgtagttcttttctataagcaagaaaagattactgttctggctcccttcagcttctatgtcattgcatcattgcaaatcatagtcagttatagcatctaaaagtagtactctgatcttgtgaattcggtgcctgagagatatattctccccttcttccaaaggtggtgccacctctttgttgccttcatgctatgacatgacttgagaccactgatttagagataaagggaagtcctaattcactttgtagtaaatcacttgagtactgttgatccagataagtttgcagttctatttttgttgctttcccttatagatctttttaattagtcttgttggacacattg

SEQ ID NO: 103189 - DNA, 1078 bp, Homo sapiens
aaaaacagtctgggggaggcactttgaaacaatgcaaatgtccctgcttctcataaaaatttctccataagtttagcattcattgatgatttgtatctgcgcttaactataatggttgcaggctgggtgtggtggctcacgcctgtaatcctagcactttggcaggccgaggtgggggtggatcacttgaggtcaggagtttgagaccagcctggccaacatggcaaatccccatctctactaaaaatacgaaaattagctgggtgtggtggtgcacgcctgtagtcccagctacttgggagtctgaggcggaagaattgcttgagcctgggaggcaagaggttgcagtgagctgagatcacgccactgtactccagcctgggtgacagaacaagactccatctgaaaaaccaaaaaccaacaacgatgcctgaaatgcatttttaaatttaatagctctagaggtcttaaattccacaagtttttactgcattcctctgacctcttctggggtgtcagtaaatattatgtgttggcatactgatgagccaccatgattgggatgagagagaggtttaagtgaccccttggttttaagatagatatttatattgctttttagtcagtgagatttggcttatttttgatagatactggctacaactcacagtttaagaaggtagttgcttattaattagtcagtttttaacattgcattcaaaaaggccaaatatttaaacaaatctttatttttatttatttattttcttgagacagagcctcactctgttgcccaggctggagtgcagtggtgtgatcttggctcactgcaacccgtacctccctgtttcaagtgattctcgtgcctcagccttctgagaagctgggattacaggtgcacgccaccacacctggctaatatttttgtatgtttatcagagacgggagttttgccatgttggccaggctggtcttgaactcctgacctccagtgatctgcccgtcttggcctcccaaagtgctgggattacaggcatgagccactgcactcagcctaaacatatctttaataaattag

SEQ ID NO: 103190 - DNA, 1041 bp, Homo sapiens
atgaacttaatgagtgcatcctactgcattatgttatataagaactttaatttgtttaagacccctgactccaagacccctgactccaagaggtattccctaattttgggttgccagcatttactcagcaagatttgctttctcctatcctgttctctcacaaccacagactgaaaagtccttatctttttaggagagcttttttagtcccttgataatttgagtttcttttagatttcagcaaactcttaggatattcctgagaggtacctcagtctagtcttttaattatgggtggctctgccctgaggtgggatgactttggtccccagacccttccccttcctgatgatatctggtattctttggccatcaggacataaagatatctacagtgttctctgtcttttcgtaggtttgtgatgcaagggcatgtgaggggtaaagtactgacttaggaattaggaaacctgaatttaaatgcgtattctacgatttagttgaaaaaaagaacactgggcaaagaatttatgctctctgtgctttagtttcctttgtgctttaaagtgggacattcatgctcttcctgcccaggctgatccaggtatcctgaagatcaaatctgttaatgctgcagagttcaattcagtaaatgtttaagtgccccctatgtgccatgcttatgaaaacactttggaaattatgcaactacaaggtaatgcaatcataactgtttggctagagattatgagtaagggttgcattttgtttcttcccagtatacacagtccacattgatgttaacctgccaccactcagcatggaatcttgtatttcagtgacttggttgaatgtatgtgtatgtatggcttttgccttttatgtatattcgctgtggagtacaaaggaaaaacttggttttaattaaaaacaaaccaaaaaaaaaaaaaaaaaaacacctcgaggacatccagtcaacctgtttcttttgtcattacctcatgttgttgagcagtggcggtgtatatagcattactcatc

SEQ ID NO: 103191 - DNA, 1138 bp, Homo sapiens
tgtagatatgttctgattctaaatgaggggctataaacactgagcttctgtaccagcatttggaataggttaaatctcttgagtgctgcttttgtaattcattgaatatcttagttctcacagaatcctattaaattttaaagaagtccttccttcttattctggaaatgttttggatgtcatctctttgtaatgtttacattctccatttcattttcccagtttgccggctttttggactctccctgagttgggccaatccagtggcttacagttagaaacttcattccactgaaatattgagattgtaggaagggatttgtctccttgtggaattcctacagaggtaaccagcttgttcatttagtctactaaaggcaaactctgatgcccactctgaatggagagagatggaaaagtatttgctctggcccagtggaactcattacgtttttaatctcaattctcatcactgttgttttcagacacccctagaaaagtcagtcaccaaatttacctgtcattcaagtggtaaggatgctacaggaactagagagtagtgaaagctgaagggatttatgagtcttatcaatgatcagctcagctggaatggggaaagcagccagttgctgctctggccaacaactgtgttaggtcagcagccctggcatctgtggggcttgctgactttgaccaaaagggggaaggtactcttatttgcaaaataagaggctttaggtgaattctccctttgggaagagaagcttaagagggctggttgaagaaaaacttcctttttttctaaattttattctagagggcatgcaccttctaaaattaattctagagggcatgcaccctaggttttccccccctttttctagagatacaagaggatatataaatgaaaaattttatttgcagtttttcagagaaagtctttcaaaagatcacaaagttcttggtgtagtcatccatgcaaaatcaggcaggtttcctggaactgggctctgtctcagaacatgtgtcttgtatcgctgagatgcagactgggttgctgtagtatttgggagctttgtaaggggcgtgtggaagaatcggatcctccaccatgctctgctttgccagcctaggtggc

SEQ ID NO: 103192 - DNA, 1121 bp, Homo sapiens
tccttccacctcagcctcctgagtagctgcgactacaggcatgtgctaccatgcctggctaatttgtaaaaacttttttgtaaagatggggtcttgctatgttgctcaggctggtcttgaactcctgggctcaagtgatcctcctgcctcagcctctcaaagtgctgggattgcagagtgagcctccatgcctgacccctgttagtcatttttttgggtaactttacagggatctccgtgatgttatggtaattgagaaagacacacaggttttgttgtttgttcttgttggttgtgtaagatttctaccctctttaatactgagaggacttgaagctgacccaacacttacctagaattagactgttcattaaggcacttaaaatctattttgtgtgagtacagagagcatctgaatgggtacagttgttgtctcttgttcctcacacaggcaccagagcaatggagctgtcattgcccgctgtggacagccagaggttagctggtggggctggcgaaatgcagatgatgagcatctggtacagtcagtagccaaagcttgtgcctctgactcccgatcgagtggcagcaagctgtcaactaggaacacttctcgagactttcccaatgggggagacctttctgacgtggagttcggtaaggtgctccctggacccatggcaatgatttttatagcatctaagaaccttttcttgaaatggcctcttccttacaagacatagatttacttttatagaagtgaatgtgcagagcttcacttgatgggattgattgaggagtcatgggtcttggcagagaatcagaagaccctttgtttcaaacctgaatcaagatattagtgtgtttgttgtctttcttgccattgtgacaaaaatggagtgtttatgtaatagaggacttgcagtatctgcagaccatggcaggaaatgccaggcttcatgaaaggacaacagatacagaaatgaagtataagagactgggctgtgtgaaccccatgtgtactctgggagtcagttttggagaataaatccttctcatctttcataagaaggccacatagaaaaaaagagaaaaatcctatgtatcaagggttttggtta

SEQ ID NO: 103193 - DNA, 1017 bp, Homo sapiens
gatgtggtctaagctggaaattgaaagcagctgtaccaaggtgaaatttgaatgtgtgaacgcattgttctgtggagttcttttcaaagagatttcaaagccacaagttagataaggcccaagaagtaaagccagagtgagatcgaagtaggcctttcttttaaaaaataatagcttttattttatgtcagtatcttctttacaaatctaaccttcccttttcacgctttttgaaaagatagctaaaattcagtgtgttcctcttattataaaggattgggctaatagttaagcatttcaaaacatttcagtttcgttaatcagaagctgcagtgggtttgttttatagccagtttgcttttaaatttggccatgtgggctttaagttcaacgtatttgtgttctctttattgttactctctccagagtattacccaaactgtgaagttgtgtttatggggatggcaaacattcattctattcggaggagttttcagtctctgcggttgctgtgcactcagatgccagatccgggaaagtaagtccttggccttggctttcattttgcattgctcttaaataataagtttgcttctttccttgaactaagggggaaaaaaagaaaaaaaaattaatttggagcagtctttccttctgtttcttggtaatcttcagttaccagaccagtctctgcaagtatctccttgctgggtctgaaatgtggcagcacagaggaagagttgggagaaaatacagccatttgaaaggttttaaaatctgcagcacagaagaaatctcagcatcaaaacagaagcattaccttactgtttgtcctgggacctttcccttccacgtcatttttagcccaaagaaatttaattcttcagtttctgatgtcccatagtgatacataacctgttttgaactgggatgttttatcatgaaaagtcagaatttattcatcatgttctaaagggtttaaacttgccattaagtcagttccttttacatctgctt

SEQ ID NO: 103194 - DNA, 1018 bp, Homo sapiens
ttaaattcaccgtagttgtcatcagccaagaggatgaagcagtgcctttggggaaagcctgaccggagaattgagcttgctgcctcctttggggattagccatttgcatttgctacacagttccaggtcccagctagcagcgctttcttccctagggtggtatgtagaaggagccttactaaggacccaggagatcggccgcgaactgtgtaaccttggccaaggggtttaactactgtagatctcagttttcctgtctataaaatgaaagacatgtaatcaacactacatgatctaataccctccatatattaaaattcttaaagagctatcagagtcaaaaaagatagaattagccctcacctggtccacataaatgtcttggggattttattaaaggtaatgcttttatgtatttggcagcaaatcataatgctgcactgaagtctccctcatgggtaaaaagcagctgtagcagtgatgggcagctgtaattaggcccccggcctgtgtttggggctgtggaggataggggaatggtaggcttctagtgcaggttgagaacaggacaagggaatggggagtctctcagcagcccctccttggctggcaggttttggagtacagcttcattagtcacagacaacaccaactggtattaaataatagtttagttaggttcaaaagaacctcacaccggttctcttgtttaccatttcttcaggtgctaggagataatttagtatttgttctcctaagccttatcttttagttcctttcaagaatatgtgaggaatgaaataaacaattgatccatcaggaaaaaatgtttctcaggtacctgctaggagatagaaagtcttacgattggatttttacccataacagacttacaattcattaaacagtgggactccctactgtatgctaggcactgtgctgggggtacagttatgactgagacatagtgttagccctctgaggagtcacagtctggttggtagtccaaacaaatcca

SEQ ID NO: 103195 - DNA, 1026 bp, Homo sapiens
aaagtgaaatttctgttttggtcattgttcctttatgccatgagctaaattgtggtggttcctcccacagttcttgcacctcttaaaatggggcagattatgggtaacaaggtattgagaatatagacatattttcctttacagtctatctacttgtaaaagtttttagctacctcaggaaaataaggagtctgtaaaaggatcttggcatgctagatattaccagagtgttctgtggagaagcagctctacctgaaataaccatctgttgggttaaagatgaaagaaaaatcataaagtaccctaaaatatatgcaagtattaattaaacttggggtatagaaggattttacagacttgactttgtaacaccagaggcagaaatgttaagagaaatttaggggaaaagtgtggtttttatatagtgaacacaagaggctaaaaatacacattcaagaaaggcttagataaacgcagtcagtaccattttagtgatcatggaatggagttcagggaattgggaaatttccctaagtgtgtgcctcatcagggatagagccttccaccaaagggcaaggccgggtgggctttctgggaggctgttagaggggattgctttctgtgacaccaggcttaggactgtcacagtctggatagtctagcacaaatggtctctcctggatgcttccctgcagggtttccaggtcctcgtggaaatggagtggctggattttggccataaatttgctgaccggtgtggtcatggggagaactcggatgatctgaatgaacgttgcccagtgtttctgcagtggcttgactgtgttcatcagcttcagaggcaatttccttgctcttttgagttcaatgaagcattccttgtaagtttcttcattttggggactttctcaatttgaaggagggtcagtacaaatgttagtgggccagttctcacatgaaactgtgctgcctcttcagaatttaatagaggtgatttttttcctgtttctgcttttttttttagta

SEQ ID NO: 103196 - DNA, 2395 bp, Homo sapiens
aagaatttgctggtcattgctacatgcccagcaccttagtcatgtttgggccatgtgaaatgctcaataatttgtagaatgaacaagtagttttacaaacatactgtcagctcagacttgagttgtacactgacgtgctcctgcacccagttcatatgctgtggcgcttgtgagagtggctgttaattcacaatctcagactatttatcacggaagctaagaggaataggggcaccaacaacctgtctgactcaggttgttgggtcctggaattggtggtgtgaggaggaggaggctactgcatggcttactgggttccccgtcctgacagagtaaattgaagtgttctcagggatgttaggataaggtggctcagctgagctgacttatcagagtgtgcatgcctgattgcttaatttgtgcttcattggacttccataggtgaaactggtgcagcatacctattcctgcctgtttggaacattcctgtgcaacaacgccaaggagagaggggaaaagcatactcaggaacggacatgttccgtgtggtcacttcttcgggcaggcaacaaggctttcaaaaacctactgtattcctctcagtcagaagccgtatgtatccttcagcctttccactgtggtcagcagaaggaatttggggttggttacatatgagagcctttttgagtagtgactgtttttgtgaagacatctctactgtctctggatggactggttccatttttcccccatgattctgtcctgaggaaggcctgcttctgatggtgctctgatctgtttctgatgactacttgctgagggtggtttggtttaacacagatctctactttgccaccctagacatgaatcttttttggcactgcctccagagcttatttctagcatattctgtcttacgggagaggcacttaagttgcttcctgatgcactgatagctcagaatgagctgccaccaggcccccagcaccctcccagtgtcaataagcaatgatacccaccaaagcttctgtctcagaacagtaaactgtgtttgacattggtatgtgtgtctgtctgattctctgctcacatgaagagctggcaggccctttaagactttgttccccgaaggaatgaataccttctgttaagcagagaaaaggaggcacatagacctatgtgtcagtttcatagtaatactagctttgtcagaatgcatcttagaccctaaagaagtcaaaaggaggctaatcagagttcatactgatttcctggactattaatatggttctcattacatttaagtaatcacagaaaagatttaagctgactgcttgtctctccccttcagtgtgccttctggggaagtaacaatacagcaggaaaatttccttcttttcacatgattaatttaaatgatcccataaaatgggtttgacagtgtttcttgaagccaagcttttgtgccagcaggatggacaatcaccatctaacagaatgactcactttcttaggcagtaaaagcaacaaatcaagctgatgaaagtcagacattgaaggtgacctaagaaataactataatgagaaagggatctaaaaaatattttatattttcatgctctcaagtggctcttaggtgaaaaatgttggctatataaaatgtctagtcctgtattggtcctcttgggatagacctgtatccattggtgctgcttctttgtggagatcctgtcagccctgttgggtattccagctgggtgcttgctcttgatcctcatttccagacatcctagaagacttattggggcatatttaaacctgtgtcctcccccctcctcaggtgctgtaccctgtgtgccatgtgcgtaacctgatgctgtggagtgcagtgtacctgccctgcccatccccaaccacccctgtggacgacagctgtgcaccatacccagccccaggcaccagccctgatgatccccccctgagccggtgagcccagggtgatgccacaggcctgacagcctgtgtgggtgtattcctgtgttgggacgtgtgcagggatggtcagagatcatgatggtatctggctccacagtatctttcttaggtctctgcagttttttcagggaagttatagggatttctgagctacgaggctgtaagatccttgtttctgggagtgagttaggccctgttgcttcatgttgttttgcatacactgagccgctcctcagtgatagagcaaatcctccagtttttctgtgaccccctggtttgtgttttccccagtgctctgtgctcctgcctatttgccatgatttgtcttctgaggcttaaaaggcagatgctgtcagatgacagaaaattttgctttggggccaggcttggtggctcatgc

SEQ ID NO: 103197 - DNA, 1234 bp, Homo sapiens
gcagatggagaacatcttgcaggaggccaccaaagaggagagtggagtagaggaacctgcccacagggcaggcattgagatacaggagggtaaagaggaccctctcttagaaaaggagagcaggaggaagacacctgaggcctcagccattggacttcaccaagacccagaactgggtgatgctgctctgaggagccatctggatatgagctggcctctgttctcacagggcatttctgaacagcagagtgggctcagtgttctcctcagttctctccaggtcccccccaggggagaggattccctggaggtccctgtggagcagtttcgaatagaagagattgcagagggtagggaggaagcagttcttccaatcccagtagatgcaaaagttggctatggtacctcacagtcatgttctctgctaccttcccaagtcccttttgagaccagaggaccaaacgtggacagttctacagacatgttagtggaagataaggtgaagtcagtaagtgggccccaaggtcatcatagatcttgccttgtaaatagtggcaaggacaggcttcctcagaccatggaacccagcccttcagagacaagcctggtcgagaggccccaagtggggtctgtggtgcataggacttcccttggcagcactctcagcctgacacgttccccttgtgccttgcctttagccgaatgtaaagaggggcttgtgtgcaatggtgccccagagactgaaaacagggcctcagagcagcccccaggtcttagcaccctccagatgtaccccacacccaatgggcattgcgccaatggggaggctggtaggagcaaggactcactgagccgtcagctgtctgctatgagctgcagctctgcccacttacactcaaggaacttgcaccacaagtggctgcatagccactcaggaaggccatctgcaaccagcagccccgaccagccttcccgcagccacctggacgatgatggcatgtcagtgtacacagacacgatccaacagcgcctgcgtcagattgagtcaggccaccagcaggaagtagaaactttgaagaaacaagtccaggagctgaagagtcgcctggagagccagtacctgaccagctccctacactttaatggagactttggggatgaggtggtgagtaggctgtggtattcctccatagctgcccaaggagacggcatgctgaggctgggtgccctttgt

SEQ ID NO: 103198 - DNA, 2175 bp, Homo sapiens
gttattcctgtcagattttagtgcctgttctgccttagtaactacaaagtattagtccttccagacgtgggctatggctttgaaggttcagttctttttaaacaaatatttatacccatcctgtggcagatgctgccagtagaaatggagagaagggactggtttctagcactgttgaggagttagctctgatgggggtttgtggctggaaatgggggttccagagggggaggttctcaaggaggtgctttcctctctgggtggacttgactcaggcagctcaagtacaagtgtgagcctggctctcaagtggtcagcgtacattaaaggcgggcacatccagtgactttcagttcagagtgacttggcttttccttcatgctaatgatagtttctcatgttcccagagagtccttctaagaaaaggagggcatcccgaaagcactcagctttaacttagtggcaggcagggttggattgacaggcccactggagcagctgacatacagaattctcattccattttggtcacttccctctcactcactttctggaaccctgagggcctgtttttctactccagagtcactgcacacaacctgtgtatccctctcccagctgagcccaggcccacactgcacttcttcaccccagttcttgatggctgatgcatctgcagattcggcagtcctagcactcggccccacccagagtcctcagttctcccttcttcaccaggccttttcttcttttgggaggagaccaggttcattctgttcagctgtgtttgtttgccaacagacttcaatccccgactcggaaagcaatctggatcagaactgtttgtctcgctgcagcacagagattttctctgaagccagctgggagcaggtggataaacaggacacagaggtacaggctcagcccctgctctgagtgccatcaatttaactgttttgtggttcttctccacccccattcccaccccatacccctggccaaggaagcacctcccagcacagctagccctgagcctctggcaccttagctcctgggaacccacatgaagcctaggatttctgagccagggagactcagcaagctggccctccctcttcattgcctctatgaactggagccttgccagctctcacagtgacccagggtgctgctgcctgctactttatctcaggggagattggagtcccctccagggaaacgatttggacgcctttcttgtactgttgacatcagatctgctgggctggtgccactggagctgatgtggtccttgtgactcttgctgcccccagcatggctctgctggctccagctggatggcccatctcctgtcagtaacctggtcccatctgttttgcagatgacccgttggcttcctgaccacctggccgcccactgctatgcgtgcgacagtgccttctggcttgccagcaggaagcaccactgcaggtaccattgaggggctgtggtagggtgggctgtgtgtggaggttgagggtcggcccacagagcctgcagagtagagggttgtgggtatctcagtgttctgtctgaggcagagccatggtctcatcttcctgtgcctctgaaattggtgtttgcaaaactgcatttggcatctttgttcaaattcagagtaatcactgttaaattctgaaatgtgcaaatggtagcattttgttgtttcccagattggtgaaacaacagccaccactgaaaccaccatttcttattctcagcataacatttcttcccattcaacatggctactatgagcaaaaccagttttcctgcgatggggagggaactattttcctattcctttcctgctccctgaccccacacttgttttcccttgtgccattggtgagcagctgtagcttgggaagtagtagagacagctgaggacagtcttccaatcattaaggttcctgacttctttttccttctgggttagggtagtgagtttactagggaccctttgccccagctagggtgttgactgtctggtggatgttcagtgttcttagaagaggaagtttatctgaatcatgccatagctcacccacacgagtgggtggattgaaaatggaacagtctctttgcctagtaatgatgcttctaggacatgtatctccccaccctgcaccccaa

SEQ ID NO: 103199 - DNA, 1007 bp, Homo sapiens
cctggcctctgtgatcacaagctacacagagggcattgcctaggtgggtgtggccactgggttttcctggatcaggactaacccattgttaggaccatgtattcttacagatctctcttgagcagcattcttttgtatacctgagcagcattcttttgagtcagtggtgaggcagccaagaatccttggccccaaagtgaaaatgacatgtgactctgctaggtagggacaccctccctacccagcttgttcctgggctagagagatgaaagggtttgatctcaaggagctccagcacatgcaaattacacacggcaaagtttgtcttttgaagttggtttccctccgcatacctgctggccaaaactaacattgttctgtttcttctcatctcaaggaattgtgggaacgtattctgctccagttgttgtaaccagaaggttccagttcccagccagcagctctttgaacccagtcgagtatgcaagtcttgctatagcagcctacatcccacaagctccagcattgaccttgaactggataagcccattgctgccacttccaactgaagctcagtgacctgggtgggcagtggccaagctgctgttcctatgacaggcccactcaacctgggcagaccgagaggcccgtgcactttggaatgggagcgtggaaccacctgtacagagtgacagatttgggatgcaccactggattgtagattgatttttctttcctgtccccctactccctccctaccttttccatcctcctcctctgccttcaaaaaaggaaactttcccttggttgtcttaattttttttttttttgatggaagaccaagggttgccaggcccactgtaactgccgagctgcctgctgtcacgtgacactgagggatggcttgtttcttccgggtgggaggatggtggtcagagccaggagtatggagatctgagaccgtgagcagggaagaaagccagtgctaacatgcaaccattcctcac

SEQ ID NO: 103200 - DNA, 1044 bp, Homo sapiens
tttgtggaggtaggtgtggggaaggttggagaagagttaggtttgtgctttgtaatcttggcatccatgttttgtgcctgccctccctcttggggaggccatgcttgactctgctgaaagctgctaactggtgacagggtggatcatggtgaggactaggggtaaggtcagggaatgcttaagctctggccctgccctgtattcctcttccccttggtagcagttccctgaccaagggcaaggtgtgtctcaggaaggtggttctgtgcatgcctgggtgtggttaaggcgtggcccagaaggcttccctggtgctctcagtccaggcaaagcccagagcatctgagcacgtctctgacttccagtggcaacacagtttgaacgtggtgaaacagggtgtagttcttttccacattctgtgtcatctagtcgtgcaggtagggaaaaagttggtctaattgaagattgtgcatttcctagtgacaggtgccaagaggttatgatacgggtttcttgggtctgatgtacagtgtgaataaatgcttgcagctcttagctcttttttgatcgatgaagcacttttttattaatattttcctttgttaaaggaggaaccgtaactctccatagctgtacatataacccttttctcctaaagaggagtcagtcagtgctcctatatttttcattttttgtcaaagcaagaagtaaatactttagaattgttaaatatataaataaagcaaataaagttgagtgttccacatggtagcatttgctaacacttcctaattctttgccctgtggtttatcccctcttcgtcccttttccctctcacacagaagtgtttgagggcctgctgggaaactgacctttggcaaaggaaagctacagatagccttccgactctagaccttggcaaggagcctcaccatgatgttcaagcactgaacgcatttcctcagtgattttgctcctaaaatctcccaggctaaaagagggcaaagcagtcagggatctgacctggcagctattcctccttc

SEQ ID NO: 103201 - DNA, 1042 bp, Homo sapiens
ggcagggcagacgatgtctgtgcccgacattggagggggccgtgtgtggtggagctttggggaagtttatcttacctgggtcagattctccccagccattgaggttttctgccaggatcgatgcctggtacaggccaagaggtgagagaggtggggacaagacaccccgccccccttgacctcagctcccctttcactttagtgaggatttgccaattaatccctatggactttagttccctaaacagagggagagagtcttgaacctcaggattagccaatcgccaaaatgtgtccgagtacgcagggcactggacaggctgtgcagtacatcgtgtactcagctggtagaaatgaggggtggttctggcccctaaaggggtttttaatctcagcaggatcataatctaatttctcctccattggaccatcaatctgttgaggtaggaacagtattttacatctcgtaatcctgcatgttgttgcctggcacattgtagttgcctcgtagatgttgaatgaatgaataattgaaatagcatgaaaaagatattaaaaagtcaaaagagcatgaacaaatactcaattaatatagtggaagccattttctctgaatgagcacaggtaggggaattaccagggccaaatggaatttgttaaaatggtgaataatttattgaagcaagctctgttggaaggtctaagtaattgggcgaactttggcaaaccaagttcccttgcttagcctcactttccttttcttttttcttttttttttgtgagatggagtcgagctctgtgccaggctggagtgcagtgacgcaatctcagctcactgcaacctccacctctcgggttcaagcgattcccctgcctcagcctcccatgtagctgggactacaggtgtgcaccaccacgcccagctaaatttttttatttttttttatttttagtagagacagggtttcaccatgttggccaggatagtctcgatctcttgacctcgtgatcctcccacctcggcctcccagagtgctgggat

SEQ ID NO: 103202 - DNA, 1489 bp, Homo sapiens
gatggtttatactatattaaacagatggttgcagaattttgtgaatatactaaaacccactgaattatacctattaaaaaaactttaaaggctgggtgcagtggctcatgcctgtaatcccagcactttgggaggccaaagtgggcagatcacttgaggtcaggggttctagaccagcctggccaacatggctaaaccccatctctactaaaaatacaaaaattagctggatgtggtggcacacacctgtaatcccagctactcaggacgctgaggcaggagaatggcttgaaccctggaaacagaggttgcagtaagctgatattataccactgcacttcacctgggtgacacagtgagagtccttttcaataaataaataaataaaactttaaaatataaagaatgagctagactgacacaacagctagacacaattttgctctcatgttagctcacagtaggtcaggggatacttaaagacaactatggtacagtatatattgcaaagggcacataacccagacttcgtaatagtggtagtgggaattaggaagtcatcccttaaggaaattttactaagccatatgatatggtttggatttatgtctccacccaaatctcatgtcaaattgtaatccccagtgttggaggagggccctggtgggggttgactggatcatgggggtagatttcccacttgctgttcttgtaattatgagttctcatgagatctggttgtttaaaagtgtgtagcacctcccctttccctctcttcctccttctctggccgtgtaaaacatgcctccttctccttccccttctgccatggttgtaagtttcctgaggtctccccagctatgcttcctgtgtagcctgcataactgtaagtcatttaaacccctttctttataaattacccagtcttaggtagttctttatagcaatgcaagaatggactaatacaccatatctatgagatgagtaggaattgggaatggaggaggatgtttcaggcagaaggaatattgcaaaatcctgagagctagaaggaatatagtcctttggggtaaagaaggtaagaatagctggtaaataaaagtataagggaaaatagagctgaggctagggaggcatgagtcaaatcttgaagccatggtaagagttttagattttatcctgagagtagtggggagccattgaagtatttcaatctgggaaaatgcatagtcgagtttgtaatttaaaaactctggctgcaatatacagaacagactggagaaggagaataccagtgacaggaaattggtggttgcagcagtacaggcaaaagatgagactggttgatttaaagtagagatgacaacaacctggctaaagtgaggagttggacacatttgagatatatatatatatatgtatgtgcagggggacagggtttcactcttgttgcccaggctggaatgcaatggcgtgatcttggctcact

SEQ ID NO: 103203 - DNA, 6219 bp, Homo sapiens
tatatatacacatatatacatatatgtataaaatttaattttacttttataaatgtcaattcctaaggaatttaccaaatgctaatattaacctgcttgaatcctttctcaatagcaagtgtcctgaatgcctcagagttttcaatggtaatattaatttaatctaggccatccatacattgcaaaaatatggatgtagtaatgccttgtgttctaattggctgatgctattttcagagcttgattccctagaaatgacatcagaatgtctatgatcatagagaaatttttaaaaccctactaatttagaaaactatttagttttattaagtaagttttaataagtaagttttattagttttattaattttattaattaaaaaagttaatttaaaaattaatttaaaaattaaaaagtaagttttattaagttttattagttttattaatattagtattctatactaatatagaaaactattctagaaaatcatgatttctcttatttattgtgtctaagactaataactaccccagtagtgggtagtgtattatggtttaatgggctgggactagatcttaaactcttagagctactttgtttcccattttattttttgaaatttaagggggacaactgatgtattagatatgaaggttatagtctcaaatcaagtaaagatagcttggaatctttaagggttaaagaactattggtggttttcagtctcatatataaaatattgtaaaagagtgtcccctagtgcccctctgaagaaataatttgaaagaaatttaatattaccacctatttataatctctatcaccaccttgtggcagtgttcgcaaataattctgccctcttgggaaaaatcttcaagaatcttgcattaatggatacacaaaaaccggtcacaggctatccttggtgatccagaatggaatatctttaaagaagttattttacaagtattttggtcagaacttcataaaaccttgaaaagaagccccagttgaaattaaattaagactttgtaaagaaaagggaaaatttgctgctgcttctttttttttttttttgagatggagtctggctctgtcggccaggctggagtgcagtggcgcaatcttggctcactgcaagctccacctcccgggttcacgccgttctcctgcctcagcctcctgagtagctgggactataggcgcctgccactatgcctgtctaatttttgtatttttagtagagatgggatttcaccatgttggccaggatggtcttgatctcctgacctcgtgatccacccgccttggcctcccaaagtcctgggattacaggcatgagccaccatgcccggctgcttcttttttatatcaacaaaacaataagggtgaaaactagatgtattttaaatattaacttttttattgtggtaaactgtaatatgaaactcaacacctcagcttttctaagtgtacaactcagtgacactaagcacatttgcaatgttgtgcaaccattatcactatccatttctaaaaccttctcatcatcgtgaacagaaactctatacctattaaactctttattccttctaccccaccagcacctggtaacctctattctactttctgtctctgtgaatttgcctactgtaggtacctcatataagtgggatcatataatatttgtccttttatgtctggcttttcacttagcataatgttttcaagatttattcacattgttgcatgtatcagaacttcattcctttttaagattgaataggggtcgggtgtggtggctcatgcctataatcccagcacactgggaggatgaggcgggtggattgcctgaacctaggaattcaagaccagcctgggcaacatgacaaaaccccatctccacaaaaaatacaaaaattagcgaggtgtggtggcaaatgcttgtagtcccagctactcgagaggctgaggtgggagaatcatttaagcctgggagcgggaggttgcagtgagccgagatcacgccattgcactctactgtgggtgacagaaggagaccccgtctcaaaaacaaaacaaaacaaacaaataaaacaattgagtaatattccattgtaaataccacattttgtttatccattcatcttttaatagacattcgaactgtttccatcttttggctaatatgaattatgtggctatgagcattggtgtacaagtatctgtttgagtccctggtttcaattcttttgaatatatacctagagatggaaatgctagataatatggtaattctgtttaactttttgaggaatgccattgctattttccacaatggctgcaccattttcattcccaccagcaatgcataagggttttaatttctccacatccttaccaacttactattttccatttttgaataatcatttataaaatttttaattgacacacagtaattgtacatatttatggggtacagagtgatattttgatacatgtatacaatatgtaatggtcaagtcaaagcatattcatcaattcaaacatttatcattctttgtgttgaactattttaaaatatacaataaatcattgttaactgtggtcactctacagtgctatagaacaatataatttattctcctatctagctgtaattttatatccattaactaacttctccctatccaacctcctccctgctgcccttcctagcttttaataactacttctgagagctcatctgttttagctcccagatgagtgagaacacatggtatttatctttctgtacttgacttacttcacttaaaattatatcatctaggttaatctctgttgctgtgaatgacagatttcatgcttttttaaatggctgaataatattccattgtgtatatatatcctttccttcctttctttctttttctctttctctctctctctctttctttctctctttctttcttttttttttttttttttgacagagtcttgctctgttgcccaggctggagtgcagtggtgcaatcatggctcactgcactgcagccttgaactcctgggctcaagtagtccaccttagcttcccaagtagctgggactataggtgcgtgccaccacacccagctaattttcgtattttttgtacagatagggtttcaccatgttgcctaggctggtcttgaactcctgggctcaagcaacctgcctgcctcaacctcccaaagtgctgggattacagacatgagctgccaccccggcctatattttattcatgcattcatctgttgatggacacttaggttgattccatatcttggctattgtgaatagtgctgcaataaacatggaggtatagatatctcttccatatactgatttcttttcttttggataaatacccaatagtaggattgctggattatatggtttctattttaagatttttgaggaccttccatactgttttccataatgcttgtactaatttacattcttaccaacagtgtataagaattttcttttctttgcatccttgccagcattcgttattttttgttattttattttattttatttcatttcattttttgagatggagtcttgctctgttgcccaggctggagtgcagtgacaagatcttggctaactgcaacctccacctccccggttcaagtgattctcctgcctcagcctctcaagaagctgggactacaggtgcatgccaccacacctggctaattttttttttttttttttgtatttttagtaaagacaggatttcaccagactggtctcaaactcttgacctcaggtgatccacccaccttggcctcccaaagtgctgggattacaggtgtgagccacctcgcctggccattttttgtccttttaataatagccattctaactgtggggagatgatatctcattgtggtttcaatttgcatttccctgatgattaatcatgttgagcattttttcatatacttattagccatttgtatgccttcttttgagaaatgtctattcagatcctttgctttttttttttttttttggcttttgagttgcttgcacttcttgtatattctggatattaattctttcttggatgaatagttttcaaatgttttctcccattctataggctgtctcttcactctgttggttatttacttagctgtgtagaaactttttagtttgatataatatcatttgtgtatttttggttttgttacctgtgcatttgaagtcttacccataaaatctttacccagaccaatgtcctgaagcatttttcctgtgttttataattttgagccttacatttaagtctttaacatattttgagtttatttttgtatatggtgagagacaggggtctctcattcttctgctgtggatatgcagtttctccagaaccattttttgacaagggtatcttttccccaatgtatgttcttggtgactttgtcaaaaataagctggttgtaaataggcagatttatttctgggttctctattctgttccattggtctatgtatctctttttataccagtgccatgctgttttggttactatagctttgtagtatattttaaagccaggtaatgtgatgcctccaactttgttctttttgctcagaattactttagctgttcagagtcttttgtggttccataggaattttaggagtttttttccgtttctatgaagagtgtaattggtattttgacagggattgcatttgaatctgtagattgttttgggtaattaatatgatcattttagcaatattaattcttctaatcaatgaatacgggatgcctttccatctttttgtgttctgttcaatttctttcatcagtgttctgtagtttcattgtagcaatctttcactttcttaaatttattcctagctaatttttttggtaggtattgtaaatgagatttctctcttgatttctttttcagctagttgaatgaataactattttaatgggtatgaagtataaacattaacttctgagttgaatttgcaaataagttacaactgaagttagttcaagaaatgtttttgagcctttgctatattgttacactctgagggaataacaaggattaataatatatattgagtctctaggtgatttacaatgtattttctcctctgaatatatttttgaacaaataaataatcttataattttcattgagtgggtggaaaaattcatccagagaccttatgccaaaattatagataaaaatgtttattaaacttatttcccaatgagtatggtcaaattttaattatatagttctcctttggaaaattaacaataggtacttttttcaactcaaattcattttatcgtttagatagagcctgatagaattatcttagcattcattcttcctttgctcttcaaaatgtagcttggtaaatttctctctgaactgaacaatcttgaaaacagtttatacttaactgtctttgattttaattttttgtttgcttttagactttttcagtttcatttttgggcagagtaagagaggaagcattatatttggcaaggtctctaattaattaattattttttaataggttggacttgttgaaataatcctgatacattcctacaatggccactgctcagctttctcactgcatcacaatacacaaggcttctaaggtatttgttaagaattaaaagaaaatcaatgaccatttagtgagttagttcagaattatgattttaatcttttgtgtgtgtgtttttaagcagcagttttatcagttaattggcacataatattctgggagagtatgtgtacattttaactgcctaatagaccaaggaccagaaaattaaaataaatttctacaaagttacttactgggtgcttgtttcatgtttatgtaatatatttaggtcttctagagtaaaagaaatcagaaacaaaaagatgtttaaagagaatggttcttggttagacattcacttcctaaagtgttaggaaacttgtgttgcacaccatggtgtaattataagaacagaaggggagagcactgagagaaacttggatgctaggaggtctaggggagcatcccagggccaggcatatagtttagtttgtctcatgacattcattaatgcatcctttgtttattcattgagactaaatattatgtagtat

SEQ ID NO: 103204 - DNA, 2127 bp, Homo sapiens
tgaaatcccactctaaggtacttgaactctctcctggatgaacactggcagtatcatgataagatttgtatccttgaaaattaattctgatggcaatatggaagacaggttgaatgaaagaatcgttagcaaagagataaggggctactgcagtaatcaaggagagaattgagtatgtcctcggtcaagccagtggcagtgagcagggaaaggagaaaatagatttgagaactcttttagagagaattaatagaatttagtggggtatgaaggagagagaagacaaagatgaagctgcttctagcctggatgactggagtagtgctgattcactagtctgagaatgagacttgggatcaggttttagccaggggtggcagagataaactgagtttaagggatctacaaagtggtttaggtgcagatgttcaggaaataaaaatatagaactgggactcagaacagaaatagggacctgaattcctttttgtataggctgtagctgaagctatgaaactagatgagattattcaagaagacagctataaaagagaaaaagcctgaagacagaatcctgggggataaccaatatttaaagagtagaacaactggaaaaaataaaagagactgagacagatatgtacggataggtgaaaaaacaaagtagtgttgtggcaccttggagaggaaaagagagtatgtgggtaacagtgtcagataatataaagaagttacatattatgaggaatgagaagaggtcaactataggattgtacttggtgactttggagagaatagtttagaaaggaaaggaggaaaatccagattgcagcggggtctgaggagtgtatgagagggaagaagattatataatcatagtaaaactccagtttcatggatcattgtgaaataaattgttttagtcttgaattacttgggtaattgtttctgccttctgctctgccttgcctatgaagatctaatttaatgtaatattcaaagcgctatttctttttgattaccttcaaagatatcaaatttgaagtcctgagaaatcttttcatcatatatgtggtaatgatgtgctaaactgaatatattaaataatactaatcttttttcacctccgttgtttttccaggaaacagttttcccatcccaaatcactaatgagcatgagtcattgaaaatggtgaagaaactttttgctacttccatctcatgtataacatacctaaggggcctgtttccagagagctcttatggagaacgccatttggatggtaaagttaaactaactagtctctttggctgttgtagcccctttctctatttagcaggaataaacctttcacgtctcacaaagtgtgctaattccaacttaagggcctgttcttcaagaccaatttgctaatccattttccattttaattttactgtgtgtagtgattttacttataggaattactagttcctagctagacgccaggtgacagatggaagaaaaaagaaatgtttggacaagtccagtataaaagcaacagctagatcaaaatctatttgaatgctgtagatttgcgctacgttgtgcctcaattgaatttattctttaaggtacactttagcattgaggaagttcaaaggaaccaggtgaaaaacttttctccctgttaacgtatataaaaatactggggataaaaaagccaaactcacttgttgattaacatggatattaaaataattattattctaatcagttctggcttttttctcaattgccaggtcttctactttcattccttttgtttcagtgctcttaaacttatcatcttattgtcttatactacaagctgtttctggccccttttcttctcttattataaaaacaagtaccagccaggcatggtggctcatgcctgtaatcccaacactttgggaggccgaggcgagtggatcacctgagttcaggagttcgagaccagcctggccaacatggtgaaacactgtctctactaaaaatacaaaaattagttgggcattatgctgggcacctgtaatcccagctacttgggaggctgaggcaggagaatcacttgaacccaggagacagatattgcaatgagccaa

SEQ ID NO: 103205 - DNA, 1108 bp, Homo sapiens
ggctggagtgtggcggcatgatcattacaggattacagcttcgaccttccagcctcaagtgatcctcctgcctcagcttcctgagtagttgggagtataggcatgtgccactatgcccagataatttttttaattattttttttagaggtgaggtttcactaggttgcccaggctggtttcgacgtcctaggctcaagcaatccttctgcctcagcctcccaaagtgctgggattacaggtgtgagccaccacacccggcctaaacccaaactcttaatatgatattcctattcttcttaagtataaaaaggtagatttcggataaaataaatatttgagaataatccgtgtgaaattttttattccttccttttcaatgagagggagagaaataacagggaaatgactgatatttaggtgtatattttaagttggtcaatggagatagtctcaatactacctcataattacttagaattctacagcggcaaagaaaggacacaaattgattttggagccaactcagttgtgctacattgtagaagggggaaaatccttactgtaatcgaaattgagaccaagctacttcttaacataggatttatttttaaagtagatgtttagagatccaaaatgtttttataagctataaaactaaataaattacataaataaaatagttaaaggaaataccctatttagcatggacaatttcagtacagcagtcatttagtagataaaaatagactgtgtttctgtttttgtagacctcagtttaaaaatcctccgagaagataaaaaatgtcccgggtcactgcatattatcagatggtaagtaatagaaattctataaaagttgaacaacattatttttatcatggctgaaattacccataagactttatttagtaagatcattttttaaaaaaccatttcttcttttctactttccctctttctttttctttttctgtttttgatttttttttttttttttttttttttttttttgagatggagtctcgctctgtcccccatgctggagtgcagtggcgcaatctcggctcactgcaacctctgcctcccaggttcaagtgattctccgcc

SEQ ID NO: 103206 - DNA, 2219 bp, Homo sapiens
ggtgtgagccactgccctgacctactttccctctttctttttaaaaataattttctaggaatttgtaagaattattcaatataattttaagacactgatttagctttttgaaagaaaattgacttgtataaaaataaaaactgtgataaaatattaaatatatacacctattatgtacccacacagattttaaaaattgataattcatcatatgtgtgtcagtgtactaaacatgggatccaaaaaaatttggttcactaccacaaaatagctcactattacttataaaggtctatcatcatattaaaagttgctggaagtttaaaaaaatgattaaatgggaaaggtaagatggttatcaacttaatgtacatcaaagcaaaaagtgcaaatgaattctgtacttggaatttttttggatttgcatatggtccaattgacatcaaacatttatttcttgacaggattcaaggttgttttgatgctttggaaaagagatacgtaagaatgtttttacacttacactggaatcaaaggcttgtcttttattctttaaaaaaagaaattagacatttattttgtttttgtgtttaacagtataagtgtctacgtttgcatccataaactaatttcttatcttatgtctttattgtcctgttgttgtctcctttgcatcaattagaaagaaaactcattttttctcttttacatactcacattttttgaccacagagtttcctctgaagtcactggaagagatccacaggatgtgggacaggagagacaagaatctggcatttagtgcattgaacaaatttagaatagtggtgattcaatttgcagatatgaaaggaaaaaattgacttgaataattggtttttattctgtcttagttattttggtaactatattttgttcataagtataatctattcccttacaatagctagtattgtacctcaaattttaaaaaaatacagcttaaattttaagtgcatctgatctttcatgctgcccaagacagctatgaagggtgtacaaaatggaggctctagtcctagttgaagagacaagatgtatataaatgaaatttctctttttctttttttttctgtgaagcttttattatgaacagagggcagggcaaggcagggggctcagtccttggcagcggctttcctcatggtggccaggacattgcgcagctcctcctacttcctcttggtgcggatgtgtgttcccacctttttcttgatgaacttgaaggcccttttgtccttggagaccttgagctactccatgggatgctgcccatacagggtgaagccacacacctctcagatcatatcccgcatgaacttggtgtgtttggtcaggcacctgcgatggcagctgggcctgggcttgctcacattcttggtcaccttgtggcccttgttgaggcccatggctgtaggataaagcagaaccatggctgctgctctccagtgacagccaaggcctgtaagtatttgaaatttccgccactgcttttccccactttctccatctatgtcttctttttactcctcaattcctgttcctttaagaaatcttgaggtcaggaagccttacactggattatttagcaaattcatacatttctatttccactgcacatttgttacttatgatttattcaacactgaccagagggacctagggatacaaagataaaacagaagtgggaaagagcttgtaaccatggcagaagataagtgaattcatatgcagggctgatgatcagctgttacatactgactcagctgtatctgctcttaaaatattgaaatatttctgtattgaatggtgaatagctacttttctgagacctcatgtggctccccatcaatatcctccccatcaccttacagtgtctcttttgggatctctccagaacactccaaaatccagtaaccaaagggttaatatctagtccgaacgttgcttccaggaggccagctctagagccaaattggcatcctttctgattggccagtatctatgtcatattgggctttacatgtttatttattaatttttttgtgagtgtgtggcagagtcttactctgttgcccaggctggagtgcagtggcgcaaacttggctcactgcaacctccgcctcccaggttcaagcgatgctgctgcctcagcctcctaagtagctgagattacagaa

SEQ ID NO: 103207 - DNA, 1306 bp, Homo sapiens
gcagtgagctgagaccatgccactgcactccagcctgggcgacagagcgaaacttcatctcaaataaataaataaataaataaatgaaaatagtttgagtaaaatcagatttgagtatctagagatcttgaaaggtgttcccctgtaagagcatgattatttctagttatgaaattttgtgtgattttttttttttttgagacggagtctcgctctattgcccaggctggagtgcagtggtgtgatctcggctcactgcaacctctgcctcccgagttcaagcaattcttctgcctcagcctcccaagtagctgggactacaggcacgtgccaccatgccttgctaatttttgtatttttaaagtagagatggggtttcaattttgggtgatttttatacttattttgtactttatattatgcttgaattcttcaaaataagtacatatcagtgttgcagataattattgtaaaaaaagagactatattgtatatagctatctagcttgtttccttattcgcattctcaatccctcaccattccaacccactgtccacactgcatactttcagaaacccaagtctgatcatgtcattcttttgcctaaaaattttccacagcttttaaaataaagttcagggtccttcacatggtctgcaaggcctgtatgatccctatcttcctgtccagggcatcactgtcattcccatgttcaagccacacaaagaatctagaacatgccaagctccttttacctttgcatatattgttcctcttgcctggaaacttctctcccctgccccatacaccttgcctggctaactccaatttatctgtcaagtctcagcttaaatatttacttccctagggaagtaaatacttccctccctgacaccctcctccctagcctagatggtccctttatttcatgttctcatagcatcccatgctgcttcttcatagcaatgaacacaatgttaatgatgtagctatctttgctatttttttgttgtttaacgttgttctcccctgctagtctaaatgttccctgagattgggaccatgtctatttttgaatgaatgcataaataaatgaactcaattaagtaatgtatgagtttatatgcagtaatcaaaatggccacacagtggcagtaaagttttagtcctttgatatgaaattatggttctgaaattttttttcttttctctttctttctctcgctctctctttctctccctccctccttctttccttccttccttcctttcttctttttcttcctttctctctttccttccttt

SEQ ID NO: 103208 - DNA, 1072 bp, Homo sapiens
gctgggattacaggcgtgagccaccatgcccggccctctctttctttcttatagggtttcactctgttgcttaggctggagtgcattggcacaatcacagctcactgcagcctcaacttccaggcctcaaacaatcctcctgcctcagcctcccaagtagctaggaccacaagtgtgcaccactatgcctagctaattatttactttttgtagagatggcatcttaccatgtttcccaggctggctttgaactcctgggttcaaatgatctgcccaccttgggctcccaaagtgctgggattacaggcaagaaccactgtgactggcctgaaattttctgatttgtattctagtttttaaaaacaattatcattggcttgattatatttctatctctatatgttactctttcaagcagagataatctgttcatagtagtgtatatgtagagaggacaaggactttatagacatataagatgtttttactttagtagattagtttcaaatgggacactttttgaggtacttgttgcatatttaattatttagtaataatgaattattttgtataccttttgcctccagaactagaatataactttttaagggtagggatagttatcttttttgtgtccctctcgtctctagcagagccctgtgtacgtaatggactctcacttgaatgagtgaatagttagtacagttggccctccatgtatcagagcattctacatccacagattcaaccaactggaaaatatttagaaaaaataacagtacaacaataaaaataatacaaataaaaaatacagtgtgacaagtatttatatagcatttacatggtattaagtattataagtaatctagaaatgatttaaaatacagttgaactcattacacattatatacaggtatcaaaatatcacatgtacccccaaaatatgtacaactattatatatcaattaaaaaatgctagtctttcagaaatggagagaaaaaaagaaaaaattataggaaagaatcagttttcagatatctaggaaattcccctttataatgcaaaaaaatt

SEQ ID NO: 103209 - DNA, 2454 bp, Homo sapiens
acagtggctcatgcctgtaattccagcactttgggaggccaagatgggaggatcacttgaggtcaggagttcacgaccagcctagccaacatggcaaaaccccatctctactgaaaatacaaaaattagccgggcattgaggcgggcatctgtaatcgcagctactcaggaggctgaagcaggggaatcccttgaacctgggagacagatgttgcagtcagccgatatcatgccacaacactccaacctgggtgacagagtgagactctgtctcaaaaaaaaagaaaaaggaaaatacagtatctgtagatgtgaaacccagatatggaaggctgacttttcatatactccctgaggtacttgagtacacatggattttggtattcatagggagtcctggaactaattccttctcagatactgagggatgactgtatcctttttcttctggccttctggatatttttttcctacccaaatctttcgaacctctctgaaataatattttaattagtctattgaaaagaatgataatataggtgcaagtatgtaataataatagtttttttttctttctcttgaagctacgtatggcagtactgacagtaagtacacactcatttaaagaccaagcctctgtctctatttcattgtcttttggcaagtgaaacattaaaacagtactctccctcttcctccctgactttttttttttaatctgtcttggaattaaaaacataggatctatcagaagtttaataaaagattatgaattgtatatttctttggtataatacatgggaaaatgtataggctatactatctgcttcatttattggctctcaggattttatttttttagttactttacagactccaaattttttgtttttgaagtttggtagactcttttgaaattttgtatacctctgagtttaacatgttatacatagttaagaatagaaaatgagaagataccactgagagtcttagatctatgatttattgaacaaattttaaaccataatggattatttagaatttatttgtagcttagtcatggtaattatgaatccttcattattaatttccttttattcagtgttcacagaatattctaaagactctacattcacaaaataagcatatcctatctctagcttaaaatatatgtctgtactcaactaatagaacacaaattgaactctatataaaaaaggtatttgatgaggagtaatctagtaaattccagaaattaaatgatgtttattttcccttatacagctttacacagatcccatgggatctgaggtaagaacacacacaaacgtataggtgggtagtatatgtatattatattttaagatgtttttctgagttgaggctatagattttgttactagactaccatatgagcagaggaactaatagtgggctctttcagtatattttactctaaacttgaccaatctcttattatgagatttttcaaaaactatgtaagggtattggggaaaaaaggcattgagaagaactgagcttattccctaacctgttggcattaagagtctcttaatgtataaatgtataaaaccacatttttttcttaaaaattttttaaatttaatttttatgaactttttttccgagtcatataaaaccacattttattatttatttaaactgattatgaatcttttctgtttatggccttttgggaaaataaatgagatatggcataactctaattttcatttttgccaactaaattctccctcttttcgtgtttttatagattttcagagctttacctctttacttctctctttagatttcttccctctgtttagggaatccgactcatcttcaaggccaactatgttcatatcttatatgtaaacctctttggctatttggtctatactaacttctttctttaaattctttttccagcagaaccccacaatttaacactctcaattgattcatattgattacttaatctcctcaaccagattgtgaattcttctttttttttcttttttctttttttagatggagtctcgctctgttacataggctggctctgcctcccaggcttctagcaattctcctgcctcagcctcctgagtagctgggactactggcatgcaccaccatggccggctaatttttatattttttatatttttaatttttatatttttagtagagatggggtttcaccgtgttggccaggctggtcttgaactcctaacctcagtgatcttcctgcctcctcctcccaaagtgctgggattactggcatgacccagcatgtctggcccagattgtgaattcttgaggacaagagtcttgtctcatagtcttggacacataatagttacttgtgccactttgaatgtggctgtgggacagaaattgagggagaaactttctgttctcttctcactt

SEQ ID NO: 103210 - DNA, 2224 bp, Homo sapiens
gaaaccagtgttttttgggggtagtgaaatgctaagcaagttgagtttaattacaaaaaaagtattacagagtgggaagaaatgcaggcatatataataatgaagttaggaaacaaaagctggttatgtggtaagttttgagctatcatttatgacccaggaaaaaatattttgaatgtttacagagtgttccccttatgggtagatagtgatgcctaacctctacgtgttcatggtatactttttattactaaaaaattcagtagcatattgggtaatactaaaacactcaaaggagcccaaacaaatcagtaataattacaatgtaactactactgtggtatagcaatgttcatagggcctaaaaagcatccacaagttacattattttatgattgctatttagcatcaagtcactgataaaactatttagctccctgatctcattctcttatgtactcaaaaacaacattctaacataaacatcgtctttggcattcatctcatattgtgccatgtttcttgagttatatgcctggaagtatatcctttcctaaacaaaattgcacaaacaataacaatgtttatatatgcctgaagcaaaaatacactagacagttggattaaaatttgcagcactcttgtgaagagtatgtcatggtataacaattgagaacctctggcttaaatcaaacaagtgtgtgtccctagttcagaaggccaactgagttttcagcattctacaaagttatggtacttctgtgctataagttttgttctggttgctccatctcatgaaagagatgaccaacgaaagtaactaagcatctaagtaaactaagtactaaagtagtgaagagtgatagtgtagcttttctataggaacacactacaaaatgagtagcaagtattagtaaaacatgtaagccaaaatgtaaataagatttacacagcttaatgcatataagaccatatagaattattatatatgaatatggtgaaggcataaatcttatggtttcactatctattcctttgtgcctgtttaccattggaggtgatcaatactctttattttttatttttttaagagacaggctctccctccatcacccaggctggagttcagtggtgtgatcttggctcatggcagccttgaccttctaggcccaagcgatcctccaacctcagcttcccaagtagctgggactgcagttgttcgccacaatgcccagttattttttaaaatttttgcaaatgtggggttatgttgccccggctggtctcaaaggatccccttgcctcagcctcccaaaatgctgggattacaggtgtgagccactgcacttggccaacactcacctttaatagattgcctcataaacttaactataagtagtgtccatttctagccacaatatacttttagatactttattttagaaaaaaatcgttgtaggatgaaatcctaagtaagcatgaactctaccttggccaaatatttattcattcagcaaatattaattgggttccttttatgtgcctagcactgttcaaggtataaaaacacaggggtgaatgggataggcaagatccctgctctctagaagcctacgttcttatgaggtaggataaacaataaataaataaataaaaattagtacaaacaatttcagatagacatagtgctatgaagaaaattttttaaacaggtgatgtactagagagtgctgaagtggagaatgaagaaggagggattggatggctgtgttagattgggcagttcctaggaggcatccctgagaggctactgtttgagctgagatgaataaccagaaggagtcagcccatgcaagtctgtgaagggcaatggcatgtgacaggccaaataacaccacagttaacatcacaggcattggcgtcaaatcgcagttctaccacttactagctacatcaataatgagactaatgtctacttcagagtgttggctacacaaggagatgaacttgtgaaatatttagggcagtgcctgaatattattattatcattaaccggagaccacatgttccagaatatagctgtgcaaaggccctaagacaggaaggaatcttgggtgtttgagcatagaaaaggtgccatgagcctggagcttagctgagtgcaagggaaagtggccagagataaggttagagaggcagacaggggacagatgggtagggcct

SEQ ID NO: 103211 - DNA, 1026 bp, Homo sapiens
acttttggctgcagaacagagaatgagcatcagatggacttgcaatttgctttagagatagacctgaaaagtcttgccaatgggttggaatgtggagggagaaggagaggctgcatatgttgctgctgctttggcctatgtgactatatttagtatgattcatagaaaccactgatgagcagttcaatggttcatctttattaggcaacacattagtctgaaaagtgttatatgaggtgttaagaatagtgcctgctgtaaatatactttcctagataagccagagtcagactgaagttaattaaggattagcatcttctgtaaaacaattataactataactcttttattagttgcttcagggatcaaataataaagtgtaaataaaattatcaactactaaaacaacctactcttgttacaatttaaaaaaacaaaagatcactcagagcattaaaaagctagagttgattgagaaacatgggcaggcaggaagaatgagcattgtttgcttggcagagcaattacacccagcattggctaagagaggactctgttcatctcgcctatctggagtgaacctgttgctataggctcctctaatctcatctgtctctcctattgtatttacaaagcagttttctgaacttgatttgatttctcaagtaggctgtcttattcagaaaatacttttatcttttaaaattaactccattacaaatcaatctccttagagtttaagcatcatgagccaattttcccaagatctgatcacctgtaattaagtttcatgttaaggtttaagatcagcagagctgggaggcttaaagtaacagaaacactgagactttttctgatcagtctgacatcctcattttcacattgtcaaggatcaaatactgaaccagatgaataaaggacattttttgtgttctgttttgagcttatactgtttacttgtcattagtacttctccagctctgtggacatactgtatgacatatctgggccaaacatttgcttcaa

SEQ ID NO: 103212 - DNA, 1034 bp, Homo sapiens
cgtagacttctagcttacttagaatgaaatccaaaccccttaccatagccaacaaggccccatagtctcctttatcacctcatttcctgggttctccccctcgctcactggtttccagccactgggcctcctctctgaccctagaagaggcatccctccccacttcagagcctttgcattgctgttccctctgcctgaggcaccccacccccaagatctgcacataactgacccttgaggctcagttcaaacctcacctcttcagcaaggccttccttggcccttccaaaccaaagcagcacttgtccccttcatgtacctctctatcacagcatctgcttcttgttcacagcacttacactatcggaattagcttatttcatttgtttacttatttactgactatttcccctactggattgtatgtatattccagaaaaacagggaccttttctgtcttgttcaccgctgtgactccagtgactggcacaaagtagacattcaatacaatatttgttacatgaatgaatggtttctcaactgtttccactgttgtttacctagtttggttagatatttgactctgtgattttgtttttccagctttaaaatggtaataatagtatctttcatctaatttatttttagcatggaggagaaaaactaggttgtctttatatttggaaatattactcttgaataatgtgatactgtgaaacaaacagctatataggaagtacagtagatatacagtgaaaatgttccttacttatgatcaggtaagattctggatttcttttctaaattcttttttttctttatttcctttggtttttgtagaaggtgactgagatgtaccagttcaaattcaaatacacgaaagaaggagccactatggattttgacaggtagaatctaactgcttaatgaacatgagaaataaataggattgaggtaaacataagcttcttgaggccagagaaaggccttatacttctttacacatttccccacaaaccctacagaaaaccact

SEQ ID NO: 103213 - DNA, 1036 bp, Homo sapiens
ttataaaaaggggctgcaacaattgtttacattcctgaaatccatggattaagctggtgggaatagagaaaatggcatgcagcacaaaggtagaaattatgtcaataaggttgcctacacgctattgattgaataactccataaggctctgtctagccattaattcaaagtttctcaactgctatgcctagatagcgatcctttccacctcgatatagccagcctgtgcctagggtagataatacccttggactatttgcccgtatgcacaaatattctcatttgcttaccccagtatgtcatataaatatcatttccttgtgtccttgtatgaaaagattagaaagcactgcagtttccttatgaagtcgaaaattccaagttttaggttactaatgggttaaatagcaaacacaaggacattgaagagcaacgtttatttttctcccagtagcttttggattcagacctgccaggggggatggagagctaagtattgctgatgagatggcacagtagtggaaggtacagatgatggtgaaaagctctggatagtagaggaatccaagtaagggggatggatgcccttgaaaggaaagactgatgagagacatggcctaattttcaattttccctactattagctctggctcatcatttgccatgagcttgaggacttttctccaagattcactcccttgattatccttccatttgtaaaacctacagacagcactagaatgtgaagagaaaatcagttccaaaaatgagaattaaaatattaccttttattagctaacatttgtataatactttacagcttatacagcagcacttttcatacacgttttctcacataaaaagttacctttactctccaaaactcaaaaatatacactgatggccagattaaactcttttgttctgaaggcacatatgccaagaggtaagctgtaaaacaaaaatggccaaatctttcacatgctaaggagagaaggtgatgcatattattaatttcctagagaagaaatatagg

SEQ ID NO: 103214 - DNA, 2285 bp, Homo sapiens
gagtgaggaagggatacttttgcgagataatcagacggtagaaagtcccagagctggtgattgattttatgcttgagagttgtagaaatgtctttacgcttatctcacaaatgagctaactgacctagagtgtgtctaaatgacttgaccaaggtcattcagctagttatcagcagagctgatattagatgccaggtcacctaattccaaattcgttgttcttactgttgtggtatatgatttttttcaaatcaaatttttaaaaagatcgtattttaaatgcttttagggaatttgctacttaagaaattctttgtatatacattgcaaaaagtaccatcgctcccctaatttacattctaaaaaagtctcaaaatatactaatgtttaatttatatttactcacatagtcaaaagttttgttccttttgggatagattgccactattgtatatgatcaaaaagtatgcttttttttctgtgtagtcatagcagcagtacaagctttgaaagtggaacaaacaatgaagatattaagaaagccagtgttctactgatccgtaaattgtatatactgatgcaggaccttgagccacttcctaataatgttgtacttactatgaaactccactactataatgcaggtaggtagagaactttaggcaaattcctccttaagtgctgagctaatattttctataagtaaaaggattttgcaggcatctgaaagagaagtctgttgctacacatgaaagattaatcggatttgttgtattgaaactcagttttcatggctttttgcccttttcatttcgcagtgaccccacatgattaccaacccctcggttttaaagaaggggtaaattcacacttcctgctgtttgacaaggagcctatcaacgtgcaagtgggatttgtctccactggctttcatagcatgaaagtaaaagtcatgacagaggctacaaaagtgattgatttggagaacaatctgtttcgggagaacagcactactgagatcgcccatcagggtctagactgtgatgaggaagaagaatgcaatgaccatgtaaggcaaagctttagagattttctatcgtgtcagttaaacacaattgatatttttcagtttctacccagggcatgcacgtggagtgtgccagctataaaaactgaaacaaaactagtctctgacatcaaggagtttttaatctaaaaaagtttaatcttctaaaaggaaatatactttatcagatgaaattgtccataactaggaggaaaaagattttctaatatatttattttattaaagatatcataaatttagaaaatttgaggttttctttcctttatttgtaaatgacataattttagggttgaaaaatattctaggtatttattcatactcattggaagtataaatcagttcttgatactgagataattggatgggaggagttggggaagataaattttatggataaacccgagtcagcgtgaaaacaaataatagttaacttctggttatgtggaggaagacaagctttggggctaactcactggggaaagtcagggggttggtggggttggagctagtggagccaaacagtcaggtctctgatccctttatcctcccatttccaccaatagagacttggagttagattcttgctagggtcccattatgccctaggtaactccacacccttaactggtggttgtctggataataatgttaactgtatgacaacattgtgttaaaagggttctgagttagacaaaaaattttcagtaggaagggatgctataagatcttttcaggagatattttaagattagaatgataacttgtttgcttaagataatttgagtcttatttaaagataggtgactgtactaggtaacttctgaaggttccttctagttctttaactctgtattatgtttaatacattgaaaagaggttctagttgttctagttttaattcaattaatgtaaataatataaccaaacaagtaacagattgtttttaaatttttagtgctttctcgatgttagacataaaaatgactttggattttggtgcaattttcctcttccaatttcacccaaggaagatatagctaacatagaaaggggaaaaaaaatgaaggttaagaaaagaatgtttcagctagttttttttgttgttgttcttgttgtttttgagacagggtctcgctctgttgcccaggctgaagtacagtggtgcaaccatgactcactggtgcctcagcttgccaag

SEQ ID NO: 103215 - DNA, 1030 bp, Homo sapiens
ctcaggttatttatcttttcctcaatggtttaaaaaatatgtgcttagtaataattctttttcactcatttatgttgcaatatttttttcatgtttgtggctcatcttttcactttctttttcttttcttttttttttttttttttttttttttgagacagagtttcctcttgttgcccagcaggcctgagtgcaatggcacaatctcagctcacggtaaccttctttctcctgggttcaagtgattctcccgcctcagcctcctgagtagctgggattacaggcatgtgccaccacacccagctaattttgtatttttagtagagacagggtttctccatgttggtcagggtggtcttgaactcccgacctcaggtgatccgtccgcctcagcctcccaaagtgctgggattacaggcatgagccactgtgcctggctcatctttcactttctttaagaggtcttttgagcaatgtaagtttttaattttaatatagtctaatcttttcctttaatatgtgcttttggatatccttaagaaatcctctacctaaggtcattaataatattctcatattttattctaaaagttttaatgcttttctttttacatttaggtttataatccacttaaagtttattttcatttatggagtgaaatagaccagactttcttaacacttttaaattcaagaataataaacatacagtaaaacatatgtatcagtgatacagctcaataaatattcacaaactgaacactagagctgggatgagggtgatgcaagcaaggtgcctagggagcatattttaaggaagatctcaggtgccaagagtaaggacctccttacattttgccccctggacatcttgcttgctttgtctttgtcacaaccctactgaataaatatgtgaaatcagcactcagatcaagaaatagaattcttccagaccctgagaaacccccagtcttattttacagtcactattctgctcacaagaatattgctatcctgacttctattcgca

SEQ ID NO: 103216 - DNA, 2824 bp, Homo sapiens
aatttataatttttgtctatgatggatagaaatgctttgaatattctggaacatgttttttagggaaataactacacatttctggtgggaatagaattactaggagtagaattgctgggtcaaagggtatgtgtatatttagttttaacagatagtgcaaaatagtttccaaagtatttgtgccaatttacaatcccaccagcaatgtatgagagttgtggttgctttacatcctcactaacccttggcgttttccatcgttaagattttagccattctggtgggtgtgctgtggtatgtcattgttgttttaatttatttaatttaatttattaaactaattttaactaatgaagaggagcacctttttatatgtttattggccatgttgaatattttcttttgtgaagtatctgttcaaattgtttgctcctaccctgcctttttttctcttggattgtctttcaatcctactgatttgtaggagctctgcatatatattctgcatataagtactttgttggatacatgtattgtgaatatcttcttcaaccttacgagttgttttcttaatgaggtgttttataaacagaagttctttttttttttttttttttttttttttgagacggagtctcgctctgtcgcccaggctggagtgcagtggcccgatctcagctcactgcaacctctgcttccctgattcaagcgattctcctgcctcagcctcctgagtagctgggattacaggcatgtgccaccacacccacctagtttttgtatttttagtagagatggggtttcataatgttggtcaggctggtctcgaactcctgacttcgtgatccgcccacctcggcctcccaaagtgctgggattacaggtgtgaaccaccacgcccagcctaatttttgtatttgttttagagataggatttcttcatgttgcccaggctggtctcaaattcctgagttcaagccatctgctggccttggcctcctcaagtgctgggattataggcgtgagccatcacgcctggcacatctttgtctttttctatttctctggtttggtttgtctttctgattccaaattgtacttccataaatgtatagacatgaatatcctacaggtaccttagattcaacatcttcaaatggaattttaacttctgaccaaacatgcacttcctcatcctaggttccttatcttggtattgcaccatcacttttctaagcaacccaaccaggaatatgttcaactgttattttctcctcactttctacattcttttggtacaccatttccatgtgttttgcctttgaagtatttctcaaatctagcgctgttaccactgtgctgattcaggatgtcatcattgctttcttggtgatagttgagtcttctaactgggtctctttgatgtcatcattgcctctccagtttgtcttccagggtgccagagagtgaggcactcaaatatttcaaatattttaagttgatttattttgtgtaattgcaaagggcagaatgagaaccagtagatgaaaattatgttgattttggctcaatagaaggaagaattttctctttacaaattttaaagcaatgttattataacattaaagtaatttaaaaaccaatggaaatcttccgccgtcccaccatcctatcaatactgtttttatttttatatgtcccatcctctccagtattttttcattgatttatatatttgtatatggttttaatcatggtatatgtgaatttattttacttttatacttaacattattgattttgtaaatatgttccactttaatctttatatttttaattttaatgacttcttgttttatttaggcactctaccatttccctactttgaaacatttaggttaattcttgattttgctattataaagtattataataaatacctttgcacacatgaaagcatttaaaaaatttttctacgaatatagtatcaggagtgaaatttacagagcttcaacatttgtatggctctcaaatgagtagtaccaaatcattttccagaagctgccagcttctccacctcctcagggtggattttctaacaatgataactacttaaacctggttgccttgtgtgggggtgagctccagtgtcaccagctgtgctcaagtgcagatatacacgtgtgttcaagatagagtatatgattagggtgttgcaaaagtaaaatcatgatttagagggaaggttgaactagattgacctctaagatatctttcatgctaagattgtctgggatattttttgaatccctattaagagaataatgccctggccgggcgcggtggctcacgcctgtaaccccagcactttgggaggctgaggcaggtggatcacaaggtcaggagatcgaggccgtccgtcctggctaacacagtgaaaccctgtctctactaaaaatacaaaaaattagccaggcgtggtggtgggcacctgtagtcccagctacttgggaggctgaggcaggagaatggcaaaaacccgggaggtggagctggcagtgagccgagatcgtgccactacactccagcctgggtggcagagtgagactctatctcaaaaaaaaaaaaaaaaaaaaaaaaaaaaaaaaaaaaaaagagagagagagaataaataatgccctgctaagcactgtgaggaaaataaagacatataagatatagcctgtgccctttagaattgtggctgaagagataacacctacataatgtaataaaaaggtaatactagagagtatatgaatgatagaaataatattaactaaca

SEQ ID NO: 103217 - DNA, 1052 bp, Homo sapiens
cattcaggcattcagtatacatgctttcacttaattccttgattccagtaccataatcctgcctcaactgcactttgtattccattatccaaagactttctattaccctctatagagaataaacctctgattttatcctagggtggaagaggaacaactgtttggccctgcaaaactggggagggaatctgaagattccaactgtttcataaatgtgtttcagttggtctttcttattttagctcctctacctaccctctctatctcctcttccaaaagtatctgatgctggaaattatttagaatgacgtgcatttgactggtcctcggtttggtccactgctggtttaggtttcttgggtctgctattttagttatttatcttgcatctgcttcctggcttccaaaatttcattgtcactgtcttttcgcttgttctttctttctgtttgtttgtttgtttgcatttctgccttttaaagaaatgtcttttcctgtcattctagaggggtttttggaggaaacaaaataaatgtgtgtgtcaatctgccatctttatccagaagtcggtaaacatatttataaaaacataaatatgtcaagagttagtttataggacaagcaatgcagttttctttaaacattttggtctgaagtataaatataatactactttaattcatacaggatttctgagaattggtaaagtattgcttaagaatttcaacatgaaaaatacttcctaatactataaaaatactataaaactatatttgaagaatttaagtataaatggcctcagtaaggaatattagctcatagtcctccacttggaaataaacccctcagctgtgttgaagaccattggagataataaatgacattatctgaaaatatttgcatgttttaaaatttcttactcatattatatctttttagaggttgccagaacatcactagtctcagtttaggaaaaaaaatattaataaaagatagtttgaaagatgacatagatactttcataggaattgataagaacacacagagagatc

SEQ ID NO: 103218 - DNA, 1841 bp, Homo sapiens
gtatgctgtcgacttccatatgtgttatcttgagccctgatcatccccaagagctccagttctatatctttaaccttctttcgggcatttgtgctttgagttaacactgtcatgtcaaatccagtatgctcgtctttttattcaccactgccttcccttttccacacatagaacaagtttctctacccagtttccccccatctcagcaccacctttatctcagtgtcttaagttcagaatcttgaaatcattctcctgcattatcctcatttagtcaagtatcagaattcccctaagccttccctttccagcctgttcttactgccaaaactcaagtccagaccttcatcctctcctatctgaattactaccacagccttgaggctctcccacagcctcctggatcctagataccactgccatctactgttatttaaatatgacttttattctatcgcttccctaatcaaaaatatctcatgagtcttatttccagcatcaagtctaaacaccttttcttggctttcgggctgcttgtagcctggctccaccttatctgtcttattacccaacatcttccccttccttgagttaggtcagttttctcactgtcacaagaactggccaagttcatttcttcccccatatcttaacaagtgtattttctcttgtccagaatgcctttctttccattggcccaaatcatatccattttgcaagagaattgtctatgcttcctgtgtccaattccctgctttctgttctctttaacccactttaatcaagcttttatcaccaccactttactattcaagccataattcttatcactttcctatcattagtcactttctcagtctttcccatctcagtaaacgacactatcatttacttagttgcttcaaacctaaaagccatctttagttcttctccctcaaaacctatatccagtccatcagtgagtctagtgagctttccattcaaaatatatttcaaatctggccacttctcactatctcactgctaccactctggcccaagcaaacagtacctctccagtggtctccttgctttcatttttgcccttgcacagtttatttcaccaaagcatctctaaagatgtcaatctattcatgtcacttcactgtttatggcttttaaggccatacctgatctgctctagcccaaggctctgaccttaccttctttcaatttccccttacttcctcgtctctattttctctggccttctttctgtttctacaaaaagctaagctttttgacacctcacttacacatggacacatttcagaatagtcactagataggttagaaaagaataagtgttttcagtttccacaatatttgtcactaaaatatgtattgtattaacaggaaaaacttatttctaaaatctacatttttgtataagtttatttttattttgaaataatctcaagcttacagaaaacctgcaagtacacacaaatcatgttttattttctgagccatttgctttatcactcctgtatactgtactatgtaattcctataggcaaggatattctcctatatattcacaatataaccatcaaaactgaggaatcagctttgattcattactgtcatctaaccctcagattcctttcaagtttttccagttgtcccagtaatatccattatggcaaaaggatccaggttagaatcatgtgttgtatttagttaaatttctttagcttcccttagcttggaacaggtcctcagtccttccttgactttcatgaccttgacatgttttaatagaacaggccacttattttttagaatgtccttcaatttgc

SEQ ID NO: 103219 - DNA, 4088 bp, Homo sapiens
cctgaggccaggagttcaagaccagcccgggtcacacagcaagacctgcatctcctaaaactttttaaaaagttagctgggtgtggtggcacgtgtctgtagtcctagttactccagaggctgaggcaagaggatcacttgaacccaacagttttaaggttgcagtgagagctatgttcacaccactacactccagcctgggtgacaaagtgagaccttgctttttttaaaaaaaaaaaaaaaagaaagaaagaaagaaggaatatcacagaattggtgctgagtaatctttacttccttcaggtggcacatgattttgatttgtcccatttcaattatgttttatttggtcacttgattaaggtggtgtctgccagccttctccactgtaaagttattttcccctttgtaattaataagtagtttatagaagagtacttagcaactatgtaagttatcctgatcctcatcaaacttcccatttattcacttatttatatcagtatggactcatgggtctttattttatctgttactatcattatttattttgatgctcatattctctaagatgttgccagtgggagcctcttcaagttggctcttgtattctttgacatgtccctctaattaagcacttccttacatcctgttacaagctgttccagactcgtcttgtgttttccctgttccagtcctggaatcagccatttcttcaaggatccctggtttttcagtggttccttctaatagccacaatgtggtttctctcagtggacagaactagagaatatatgtatgtacacaacacacacacacacacacatctatatttatgtatctatatgaaaacccatgatttcacacctataccatcaatgccaatccaatgctgtagaattcattctagctttatcactttctatatttgtaatttttctccatcagtgagagaactggctgccattatcattagcttattaatttatttgatcagttcccttaaatgtaaccaaactcccatctttgccaccttccttgtacacatatagacacccatatcacacctctaggactcttgactctactccccagactgcctcctcaccctgctcaagctttgacactctgccttgggccttttccccatgtagatgaccctgcttaccctgctcaggctccaactctggcattcccactgtgggtcacccacacttgtgatgccctcgttactccatttggcactgactccccaagccatgctcgccctccacatggttgccctcctcacactgcacaggctctgatacagatgcttagcttgctctgccccacctgacattggctttaggattgagctgtttctcaagaattgggaaaaggaagaagtaagaccatattttatttagaaaatgcttcctacctagtgtagctttcactatgagttgagaaggctgtaacatttctgttccctttgacctaaaaaagcatatattattagtattcatctgccttaaatactgtagcaatcagtggaccaagagccaaatcatttttgaaagaacacctaacctaaatgaatgtagaaacaaaacaaccagataaaaaaagaaagatttcttcacattttttcatcttttgttcaaatgctttggtattatggacacagtctcggaatcactgttaagtgctaatgattaataagttcatgaaccttacattttgaacagggtagtttctgatgcctgacgcccttggatcaaaattaattgtatcttttaaaactgagaaatgaaaatatttagtcacaataacattactgtcattcagtcataccacaagattttgcaaggcaatatctacattgaattgattgtcccttgaaactttagaactaaaacctctgcaagattgtccttgataatcttttcacagcaataaaagcactgacgaagagtcagggcgttgtcatcaaagagactaaactgctgcagactacaactttcccaggacaaaaatattcaagtttgcctccaaacctcttcaagatataaactaaccattccaagaagtagctttttcattcctactgttactctaaattgtctgagaggcaaatttagccttttttctaaattaagatatgttattattgggcttttgtttaattctaagccaaaatatacccaaactcccactacattccttggaagctgtagatgctgttgaagtgctctcttggccacatctcactcctttaggagtcagcactctccatctgtatcctcttggagaccatgaaagggaaaacagcctctgtgacttctccaaccaggtgggtcagattagctttacagtccacttacaaggagactaacaaagctcctctgtgggtgtttgagcacattttacaaaactgctgatgacctcatgagccaaagaaaccaggtctcacattgtggactaagcctaaatattaatactactttatatttatgtagtgtcttttttccaaggaactccagcctctttacagacattatgtcactaatcctcaaagcatccctgtttggtacatggcaaatattatccccctccctttttttttttttaacagtgatggaaacttgcaagttggtgatggaacccagccccctggttcttagtctatgcactataccataaaaaaagtcagacgaatactttttcaagctattcattgcttcttgggtgggatttaagaggatgtcttggcttgtatgcatttcagttttcagtgtctctagcttctgtgatcctctttttcttcttcattgtaagtcaagcatgttcaagcatatttctcttccactgttgcatttatgggaacactagaagtttgtaactgagatttgaagtgaaagacttcggtattgaatatgtaatttcacttgtcactcagagatcccttatacttctcataacctaaaagaaattagattttttaaaaaaattcaccatgccagcttagagcacatttcatttatagcaatcacattttcaccaaaattaggtaatgttcaactaaatacaaccaatttgtgttgaattattaacatgtaccagatattatatcaaacattttcaaatatatgatcttgttttacatatattaacacatatgtaatattccatgtgaacctgttagatttaattcttaagtgtataaacactctcctagagtagggcaaagaaaaaaaaagaggcattaatagaaatatggcctcagttgttatatccaataaaaataaaaataaaagagctccctcaattctctcagtggaaatccccagtgtaaatatttccacaaaagaggaaaatgtgggtaacttctaaaaatcaccaggagttagcttcatatccacaaagtaaaaaaaaaacaaaaacaaaacttaaaagtttggttcctacataatcaacaactatacaaagcataaggaagagaataaaacacagccatatctaaggatgacaaatatttcttgatttcacttggttagacccttcctaatcaggattattaaaaccaggaattatgaactgtagtggtatagcttgctcactctttctttcctttctttctttcttttcttttcttttttcttttctttctttccttctttctttttctttctctccttttccttttccttccttccttcctccctcccctcccctcccttccccttccccttctccttccttccttccctccctccctccgtccctccctccctcccttcctcccttcctcccttcctgtctctctctatctctttccccctccccttctctctttctctttctttctttctttccagggtcttgctctgtcacccaggctggaatgcagtgacatgatccacagctcactgcagctttgacttcctgggctcccgcgatcctcccaccccaggcttccaaggagctggaaccacaagcgcacgccaccgctcttggctgatttttgtatttttggtagagatggggtttcaccatgttgcccaggttgatctcaaactcctgagctcaagcaatctgcacacctc

SEQ ID NO: 103220 - DNA, 2205 bp, Homo sapiens
aaatagtaaagcttttgaaaatgctcattttttttttctgattcactactgaagaccagttgtgagctgcaggagggcttttattatttttcctatttttttgtgtatatgcaaggtccttagttttttcctctccatgttgtttccaaaagacttccttactgactgagcttcagcacactgctctggcattctcccagctctaagttttcatgagtcagggaaaatgtgtgcactctgaaaagaagcttgtcagacatgctcagccagctgacatgaagtccctctctccattcttcttttccatccacattcttacagcctactgcttgtacctttatttagccctgacttcatcctacctgtgttggatgttagttagagtttgttgtttacatatctgtgttccttactaccttgaactctactgcccatccctgctgtcctgctgccactgtgccctgcccttatcaccaccatagcacttagcatggtgccttgaatcttctgcttgtctgaccctcctcttttacctttccattctttggttttctttcattttctttagtcaggaggaaaatatgtattctctagatggggagaataactggaggaatgggaagaaagctcacctccgtaaaagaccaagagtggccctgcagttagttctgttacttggtcacaaccctccatttcctcatttactcttactgtggccaggcctggcccagatttaataaaacaacttgaagagggtgatatcatgaattttattccagttttaagtttttagtgatgcagttgattttgaaatgacaacagtacagatggtttttgcaaggatgtaaaagaaactagtaacagtgattgtcttttagaaggggacttgaatggttctgggatagcagggaaagtttcactatatacctttatattaccttttgaattgcatattatgtaaatgtattagctattgaaatagatacataaaactaacaaaaatggaagcaattaaataactatagttgaactaaattgatgctgtagaaaattctgttaattacaacaaagtgtttgaatatattttttcaaagctagatcaggaagaggagaggtatgattattctcattttgtgttagaaattttgaaaatgtttcatcatttcctgcataaataatatgaaaattaagtttaggtgcatgctccttatataaaacttatcctcactctgaacactcaactacttcactttaggggttttctatttctcttcaattgaatttagggccaatttaaagtgaaaatctgacttcttagtgactgtatcttgcaactctgcctctgccttgtgtggaggaactttactggggaggccagagttcctaagtgttatctactttggtctctccttcctgccagcaagagtaggcagttatgacctgaggtttagatattgcaccaatagagatcttccatcttagacaattttcataccaaagtggtctttttctgatattttataggacctatctctatagtcatttctgtacttacagttatgctatgttcctctcaacacctgctaaagcacttatagaggctcatgttcaagcaaatgacctacatagcaagtctgtgagaagcagggtattgcatttccaattctgtatctattatctgttcatctcttttttgaagaatcagcaaatgtatgtcaaactttagtacatctaatgacaccatcatgtcattgcctgtaaatttcctctattcatgccacaaaccaagaaacaactttttcatttttataattacttcaagtatgtgcttgagcgtgtttatgtatttaatgtatccacctttaactaccacggaattcataattatttactcaggcatttgaaagtaagaaagtaactgacatttttctattgaaaagtatttaataatattttagaatattttataatttttaaaagcctaataaacattatttttttaaatgttcttttttacctttgcaaataaagcaagattgcaaataaaaagatttttacactaacattttttatcactttgaaataaaggggataaaagagattaaagtaataaaaatgttgattattataaccgtgtcaagtaatagaaaacacaatttaaacaataaacacactgatatgaaacttcatatttttaagtttaat

SEQ ID NO: 103221 - DNA, 1157 bp, Homo sapiens
ctgtcgcccaggctggagtgcagtggcgcaatctcggctcactgcaacctctgcctcccaggttcaagcaattctcctgcctcagcctctagagtagctgggattacaggcacccaccatcatgcctggctaattttggtatttttgtagagacagggttttaccttgttggccaggctggtcttgaactcctgacctcaagtgatccacccgcctcagcctcccaaagtgttgggattacaggcgtgagccaccacgcctggcgatttgtggacatcttaaaatcacaaatgcaataatattgtcctttttttaaacttacttttttcacttaacatacgtcttacagatttttccctattagtatacttaaatgaacctcattctttttaactgtggcatagtaatccttagtattaaagtgttctaggtttatttcaagttttttatattgatgaacatttaagtttttactttttcttaggaacattgcttcaggaatgtccttgaacatgactctttgtgcatatatgggagcatttctctaggatagacacctagggggccagaagatatttgaagtttttgattatctggatatagtcctgttcaaagattgtattacctcagaaaagatgcttattttttatggttttgtcatttttataaatcatgtgctgattttcttttctttttttgtttttttgagacagggtctcactctgttgcccaggccacagtgcagtggcacaatcttggctcacctcaacctctgcctcctgggcacaagcaatcttctgccacatcagccttctgagtagctgggattacaggcatgtaccaccacgcccagctaattttttgtattttttgtagagatgaagtttctccatgttgcccaggctgttctcaaaccactgagctcaagtaatccacctgcctcagcctcccaaaattctgggattacaggcatgaaccaccacgcccggccatgtgctgacttttatttttatttttatttttatttttgtgttggtttgttattgtggtaaaatatacataatatataatttgccattttaacgatttttaaggatacagttcagtggcattaagtgtattcacattgttgtgcaactgtcaccgttatccatttc

SEQ ID NO: 103222 - DNA, 1442 bp, Homo sapiens
ttcctcattgaaaatcatttgaccatatacatgagggtttatttctgggctctttactctactccattggtctatatgcctgtctttatgccagtaccacactgttttgattactgtaggtttgtagtaagctttgaaatcaggaaatgtgagacctccaactttgtttttcttattcaagattgttttggtcatttggagatccttgagatcccatataaattttagaatgggtttttctatctctgcaaaaaattttattgggattttgagaaaggttgtgttgagtctgtagattgctttgggtagtattgacatcttaaccatattgtctttcaatctatgaatgcagatgtctttccatggtctcatcattttatacattttatatgttgcttaagagggtcttcccaatgctaaagttataaataatttttttctatattttgttttaatagatttgtagtttgggtttacatatttgtttccttaagttagctgggatatttcccccagtatgataactttttcccattttattggtaccacctgaatagtctgccaattccctggtaattgaaatgccacctttttcataaaccatagcataggtttgtttttagatttttctcttctatttcactgatccatatatctactcttgtgatataatttttaattacctttattttatagtagcttttgatatctggtagggtaactgtttcccctcattcttcttctttttgtttattccctttatttttattattattattctttttctttattcttcattcttcttctttttttattctctttattattattattcccctcattattcttctttttcattattctttttaaggttttcccatatattttctctttcagatgactattagaatcagcctaacaagttccaacagacatattattggaattttgattgagattacatttatttgatgaattaatcttgggaaacttatttttataataatatgcctttgtgttttgaggaaacattatttctagtatctatattcctattatcaccataatccctaagaaattttctatttacttgtataatattcaagattgccatgtagaatagctctgtccaatagaactttccatgataataaaaatgttctgtatctgtgatgtcaaataggtagccacttaccacatgtggctattgagcaccagaaatgtggctaatgcaactgaggaagtaaattttaagttttatttcattttgattaaatgtaaatggccacatgtagctaatagctatcatattagacagtacggcttttgaatgtatgaataaatgtgtaactgaacacttttgtaagtagtagaggtagtgtagcaaagaattattgatacctactgtgtgaaagacattgtgtaaagcattgcagagaggc

SEQ ID NO: 103223 - DNA, 1030 bp, Homo sapiens
acatttagggtccacctgcataattaagaagaactctccatttcaagatcctttattacatctgtagagacgccccccttttatatttttgccatgtaaggtcacattcacaggctgcagaatttaggacatgaacatctttgggggctcattttttagtgtaccacaaatatccaatttgcctggagttagggattcctgtggcagtaggaattatgataactgtcagtcactgaatgacttgcacatgtgagaggttataccaagtgctctatctgtgctattccatttactcattacaagaacattgtgtaggcattaggagacgagggatgaatctaaggtgactgttttccacctttgatgactaggaaatgatgatttacagaaattgtagagtcatgaggaaaaattggttacaaaggaaaaacaataaatttgactttggctgtgtttagtttgaagtcccaataggctgtgcccaaggaaagatcaaccccaaatagaaacttaagggccccacgaagaattcttatagtctcttctataattttttaccttgttttcccctttgggttgaagaaacaaattataaggagcactaaacttgaaatcagaagacttgggttcaaaacttgcacttactaaatgtgtgaactagataagtcatttcacttctctgagcttcagtttctacatctgtacaagaggaataaccactccccctcccatcacacacagttattgtgaggaataaatgacataacatatgtgattttttagtatatagtctgttgtaagcattcaaatgtttcatttgaaggtaatatgtcttaaagctatctggatcctaagtaaaactctacattatttttacaaatctatgatcaactgcttttcccattgtccaaatgaccattctatacttttaccacttaagtgttttaagtgccacccaagaccaatttactccctttctaagcagatgacctaaactctacttcatagaaataattaaggccatcaaaca

SEQ ID NO: 103224 - DNA, 3666 bp, Homo sapiens
gtcaccggcattaccagaaacttgggtaatttttgtcatgttttactcctttctttcctttactatacctgtgcttattccaattaatgatcaagtcatggtagggctcaggttcaggcactcattctgtctctcctgagccctctatccttttaatgttttccctctaacttcactgcggcttttggtcttgctcagatcattcattttctgaagtagcctcattgcttctcgtcttactcctctccaatccacccttcacactgctgccatagggatctttctaaaacagacctactcttggaacccttcagggctctccattacagactctcattacaaagtccaaactttaaagaatgacattgtctgacccagcccaccactcccacacccttcctgttagccccattgagctatacccaattccccagaggtatcctgctttatatccctgtacctgtgctccttctgtctaaaatgtgttatctgcaaccccatttcctaatgctgtttgcctggtgaatgtctgctcatcttgcattacttagttcaagcttcatatcccttttgaagccttgccaggcctccccagaaagaactgataagatctttttggaacccctgctgtaccctatatatgactctgtcatttcctctgtaacctgtttgtttccccgtaccaggccttctttgaggacatgaagtgtcttgatcagctttgtatctttagtgtttaacacaatgtctggcacagagaaggtgcccaaaaaaaatttatcaaataaatgaattaattataaaacttttaaagttatatgatgccttagagaagggagtaaggaagaacttatgtaacaacttttggagataaatggaaatatctgattatgagcctaagaagaatacacatttacctcctaagtagagatagtcatggtccagaactctggtcacaaactacagaagataaagaaattaattgaatgggcaaacccctcataagtcccagtaaaacatgagacacttcccaatgcgctcttgatgtgatttcctccatccttagatccagttcacatagtcaacacctggtgaacatcttcatttggatatctcacatctaattcggaatcttaaaaacagagtcaattatttctccatctatcttccccaccattttcccacctctcactccctcaacttcttctatttccaatcttggtcaatggcattaccacaaacttggataatttttgtcatgttttactcctttctttcctttactgtaccaacatatcaagaaagcttacagctccactggtgttggacataagtattctctcaaagcatttgctttcttactgcttattcatcacaatgttaacataaacttcatttacgttaatagcatttattttataattactgttgatctacctttcattgtgccaaaaatataaatgttaagggaatcaaaactaacatcagtggtataacttacttttagggacatagatcctttgaaccatggaaatctttgatctggaaactgccaaatccaaagattctagacataaacttaactacaaatttatactggtgaggactggttttctcaagagaaaacattttgccagatctgacttgaaaaataattttgaagtgagcaaaattcactacactcaccccaggcacacaactcactgtatttcctggctgcctggggctgccctctcccgtggttccccatgcaggtctacctcctcatgcaaaacaagtaccgtgccctgaactgcctttcctgtgtcacaacatatctgtcttttttccaaagcctgtgaggctctgcttttagtaggctgacacttggagaccacttggtaaattcacttacactaacataatattaagtaaaaattccaggggaatttacatttttaacaggagtatgttggatgcataatacctaaccataagagctaatctaataaagggacatttcctaccatctcatatattttccatgtcttttcatgtttcattgtctttaaacatattgaactttctgcctagaataacctccccctgctcccaccaccatttccagtctggtgaactgctgctcttccttcaatacccagctcaatgtctctcttctaaggagccttctctaaattccccagcctgagttggtccctccctctggacttctataaaactttgtgtacttgtctcaatttctttagtcttttattcactcttcaaatgacttcaaggtgacttctaccctcaccaatccaatgcactaagtaaaccccatgtggtgaaatcaagtggacatatttgagtcctcatcttccttgccctctcagcaacacctgacactattgaccaccaccttttaatttctccactccctcttcttaaaacccccttcccctgactttctcaacatgacagtctgctagtcttcttttatctctctctttctcagtctactttgttggctcatcctctaactaatctctaaatgttagatttctttaggctatgtcctgatccttttcccttcccacactctgatctttcaataagcaaactcttccacacccatggcattagttatcctccgtatgcttatgactttcaaatttacatctccaacccagacctctttcctgaatttcagacttccacagatagccactgattcagcatgtccacacgaaggttttgtaggcactccaaattcagcaggttcaaaactcccattgttctcgacctgagagaacagcaactccatccatgcagttagccaaactagaaactgggaagttattattgacccatctatctctctcttaccatggtatccaattggccatcctcctgactctacctgccaaatatatctctcaattttaacttctctccatctccactgccatgcaagttatcacctgtctaccactataacagactcatcacttgtatctgcttgatgtctccaatacatttctacactgcaggcagagtgctctttgaaaattcattcatcaaaaagtatttattgaacctttactatgtcaaggcacttgctagatagtgatacaaatgtaaccaagacatgtatgttcctaatctcctagaactctatacagttctgtgattgggagacctaacttatgtgggatggagagaatttctctgaggaaataatttttttaatctgggatctgaagaatgagtaggaatcaactaggcaaaaagggaaggcaatggaggggaaagaacattttaggcagaaggaacatcatgtgcaaaggtttagaatcaagaggaagcaaggtatgagaagcaagatatgaggctaggcacagccagggcctgaggagtcataactctaactgggaaatactcaggaggtctagtagctcctcaaacagcctgccaaattagattagtgagtggaggtgtgagcatttttctgaggagagagtgcatagctttcatcagggtctgtgacactttccctcccctgaaaatgtaaagaactatgtctggggtatgaaagaccatttttggactttgtcctaaaaacaatggatgacattggaaagtatgaagccaaaaagtaacatggccagattgtaaaattcatggggc

SEQ ID NO: 103225 - DNA, 1043 bp, Homo sapiens
ttaattagatgctagcatgagaatgatggagtagtcatggatgattctctgatttttaacttggacaccttgggtgagtgagaacgaagattgggaacaggcttagagaagcagatgatgaattccaatttgggcagactgcacttgagttttctttggaatacccatgtggagacttttagtcggcagttggatacacacatggatctgaagttcagaaggaagatctaggctgtaaacataaatgtgggggtctttgcttatgaatggtaattgattcctagaagtggatgagatcactcagggagggtgtggagaataaggagaaagacagccaaagacagaactttaggagaacattcaagtaacaagcatttttaaagggagcgaataaaggaataagtgattaaaaagagtcatttagaagaagggatcccttctaaagcttcccaaatactgctaccaaatcagctggctatcctatttgtgcttaaggcaaagcctactttttggctccccaaatggagaatgtgttactaaaccaaagatggaaagtagggcaacatcatatacagaaagcatatcttcagggcttttttcagatacatatgtggatactctactcctgaggctctattggtaaacagatcatagtagcgtcttgttagtctgcatcaagaaacacttaataattaaaaagaaacactttaaaaagctgtatgtttaaaatataatatgaaaagtattagaagtcatttgatgatcatctgatgttcagatcaaccagataatctttctagcctgcctgatgagtggccttttgcttggcttgttggctttggcgtcaagtgtacaaactcagccagttggaatacacctgaaaaatgtttctcaaatgttcctttgtgtggataaatttgttggtttatatagtgtgtatatgttatttgtctatgttaagaagtgtcccctggctgataacatacttgtttttcagcccacaaattttctatgaaccattgagagttcccaggcctcactat

SEQ ID NO: 103226 - DNA, 1980 bp, Homo sapiens
acatagacccaatgggaggacatcccagggatgcggatttggcctcaacctattaaagaattttcccccaatgctctagcaaattgcctggcacatggaaggcaatcaacatttgactgtttttgatagcaatgaaaactgtcagatggtgactgcttctggctgtaatgagttccttatcaccggaagtgttcaagactagttgtgcaagatgtccattcggataagaattgaaccaactgaatactgtagtctcttctagctataaaactcagtgacacttctataaatagttgaatttcaatggagattttagagcaaaggaacattttatcaatcctttttccaaaaggcagcaaagtggttaaaactgagggttctggagttagacgttatctgggttcaaaccctggtcaccctacttactagctgtatgactctgttcgacaattttaatgttttacttgctatctctgtacatcagcttccttatctgtgaaatgggggcaatagtagtgtctttctcacagagctattgtgagagctcaatgagttaatacaggaaaagcacttagaagaatagctggcacatagaaagttaatgttcaataaacattagttatgaggtatcatctgatacccttgccacttctacagctttttacgtcttttcagtatgtggagggaggtcctttgtagcataattgaccctgaccttgttttttcctaaatcagatgccagccatggccactgtgattaaccagtggactttctatctcctaaaagcaagctttaaagctaaacaagcgacagggctggtgacgtgcagtttatgaaggatctgccaatgaaacacaatcatggctgtggacaccctaaccctgctatgtgcctgacaagtgatagataaccagtaaatatttgttgaatgagctgggtgcagtggtgtgtgtctgttgtcccagctactcaggaggctgaggcgggaggattgcttgagcccaagagtttgagaccagcctgggtaacacagcaagattccatctttaaaaaataaacaaataaacaaaaataaaatatgtgttgaatgaatagattaactcggtagggttttattatttttatttatttatttttgatcaggtaatacattcacatgatttaaaattcaaaaggaacaaaaggatatataaagaaaaacctccctcccacccagtccctcagccatccagtttccttccccatagggaactaacataaacgctttctcatatgtctttccagagctattttaggcataaacaagcaaacatacttgcttacgcacatttatttctttccctcccttttaaacaaatggctcatatactgttctaggcatgattattgaagtagccccagaaatgggagtgagcatgggtacgccaaggaggaattaaaaaagaaagagctcagggacagaaaaatcaaccaggagactattgcattaatacagatgtaaggcgattagagcctggactagtatattaaatgggataatcagggaaacaattgtttgaatgttttttaacttacactggggtaaccactatatagagtatttctgtcaccccagaagttcccttgtgtccctttgccgccagcccaccctccccaggcccaggcaccaactcctctgctttgtcagagtttttcagctttcgtgttacaggcctgcatgcccgtggtgggacctccactcagcagagttaatcacaataccagtcaacatcagtggcacttactccaggccagacactccattaagcacctacatgtgctcattcatttaatcctcttcaccaactgaagcaggtactgcttttatctcaatttctgataagatatctaagatacagagaagttaaatcacttgatgaaggtcacacagttagtacatagcaaagtcagaattttgaactcagaacaatcggcttcca

SEQ ID NO: 103227 - DNA, 1115 bp, Homo sapiens
aaggaaattatataaaggtcataatactaagagaaaagctttaaattgtcatttccaataggacataagcctcctaagaaaaaaacaaccttgtgtgtttttcttggggggggaggcatatataaataacaatcaaaaatctttttctttcttgatttaattttaaaggtgatagttaactaaatcactttaaaatgacttcctgctgctcccccaacctcctcaaaattaagaatacaacaaatatttgcataggtttattattcacatttaatcatgaataattcactttgtacagacagctgggtaaacaagagatttggagtttcctttttctagaatatttttccattggctgaaaggaaacagcatcagtggtgattttatatgattttcagtgccatcttgttttctctcctctggataggagacccctcctccctccctccttctgtccttttttttttttttttctgtttacttatttctgccagcttttgggctacacctcatcaacataacatttttcattacaaaatgaaaaaatagctcaatcattcagttttttattctgcaagacaacataaagtgtttgtttctcactttccacaatattagagtttttttaaactgtgggtttgcttttgtgtgaagaccctcttactgatgggaaaatatctttcagaactaattctgcctcatcattacctcctccatcttttcctatcagccattaacaatttcacaattatttgactgtctgccacaaagttggttctcatttccctctgcacctcccaggcctacgtgaggaagtggagcacgtatcactgaacataggtttacccaaggctatcaactcttgggcaaggggggcataatttaccaaaggtcaaggatcctttcagttctgtgaacgtcattaatcaaattgcgatagtataacctgtggtttaggagacaataaggcttgccataattcatctacgaccaaagaaggggttgggggtgggggggtcatcgtatatctttgggaaatccctgcattttgtcatggcctctgggaagtaagaattttcgacacccaccaaatgtcaagcatccactctaactac

SEQ ID NO: 103228 - DNA, 1138 bp, Homo sapiens
agcctgggtgacagagcaagaccctgtctctaaaagaaaaaaaaaacgaaaaacaaaaaagctgtgtttcaggatggcatttgggtaaagaggtcaaacactctttcttttaagagcctgggacatttctttttcttcttcttgcttcctaatcagtggtttcttgcccttcataggagcccagggcacggagtgtctgggcctggaatgcggacatgtgtgggagggatgcgaaactgtgctggcagccccaagaaaagaatcagtctttgtcctcatcttcacatgcacctgtcgtcccaaacccttgacaaacattgtgtcattcaccttccaaacctctctgcggattcagcctgggcgggcgggagcacagtgagccacattctctgcattcccgcctcctgacagctcctggtaccacagccgctgagctgggatgtccaaacattccaactgactcatccgtgggtgagcaaggccgacacgaggggacgggtggaggctgctggggctctgtctctgccgaagtccctaattcagagaagaaagtggggcgggtgggggaattgccgggatatgggccatttcccttgaatgatgctcgggtgtcacttgaggtgccaggaagtggtggcagttgcagcacagtggccctggtggaagcctgggctcagacctcacatacctagatttgagttctggctccatggtcagaattttgtaacttcatcaaaactctctgagattggccgggcagagtggctcatgcctgtaatcccagcactgcaggaggatcacttgagcccaggagtttgagaccagcctgggcaacatagtgagacttcatttttccaaaaaggaaaaatattagctggggatggtggcatgcatttgtagttccagttcctggtaggctgaggcgagaggattgcttgagcccaggagtttgaggctacagtgagctatggtcgcaccactgcaccctaacctggaaaacaaagccagaccctatctctgaaaacaaaacaaaacaaacaaacaaaacaaaaaataaaacaggccaggcgcggtggctcatgcctgtaatcccagcactttgggaggctgaggcaggtggatcacgaggtcaggagtt

SEQ ID NO: 103229 - DNA, 1027 bp, Homo sapiens
cgttctggtcctagccgagctccagtttgtttcgtgtcccttctgtctcaaggacttcaatcatgaaacccacgtgtgtgccagaaggacagaaacgtcccctccgggatgctcccaccggctgcgcagctggctttccgcggaaagggcggagcccagggagggggcgcgtcaggggcggggcctggaggagtcagacggggtggggtctatccccgagccagtactaaaaaaggcggagccgttcggggcggtctcggtgggctggctggaaagcgggatgaggttctggcgttaggaggaggcgtgaccacccaataggcttctcttcccgcggggcgtggccgtcaaggagccggacgccgcgcctggctgggcgggtcagcctcgcagcgggcggcgtggacgcggcagcgcagcggctcctttaaggctcgggcaccacccccgccgccccgcctcccgtgcggcctgggtctagttggcggcggggtcgggtccgcgcgagccgcgatggagctgcacatcctagaacaccgggtgcgggtgctgagcgtcgcccgtcccggtctctggctctacacccacccgctcatcaagctgctcttcctgccccgccgcagccggtgcgcgcccgggttcgggagcgcagataggggctgggggctctgctctcgctccgggccagggtcggaggattaggatcgccgtaaggcaggcaggcaggcgggcgggagcgggtggggaggactctccccgtccggccgccatccggcctgggggaccgccgcctatccggccccgtgaggccccctcccaggggcaaagcgcaaacagcctgggatgggcaatgcttaactcagtagtgtcaaatgggggcattcctacctggtcactgcggggagctccttccaggacgcctcccttcatgtcagaggggctggactagggggtccaaggtccgacgcccctggggctgtcgccgcgggtgtgaacctctcctccctccaggagtggaggggtggag

SEQ ID NO: 103230 - DNA, 1240 bp, Homo sapiens
gccaaggctatcttggatgcagaacctggtccccggcctgccctacaaccttcaccatccatccgcctgcccctagatgcccccctccctggctccaaagccaagcccaagccacccaagcaggcccagaaggagcagcggaaacagatgaaggggagagggcagctggagaagcccccagccccaaatcaagccatggtggtggccgctgcaggagatgcatgtcccccacagcatgtgcccccgaaggactcagcccccaaggactcagcccctcaggatttggctccccaggtctcagcccaccaccgctcccaggagagcttgacgtcccaagagagtgaggacacctacttgtaaccctggcagctaaggcctccagggcggggtctccatataactacacggttcatgaactgacattccacatcctgcccaccctctgagggccaagctgcctggccactgggctgggctggagtctggctggtccaacacagattctgcctggtccaacacagattctgcctgagcctccttatttattttctttacagtggcactcaggctggcccagccagggcaggcagaagctagggcctggggggtggggcctccttcagccccctcctcctgggggatgctccccagggttagggtgctggtgtgaggggaaagggtggggtgttctttgtgtaaaatagaaacatggttttgtacagaaataaacagccttgtatagagagctcgtgtacagctaggggctgggaagggggtaccaccttggtcaccttggtgctcagcatctcttctctttgccctacagagccccttctcctgggccccagcccagcaccagagcctctctgagaggtacctttgccagaggacatgccaagtccctggtcagcccccattcttaacccccattttcactcaccccatccccactgccttatgtctaccttctgccacagatgagggacaccagggctggagctcagtgctgggcagagcagggcgtgctccctaggccttggtcctcacccacccaccaagggggcagggactcctaaggaggaggtttcagggtcttcctccttcaagtcctggcctggatgctacctcaggctccagtaagtttctgagagctgattctgggttggggtcagggacggggcccggagtggagcaccacgaatgtcctcacaggctcagcccaggccctcagggagggggg

SEQ ID NO: 103231 - DNA, 1048 bp, Homo sapiens
ggctggacaccctctgtggcccctccaggcccttctctcatagtaactcctgcccaggttaaaaactttccggccttctgttgccttgaggctgaagtcccaaggcctgccagggttaggtctcctgggttacaatgttatcccttctacactgactttcatctcagcctctagctgctctggtcactttgcagaattgaagttcttccagggcaccaagttcttccctcccttcgccttggccttgtcctaggctaaaatctgcttggaagctcccttccccgtgctgtcccctaaaaacttctcttgtccttcagcttttagccctcagggagcttccttgaccctgacaggcgagaccctccagcacatgcttgagagcagtcctgctccagccttgttaggggcattcagcctcctccccctcccctagcctcttttgctcatgtgcccttctcaggataagctccctccaggggaccagctggctccgctttgctcatcattgtatcctagcacctggcagaggcagacaccctgcaggcggtagctgcctgagcctgctgggtgctgggtgctgggtgctggggtgtagtctctgccctggctcctgcagcccacggtcatggtcccgtggcctcgatgtctccctaggaggcgatccagctggacggggagatccttttctcgctgttgcagaaggtgtcgccggtggcccacaagcacctcagccgtcagaagatcgacccgctcctctatatgacagaatggttcatgtgcgccttctcccgaaccttgccctggagctctgtgctgcgtgtctgggacatgttcttctgtgaaggtactgggctgggcttggggggagcacccctgtccccagcagcccacagtggggcctctctttgcagagaaaccccaaaaagcttccttgtacttactgcccatcccccatgcaggggtcaagatcatcttccgggtggggctggtgctgctgaagcacgcgctgggctcccctgagaaggtcaaagcctgccagggccagtac

SEQ ID NO: 103232 - DNA, 1970 bp, Homo sapiens
cctgcaggcaacttgtacttaaaccaacactcccatgaaggtgcctgggccacacctttcagcacattctggttcctctggtgaatactctgcttccctgctcagccctctgggcttcctccttatttattttttctttcttttttaaaaattgaggtatgaatttacatacagtaaaatgcatagatcttgaatgtgcatgcagttcagtgagttttgataaataatacacatccatgtaaccaacatgcagatcaaggtagagaacatttcaaatgaccaagaaaagattttcctttttgtaatggctttgttgttttgtaaaggtgcacatactgaagcgttcacagaagttcaaagaaaagagtaaaactttgttgaaacctcggcacccagagaagtatctgaggttaatggtttgacagatgtcatgtccttccagaaagagctctgtgcagatctcacacacacctggcttcctggatagttgacgccacctgcacagggaggcatgtagctgaggagctgggatggacggctttgagtcagacctggcttccagtcccagctccaccatttttctagccagagttaaataccttgacatgaggccttgacattcagttttctcatctgcgaacagggtgtaatgataggtcctatctctggaggttggggagcaggatcagtaaggcccacaggtaccctgtgcccagcttagcgcctggctcagagaagtgggaacagctggtagctattgctcagagaagcagccttctgtcttaaggatgtgacataatgtatctgactcccgaatgaaatgtctagaggtccttccagccgcagctggagtggacactcttgccctcatcggtcttcctagagccaggtttaaggtttccagggcccttccctccttgcccctttgcccctgcccaggcattccttacctgagcttctcttcctgtccttgggaaggcccagtctgtgatgggcttgggtgggcactgcccctggtggagggccccctcccctaatccctgggcagccgtgtcctgtcagcaaagcccacctccatcctccccagcccctaatttgtgcccttgcttctaggagctggacatgtcccctggggaccccaagtggctggacgtgattgagcgtgacctgcaccggcagttcccattccatgagatgtttgtgtcccgggggggccacgggtgagcaggctgggcctcatgaggtgggaggtggctctagggcctgtctctaaggggtctaaggaggtacagtgagttcagggctttagaagctcggtgcccccaactccactcttagcatttccctttttttggtttgagtctgatgtgtgttctcagcatctcctcttacctctgggggggctttcctcattgactccagagtgctagagcttgtccagcctggccctcttccggaaacaggttttgttggcgagaaagagggatagagggaattgggtgagtggagggtatgcaggggagagatagggcaggcaaggggaccaagacagatgcagggacaaagctggcccggccaaggggccatagctgctgagtgaggggcccctacttccagccctgacatagctttacatcccgccctggccctgctccctgttttctctttgagcctctgccctcccctgtcatgggggagaccttccccacctccttccttctgggcacgtgagagtccatgtgctccagtaggagactgaccccttggtgaccacaagcagatcaccttccctctcaagggaggggcagattctgaggctggctggtccactggggcataggtgaaggccgtgggtagcagagtcaccccggtcatcactgctctgcccggcctctccacagccagcaggacctattccgtgtgctgaaggcctacacgctgtaccggcccgaggagggctactgccaggc

SEQ ID NO: 103233 - DNA, 1033 bp, Homo sapiens
tgggctcagctgtccttttgattttcagattcgtctgcggtgccaaaagggcatcccgccttctctgcggggccgtgcttggcagtacctgtcaggaggcaaggtgaagttacagcagaaccctggaaagtttgacgtaagtttcccttcctttgccctgccctcccttccgcatctcttggcgtcctccccatggcggcaatcctccatgtgctcacctgaacctcacaggatgagcagtccatgaaacctccagtcatgtgcccaactgcccaggccccagcaggccagaccggcccagtcctgggtacctgtgtctcctggagggtctgtacaactgaggctccagccctgagcagccctcagtggaatggccagatttggtaccccctattccagctctttctcttgatgaccactcaggttttgctttcctgggctcagtaggctacctccctgctcttggtcatcaggaggggacactcagaccatttccctgactgccttgggccctgtgccctgggcctatgggggcttgactagcaggaccacaggtccttcagtgtctcccggcctcccatcctctactttctcctgccttgtccaagcctggccagcacagcccacctgtgtgtcttgtggggtcatcagccctaggagtagcagagccaaacccaagggggctgaagggaactgcccaagtagctcaaggggtcagacgccagtcagtggccagagagggtgccctctgttgttatccctcctcctgtcccgatatccctcctgctgctccctgccccatggctggccagagtaaaatacctctccattcagagctgggcagctcctccagcctgctcccccagggaactatggggaagcagttggattccctggggttgccccggcttacctgccagatctggccgcaggcatcggggtttctcgcaggcccttgggactggtgacaggcagacagtgagacagagcagagctgcctaccaccagctctttgttgacatatctcatgctt

SEQ ID NO: 103234 - DNA, 1242 bp, Homo sapiens
agctgggtgtggtggtgggcgcctgtaatcccagctactcgggaggctgaggcacgagaatcacttaaacccggaaggcggacgttgcagtgagccgagatcgcgccattgcactccagcctgggcaacaagcgcaaaactccgtctcaaaaaaataaaataaaaaggggagaatgatgttatagtagggttattacaaaaggtacatgtgataaaggtatgtgaagcattgagaagaaaattgtaagtagtaaataatctacgaatggtaactactgttgctgatattattattgttgtagtgatggtttttaatgtaatattgggctctgaagggttactgtcacttggagaagggagaagaaagggcattcagttagggatgagtggatggtgagggataaacatgtgtgtgcctggtatgggagaattgtatggcctcaaaagcggtgttgagattacggtggaagttactaggacaattttggcataaggtggggaagaaagctttagcagtggaaactgtttaacaatagagtgacttcacctggaggtaaggaaggcccatccctggaggagttccagcagtggctgagccaaaagaaactggtctcacttgtctcttttggcttcagagactccctcagtctaccttaaggaaggaggggttttctggaggatgagtgaggccgccagatttgcgacatcccccatgggccatttgtggtcccttatactgggccagcttctctctcactagcaattggttcctgccctctccactgtcaggaggaagcctcctcagggcttctacactgtcatactattttcagggacccctctggccccagcttcatcccacagctcctctgtgggcctccttagagggtcaaattcataagatagactgtacaagcatatagcgaaactgaggatcagagaagaaaggggacttgcctaatgtagaaaggatttctatatcagacagcagttggatcagatgttttctaagatcctgactgagttaattgaaggatatgtgactcttctgatttaacaacaaaaaaaatagatagcctgcaatgtttcaggagtatatcctgtgcctagagacatctacctgcagttagagagcatgtggtacgctgagtgctgggtacagccagacctccagtgtcttccttctcaccatctccaggtagattaaactcctctgctgttaaaggaaaagccattcagatg

SEQ ID NO: 103235 - DNA, 2098 bp, Homo sapiens
ggggcggacgggcccacacctccacccgccacctccaccctccggacagactgacccgctcccaggaaggaccgactgtgccctccttccagccgtggaacagaatgacagactgccccaaacccacccctgccgccaagaccttagggatgattgtttctgccaccccgacaggctcccagatggctggcgcccccctccatagacactcattctccatctttccccctcccacaaacccacagacgcccttgtctccccgcctcactgcccccacaccaggagacctcagaccgacttcaggactgactgccccgcccccaccccttcccaggacagactgaccctttcctcgaggcatacagacctctggatggacagacattggtcacctccctcccctcagctccatcctgggacagacagtcccttctcctcatggaagggtcggagaagggccccctatccgctcatacacagcttcctccactggcactggcaacaggtgggcaggtactcccccttcccagcacgtacagggcgacagggagccccaccactaggacagaccatcagctccagcagccacaggagccagtagatgggctctgtgtatgtcctgtgtatgtatgcgcctcctcccaagggcagatcttgggcgtgggacgggggcaggcagggagacagcagggtccctgctcatattagcaccccccgatgtcctatcccgagagcacccagacacccagctagcagacagagaaatgtggggcagtggaacagcaccttgcctccaagctgggccccatgttgccccacagaatcccccgagcccaggcctcagagatcatgtgtacaggctggcggtccccttaggaaagatggactccataccccactcccatcccagctgtcctgtcacgtgagaccagtgttgtgcacagaactgacaagactccctcctgatgtgtgctttccatcccaatcaccagtaggagctcctggggccctgccatgaccctactccagagaatatcctttctccctttctctgaccaattgagattgtccaaggtcaccccagactctctcatgacttatggaagcgctttaactgtctaagaacccctgtcacttccgggattttccccagccctaaagcctcttattcaccaggcctccttcttccttggagaaatccaggcccctcccctaaggggagttccctctcacccactggatctgtctcctccagtatctccctactggctcacagcaggctaggtttagtccaggactcagagagagcacccctcattctgaaccctcaccctgactgatgctttgtcacagttccccagggattcacttgtgagaacttagtggggacctggagtgttttgaattgaggagcagtcacctgggattaggacccagggaggtgtgtggtcttgagatctaggaaaggagttcccagttgcatttatgggaccttggaaggaagagctcagatttgtgggagaatgctagggcatgagagttcctactacatgcttatcaggcaatcaaccagatcttggggtgcagagcaatgtgatatattaggaaaaggccaaacttaggaattacacttgctagctttgtgaccttgggcaagatcctgaatctctgagcctgtttactcactgtaaagggcgacagtaacacccacttcccaacattactctgggggttaaatgagtatatgatacgtgaaggtgcctggcacagcgcttgtcacaagtagcggcccagaaaatgttagttttctttctttccttctaagggtctgagaaatgaagagaaaaatgagggcatatctctggtatttgtgggcagagtgaggccccagtggaagcacctccctttggctgtagtccccaaccaggcagccagacatctgtctttcttaccccacaaccacaaacccgggatgtggctctgcagacaccctctacatggctgctgtctgtagggctggggctgaggtgggatcccagctccagtcctctctccttccctcactttctggagcctgtcagtcaacctaaaatctctg

SEQ ID NO: 103236 - DNA, 2591 bp, Homo sapiens
ctcccaggctggagtgcagtggctccatgttggctactgcaacttccgcctctcacgttcaagcagttcttctgcctcagcctcccaagtagctgggattacaggcacgcaccaccacacccggctaatttttgtattttcagtagagacggggtttcgctatgttggccatgctggtctcgaactcctgacctcagatgtgatcctcctgccttggccccccaaagtgctgggattacaagcatgagccactgtgcctggcctaccgttcttttctaagtcagaggggttgcccaagcactgggtttataggcttagatcgggcagctttccccgagcccagaggacaagagttggggccctgagtcaccctcatcccatggaaccagcctcctccctgcacaccagaaaagctgctctcttgtcaggacacctggtttattttctctttctatcctctgcctctgttttgtgactgtacaggtctggatattgagagcagcttgaagcagttggctgagcggcgtactgacatcttcggtgtagaggaaacagccattggtaagaagatcggtgaggaggagatccagaagccagaggaaaaggtgcggctaaagtggaacctagtgccttctctgccccccgtcttccatacttggtcttagttccagaagcattgtggctttgctttcacttgcaggtgacctgggatggccactcaggcagcatggcccggacccagcaggctgcccaggccaacatcaccctccaggagcagattgaggccattcacaaggccaaaggcctggtgccagaggatgacactaaagagaagattggccccagcaagcccaatgaaatccctcaacagccaccgccaccatcttcagccaccaacatccccagctcggctccacccatcacttcagtgccccgaccacccacagtaagccagcatctaccctggaactgacttttttagagcttcattcttgaggtcggacactgttggctgagaagtgcagctgccttttagtggggcctgagtgttgggtgggtcagtttgaaagagaaagagccctttaaatgcaagtgggaacctctctcttgatctgtttgtggaggagggttggaacagggagggaggtaagtggcaaatatgagaaaccagttggcgtcagagaagggctgcagggcttattgggtctttgaggactgttggcttgtctccaggagagacttagtcgaggtctcggcctcttttttttttttttttgagatgaagttttgctcttgtcgcccaggctggagtgcaatggcatgatcttggctcaccgcaacctccgcctcccgagttcaagtgattctcgtgcctcagcctcccaagtagctgggattacagggatgcgccaccatgcccagctaattttgtatttttagtagagatgaggtttctccgtgttggtcaggctggtctcgaactcccgacctccggtgatctgcctgccttagcttcccaaagtgctgagattacaggcatgagccactgtgcctggccaaggtctcagcctctttagtgactctttcagtgtttgccaaagtagcaggtcgagtttgacccgccaagtcccaagtagagagagtgtcatcctcgggctctcagcagctcagttcctattggacgcccagtgtaggccacagtttctcagtcccagggggccaggacgtagttgtctaacctccatcctcagagctgcaggcagccagttgccaactgtgtgtgaccttggagtccaactttggcttcctgtaatctgtgggtctctttcctgcacagatgccacctccagttcgtactacagttgtctccgcagtacccgtcatgccccggcccccaatggcatctgtggtccggctgcccccaggctcagtgatcgcccccatgccgcccatcatccacgcgcccagaatcaacgtggtgcccatgcctccctcggcccctcctattatggccccccgcccaccccccatgattgtgccaacaggtcagtatctcttgcatcattttccaggccattagttcagggaccacgggccaagtactgtcagcagagcagtggctgatgctagtgccagctgttccagcagggtatccagcccagaggagagccctggcttcccattgaaagatccgcaaccctagagctgggagccaccgttcctggtagaaatgagaggctgaaatggtgtagccagtgtctgtgcattcagggatcaggtccccaacaggctcagaggcctgagaaatgcttgttgcttggcactagctccatccatcagtcctgcccctcctgcagtcctctgctgtccaatctgggcagcctcccaggtccccttgccagggaacctgctggctgccagacttagcagggaacagcacttgacacctctgactagaggaaacctttgcaaccttccctctcaacttctcatcagccctgagtcctgggccccttctgccctctcatggggctgcttattcttgtctttgcagcctttgtgcctgctccacctgtggcacctgtcccagc

SEQ ID NO: 103237 - DNA, 1334 bp, Homo sapiens
atgccatagtttggaaccatacttccattctgttccgaaggaggcgctgactttgatgaaagccctggaggtggtagcctcatcaggagcagaccctgcttcagcgtagcaccaagctgtttcccatctctgcaggtgtgttaccgagtggaatgggccaaattccaggaacgtgagaggaagaaggaagaagaggagaaggagaaggagcgggtggcctatgctcagatcgactggcatgattttgtggtggtggaaacagtggacttccaacccaatgagcaaggtaggtctgtgaggagtgactccagatggggagccaggaactcagacttcccgggaaacctggtgcaggtgttcccagagagcagtagaatctctcagagggctttatcagtgctgtctcctccctgctcccaaaagacttcagttctaccactttgcccaacttagattcaatacgtacttgccagaccctagatgggcctctggagatagctggagagaaaacagacatggccccagcccttggggagctcagacagggcaaataggtgggtctttgataaggaatacctttgcctctggctcaccctctagggaacttccctccccccaccacgccagaggagctgggggcccgaatcctcattcaggagcgctatgaaaagtttggggagagtgaggaagttgagatggaggtcgagtctgatgaggaggatgacaaacaggagaaggcggaggagcctccttcccagctggaccaggacacccaagtacaagatatggatgaggtaagctgctgggcaggcctgcaggatgaccttttcccctgaagccccaggaggtcgaagtgctctccaccagtcagatccagctcccctgtgagccttgaaaggaggcgtgggtcctgaacaaggccatacagctgcccaagtccaggcagcacagagcctctttccagctccggcaacaaagattcattcataggcaaggatctaaaagctgtgctgacctgttctgtggccgcctccctggcccggacagcctgctctcactgcctcgtgccagccctcagggaactcactgcattaccctgttctgttttgagctctcagctgggctccaagctcccagagcttttctaaatgtagcccacgcttcctttcaggcatccctacccccttcaagccaggccctctaagcaggcatggagtctccagaaccagactgttctcccccactcggaaataatttgtgcacagcctgagaagaaagggcccctgtctgtgggaaatgactttttctctccctcccagcattgctgtgtgagc

SEQ ID NO: 103238 - DNA, 1068 bp, Homo sapiens
ggacagtgccttgcatcttccaagtgtttctatcttatcagatgatttggtcagagatgtacagtatcttgtccaaggtcaagcagagaaatgaagagctgggatgcaaacccagaagatattcctctaaaagctgtcccatgctgccatggcagcacacaaaaaagggtgggattcagttctgccaggacgtgtccggcacctgtgatgggtgtggcattgttcaaatctcttgagggagcctatgggcccaggagaagggactgattttcataacggcagagtcagggaatgtgctcggcactcccagagagcgatggttaagggaccggtgacagtccagagggcagcctgtctggcccaggttccacaactgtcagcaaatctagatgccaaatccacagaggacatacaactgggagggacagttcataggtcagatggcaaaattgatctgaatctggatctcaaaactctttgaaggatggactgaagttgactgtaacaagaggaaatttgatagggaaggatctaaggtctctcctctccatgtatgcaatggaggcttagcagtggcacaggtgaaaaggatttggggggtttcagtgcctataagctccacctgagttaagggtgttgcctgttgccaagaaagttcttaggctgggcacaatgtctcatgcctgtaatcccagcactttgggaggcccaggcgggtggatcacctgaagtcagaagtttgagaccagcctggccaacatggtgaaaccccatctctactaaaaatacaaaaattagccaggtgtggtggcgtgtgcctgtaatcccagctactcaggaggctgaggcaggagaattgcttgaacccgggaggcagaggttgcagtgagctgagattgcaccattacactccagcctggatgacaagagcgaaattgtctcaaaaaaaaaaagaaaagaaaagaaaaagagagttcttagacaacacttggggctctgcgtggctcttagagcacactctgagggggctctggaaaattggaaaacactcaaagggaagttatttgc

SEQ ID NO: 103239 - DNA, 1042 bp, Homo sapiens
cccacactcatctacaaatgttcacagagagcctactgtgcgcagagaccctgcggagctggggatgcaggaagcattagacgtggatgcacccctgagggttcagggtgcacagaacgtctgtcctcgggcataagtggctctacgggtaccgtgcacagagcacacagtgactcaggaagggggaggccatcaggccaaactgcagaaccaaagccatctcagatgtcatctagatccacccagtcatgtactggaaaagaacacagagacctaggcaggaagagtgactcgcctagaccacaattctggcctggggtgattatctcagtttggaaaactctaggtccggccctaactagctctgattgctctctggatgcacagtgcaatcatttggcctggactggaacgggcttctgaagtaggacagcctgacaagacttcctgctctctgttccctgcagttggggaggaaggtggagaccatcaccataatttatgactgcgaggggcttggcctcaagcatctctggaagcctgctgtggaggcctatggagaggtgaggggcaggggtggggaggaaggggacagagggaaggggaggaggagtagacccctctcctaggctgtcctgtgggatgggtgaggcaatgggggcagattctgagcctgctggaatcaagagtgattttgtttccacagtttctctgcatgtttgaggaaaattatcccgaaacactgaagcgtctttttgttgttaaaggtaagttgggaatttcttgtgataaagccagatggaaaagaggggtcaaaaacatgactgcggcagatggagggtcaaacagtgagccaaaagagggggtctgaggacatgttcagaagactgctgcccctgctagtgtgctggctcacgcctgtaaccccagcactttgggaggccgaggcaggaggctctcttgagcccaggagtttgagaccagcctgggtaacacagcaagacctcatctctataaaaaagttaaggaaatgagctgggta

SEQ ID NO: 103240 - DNA, 1026 bp, Homo sapiens
actacttcctcctgcgctggctgcgaggtgaggcttgcaggggtcaggggacgcagaaagggagggaaggaaggagggtctcaggagaggagtgggagactttgagggaatggagctgtagggtagtaaagaacacaggcttgccgggcccggtggctcacacctgtaatcccagcactttgggaggccgaggcaggcagatcacctgaggtcgggagttcgagaccagcctgaccaacatggggaaaccctgtctctactaaaaatacaaaattagctggcttggtggcacatgcctgtaatctcagctactcaggaggctgaggcaggagaatcgcttgaacccgggaggcagaggttgcggtaagccgagatcccgccattgcactccagcctgggcatcaagagtgaagctccgtctcaaaaaaaaaaaaacaaaaaaacaaaaaacacagggtctggaatcagcctgctctgactagaatctgagctcccctgtgtatgagcacagcacaaaaccccactgagcctcagtttcttcatctgtcaagcaaggatgaggcaacaggtgggcacagagtccaggtgaggttacagttaacagccaggacatcctcaggcctctggcctggccagcccttggggcagatgttgcagagcactgttttcagtacttgcctttgggtgtacctccagttccccgaggacagggctctgttgtcccctaaaggaaccgaggtgccctagtgcactgagcaggtgcccagcaaacacttaaggaagtggatttagcgaatgctagagaagcagtttcttctaggaattacagcagcagtctaaaaaaataataacaagccagatgcgatggctcacacttatagtcccagtgctttgggaggctgaggcaggcagatttcttgagctcaggagttcaagaccagcctgggcaacatggcgaaacctcatctctacaaaaaatacaaaaattagccgggtgagctgccgagcacctgtaatcccagctac

SEQ ID NO: 103241 - DNA, 1094 bp, Homo sapiens
ctgtgctccaggctgagcaacagagaaagaccctgtccctttaaaaaaattaaaaatatattgtcagatgaccccggaaagaaggttcttcctgttgtacccctttccaccagctcctggtgaaggttctagtggcatccagctttcccaggtggtgtagggaaatggggcagttgccaaggctccttccagctctgggagtttaggattctcttatctcgagatttgtgggcccatgaaataatgttgttaaagcagggctagcgcatgttttctcaccatgaagtgggtcaggtagatttttttcctgtgagaatttgtgaccttttcttgaagctctgcttttaagggatatagctttgagttctgtgccccccaccctcccttctacacatacctcagcctgaccttcgccttccccctcacaggccaacaagctggcggagaagcggaaagcccacgatgaggcggtgaggtctgagaagaaggccaagaaggcaaggccggagtgagtgcctgcggcccctcacagggctgaggccagcccctagcagctggatgtggcagaggcaggccagaggacctaagtgtgatggaccagagtcacttctcctcctcctttctccagccagccctgacccctcatgctctctggctgggccagtgggcagccctcgcttcccttggatggagctgccctgctggtgcctggtcagagaagaggcctctgtgcccagcctgattctctgctcccaggagccagtgacatgaggtgcagaggcccacccagccccctacctactgcccccattcatcctggctttccacagccccctcccacacagttggacccgtgattctcagggtgctgtgatggggtgagggtagggggagcatttgttattaaatgactggacttttgtgccaattgcattttgtgtccatgagccttcctagggttggaggaggcctacctagcactctatgctgcaggctgggccagccctgggtatttactgagacagagctgggcactgctcagagctctctggatgtccaaggacccctccaggtccagggatgccaaaaggtag

SEQ ID NO: 103242 - DNA, 2166 bp, Homo sapiens
cattgggatggtgtcagtttccacttcttatgaaacagtgtgtggaaagtgctcggcaccgcactgagcacataggaagtgctcagcagagggcggaactgccgtcattttattactagcttagcacagaaggatgggcagtgggcagatctctgctgagccaggattgaaggatcctggggtgaggagggggtaattgtgtcctaagagggtgagtttatgggctgggtggccagcaggtcccagggagctgagtctcaggacaggcagctcatgtctgtgtacccgtgtgggctctccctgtccctgtaggagttttggtggggaagtgtcctgggacaaatctttgtgcattggggccacctatgacgtcacagactcccgcatcacccatcagattgtcgaccggcctgggcagcagacctcagtcattggcaggtaggccctcaagggtcctcgtccggatttctgggtatcctgtctcaaaggccctgcgatgcagcaggaccctgagttgccctctgtgactcgtttttgcctgccactctgcgccaggtgctacgtgcagccccagtgggtgtttgactcagtgaacgccaggctccttctccccgtggcagagtacttctctggggtgcagctgcccccacacctttcaccctttgtgaccgagaaggaaggagattacgttccacctgagaagctgaagctgctggctctgcagcggggagaggacccaggtgagcgggatgggactgggctggccttgacccctgggcccacgctggctgtttcccttagctgccaaggtggaaagctccagggaacaggcagtaggagcagaaagccctttgaagtcacctgtagaataaggcttaggagaagggacatctacctcctggggtcaggtgttatttgacgttcaggatgactgagcagaagaacatgctgcattgtcatcagagtttacattggaggcgacagagctcaggactgggggtcttggaatttcctctgatggcagctgggctgtggggaggtgcaagagagggccacaattgggacatccctgaactgcccatggctaaagacggcagggtcagagaggatggggcctgggcctgttgtcaccctgccagagagacagtagattcccagggcattcagaggacattggctttctctaggaaacctgaatgagtcagaagaggaggaggaagaggacgacaacaacgaaggtgatggtgatgaagagggagaaaatgaggaggaggaggaagatgcagaggctggttcagaaaaggaggaagaggcccggctggcagccctggaagagcagaggatggaggggaaggtagggggagctgcaatgcggggcttggcctgggaagcagccctgcttggtgcctgctctggcctagaaggtcaggagccagaggactgtggaggtcgggagaacctgcccccataagcaccctccttgtgtccccagaagcccagggtgatggcaggcaccttgaagctggaggataagcagcggctggcccaggaggaggagagtgaggccaagcgcctggccattatgatgatgaagaagcgggagaagtacctgtaccagaagatcatgtttggcaagaggcgaaaaatccgagaggtgagttcttgccacccacttgagatccaggtgtggccaccagacccaactgcacaggtgaacttatgtggcttggggccctcctctaggcagactgaggctctcctagccttttcctgaggttgcctgcctggcccagcccagcctttggggcccccgacctgggccagtgtaggcgtcttggtactgccatctccggcctgggctttccttacggcttccgtcccaccccgcatccggcttcctgagtctgctggggtctgcaaacagagccttcccggcagactcaaggactgggggcgggggtggcgggggggagctttgttaaacttctatctgttttgtattttcttgttcatgaagccatatatgctaattaaaaatacaaactcatgcaccctggaaccctgtgatgagtgatgcagaagtggctcacagccctgcccttggaatagagcagcctgtagtaacagcccccaggtttctcttgtgcccataatgacccgtgtttg

SEQ ID NO: 103243 - DNA, 1601 bp, Homo sapiens
tggtgctcacacgctagcccagcagcagacatgcagcaaagattgtagactaggtgatgtagaaggcaggagctctggccaggtcggaaagtggtctgtccgagtctgagctagacctgaaggaagtgggagagccggagcagggaggggagggccagccagtcttcggagcagcagggaccagggtcccttttctcactcttttatgggggtctggcactgacttccaggatgcgtctaacccttgggacccctatccagagcctcacttgtggctgggaacacttgtggccggaacgcccctggtgggaagatccatgccaccccttccctagggcagcgccttaagggcagagccttcttgaggagcttggggtctttgggtaggtcagacaccctccactctgtgggttgtctgtccctcctttgcccccatccctgcacccacactgctcatgcatctcttgtgttccccagcacccgacagacgtggactacagggtcatggccaccttcaccgagttctacaccacgctgctgggctttgtcaacttccgcctttaccagttgctcaacctccactatcccccgaaggtaggaccccagcccagtgccttctgctcgccgtgcaggggccacagcccttctctgtccacacagaggcgaggggctgtggctgtcctctgcctcctgaccttccctttgcctactagctcgagggtcaggcccaagcagaggcaaaggccggtgagggcacctacgcgttggactccgagagttgtatggaggtgagaggctccaggagcatcatccggcatctcccaagggagtggtctctgtccccaacacctctgggggtctggttcagagtgggggtggttatggctaggtgggtggtctcagcctgcccttggaacccacacctgctgatgcccaggactgtcactgctgcccctccccaccctggccacatgcccgcatgaggtcccccactgcaagcagcccccttctctcctgtagaaactggcagccctcagtgccagcctggcccgcgtggtggtgcctgccacagaggaggaggccgaggtggatgagtttcccaccgatggggtgagcactgcactgccttctggcaggagggctgggaggggtcgtgtggggggtttcccagcttagggacatttgcatcctataattaggtgttatttgatggtcaaagcaactgagcagaagaatgggctgaattgtcatcagagtttacataggaggcaacagagctcaggagtggggccttggagtttcctttgaaggcaggatccaggatctagaaggaagctggagtggacgttatctccagccctggccctccagtgggggtgggcagccctggtggtgcgaggcctggcccctttctcaacaggagatgtcagcgcaggaggaagaccgcaggaaggagctggaggcgcaggagaagcacaagaagctttttgagggcctgaagttcttcctgaaccgagaggtgccccgtgaggccctggccttcatcatcaggtagggaggctcaagggcccgctgacagcattggttcggccatgctctgg

SEQ ID NO: 103244 - DNA, 1678 bp, Homo sapiens
tcataagtgctgctgaggggaagcagcccccaccccgctccctgctccaccagggcagcttcggtttcccattttccattttggacctccctgtagagtgtctgtgcactaaagtttccaccttcaaagagagtcatagagcccctgactccgtctaccgtcgtgcaccacaaaatccgcacgtgggtcaaggctgggtctttggtgagcattcggtgtcttgaggacccccatcgggacttctctggtcctcagagcctagtgggcgcatcctggttaagtggttcctcctaggggctgtggtcagctgtggggaagctgctcctgccaggtcaggaggtggcagtggtgaggcctggcttgaggaacggggcatctggggtgggataaggagatcagggtcccccttggcacccacgctgaacaggccccatgtgctgcctcactggccatgcaggtatcccacgttcatcgatgccctgcgggacctggacgatgccctctccatgtgcttcctgttttccaccttcccgcggactggcaagtgccacgtgcagaccattcagctgtgccgccggctcactgtggagttcatgcactacattatcgctgcccgtgccctgcgcaaggtgagcctgggactgcccggctggcatcccaccctgccccctctcctgccaccccatggtcttcacccagatgtctcctcctctcccctaggtcttcctgtccatcaaaggcatttactaccaggccgaggtactggggcagcccatcgtgtggatcactccctatgccttctcccatgacgtgagtgtgcctgtcgggaggggacgggcttgtgctgcctcctagacagatatggatgtggaggaagggggattttgctgtccatggagtttagcaagtgctgggttcccaactgttgatgaggggtgaggcgcggcagaatgtgccacacagcatcctcattaagagcgggagcctaagctagccctatggcagcacctgccagctgcgtgcccttggacgtgttcctttcacctctctgtgcctcagttaacagtgtctacacccttaacagtgcctggtgcttggccttttagggccgaataaacagtgagaacagctatcagggccatacccagcctgcatgcccagcaccatgtggtgccaccacggggacagtggcagagccctgccctcgaacctactgggctcctcgtccctgctttgctgccgatagctgccagaccttggccaagtggccttgcctcccttctctgcttcccccttcctgcctctctgccccacaggactcggggactgggagagaaggggaacggtgagcacaggagaagcacttagcatgtggcactgtttcctacatatattgttttctttttcttttaaaatagagatagggtctcactatattacccagactggtctggaactcctgagctcaagcagtcctccaatctcagcctcccaaagtgctaggattataggcgtgagccacagagcccagcctttttctttatctctttgaaatcctgggaattgttggcagggatccactgagagaaaccctggttttgccctctcatggagcttctagtgccccgcaggtgggccaggctctcctgcctccctgtgctggtggcctgcatttagc

SEQ ID NO: 103245 - DNA, 1049 bp, Homo sapiens
gtgatgctgctaaatacgctatagtagtcccccacaacatagaatagtctgacccggaatgtcagtagtggtaaagttcagaacccctggactggtaaatgtctgtcatctttggaggctgatggcccaggaacactgagctctaggatggctcgggttggcttcatccaacctggctgtgggctgtcacaggaagtgccctggcctaggagctagacagctggtgttcgcatcccagctgtgtggcacatgagctgggtggccagagggtatttcctagcccgagcaggtccccatcttcagaagagatgatggtagttcctgtcctgcctgtggcacacagtgttaggtgaaataaatgaaaaaaagccacacacgaaaagcaagtgcctggattcatacacacaccaagtgtggtgatgtggttgtggtgatctcatactacaccatccccagctccttagctagagccagagcttaagaaagaaaagcagttggcccagaaatgctggtgctgtttctacagaaagcctgggttcttggttttgtctgtgaggtggagagtgaggaaactacaaggcaccagagggggccagttgaggccgccacctctgcaccaagaaaccagacagctgttctgctgcctcatcagaggtctctgcaggcctttcttgcatcttggcatgggtttgaagacctggcagacttctgactcgcagcagtgagtgatgctatctggggctggaaggaccttggcaatgtctggtctcatggattttggagtcttttttgaaatagcagaacccattcttttttttttttttaacccctgcccccactccccccaacccctgaccagaacccattcttcaaaaggaagcttcttctccttgaagactgggcatttggaaaaaagaaaatagaaaaagtaacaaaaatgatttttgaaaaggtagcttcctggaaggcagtttggatgccagcgtctctggcagctgctgtggctgcgggagagaggcttgaagctctgtctgtccgcttgggctcaa

SEQ ID NO: 103246 - DNA, 1062 bp, Homo sapiens
gaagaggtcggttagtttggaggacctggccccaaaacaggactccgttgcatttttctgggtgtctcagtgtcacacacagacccacagcttgtttcatgctgatatagtctggtgttggcaatggaggccagcctttctcatcctgtcagtgtcaggtcacttggcttctgttctcagttgaaaaacggagctgctttgctgtgccatcctcccatgtaaacgtgtggagttgggacatctgtgcattgtcaaaaagggtgcctggtctagctctgctggttaacacaccaggcttggtgctccttggagttggctcttttgctcatcctgggcagaggggtcagtgacacaggcacatagccgtggccagcttcaggaggcatgagagtccttctgccctgcgtttccatcttccatggaagaagttgtccaggagacctgagcctcagcattgaggtgttttctttctttcttccaggtgttcgtccggaagctccggaaggcttatgggaagagcgagtggaacactgtagagcgtttaaaggacaataagcccaactacaaactcgaccacatcatcaaggaacggtgagccgggctttcctcaggacactgctgtttcttcatttactgctggtctctgccctagcaccagggatacaatagggaataagaccaagaccctgctcaaagagcttgcaactttttcaaggacacagaccaaaaaccaagctagcaaattactataatgattacgaggtttgtagttacaggcttgtcagaggggtctctgaagggagacgtttgagccagcccgcggaagcacaatccaagcagaggccatggcaagtgcaaaggccccatggtgggagagccccagggctccatgaaggcacgacgggtacctggtgagacgtgggaagcatggctagacacctctcgtctgaactgttccttgcccagccttctcagactcagttcactgcaacctccacctcccaggttcaaacaattctcctgcctcagcctcctgagtagttgggattacagacaccacca

SEQ ID NO: 103247 - DNA, 3548 bp, Homo sapiens
cagtctcaccctgcccctcgggaaccgcttctcagcagcggcagccgaagtctgacgacgcttagcaaccgttaccttgacaacgcaatcctatcgcgcaccatggagtgcggcgcccctctgcatcccagaaggcaccgcgctgtccctaagccttccgcccctctccgtcccaacatgcaacgaggctcacagtcaatgaatcgtcatcagggtgattacagaaaagcctgtatatccacgtttgttttaacacttaaagtgtttgtaaccattgtgagcgggaaagatctggaaagagtgttctcagtgatttttttcagactatagttttaaatcttgaggaggaaatccccatctttccctggacttgtacaggcatctcattgggcagcccgcacaaacagacagcgtggggtggggagggtcctcggggtccttggcagggcacgtgcgggaggaagtggagctccctgtacgcgcggccctagtcggctcctcaacgtggagcgatgggaggccttgagaagaagaaggtgattgggaaagacggtggggattcccgaggggtggggtgcgggggcggcagagcatggggtcgactcttttcccgggctccgtctcgtggagactggaaagacgggatcgacgtgaccgtaatcagctgcgagaaggggtccgagaatggacaaggatggcagtattcgtttagtgaaatccgagaacgaactccagagttctttctgtggagagggctgtgaaagagagttgaacttaccaagcgtagcttcattccaaaagcaggccgagccgtgggaccactatttaccgaaagggtgataaacattacgtagagctcaccgttactgcaccgttacattagttggttagtgttgtcttggaagttctcttcgaggcataacatttcggctgaaatgggaaagatcagaacgtcttggatgggttctggggcatgggagtgcttagcgagcaggcctgacaagggaaaccaagtgccaagatcagtaggcagggaaggcttgctgtgtgtaaggagttggaaggacattaggatgactcgcatgtaaaccaagaaaagaatggcatctgataagattggggttggacacgtactgtatcgtgcaaggcctgtaagcttggattttattctaagtgcagtaggaatagtgtagagcttggattttattctacgtgcagtaggaaaaaaaggaggagtaacacgattagagtttttcagggagttcttgtggctgtatggagaatcggcccagtgacatgaaaagactgggaagggaatgggaatgaggaatatatagttggcttaagtgtttctttcagagtgaaagtttctattgccagtgttcttaacccaacacactacattgagtatccagtgctagccatcggaactgcaaagatacaagatggaaaacctgcccttgagttgcagatgtagatatgtaacaaaatcgttacagtttttaaaagctgggtttcagagccagaatcaacaaagatgagtctttgttgtgggaaggattgtcttgtgtgtagtaggatatttggcaacatccctgatcctttacctactggataccagtagcacccagcaaccaaaaatgtctccaaacattgctgaactctcctccccccagcacatacccagggagtaccccattgagaactatttattcccttaacatttataaggataagcatggtgacagagataagtgtggcataaggtaatggaaaacgctataaatgaaaactcaacttcttaaggcagtctgaaactcatctttatacctccaagacttagcatgggcctaatacctaatagacaattaatgtctaaaggaaagaatgaatgaagggtatgtttcatgactatgatgttattagtaaacgtacctgtgggagactaacaggtttgtctctttagagctgaacctagccaaagaggcccctgctgtcttagtccagaggaagatcttgtttggaaacgacatgcttgttagcttgcagggtatttgttacagtgcactgattgtctctatcgagggatacagaagtgtgagggatacagaaatgtgggtgtgaggcagcatcttagcaccacaggcatccagatggttatacaagacaataggcttcttaggggcaggtagagaccaggctttttgtctttattgccttcatagcatctagcttagtgctttgaccataatagaggacctgttattgtctgttgaatgaatgaatgaggaaggggagaagctgtgtggcttagagcatgctttttcagccagggtaataccaccctcaagggaacaaaattggttgaggggcagtatcttagctattacaatggttgtggctccccaaggactacattacataaacagacctacagtatatctctggtattaacattttatggggcatagggaagaaagggtgatgggtgagggaggaagggggtgtctaataagtctcctggtagtggtgaagaggttataatgaggaagaaaagaaggggaaaagattaggaacactggcttagctattaggcattcaggtactggactcagacctgagtttgaatcccagccccaactcttaaaaagctgtgtgctttttaagagttgcatgggttattttacgagcccgttttctcctatgtgaaatggacgttcggacagcacctacatcacagggttatgggaattaaatgaaatgtgtgaaaatcactaattgtaatggccaacatttagagctagtgctaagcacttggcacagcaccctatccgtagcagcctcgcagccctcagcatcatgcagatgtatgtgttccctatgctgacagccgcaaggatggtacaggagagctcatccaggcaggtcggctccttccctgcagtgtttcctctcctagactcatctcagccacttatccagagtgatagttgcctctggaactaggcatgcccagagtttgatgtcagtcactacaatcattgctaatggagaattgtttttttcctctcccagtatgaacgaggctcggccaccaactacatcacccggaacaaagcccggaagaagctccagctgagcttggctgactttaggtgaatatagagggaccgtgggaagcccgggcagtgaattgcacattgaaaactcagctgcatccctgtcttacctgagttgccatacccattctggggttctggtattccttctctttctcaccgcccttgctttagtgagttgtgtttgctaggtgtggtccaagggaaaatggaggagaactgaactggattgtcaggatgggctagctgggctgggatgggctgggctgggtccctgccatccatcccctcctatctggtagaagagacccctgatcctgcaactaggggttctcattcctcatagagtcaaaataagacttcactgtggcctgtgggccctgccctctggcggtccctggcctttgtggctcacctggcccacttttt

SEQ ID NO: 103248 - DNA, 1050 bp, Homo sapiens
ctggggaatcttgaactggggtttggggtgcaaatatctgcactgagtcacttaattgcacccagcctcattcctttatctgtaaagtgggctaagaatgctcccctgccttcctcctcggtgtagtacaaggaaggatcccatgacacctgctctcccagtttaaagctctatatgtatgttgtgaaattgacagggatcgctgcacaaacgctaatgcaaagtgggctcctgtgcttccttttctctttcttcttcttttttttttttttaattttcttctagagatgaggtctcactatattgcccagggttggtttcaaactcctagggtcaagcgatcctcccaccttggcctcccaaactgctggtattacaggcgtgagccactctgtctggctcctgtgcttgtgaatgtcaacagcaatcagcccttagctggcagggctgggttggtagggcgagagctcacccaaggctgcttttattaccctgcgtgaatctgcctggccccttccttctaaggaggttgctctgtggttgtcagtctctccctttacagctggatcctgatctttcagtttctaaccctgtgctgactcatcgtgctggaagtgagagcccggggtgaggtcagggaactcccttgcgcgtttcaagaaaagggaaaaggaaagagaggtgaggaggggggcagatgaccagagagacacaggctgagagagactgagacagacccagagagcctcacacattgagtgacagagacggagaaatggagataggcaccaaaaaatggttctcagtgacagaaagggaaaaaagcaaccccccagtctctcttaacatctggtgagaaaccagccatgtgctttggtctgggcccacacagcaaaggattatgtagggtttcatgctggtggatggtcaccttatagcaacaggtatctggggctgtcgggaaaacagacacgaggttgtgggacccagacccacagagatggagctgttctaggagctctggtcctcgttctggtcccctgggatatg

SEQ ID NO: 103249 - DNA, 1059 bp, Homo sapiens
cctgggtgatagagtgagaccctgtctcaaaagaaaaacaaaagatatgttgaaatcctaaccccttgtacctgtgaacatgactttgtttggaaatagggtctttgcagatggaatcaagtcaagatgtcttttgggtgattcctaatctaatatgtctgatgtccttatgagaagagagaagtgtggacttatgccgggcgtggtggctgacacctgtaatcccagcactttgagaggctgaggcgggccgatcacgaggtcaggagatcgagaccatcctggctaacatggtgaaaccccatctctactaaaaatacaaaaaattagccaggcgtggtggcgggtgcctgtagtcccagctgtttgggaggctgaggcaggagaatcacttgaacccggaaggtggaggctgcagtgagctgagattgtgccactgcactccagcctgggtgacagagcgagactccgtctcaaaaaaaaaaatgtggacttagacacacacacagaggagaccaccaggtgaagacacagacagagaggggaaggtcatgtgaagtcagaggcagagattggaattatgctgccacggccaaggaacacctgaggctaccaggagctggaagaggcaaggaaggattctcccctagagccttcacagagaatgtggccttgctgacaccttgattttagacatccggcctccagaacggcaagcagatgaatttctgttgttctaggccatgacatttttggcagccctaggaaactaacacagtgagtaagactccttcccagcccaggtgctggatatttttcagggagacagactctccaatggagccttatgagtcagtgtggtgagtactgcgagaaatcgagaagtgtatgatgaagactctgagaagggccttccaccaagcagccttccagccccttgctggggtggcagctgtcaaggaagtctccttgggggagggaaggctcataccccatgttcagagatgagcagaagtccaccagggagcgaaagccaggctatctcaggccccgtgagtg

SEQ ID NO: 103250 - DNA, 2982 bp, Homo sapiens
ccgtgctgactcccgggccaaggcctccgaggaaagcctgcgcacctccgagaggaagctccgcgagacggaggagaagctgcagaagctgaggaccaacatcgtggcactcctgcaaaaggtgcaggaggtgagcccggcagccttcctgttgcagctggaccacctggtctctcagggaggggggcctgggccctgttcctgttctcacaagaatctatccactcacaggaatctatggttctcaccctggctgcacagcaccctggcaggagggcttgagatggtgtggctgcctggtcctcagcccagccagacccatagaaccaggctttttccctttagacattccgacgtacaacctggtttgagaaccctccaagccataaaaacgaagttcttttccacatgacgcccagatgggattgggtagcccagaagtggggagcaccccttagcctgttggcccttcatccaggcaataagcatgagggcctgctctgtgcctgtcctgtggatacagaatgaacaagacaagccagagaaggttcctgctctcacagcctgccagtctggtggaagagagagaattactgatggtggttcataaggagatacagtaaagtgtggggaggccacttgactagggtgttcaggggcttaggcatttggagacactggaagccagtcatgcaaagagtgtgacacgagcattccaggcagaaggaagaagagcaggacttgaggcctgagcagggacttgggggcggtaggggcagaggcagggcttgaaagttgtggggtttgatcccgagaacagtggagatcactggaggggtgtggcatgatgcagttttcagtctcagacatgtacctgcttggttggaggaggcctggaggggtcaaagttagaaccagagcctcctgtgaggaggctcccacagttgtctgagacagtggtggcctggaccttgggcagtgacagagaagggagagaagtgggcatatttgtagtatctgagggaaatatacatctaagacaattgggaacatggggtagaggcagggtgggcgtaggaaatctgggcatcatctgtgcacaatagatgagggaggggagagtgattaagacaggacagaagcctgacatccagggcggggtgggaggtcagggagaggactctgggctccatcccaggagctgagagaagggtggaaaggtgagccccccaatcactttctggcccccagttgatccctaccctgctctattccaggacatagacatcaacacagatgatgagctggacgcctacattgaggacctcatcaccaagggggactgaaggcaggagagagagcagctcccctgcccacctgcccctcaaccctgtagctgcagggggaggggacttcattcatgggttggtggtcgcaccttggtttgacttacacgggacatttgtgtttttggaggaaaagataccctgattctttgaatcttccttaagtttataaatatttattttttaaaagaagatgctgtgcctgtgagaccatacttttttttttttttttttttttttttttttttttttggtgactgcaaaggacagagaacctttccactttggccatactgggttgctaagccggagccatttcagctcctggctcctcaagataacggcgagtccagtgccatcttggagaagctccaggggcagggctgacttttctcctacaggaggaacaatgtggggatctgagggatgggagggagacttccccctagagtggtggtcctgctgggggctcatatccagggacccaaaaggggggctgtgtaggaggttccacattggaggggctctctctctcgcagctgtcagagttggtcctggctgtggcgtccaaacagcttgagggaaaaagatcctgtctaaccacctcatctactactcaagttctttctgaaggagggatttcttcagttaaccatggacagtgaggtttctcaccacagtaacttgagtccaggttgagggggagacagatctgtggtaaatctctgacttgggcagcacactgagtgtggaaccccacaggactccttagggaaggagcttgtgtgtgaaagaacccctggggctgagctggtgacctccatgtgtgggtgcagcagggccttggatggtgccaattgatctggacagcctgttgatgcttttctacttccacccttcggcctggccccactgagccccatcaaggtgcctgaagagggggccagtgagatcccgtggccacagggactccagaggcatctctgcaggaagcacaccatgccttccctccatgttccatcacggcgccacaatctgtgtcccttaacttctcagggtcaaagacaaaggcaagcgttgctgaattttctctttaatggccattggaagagtctggttcagtttttcccaactctcttcccactcgtatttggggcctctgggttttctgaaggcacaaggactgtgactttgtaccactaacctgtggttcaaacctgggtgtgtttctggcatctccctaacccagatcagcaatggccaccctgctcctctgaggtcagcagaagactgggaagcagaggtgagggatgcaggccacactggaatgggaagtcttttccccactggatgtgcctgtctggtgggttttggaccttcccagactacatctctaggagaggcctgtttggagtagtacactgagagaccctggcctcttctgctggaagactgtccaagtcttggggtttcttgagctggtgattcctctgccatcctgctctctctcttcatctcaggcagcatggggtccacttttgtccccaaacctaatgttttaatccaaatgcaaattggttccacatttttactggagggtaatcagtttttaaaattcacacacatgtaatcgaaa

SEQ ID NO: 103251 - DNA, 1543 bp, Homo sapiens
agaaaggtgagctgggggagtgacttggcagcctgtggcgggggtgggagtgggagtggaagtggagccccttaccagcagcaatttaccaaaggctcattgaatctgtcctgggtctgggctcttgtgcagcagtggatccaagtctaatcccaagcagaattctgaagggatcacccctttgtggttatttttaacactaattccttggtgttcactcctggcggtcacttgttctcctgctttttggcaccctcatagcagatggggaaggagaccatggtggctggtccctggtctctgtgtccctggtgtagtgggggcaagcacctaagtgttcctgtcctccaaaccctggggactgcctttctcgatgtggcccaggccaagtgagggactctacgctagttttctgactcgcacctctgtctacattgtcagataaagggctgcacgtggaggtgcgtgtgaacagggagtggtacacgggccgtgtcacagccgtggaggtgggcaagcatgtggtgcggtggaaggtgaagtttgactacgtgcccacagacacgacaccaagagaccgctggtaatgccccaatcagggaggagcagtggttcctcgaaggaggtatccccggcctccctgccagcagcccatcctgggagcccgggtcagacatgacataagctgtgtgtcttccacagggtggagaaaggcagtgaggatgtgcggctgatgaaacccccttctccggaacatcagagccttgatacacaacaggagggcggggaggaggaggtgggccctgtggcccagcaggccatagctgtcgcagagccctccacttccgaatgcctccgcattgagcctgacaccactgccctgagcaccaatcacgagaccatcgacctgcttgtccagatcctccggtacatgtgtcttttgtcttcccaccccagggccagcagcagctctctgcctgctccatgccattctgaattactgtccctgccttctttaggaattgtttacggtacttcctgcctccaagtttccccatctccaagaagcagctgagtgctatgaattcagatgagctaatatcttttcctctggtgagtctggcctgaccttcgattccacactcttcattcccccacccctgcccctgcatttgttgtaactgttgtgattatgattgttacgcttgttgcagttgctagctctcagctgtgtgctccatctcagccagcctctctcctgctgaaagaagaggagagtttatgatgtgggaaaaaaattggcttagctggatatgactctggtgtgcagaaagccaaccccttcccaccacaggtgctaggagttgagtcatcccttagggatagcaggtgtagtttgacattttatgacaagcatacccactttcttctgccccagtagagggagtaaacctgtcccaggcaacagtgaagagctgaggctcgaagtgcatagaacttgactctcagaaggaggtatagagaaacttgtgatgtgtggaca

SEQ ID NO: 103252 - DNA, 1571 bp, Homo sapiens
ttttttaggaacctgtgcgtagacctcagcgtcctcggtcgccccctttacctgctgtgatcaggaacgcccccagcagacccccttctttgccaactcctagaccagccagccagccccgaaaggctcctgtcatcagcagtaccccaaagctccctgctttggcagcccgggaggaggccagcacatctaggctgctccagccacctgaggcaccccgaaagcctgccaacactctcgtcaagactgcatcccgacctgcccctctggtgcagcaactgtcaccatctttactgcccaactccaagagccctcgggaggttccttctcccaaagtcatcaagactccagtggtgaagaagacagagtcacccatcaaactctccccggtgagacgcttgtcctctttaataccccagcccagtgtcagtagtgtaggaatggaattgtgcagtgtcacagctgtactgggggagccttcggaagatactgaatctaaagctttgctgctgcccctgaggacgggaagccttgatagctgaacggacttgttggggccagacagcacatcggttgcctgtacagcgagctcttcactgttgcctccgagttttggtctgccacaaacttgagtcacctccactggctctcgaagtgtgggcttaggtcagtcatctggtgacagatagcctgagtgggctgcggcagtggtcggtggttcttggggaggtgacagctagttggccaggtagactaaggtgggaagggaattgagaagcttctcctatgatagctttgagcaaaaatccttatggcgcaggggccagtgggttgcctgtgtacattccaagtaatgtcaggcagggattgcagggagtacagctcctcttggaacgactcctttaggctagatgaaatcttcctgctccttagaggctgaacagggcccctcacatcctcacgctcctcttgctctaggctacccctagtcggaagcggagtgtcgcagtttctgatgaggaagaagttgaggaggaagctgagaggaggaaggagaggtgcaagcggggcagatttgttgtgaaggaggaaaagaaggactcgaatgaggtgagtggttgaggtgaggttctcaaagcctctctctctagggcctgcagcccccaccagcagtctgcaccccccatcagcagtctataccatccaccagcagtctacacaacccaccagcagtctaccccccccaccagcagtctgcaccaactctgtttatattcgtgtcatgagccttccagaagcctagtgatctctcaaggactctcagttacacaagtgactaaacatggtgccaggtagggtcttgagtgagactggcttctggcttaaccacaggcctgaagtcacacagacgtacatcagtgaggcttgaaacacatgtcccttgcctgctgtcttgttcgtaaaggtagcagaagggtaggtaccttggacagtgattttggagtgtggctctcaacggggcttggtgatttaaactgtagcacaggaagtcgtgaagatgatggctgatg

SEQ ID NO: 103253 - DNA, 1337 bp, Homo sapiens
agctcagtcttgaggctttgctgagtttcacctgtccctcttgagtgagaaagaaggtcatctgtcctcccaggcctctccagctgcagccaggccaggctcacttggtttggtaccacatggtttctggtgtgcgtggatgactgagccaggatcttgataaaaaagggagaggggctgggggtgttaagagtccagcatattaagtttccatccttcctggaatcagtgtccctgagaagaattagtattctctaaggataggcagagttggagcccgagtgaagatctttgcctacaaagtctggggcatcattgtggtgggcctgtgaggaacccggattacagatagagttggtgggcgtggctgatatgtggggtttttttgctctctgcagatttgtgtctgaaatggagaaccctccccttccagctgagttctgtggaaaaagattaccctgacacctgggtttgctccatgaaccctgatcctgaacaggaccggtgagcacattgtctaacaaggggattgtgggtacttttctcccctgcccctcactgtgtttcttgaggtcagtgcacataccttacatctctgtcttgccacacctaataactgcccaagaaataaaaatagatgtatgtcctgcagtgtataagattaattctgtgcattgggaactctgaggtggttgctcttgtgacagacagtgtagactggctgaagagaaaggtccttgccgagcttggcgctctgtttgccacgacctctgtagtaccttgtctctacaggtgtgaggcttctgaacaaaagcagaaggttcccctgggaacattcagaaaggacatgaagacgcaggaagagaagcagaaacaactgacagagaaaattcgccagcagcaggagaagctggaggcccttcaggtacgtgggtcatggtcagtgggcaaagccagcctgtgtcagggctctgcctgtgacaggaaccttcagtagctttcctgttccctcaggctcagttttaccctccactcacccgcgttgtttgccaaagctttccaaccccaacctccaggtccacgtgtactatttgccaacagtgttattttaagaataacaccttgcttattcttaagaaaaaatgcttatatacttcaaagtggtccaattcatttagaatgtataaaactctagaaaataaaaattctgccttagaggtaaccatcattaaccatacatccttccaacttgtcatgaactcatgaatacctacacataacacacatatattttttaatagaaatagggagataatgccatgtatatgttttatatt

SEQ ID NO: 103254 - DNA, 2660 bp, Homo sapiens
caagtagtgtgggggtgggccgggggatctggcaggacaaaagatttctgtttctcaggaacattggtgatcatcttcaatctcaaactcatggataatggagagccagaactagacataatctcaaatccaagagatatccagatggcagagacgtccccagagggcacgtgagtgtggctgggaagggagggaggccctggaactggcgtttgtgctctcaggagatggcttcagggaaagaggggagagcacattcattgcccagtgttctgtggtagggtagtatgtagggccagctcagttgcctgtggggtgcctgtgctgaggacgtgagaggggcgggatgtggtgctcacactaagggagcaccagttcagggcagcagcagaagtcagtacctaacatggaaaggtggagagcctgcagagaggatgttgtgcccttggtcaggcctgttgtggagcaggtgacagcacttctctgtttttgccctctccaggaagccagagcggcgctcgttccgtgcctatgccgctgtgctctatattgatccccggatgaggatcttcatccatgggcacaaggtgcagaccaagaggctctcctgctgcctgtacaagcccaggtaggggccagtgccccttggcctgctgtctcccatgggtcgaggatgtggccgcgtttctctggggcattgttagagggatgctgtataagaggctctggcagtgctgactacgtttgggactttaagttgcctgtgattggtcacagggtcagttctgggtcctagaggagggacagatcagctgtggaggtggctggctaagctcattgagtatgtgtgcctctgtgacagggagggtgccctgcctggctcagtgagctgtctgagtctcttggctttagggccaaggggcctttagacactatataggaaagcagtgggcttggcttactcctgaggtttgtttctgctgtgggatgaatgacaaccctggtgaatggtgaggttgcttatcaaagacagcaggaggctaagggcaagtggaataaggaactgcacctttttgctgaattgagcttggatttgtctcatcatgaggggccaggacagcacagcttgggaggaggcaggaaggcagggtgcttcctgtgcttgggtgtgccacctgccccactgctgcgtgggccatcagcttgctttttctactgatcaggatgtacaagtacacgtcaagccgtttcaagacccgtgcggagcaggaggtgaagaaagcagagcacgtagcaaggattggtaatgccactctgggtgcaggagttgggggggtgtgcatctggggtatgctgcttgtgggcaaagtggggttccaggaaaaggctgagtccacaactcagggacaaggctggtctcctgaagcatagttcagttcctttgcagcccctttcactacatgccaactccctcagcatttcttctttctacactccactttctcttcttctgccatttatagggcctaaaagtgtcagctctttggcttatcccaattgaagaatcccactgagttctctggtgcaaatacttgtgaaattgcttttcctgacttcagggcaaacatctcaggggctctctcgctgttcagggtttctcagggtttctcggctgcttgttggagagtgattggctgaagacttctttagcttccagctcaagctgagtgttcaactggttgccttaggtgttttttttttttttttaaacctgttctggttcatttgtaaagtttccttggggcctccgtgataggtttgaatgccagattttccttctgtgactgactgccgtccaggcacagaggctgccctcacattgctcaccagccatagctccccctactctttttttccttggtggtgtacacacttcgtgtccagtactgtggatccaggagggatgaccaagagttttgaacctttgcatttcttaccatgttctcttctgggtttcagctgaagagaaggcgcgggaggcagagagcaaagctcggacattagaagtacgcctaggtggagacctcacgcgggactccagggtaaggtcccggcccaggcggctgttctccagcgtttctggcactaggagcccatgtcccatgagcctggtcaagtaaaacacagcttttgagtttgtccccagtgagggctgttttctgtagaaagaagtaaatttccaggtgtggttttacatctttgagataaattgagatgtcttagatgtaatgtttcaatattccctgctgtggcctagagtgccacctcccctcacctgatgtcaatgtgtgcaggtgatgttgcgacaggtccagaacagagccatcactctgcgcagagaagccgatgtcaagaagaggatcaaggaggccaagcagcggtgagtgccaggcctgtccttggatcttttaaactgacgtagcttttggactgattattgacaggttgctattctgtcaccaagactgctttgttttaatgccaaatgcttgtcaaatgcctcctgcaggagggaagtcttaatcctagctctcagcccttttttgagtcataaagacagggcagggctgacaacctcggctcgagcaccaaaaccatcc

SEQ ID NO: 103255 - DNA, 1045 bp, Homo sapiens
gaattttttagaaatggactcttactgtaggtattttttgtatcctatttcatataacactgtgtttatgttgttcatccatgttgatgctagtagtggttagttcatttgtatcactatatagtgttccattgtacagtttaatttggccactctagaatggatatttgggttatttttatttatttatttatttttgagatggagtcttgctctgttgcccaggctggagtgcagtggcacgatctcagctcactgcaacctccgcctcccagattcaagcaattctcctgtctcagcctcctgagtagctggggctacagacgcacgctgccacgcccggctaattttttgtattttagtggagaccgggattcaccatgttgcccagactggtctcaaactcctgagctcaggcagtccatccacctcagcctcccaaagtgctgggattacagacatgagccactgcaccaggcctgggttatttttgtacatgtttactggtacatatgtacaaaagtttctcctagggtatgtacctaggagtggaattgctgagttttaggttatgttatgtgtatttactgattcactagataattgcaaatatattttccctagtggtaagagtagaatttttaccaaattaagaaaatgaccagggacgtcccaagcagggaacttctcatgcagagaccctaagcacataaaccaacatctcctgaaggaagtagtcttgtgtggctgagtcttgggaagaggcagaagccctgaagctcacagagcctctggtgccaggctgtggagcttgggcctcacctacagggcagtgtggagctgctgtggggagggacaagagagatgcacatttgggaggaaggctgttctggggcttcccttaaagtgcctgctcatgtttactccacaggtgatagtcccactgcccacctggaatgctcggacccgggaacctgtcacagacaatgtagagaaatttgccattgagacagaactcatctataagtactctccattccgcact

SEQ ID NO: 103256 - DNA, 1344 bp, Homo sapiens
gtaagacatggaggccagggcttgaaagaaggggggctaagaggttctgtggaaagaaatccgcaacttccacagaagcaggtaattgaattcagacttacaatttaattcatctgtgttgattagctgtgattaaatttgttctggttctgtttagatctgagccttaatcatagcaaacttgttcaggtagggaatggtaggccttccgtcattacgtagcaagccagtgggtttgtctgcctttttggtgtggtatgtgagttcattctgcatacttgagtgagagaagcgtggcagctggaaagagcaggcttctaggagaagtaggataggaaaatatagcctgggttggggttttcaggaatgtttcctgatacaggactgaggatggtgacaggagggtatggaagtcagtagaagcagcctgcttaaggccctgagggctgtgggaggggacttggctgcagggccacctggagaaaggtggtggcctttggagatcagagagggccaggttaggcttgacctcggggccttgatgaatgtgtggggctttattaagcaaggatgtgccagtatcagattcttttaagaaggtccatgtagcgattgtgtggtgattgggttggaaaggttagggtgagtgttggagtgttccagttgagaggcccaggctctgtagcttggcggtactcgcccaagggaggtgagagaaatacatggagtttccatctctttaggatgtgggacccacagatttggtgattgattgattagtagaaggcgaaagcgaagcaggggagtcatggatgactcataggttctgctgtggcagttggggagtggggtctctggaattgggaagaatgaagaggggaagtatggaggggaagagtgtaagtttcttctggacatgcaaagtgcagtctgggtctggcatttgggggaagtctgggggcttcagcattcttggtagcaaacgaggtcacctaatggagagaatagagtgagaagaggatctgggacctagagcatgtcaatatctaaaggtcggggagaggagaagggggccagagggacaaaggggtagccagaaaggtaggaagaaaactgggcaagtgtaccattgaactaaaggagaagtgttcctgaggggagggatggggtgcccatgggagtgaaagccaatgtttaaagtgatgccattgtcacctgggatggctgtgaagaatgggaggcgtagtgaggtacaggtttatagaacacaaatggaactcggttcccgtggtggagaggctaggttgagattttttccttacttggtgctagaaggtcgctatt

SEQ ID NO: 103257 - DNA, 1497 bp, Homo sapiens
cttggagagaggttttcagcagatacacacccctgcttggatttaacaaggctcagacctttgactttgaggaccctgggaaagaaatgcaaacttttcactttctcttgtgtctgccctttcaggtgatgctgccagtgtgatccagtttgggaagtcggccaagcgaacacctgagtctactcagattgggcagtacgggaatgggttaaaatcgtaggtatattagaagcttgtcacagggctcaaacaaaatccagcaatgctgtcctgcttctcttggatgaaaactttccttctccttgtccctctattgactataattctggaactggaagaagtcagaaagtggtggtttctggagtagcttaccagctgttcccagctgaatttactccacagattgaaaagtatgaacatccaaaaacagggcaggagaggctgtacgtttctcttggcacagtgctctagaactgcacctctcctgttgaaaattcttatttttaccctgtagtcaaggatgtgagtgattctcttgtggtgttgggatgtatctgagatgatgaaggggtcaccttactgtgcagcagtgttccctgagcacctgctgcatgtcatgctttgtgccaggcactggggatccagggtaaggaagagagatgtgagccctccgtcccagaggatgctgaatgtactgcaaggcccttatagcagggacctacctaatgtcttcaaatcccatgggactttttcttagccttagttcccagttggttagtgtttggaatgtgttgttctggttttgagtgaagccccaagagaaaggtttctatttctgaaatgctcacttccagctgtacatacctttggatggaataagatttagtggaattggagtttgtgcaaatggaattgtgagtcacgtttccagtcttgtcgtggaaatgtgttgttttgtttgagggagggtggtggtttgatcagtcagcagcatcagttgggccttgtgtgcagttgtgctttgggtgtatggagaagaaagagagtacttccgaagaaatcaggacctggtatccggactttgtgatttgtctttcagggcaggaaccaaatggtaataacagacacttaccatgtgccaggcacacgaataatctcatttaatcctcatgatagccctgtgaggttgtaggtactattattttcagatgaagaaattgaggtttataagggtgaagttactttcccaaaggcattaaaaatgcctatgtgtagagcgctagggtaggaaccaggtctttctgactgcaaaatggagctgctgtgcatttcacttaaatgacaagctaaggttcaaatctcacttccgctactacgtctctaagcctcagcttcctcctttgtaaattgagatgataatgcataccaagtaggttaagaattacatgctatcattgctgtgagagcctggtttctgcctttatttctcctcctttg

SEQ ID NO: 103258 - DNA, 1100 bp, Homo sapiens
caaagagcatttaaaacagatttctcagcttagatagttgtacaaaattggttaactgaagcttgggggagattccgaaatcatcagggaccaggctgcagagcagccttgggcttgcccttgtaataccttacacagacctctttcctcttagaaatgctacctttatccctgtgccagtcagtagactgaatagcatctatatgggaagttggcttgcttggcttgtgtgggtctcctccctatacctctgccttacatccttctcttctttgtgtctaccaacttccttgattccaaggctggtttctcttttgctcacctagtcctcatcattgggtcaaaaggcaccttggaagctagtatagcctgtttccatatttgggaatcgcttctccattgaccatgacatgcttggacccagaccactttcagttaaccactttctgctgcagaagacaactgctgagagaagacgttcttttcactagaatggcagccgtagtttgttgtgttccttttctgttggccaggaaaccccaccacagctgctgtgcatcttattgtcaaaggaccattccttcttcccatcaggcaggtccagctaggaacaaggcacctccacgttgtaccatgtgccttctcactgttgggatggggagccctttcaaggaccatagctagcaggggatatgacagtaaatgcagatagcccagaatgccagtcagcctagggatggtcatgtatagacacagtacttcatcttttagatagcagcttccactgctgtgcccataccatgtctggtttcatcactttgaaggataccccagacttaattcacaaaggaggcatcctgttgagtttgagcagtattgataaagtacagtgtgtggtagttggagtactttagtgcttggggtctatggcatagggcagaagtgatagtaatccaggtggagtgagcagaaggataggatgattgagatatgtgtgaggtatgtgcatattcagtggtagtgggtatgattagatgctggaccagatattcctgccttcaaaggttctcccaagctttgtcatgatctagaaaacattg

SEQ ID NO: 103259 - DNA, 1030 bp, Homo sapiens
agttaatgtgctcgctgataatttcctctttacctctgtgtatacaataaacttattctaattacttttgttgttgttattagctggactgctcatggaagtgtgctagttgtttaaccagaaaactcctgttttgtttcaatcctggttgactcatcatttttccattcaattaaaaagtgttgtaggttaatggaactgtgtttgaatttgccacttgttaatttagtgagaccatgatgtgcggtggcaggctgctttttttgtgtatcatatggtaaaatagagattcttaggagtatgtattcctacttgtgtatacattttgccagtatctctcatatttgaaaatgttttagatatttgagaataggtatatgtagagctgtgtggattttttgcatgtaaaaccagtgaaacggtttcattttctttgcagttggcagaattggactaaattacttctgagcctttatggaagtcttcattgataactgaatctgtatgatttcagccaatggttggagtctaatggggcaggggtatcccaacttcctttcaggtttagggaggttaagattatgggctcaggaatcagtctgctgactgcagtgtgtataccacgagaagtgatttttcacaggttttgtgggagattattgtcttccttttttcttaaaatattgacgagaagaaaaagtggacaagttattggaacatctttttatgattgcaatcaaatgagtgagaaaaacatatttgaatcatttcttagggtataaagggaaatattcttgcttatcctatagatgtttttaccacaaaatcaggatttaaaaaaaatatccaggccccatgtcatgtgatcatcttcaataatttggggcttcagaaatgttttacagatatataaagaaaattgtgttgtcaagtataaaagtaaaaaaaattctaaatgtctatagaatttctgtatggcttcctgaaaacagactcaaaatactctgcattctactcaaatcactatgca

SEQ ID NO: 103260 - DNA, 2010 bp, Homo sapiens
ctcctctctactaaaaatacaaaattagccgggtgtggtggcgcatgcctgtaatcccagctattctggaggccaaggcaggagaatcacttgaacccaggaggtggaggttgcagtgagccaagattgtgccatcgcactccagcctgggcgacaagagcgaaactctgtctcaaaaacaaaacaaaacaaaaaaattgcatttgtaaaaatttggagttacttgaggaagaaaaaacaatattcctggagagtttagttatggatatttatttaataaatgttttacattttgtttgcaatatggtaagcgatcagagatcctagatgctggttatttactattgatatatttcatttaaaaattcttactttaactgaaaattggctgaaactttttactttggctgaaactctatgcaaaaaagtcagagtaacatggatatttttgaaaaattgatggtcatgtattatgtgggttaatattgtatttaatcagaagtcaagtgttttttttttaggtggttctatgtggacacatcctaatttgatatctcatgaggactattgtggaaaagagcacaaattaaacagtgtaaattgcacatgctcaatgtataacttgttagcattttgttttaccaatacttgtgcgtcatctaccagtgaagaaaggaaactcatacacttttgtgtaatttataagcaaaaatatcccatttgaaagagaaggtaaagagaataactcattttatgactttctcagattttggctaaaaccagaactttccctccattaaagaaagtaatcgaagaccttttccaacaattccttctaggatgacaagagcttgcttggtgtggttgcctagggcccctgttaacattaaccccttcaaggaggggaaccagtggtcatctcctctgggaggctgctcaaagtttggattgagtaaatacacagttatcatgttattcaaaacttactatactccagtccgagtgacaagaatgagaacctgtctcaaagaaaaaacaaaaaacaaagttcaatatttatgcataagatatatccttaaaattcttgctctgagatatgcagaaactgaccactggttaaggcaatgaaaaataaaatatacaggcatttttctaggcaggatatgaatagtgaaaaacacttttagcagttactacacataggactctttcaatgcttcagggtgggtttcccaactcaaaataggaagaataatcatttctgaatagatggcaggacttgttaaagattaacaattgaggggagttggggagctctggaaagccttgagtagtataaaaacaatgcaaatggtggttttaagatttttttcaaaaaacttaaatattttataaccatggctttttattaggaattataacttcaataattcttttgctgacttttagtatttatcatttcagaaccactcacgaattcttgtttggtgcccttgctgaactggttgataatgcaaggtatgtagtcttcaggcatacaatctgtgcttgaagtggaaacactttaggtagctgtgacctttgctctctgaagacttgagaggaagacatttctgtagaatgtagacattctgtaactcctaggatgcctcttactaaaaataatatttttaatagcacattagttgataacttccactttcttacttaaattcactaattgttctttgtgttctagcctaaaaatagtgagttatcacctccaaaaccacttcccttgtgtattagagcaagataattgtagtaaaatgcaaggaattaagatagacacttaggaatcatattaatgagacaggcaggctctgatttaatttgtgctagcaggatagtacaccatctaatgtctttaaaactatgccaaagttctgtgtcttctcaaattgtatatttgtcagataactaaatgatcacagtgtctttcattgttagcagctgtgcttggaaggaatc

SEQ ID NO: 103261 - DNA, 1026 bp, Homo sapiens
accacacaaggcacatttctaagcactgtgtggcaggtgctttgtgcttgccctttggagatctgcttattgcattctaaatttctcattcttgtgggatgctatcggaaaatatgtattgctaagaagcagttgaaatttctgttttggttttcttgtcctaatggcagagggtgtcaaaattagttttccagaatattcagattgaccattctcactaccaaagactggaaacttcattatttattctgaagttagtacattctgatgcaagatgtggtctcatacttactatggttgtgctcttgtttttttctggtagctctatttttgagattccttgatttacgttaaaagtacaaactcatgttgaaatgagaagaattgggataaaattggtcattttatatttctatataacaatcctcaaaaatatttagggtatataaaatgaattcactttgtaagtttctaagtcacttatatgtttgataggaaaatgactggttgaaagtttgaaaccaaatgttagattcacttttaaccaacattacctttggcaagtcaccttaatttttaagcttatttctccctagttagtggggtagtttacagaatactttttgtttatttagttggtaatttaaagaatttaaagtgataattctagagacaaatattttttgttctttaaattttttttttaaatttttactgagggggcacaagacagatatttttaataattaaacatatgggccgggcatggtggctcacgcctgtaattccagcactttgggaggctgaggcggctggatcacctgaggtcaggagttcaagagcagcctgaccaacttggtgaaaccctgtctctactaaaaatattttaaaaaattagctgggcatagtggcaggcgcctgtaatcccagctactcgggaggctgaggcagaagaattgcttgaaccctggaggcagaggttgcagtgagccgagattgcgccgcttgcactccagcctgggcgac

SEQ ID NO: 103262 - DNA, 1091 bp, Homo sapiens
tcaaacgattctcctgcctcagcttcccaagtagctgggactacaggcatgcaccaccacgcccagctaatttttgtatttttttagagagacggggtttcactatatgttggccaggctggtcccgaactcctgacttcaggtgatccacccaccttggcctcccaaagtgctgggattacaggcatgagccaccatggccggcctgtagcagtcacctaggttgaattctaacacttaagtatgatgaccctgaaacacacttgggtgaggttgctgattagtgattattcagctagttgatagcatagccttgggaaaaaactttagtgtcctttttaatgtttgaactgccatattaagaacaagcagttgaaggccacttaaatgttcatggatgactgtgtttgataaatggttatctcagctctgaattttggaatgatggtaagtctggaattacagattttatgataatcttggaagaccatgaactggacttcagaatttcagttcttgttccagcttcaccaaagactttatgggataataatagtaacaacagttaattgcttcatatcagtcactattttaaacattgtccaaagcaatctttacaggaagcctttgggataaggattattcctattttgcatttgaggaaactgaggttcaaagagattaaattacatggtaatggctatatagctgccaagtggcagacttaaacggtgccaagatttaagacagtgggatttatctggccacagtagttggtgcttttaaccattaggcagtgcctactgtagtcagttttaccttcaagagcctatttgcttgtctataaagcaaagggtatacttcacagtttaaaagtcttcaattttagtttatctcaatgaatctctaaggactctgggatatttctcccttctttttccccctttgctattttatagcttattgatagatacttggcactgccaaggaaaggaaagaaaccagttaagtcatttgttggggaattttctgggactttgacttacccatgttgaactggaaccacctgcttgcatgaacatttgagggtt

SEQ ID NO: 103263 - DNA, 2028 bp, Homo sapiens
cggggctgtgtgcactatcggagacaaagcggtggctgtggtgtctgtgacggcggcggcagagcagctctaaacgccgaatttcgtgttgctgaatcctgtcaccatctcaactagcgcggcgcgcgggcggcgcgcgggcggcggcggaggcagcggcggcggcggcggaggcggcagcagcacatggttccaagagcgctctgcggctgttgggttccaattccgcggggagggacaaaggcagttgtgagatccgggtagtgcccggtcaggtggtgcgctcgccactgccctcgatccggtccttggaagccgggagtagctcctcttcgtggggaggcggccacgggaccgaggcccgggaagggcctgggaggctgaggctgttgtctgagggacgtgggggcggggcgcggcctgcccgaggtgctgtgggcgggtcatttgtgaggtgtttatgtgggccaagtgtgaggtaatctgaccaccaccctgaactgggtttggtccggctttgaaaaaagaaatcgtgagtgcctaggagctttttcacttgggaggtggtgaagctgcaacttgcgccatataacactccgtcgacatcttggtctccggtcttgggcctgtttaagaatcctggcatcacgtgtggcgaagacatggctgatcagttttctgacagaagtgggtaaatttccgcgttggtaaatttcctgacaggaaatttcggggaaccaaaaaaggctggaagaacatgaagatggagcagtcataaaccacccactcaaggaccatctccttcaggaccatccacacgagactcagattgtctgaattgagctatcgcaacttaatgctaaaagctccttaaagctacagatttatgacatagttccttccaaaatattacatcataaatcattgagaagattaaaaaaaaacacttgaagaaattgtagttttaaacatctctgcatatattttggatagctactaggttactttaactgtcattaaggagcacagacttactgaagctttactggacagaatcctgggaaatcgatatcattataaggttatatttcccagttagcgggtgaagggctggagaccttattgcagtcatggctttcacaaattacagcagtctgaatcgagctcagctaacctttgaatatctgcacacaaattcgtaagtatcctctaggtgccactgaggtaaccagtaactcgttccttgatattatatggaaatcgtttccccagaaaattttgctttttcactttttgagatgtatcccactggagtgaaatgtgtcactggatatcttgagctctgtattgaagaactgagatcagtgaaatacttgttgctaatccagaagaatctgatttttgtttattggatcaaaattttctaaatgcaaactttagttatttgaagtcaatatgttgagttgtttcattcaagtgtttataggaatccaacaaatactgctctattggatcgccaaatgttggactattttagtatcaaccgtttcccctctgtagtgacaacgtcctaaacagttaggtttataacaagtgtttactttctaacaagaaaacagaagacatttaaatgacaactttcaagaagaaaatttttattttttcagaagttggcattatcttcctggcagattgctcacatccaatattatttgtatatgctaaacaggaaacggcaacttgtttatatctctatttagatagtctttccccaaaatttccacagaaacatacagtgttcatggttcttgagttcatgaaggagtaatctaatcactccaacatggtctggaatgtttcaggtttaatccatatgcccactctcttggaggctgtccagtagcgtcaaaactttagtgttttaatacattcacctgttacttttgagatgaaggtaagtgttctaacattctagtacctggagaggagatgagcagctacatgaatggtccagtctctgaagaaccc

SEQ ID NO: 103264 - DNA, 3352 bp, Homo sapiens
cacaactgcctttgtccctccccgcggaattggaacccaacagccgcagagcgctcttggaaccatgtgctgctgccgcctccgccgccgccgccgctgcctccgccgccgcccgcgcgccgcccgcgcgccgcgctagttgagatggtgacaggattcagcaacacgaaattcggcgtttagagctgctctgccgccgccgtcacagacaccacagccaccgctttgtctccgatagtgcacacagccccggccacctcgcacactccccgacgccccaagcccccgaggcctccgcggagcattcagccaatcacaaagctgcagctcctcccgcccccgccctgatgtacagcctcctgattggcgggctgcgtgtccccatgtgaccggatcttggttggccggtcccgcccctgtcacgtgacagcgtgcgcctctcttcctgctttcctgaccctctccgccatttaaagaaacagtaccgggggcgggccgagcgacgcagccgggacggtagctgcggtgcggaccggaggagccatcttgtctcgtcgccggggagtcaggcccctaaatcgaagaagccctggcgcgccctccccccctcccgggtctggtagggcgaaggaacgggcgtgcggtcgatcgagcgatcggttggcggctctttctcctgctctggcatccagctcttggggcgcaggcccggccgccgcggcgcgcgcccggtggccgttggcgctcgcgccgcgtctttcttctcgtacgcagaactcgggcggcggcctatgcgtttgcgattcgacgaggagtcgtccgggtggtcggcggcggcgggcagctgctccgccccgctccgggggaggcggcggcggcagcggccgcgggatttggagcggccggggaggcgggggtggccggggccggcttggaggcctggcgccacccttcggggcctgcaaggacccagttgggggggcaggagggggccggaggatggttggttgtgggatttctactttgccttttcctccttatgccgccttagtgaggggcgggagctctggcggcagccccggggtggggagacgagctccggagtcggaagagctgggttttcttccgggcctagccaccagttggcggagtgaccttaggcgagtcactctgtaatttgtctgcgcctcagtttcctcctctgcctatcaatgtgtgtggggttgaaatcgctttgtaaactataaagcgtgggtgtacgtaaaggatggttattgtttataattttttttgagttgtaagaaaacttagcagttccccaatccttgggttttgaacctgggaaccttggattggagttggggatccccaaacttcctgaaattgtgggaatgtgcggtttgggggaatgatgggaatttgtgggaatgtgcgttttaggggaatgatgatccatcgctagcaagttttccaagggggctgtgacccagaagagttaagaatcacaatttcttcatgctacagagaggaaactgaggcctagatgtcatttgggacccttcacaaccattttgaagccctgtttgagtccctgggatatgtgagctgtttctatgcataatggatattcggggttaacaacagtcccctgcttggcttctattctgaatccttttctttcaccatggggtgcctgaagggtggctgatgcatatggtacaatggcacccagtgtaaagcagctacaattaggagtggatgtgttctgtagcatcctatttaaataagcctattttatcctttggcccgtcaactctgttatctgctgcttgtactggtgcctgtacttttctgactctcattgaccatattccacgaccatggttgtcatccattacttgatcctactttacatgtctaggctgtgtggttggtggtgaataggcttctttttacatggtgctgccagcccagctaattaatggtgcacgtggacttttagcaagcgggctcactggaagagactgaacctggcatggaattcctgaagatgtttggggtttttttctttcttaatcgaaagttaacattgtctgaaaagttttgttagaactactgcggaacctcaaaatcagtagatttggaagtgattcaaagctaaactttttccttggccctccttgtgttctaattgcttgcaagtgtaatactaggatgtccaagatgccagtttttgcttctttgttagttgtcagctgcttttatcaaatttcaggccattatccaacaaacactataaaaatgtttgaacaattggatttcaaacattttcgttttgtggagtggtgctcaccaagtggtacagccctaagcaagtgaacacaaacacatttaagtgtattttgtctgattagatgttagccagttatgctatttcattcaaatgtctgaaaaaatcaattgactattcccttttcctaaagggcagagacagataatctcacttccagagaaatgacttggagaaaaaaaagtgttggtctttttgctcttttgtaattaaatccggatgtacctcaaaagacttaagactgtggtgataagatgctttcctcagcagaaaggagggaaaaaaaacaactggaactcaaagcttgaaattctgtggcaaaacatgagatgtccaggattggaggttgaaaagatttcactacagtgttctgcaatagttggagcagataactttcagtgtagccacagccatggactccagatttccagattttcaagacctggacctggaacccgaaagagcttgtcacgatgcggcaggaacactggaggtagatttttttttatttttgaattttgggactgttgaccttgctgtgagaaaagagacaacgactgagcaagcactaccaccagcactgttactgggaattagaagacctgagtttctgtccagaccctcagtgcaaactgaggatgctccatccaaagtgaattatggtacttgccattttccaaaatgccttatcctttaccatctctgcacttttgttcatactctcattctactttggaactgctgctctgtggcttttcatctgtcaaaactgccattttctcagtatccaactcttatgccctcttttccatgagtctcctaactagccagaatagagctttaaagttttatgacatttcgttatgtatcctctatctgtatacaaaatcctgtaaaatagttacttgcctgcatttactgtctttgcagatagcagactccttgaaagcagggtccttgtttagtgcatctttgcccacatacaccacaacatatcaagat

SEQ ID NO: 103265 - DNA, 6081 bp, Homo sapiens
aagaattaacagccatcaggctgccgatgtgctgacagcagacccacttagagtcctgtgtttgtaattccatgcatttgttattttacctgttttgtccctgccccttctagtcctgtgcctcctgattgctgagtgttcacctggaccttctgactaccttccctgtgctattccatcagcctacagacctggtacctggatttttgcccgagatgattcctaccaccttactactgacgaagacacccattccagtggaccactgtgacccaggaggcattcagccatcatgatgtggcctttacctccactcctgtcttgttctacccagattcagcacagccctttatagtgaagtcagagtcctcaagccaaatagctaaagctgttttatcacaacaaaggcctagtttgttccatgagtgtgcatttcatttcttcagttaaagccttcagagacacacaataaatttggaccaggggattttttagttattaatgctctctgaagaaaggcaacatctttttgagagcagcattggaccacaccccacaatctcaaatgattgaaattcatgaacatctaggatcccgtgaaggtcactggaccctgttttttctacttcaaatcctgtagtagcctactgaatgagaaaacatattctgacccattgggatcaaatcaaaggcacagtgaactcctcatagcatcttctttggaattactcaggaaccagaactttttacacaaatgtaagaaattctaccaaggagtccccttacctaacagcatctcacaaggctgcaccagattccagaaaaggcttctcttgatacatcaaggtagaacctctatggtaaatccctctgtttataatgcactttacagtttcaaagcacttgtacgtacatttatctcaattatcaaaataacagtgaattataatccctttttggaaatgagggaatgtaaattttaaaagttaagcaattatccaaggtgacacagctgtgaaagtggtagaggccaggctttctgacacccagtccagtactctccttggaattagcctccattttacccacagtgttaaaatggctgggtattgggaacctcaggaaattttccagcttcctgatctggtgcccctagtcacataggatgtgtgatcacgtgatagctacatctggaccagaatcccatggcaatatcccacggtttaagggcataatatctccgtggtggtagattgtcaagtcaaaaacgggacatgttctaacagcaaagctacccaatatgaaacacaaagctacttttagattttttaagacttactgatattcctgggccctaagagcttgtctatggtcctatctttgcaaactagtatttacacaaaatgagccacctggtttttttaaagtcagtattgtgtgtgtgtgtgtaaatatgacatggagaaagcttctgttacctagtaagatagtaaagtatgtaagacatggcccttcccccagtctacattgaggtatagtgtattaaaggatctcaggagacttgcagcaaattactactgcttctgtgcttaaattcagaagtctgaaaaaaaaaaaaaaagacttctagtaaagagttccattttgctgtttaaccctttgtgtcctaagtttaatcaaacacagaaggatatttttttgcatcattccatctaatggaatgcagaaactgctctagagcagtataaccagtgcttcctgattgccagcagattgccctggacaccccagaataaacagcatcttcaaaatccccctttctcataccttcttattaatggttgaattagtatgtctctgtcatctgagagtcttgcatcttgaccattacctttattttctgtcaagggaatccctagaagatgtatggggagacataggaaaggaatggaagaaagttaattcaccccaaattggataaattccatgacatttagcaatatacttctgtatccctagaattgtatcataactttagttcaaggacattgcatctcaggtgggttaaggaggttgggaaggggagaaaagggatgaggagatattttcttgagatttatctccttgagataatgcttgagaagtcatccagccatggacttcttggagtaatacttacaaagaattggatgcattttgcatccttaggcaaaaaccccagtgctgttacaactgaaaatcattagccttgttctctgatagatacttacaagcccaactgcaggcaatcaaaatttatagcagatgagttctaactccatcaacctgtaatgtggtccatcttagggaaagaataggaaaacaccttggtttaccacaggctttgcttacagtttctgctttctgtgacctattttttgtatttcagcattttgtgaccgacttattcttagatcattggttttccaaaggctttgtggccatgaagccctttgagtgaaaactgtgcagaagcccagagtaaaagtgaagctgctctggatgaagtagtgaagcaagagtaggggcctgaatcctgctacaactatcttcctttaccaccgtggtgacacctaaggggacttccttacaacaccttgaactcttccgaacacagtttgaaaaccactgccccagacagcaatatgtttgacctgaatggcattccaatcttttctgtacctccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactttgaagtcttgaccctccatgaatacctgaattatcagcaagcgggttttgaagctggtgcctcattgaggccatattagagcaacttgtacatttgacctcttgttatcagccatggtactctacttcgtgtgcaagagataactatgaaagccaaattcaaatactggcaacatttcctaaaggggctcaatatctatcattcgtcttcttttccaaactacacatcactgtatgactcaaccagtagcagttatattgccccttggtttttattcagtttaactactgtttccaagataaatgagctaataagctttaaaaaaaaaaaaaaaaaaggctgaattcttttttcttcatcactggcatatctgcctattctccagaattattatgactattcagctcactttaacagttgaacttcaagcgacaatctttgaacaccccttctcatgtgatttaaaatgaaaccatttggaaaagtttcttctagccagtaatagattttttttttaattgctctgccttgtgccgagagatgttcttttaagatgaatcttttgatgtctgataccaccaaatataggtggtagggagagttggaggctggccctttgagcaggccattagcttacttgctgggcatttccgatagcttattgcctacctttttgctggaaacaaactgatttgaaaaacaaaatctatgaagactgcagctaaggattttatcggtagacttaagagcttttgtccttgtggatattttagtggaaccacatcagtctcaatactgtcattttacactgactcagagcagctgacttcattccttgccatgatatatatttaaggcaggcattgtaacagacataaagacaacttatctgtttcagcaggaaggattcagtttatgaactctcagaccagatcatgttgaacaaggagactttgatgtgtgtcatgagaaaactcattctttacttcccagtcaatttaaaggccagctatcctgagctactcgaatgaatgcactggttaaacattggaaatagtttgtttatatccttgtctctctctaggccaattgtgattacatgactcgactctacatctcgtcaaacaaggcctaggtctggttgctgtagactgctcgccctcaacaaataaaatctggttgactagcctccttgtatatacaactattatttgttaagaagaaattatcgtcaattttctactaccttccaattgtcagctctttttttcctctctggtttttcctatactttacagaaaaagacattgatctatactgccattccctctaatcctgccatactcagtcaaaaggaatgacttaagatgaagatgatcatctgctcgagtctaaaatatacattgtatataagaattggtgattagaaaagcaaaaaacctaaaacttaaatctaggagtctgtatactgtctccatgtctccatgcctcagatctcatctaaatctttgaacagcaccattcaaccaatctgaggccttgacttgcttgtaagatgattctcagagatcggctgagttaaaaaagatgacgacttgattaccaaagaaagtagggccaactttgacaaatctggctctgctgaccctgtcactcccagatgtagcatagactcctaaacagaacctcaagtctgattgaggataaggccttctcctgagctgaaagttctttggcagatgagcaagaaactgaaagctgatgtacctgactggctctgtaagatcagaaaactgtatccagaataagccctatggattaacccctgagtacccagagtaaaaactaatttacagaacttccttattgatctgctggttcttccagatcatattctggctattggtatggctggcctttctgaaggtaccctgcttgtctattttcctgactcagctcttgcctgcctttttcacatgttgctgcaattagactcaccgtgaggactacagtcaatttcagtctatcttgtgcccaatacaacaaggatttttaatagtaacaacccacacctcacccactaggactcaatgttcacaacaggaaggaccattgctgcatactccttgaccagcaacttttttgaagatatttttaagtgcagagtaggcctctattcctgtatgtaattgttcattttcagcacctggaacctcatctatcgggtctggaaggaatacagcagttcgaaagccgcgtccatttctctccttcagtagtgcagaaatgagtccgattcaccagtacacacagaactgtaccagttcaacctagcaaaagaagaaaagtttccactgtacttaaaatttacagctgactcaaattgcctcacagaattatttgatgtagaaggctagttgtcttacttcagatcagcaggacagttgggctctcagactcatgaccactgagtttgcttgtgttgaaactgtggtttcatccaacatatgctattggacatgattattattccattcaaatggattacagacttcttgaggacaggacaaacttatctctcatggtgtttttttagaatacttttataaccaaggaagaaaccatgccagctgttaccattcaacttcttaagcagagattaagctttttcatatctgttcttatcctggacatcagtagtttttaattgcccagcatccgttccatcttgtaacaactccctgatgtttcttaaaaccacctcttcctattttcagtctgtggtttggacagtctgacccaaccttgagctttgtgggtgaacatgtaattcagacctcatcaatcagcaaatccatctgaactgtggaggagaagctctctttactgagggtgctttagctttgtaggatgaaaacctcaaactaacagggcctaccatgtagagaatgaagccagtgcaggggaaagcagagccaaaatatggagagacttgaatcctgatgacagcgtttgtgcccctggatccaaccgtgcctgaagctagaatatcccctggacttttcagttatgtgaacc

SEQ ID NO: 103266 - DNA, 1016 bp, Homo sapiens
ctggcttcaggaggtctggacagcagagctggctccaagaatcggaagacacagtgtaccttcctatacctgggggaatgacagtggtggtggcagcaagaactacgggttcagcccacagccagaagctgagcctgcggagtgggtgggggctgggtaggccctgtggatgggtgggtggggcaggaaactggagactggagtgcaccccctggtggtaagcacagcttgggtgggtcttgccaggccctggcttctcaatccaggtccctgccctccctgttttgaggtttagacaggatgagagtccatcccaggccacacagcagactggcggccaagctggcagggctggaaccagagaccccctaccctgggtttggtgagttttccagcaaaccaccctagggcagagggcagcttccagccaggagccacattataggatgggacagtaatggacgctcctaggttagagagggaaagtaaggcacagagcctaagtgcctgtggtttctggaagccccagcatgcctgattcatgtctgtcccctgcagaattctctgagctggtgacaggtgccacaggcactggggatctcaccagaaaggaaccgacggagctaggggccagcgagatggcggacgaggccttagctgggctggatgagggagcccttcggaagctggtaagtggccccatcacccactgtggggacaggaaagccaagccagagaggcagggtcaatccagggtacctctcagctgacaggaagaagtgatgggggaaaggtcaggaggagggggacatgggaacaggggtaggccagttccatgtggctgatgcagaggcccttgtggcatgtgcctgtccatgcctggtactgaagcctagtccctcccaaccctccacagccaccacctgtttaaacagtaactgctgtagactcgcccgtatgcagccacaggtgtggggaggctggatatgcctctccagagcaatagctcgggcaat

SEQ ID NO: 103267 - DNA, 1106 bp, Homo sapiens
tgagccaggctctgcctcctcttgactttaggtatgtcaccaccttctctgagcctcagtttatctatcttgacaggggactggggcactagtgctctaagactagggcaagagggtgccaggctccagccctgaggcatgtgtggcagctgccttggcagcccctggcatgacccaggccccagcccccagctccctgccgccctgcaccctggccagaccaagcctccctgaaacagctgccacctcagctctccttacccttatagcagacggagaggccctgccaggagaggaagggccataatagttggcttggggccttgtcttcaaggggctagggagatgccctgggagggctgcagggctagagactccttagaggatggtttccagcaggggcgaggcagggggaggtggtacagaggagagcttcatagaggtcttggctcagggcagccccagtcagacacctggtcaggagcctacaggccccgggccagccctcttggcaaggtagcaggcagatggggggcaacatgtgctgcctgggcactggcccaggaggacctaggcctcgggaactggcagcacagagcagagcctgcctgggagggggctgggaacaaagcagcaaaatgaactaaggttcaggagttaggctgccttcagctcagatcccaggctgcatcacacttagagagagactgtgggcaagtcagttagctgccctgagcctcagtttccccttctgttttttttttttttttttccggtcttgttttctttgcaacagggtcttactctcttgcccagactggagtgcagctgcatgatcatagctctctgcagcctctaactcctgggctcaagtaatcctcctacctcagctttctgagtaggtgggactacaggtgcacaccaccatgcctagctaattttttatttttgtttttgtagagatgcggtctcgctatgttacccaggttggtctcaaactgctggcaacaagtgatccctcccacctcggcctcccaaactgttgacattacaggcatgagccactgcgcccggccttcccttctgttaaatagggacagtaaagt

SEQ ID NO: 103268 - DNA, 2187 bp, Homo sapiens
tcattattatcactatccattgtattaatacaattcggggtacgtgggaagccctacaacaaaactgtcagtgcctcttccctgactgacgctgacatggccatctttgggcaggcaggctggcaggctagtggttatttccaaggcgtgccagcaaccctaggatctgcttccctatccattggagacatgatgagtttcacccatacccctgcttaaagtccatgccctctccccaccctgcagatggaagcagagccagcagagcctctcgctgcagcagtggaagcggccaatggggctgagcagacccgagtgaacaaagcaccagaagggcggagccctctgagcgctgaggagctgatgactattgaggatgaaggagtcttggacaagatggtatagccagatccggtgggctgggggttggcagaggccagcaggcaccaggtaggcaatgatgggctctatatgcagctggatcagagcacggactttgaagagcggaagctcatccgggctgcacttcgtgagctccgacaaaggaagagaggtagagagccagttgccctaccctagatccagctgccccattccccagctgctcccctcatactctggggtccatttgtggacaccccagcttaataactgccctacccagcttctccttctctagacccagcagttcccttggctattccctgctggatccagctgctccttccctagctccttctctcccgctggtgaccccagttattctccccaaccagcttctcttctccttcctagacccagatactccctcccgcagctactctctccttggatccagttgcctctcaaagtactgtcaacgactccttccctgaatccagatactccttctccctgctgctcctctctccctgaagtccattgatggccatcttagcctctgccccatccagcttcccttttcctggacacaactacttcctcccccagatagttcttccctggacacatctattcattcccttagattctgggttcaattgcttctcctctcaaacactctcaattactcctctgaatctagctgcttctgccagggcccactgatggccaccccagtctctatctctacccacctacttctattttaagcccagttaacccccttcactagcttctctcccagctactcttcccctggatcagattgcttctcagatcccatcaattgctcccttcctggatctaaatattcctgcctccagctgctcttctcctccaaccaaagacctgctgatggcccacccagctacttcctcactcagcttctccttccttggactcagctaccccctcactagatctagatacccctcctgacttagctactcatgcctatagaaaccctttttggatccatacccctttgagtttagctactccgtattctctagtttctgcctgagtccatcaaacccttcccacactccattccctgtcaagttatggctgtcccctcaccccagctgctcctagagaggcccttgttacctgtgtcattcatgtttctaacaagccaccctccaccccgtcttgtgtgccccatgcacctgtgcatctgtgctgtgtgggtgttggtggcccttttgcgcatgcatggggcatcccctgcccagaccagcgggacaaggagcgggaacggcggctgcaggaggcacggggccggccaggggaggggcgcggcaacacagccactgagaccaccacgaggcacagccagcgggcagctgatggctctgctgtcagcactgttaccaagactgagcggctcgtccactccagtaaggggccaaatggggccggcccagggctcagggtgggaacacatcctcccccagccccctgtgcctttcacatccttctcatcccctgcccctgcagatgatggcacacggacggcccgcaccaccacagtggagtcgagtttcgtgaggcgctcggagagtaaggccacctggtgtcgccctgtgcctgcctgcctgtccgcccacctcctccggctcttccttgagctctctctccgtgtcttcaactgtgccgtcactttctcttctctgcctgcggctatcaccacccctccatacagcctcccatcccatctcctgatgtccagcccaggccctcacc

SEQ ID NO: 103269 - DNA, 1050 bp, Homo sapiens
ctcaaagaggacacaaggcaagccctagattccagaatcagtgatgaagtaacagggcctcttgggtggtgggcagggttcaaggccggatcccactcttggagtcccctccttgttgctctgtaggaggccctgagtcaatttctctaaatgagggaaggagtgatgaggcatgaccatagccttagctgggtggcgctgggcctctcagtagctctgtcccttgaaattgcaaatatgggagttgacaggctgacttggaggaggctcatgttccaactattcactcattgtgcaagctacggggcctctttgtgcccagtgccctaggtctggaataacagaatgctgaggggtagacagcaggggggagttgcccccaggttcctgaccagtcctcctacggcttatagcacgtcgacatccagaacttctcctccagctggagtgatgggatggccttctgtgccctggtgcacaacttcttccctgaggccttcgactatgggcagcttagccctcagaaccgacgccagaacttcgaggtggccttctcatctgcggagtaagtgtgggccctggccctgctaatgttgctgcacatctggggctggacatcgggaccaggcccagttgccctgagaacccctggagcgggccagccacattgtcagtcagcggctgagacccccttccccagagagtccccgtccttctccatccccacccccccgctgctgagcgtgccaggtgcccgccggaacgaaggagccgcaggccggcctaccagcccgggccaaagcccaccaggtggccctgtccatatcccctccatcctccctctgcccccttctccctctctctccctttctctgtcctgctctcctcccactatcaccagagcttcctgctcccacgggatcccggctggagattccaaaaggaggctcctggcccgggcaccgtgcccgcccagcctatatagtgctgccagaggcttatataggacctcagcaagccctccactttggaatcgttgccccgtctgct

SEQ ID NO: 103270 - DNA, 1782 bp, Homo sapiens
tacagaggacatggtgcggcttcgagagcctgactggaagtgcgtgtacacgtacatccaggaattctaccgctgtctggtccagaaggggctggtaaaaaccaaaaagtcctaacccctgctcggggccccacggtgagaaacgccgcctctaccacctgccccgtttcaccagaatctgctcagcaaggccagagagggtccagggaggcgggtgggggaagtaaggggggcatttagtcaagccagaggagccagacatagccctgtcttctggcagttcagggcccagcaggtgagaccattctaaatgggcagtgatgacccaggtgggcagcactgtgatgggggaagcccaggggagatgcctgacccaggctgcaggtctgggccccccatctgaaaaaagtgcaaactaagctgggatctgaacaagttcaggctaaaggagggagagggagttccaggcagaggaatcagcctaggcttagcagggcaagagagctggagagcacagcacatcaggaagggaagaaacttgagtctggatatgagggaggagggggccacagttagaagtttgaccttctggccgagcacggtggctcatgcctgtaatcccagcactttgggaggccaaggtgggcagatcacgaggtcatgagttcgagaccagcctgaccaacatggtgaaaccccatctctactaaaaatacaaaaattagccaggcgtgtggcgcacacctgtaatcctagcgactcaggaggctgaggtaggagaatcacttgaacccaggaggcgaaggttgcaatgagctgaaatcatgccactgcactccagcctgggtgacagagcgagactccatctcaaaaaaaaaaaaaaaaaaaaaaaagtttgaccttcctcctgaggacaacaggagttataaagggtttccaaacagagaagggatggatatagcattctaggaccttcctcggatgaggcttggatgagagatgggatggactagatgactggaatagcttaagagctagagagacaggcttcccaatagatctggtttggagagggagagggaaggtcaagaagtctgccaggctcctgtgtgggcactggggagttggtggtgccatactccaaagtggggagctcaggagcaggaccagttcaacaggaagatgtttctggctggggactctggatcctaagccagctgtggcatttcctctctggtcacctcacctcagtaccaaagtaaagaattcagatcctaaactaactaccccattacagacaaggagctcagagagagacgtgggctaagactgtcctgggggtgggagggagagggaagatggttaggtcagagctggggccagaaactgagactccaaactccccacttagtggctgttttccttgccccatcactgtgttcccgcccattttgtagagaggattgaaaatagaggcccagaaggagcaaggggattggctgaaggaatgtgagtcagtgacaggtaggggcacactcagatgcccctcagggcctggagccattgtggggggcagtccacatgtgcacacacacactcagagaaggagcacagatgagtggcggatgggcttggtgctatctccagatcatatatggacttaggagctgctgcccagcaagccagcttggagggagaggggcccagcccagccctgatccagttggaaagtgtgactcagccgtgctgttgctcaagttgcctggtgtttggcctgtcact

SEQ ID NO: 103271 - DNA, 1743 bp, Homo sapiens
ccctaccacagttctgagtttgtccataagggcacgagatgggaggtggtcttgggttctcaggtgtcttgagaataaggagcaattgttgccattatgccttccctgccataggaaactcattcagcaacattgaatgcttgctatgtcccaggtatggcagataggagggatcaaggcagaagaggtcttgctctgggggttgagggacaggggaaaaggagccagagagcagactccagcttcagagctctgggagctgtcagttgcttaataggcacaacccactcactccagagtggggaaaaggctttgccaacacccagaactgggggcctgggtcccatgcggcctagcctgcacttactaagccatggggcttgaaacaaatggctcctctgctctgtgactcagtttccttatctgtgaagggcagctagcattctgaaggatggccagaagggtggtccccccgagcatggcatagatggtccattggtattggctgggatcctcatctgcctcctctgctctacccaaggcaggtgataagggttagagaacccctctgctgcccacacgttccctggcctccatctccagcagcagggttatccccaccccctgtcaaagaataggggtccctgggcctctcaacaggaagtaccagatcaggcagctagcagacaatcatcggtggaccacagggccactagagtgagacctatccatagataaagattggccagtgatgaagcccatctgggtgcaaaggccgagctgagaggcttctaccaactggagtgtgccagtgagggtgagcagaaggtggtctccagggagaacatgggcagggtttggagccagcacctccccagggttggaggaagcagacccaggacctgcctgactgggatggggctctcttctgccatctccgcctccacctgcctagctctgctcccccgccccgagagatgcctccaggcttgggtagatgaagccaggggcttcctgccttcctggaaggcttttccctgtctggagtttatgaaagaccagcaggcaatgcggcaataaaaaagaccttggggtagaggggcgccacgagaggcgggtctggcgctgacatccaaccccgtgccccctccctgcaggatgctggtggactgtgtgcccctggtggaggtggacgacatgatgatcatgggcaagaagcctgaccccaagtgtgtcttcacctatgtgcagtcgctctacaaccacctgcgacgccacgaactgcgcctgcgcggcaagaatgtctagcctgcccgcccgcatggccagccagtggcaagctgccgcccccactctccgggcaccgtctcctgcctgtgcgtccgcccaccgctgccctgtctgttgcgacaccctcccccccacatacacacgcagcgttttgataaattattggttttcaacgatcctgactcctctctgcgtctcctgggggtggggagggggtttgaaccgaaggcagctccgcaaggtctccaactccagcagggatcctcagaggttcttcttccgacctcccaccccacccgcccgcagcaacgaaggagtcgagcctcagttaaggcaggagggaatttagtggagctggggaaggaagaaagtggggttgggagaacctccccaaccccatccctgctggcccggggacgggcatcggctctcagcaagagaagtattcccggg

SEQ ID NO: 103272 - DNA, 1123 bp, Homo sapiens
ttgcccaacagaggctgcagcttggcttctcttttccagctttgaaactctgagagtcccacagaagggagagtgactggtctgaggaccctcatggcgtttgtgtcagggctggggtgagaaccaggtctctgccctcttcctaccaggggggcatagctggtgcatgatgcctaggaccctgctgagttggtgccctctcccctcccctccctgcaggggtcttccagggacctgatctctgttgccgggaacatgaccgctgcccacagaacatctcacccttgcagtacaactatggcatccgaaactaccgattccacaccatctcccactgtgactgtgacaccaggttggtggcaggcagcgagggcccagagctcagggacagggcagagttacccagttcctgggtaactagacattgggattgcagaggatcttaaagctcagccagcttggaccccacagtgcaggtaggaaagctgaggccagaaagaagggatgcttggaccccaaaccacccagctggtagtggcacagtgggctgtgggaggagccagacagccctccatgccccagggtcctgggtatctgttctggggcaggtttcagcaatgcctacagaatcagcacgactccatctcggacatcgtgggcgtggccttcttcaacgtgctggagatcccctgctttgtgctggaggagcaggaggcgtgtgtggcgtggtactggtggggcgggtacgtggccaccccctcatgtccctttccagacagagagggagcccaggctccaagcctggtgagggagagctatctgtctgtctgtcttccagggaatgatgtcccatcctgcatgtcctctcctgagggcccgggatgcagaccctccttgggtgtcccccacaacccagcgggatgggggatgggactggcagagcattgatctccatggagacgaccctgggggcttctggaagggggattcccagtcaccaatttccaccaactgccaccacccaggtgtaggatgtacggcacagtgcccctcgctcgcctgcagcccaggaccttctacaatgcctcctggagctcccgggccacctccccaactcccagct

SEQ ID NO: 103273 - DNA, 1110 bp, Homo sapiens
agctatgattaacgcagaaagaagggacaaaaagctcacaaacactatacaatttcacaagatgcattgcagggggaaaagtgactgagatggatcagcaatatcccagggtcttggtggatgcattcctggtggaaagggtctcattcctggagggggcatgcctactggcgtccctctagcaaggggaagcccaattggtgggcccatgggtggtttcataccaggtggaggaaacataatgcctagaggtggggctgctctgccaacaggtgggggtggagcccccggtcctggtgggtactgtgttggggctccagtaatgctcttctctgtggagtcattacctgctgggatggtcccccaactcctgggacggggcctgctaatccaccaggagcctggggaattggtacaccagctgatactcctctaccagctgccctaacaactccagggcctcctgcagctccagcaagtggtacccgagcaatgccagtatattttgggggtagcccctccacagtcatggataccaagttctccccatgcagcaacaccagaccccaaaagtgcttttcttcgagctctggttgcttcacgttctttggcttgatctttctgaactcatcacaatcgcagaggatcaaattcacatgcttgtcaaacgccttaaagatgccaaagaagattgtgccttcctgtaggatgcatttcattctatagtcaatgtgctgctgcagccttgctactcgtgcccacagtcgtgattgctgcttcaccaaatcccgtgtccacagttaaaacttcgtgcttcttaagacctgggggaaagctatagataaaggtatggtgcaggttctcccagaaacaatgcaagctgagggggaaacgtggtggctcacgcctgtaatcccaacactttgggaggctgaggagggcaaatcacctgaagtcaggagttcgagagcagcctggccaacatggtgaaatcccatctctactaaaaatacaaaaattagctgggtggtagtggcatgcacctgtaatcccagatactcaggaggctgagacaggagaatcgcttgagctagggaggcggaggttgag

SEQ ID NO: 103274 - DNA, 1096 bp, Homo sapiens
cttctagggtttatactaataatatagtcaagcagtcttgaaggtagaaaacagggctgttgggttccagggatagggagagacttttcagcctatatccttttgttgtacctattgaattttgagccatgtaaacgtgttacttattaaaaaaataaattcataaaattaaaattgttaaaatttctgagatgattattattctaaggaccattcacacctcagttgtgaatgtacttaattcagattggtttcctttttgttctctactgagatctgaaggtattggacctttcacatcttttattttgtaatttgagatgggagctctctgtgttgaccaggctggtctcgaactcctggcctcaaccaatcctcccatcttggcctcccaaagtgctaggattacagatgtgagccaccatgcttggcctattttctcctgagtattaacagagtactcactatggaaaaggtggcaagtacatgtaagtattttttaaagcttaagaaatttgtccataagtccactgtccggagactactacagttaatatttttgacctctttttttggtatctttttaacctgctgataacaaataaattcaattttttttttttttgagacagaatctcgctctgtcgcccaggctggagtgcagtgggctcgctgcagcctctccctcccaggttcaagcaattctcctgtgtcagactcccagctgctccaaatcctgggctcaagcaatcttcctgcctcagcctcccaaagtgctaggaatgcaggtatgacccaccgcacctggccacatatatattcaactttgtatacaattttacatcctgcttttttctttttcttttttttttttttttagacagagtcttgctctgtcacccaggctggagtgtagtggtgcgatctcagctcactgtaagctccgcctcccaggttcacaccattctcctgcctcagcctcccgagttgctgggactacaggtgcccgccaccatgcccggctaattttttgtatttttagtagagacggggtttcaccgtgttagccaggatggtctcgatctcctgacctcgt

SEQ ID NO: 103275 - DNA, 1040 bp, Homo sapiens
gaaggttaggcagatctgggttaggtaccctatagggtatgtgagccaggcaggccagggctgaagggcactgagagtcaaaggcttttcttcttcccttagtcccagcccttgctgccttaccatgaattatgcacttgttccttgtactgtgtctacatcctccccagcattccctgtcttcaggtactatgtacacacttctgtcagttcccagtacactgggttgccttgttggttcacttgtctgtgtctccctttagactgaaaaaaaagttttatttctgtatcttgaatgcctggcaaataataggatctttaatgaatctttgaagattcattcctatctactaagtagataggaagattagagggaaccagagaaaaggaccagtgcagccccaatgaaaagaagccagtcctttcagccttctctgttcttctgatcctgtatttgagggccaaatctccatgggctagcctaggaacctaaacaccacttagactttaaaatttcaaagctggtttatgtgtttccaagttccaataaacttattcagagttcttcccattccagccttctatgagtgtgatgtagacattcttggaatgcaggtcccatttctgcctacgtgtggtccagcagcagtctaatgagcagcgtagacaggctcaggcatgccagggttcctggcagaaagcttctgtgtgaataagcatgtgctcacagaaatgagacctctgctgggatcatgcctgttatttatcacccaaattcatagtcttcatatctaagattaacatttctaggtgtctcactacaccctggtctagaaattcttggagttaaagggacagaaaaggcagatgatgaattcctacagttctctagaacttgataattgaatttaagaatgctacagagaaatttcctcatgagatcaagttccctggtggttcctgcagggatattcaactctcgtgttctctttcttgctcaattcctgtgaggtgggccagaccaagtagaccaaaggcca

SEQ ID NO: 103276 - DNA, 1062 bp, Homo sapiens
cggcagtactgtccagcctcagctcggcatcagagggagaccgtgcaaaggggagacgaggaccgtgcaaaggggagagggagggggagggggagggagagcaatttttaattttttaagatttttttttttttttaaaaagaaacacacataggttgggtacttaggattgattgttgagctggaataatgaggaaagatagtaatgtggccctcaaaagtgggttttatcctaagatgaagagagcacatgtaatatgaagaagaggaaggtcagagagaaggtcttggagccgaggccagcgcacgaaactggtgccaccagcatccagctacccttctgggacattatgtaaaatgatgtaactgagtgaaaaagtggtgagctggcctcctctctctgctcaagtcactgagctggtatcgtggtgagggatactcatgaggccagagctctgagtccaccgtgtgaaggcaggaagctttctgggtctgagaaggctgtaacttttttggtccttgtcttctcatactctggaagctgacatcagggtgaccttctggtgttccagtggtaagtcctaaatttgtgaaggggccgcttgttttggaggtaacagtaggttaagatgacctggagaggcacagtctaagagctggagggggccacccaggacaccagggagtccagtgcctcattttacagatgagaaaattatgatcagtagagggaaagggaggttcccagaaccacctagcaagctagaggctgagtccagtatccaggcctccacttctctgactgtggtagccagcgaacatttcctacttggaatttctgaggtgatgagggtggccagataaggctcctgacagattgttaatgtgcatccagaattcctgggtatcccttggtgttggttttatcctctttcttgttcaactcctggctgggttctttgacttggaggtggtggtcaacagtggtctgtttataccagcatttagtggccagtttagtatgtagtggtacggtgcaaacagggtgtccatgagtcccag

SEQ ID NO: 103277 - DNA, 1049 bp, Homo sapiens
gtatcaagattttgatcatgacttccattgttggctaattagagtttcaacatttttgctattaaagataatgtgtagcttgtttgatgttcccttgggcacaggggtggctgtcaatattgctcctataaagcatgtagaaggtgttactagctaatgtgggactatggaaaatatcctcaagccctgtgagtgctgacttatgtcagcagagtgtttcacactgggtcagagccagtcctttttggcccattcatagattcttagctggaagctaaggctaaaagggcagagggcttgccagagttcctctacttcagggtatatatgggaggaaaagctgtcccccaccttcgaaacatgtggcacaaggtagggagaagaggcaggtgccacatgcaagacaacgtgaggtatgttgagttttgacaggcacaggagaaacctgcctgattctcctgcccttaattgcctttcttccacacagggatttcaaggatttggatttggagatggtggcttccagatgtcttttggaattggggcatttccctttgggatatttgccacagcatttaatataaatgatgggcggcctcctccaggtaagaccctatttccttgagaaattaggaagatatcttagtaatattgcttgaaagctccttggaattcagcagtatataagttacagataattgtcactacatggataatcagccttttcaaaatatcttaagctgtttttagatcacttacagacatggtaacaatgctgagcacttaccaactattaggcatgcatatatatagcactttccattccaagctcaggggatcatcacaaccaccctatggaacaggtgtgtgattagctgcgtttaacagatcagaaaatgctcagtaatgttaccaagacataccccatgtctataaaatggaaaactgtaagtgatactcagctgaggaaaagcctagttctgcacatttacttcccactttgaccatttgggggcctggaaatgtgagatgacccataaggagtgaag

SEQ ID NO: 103278 - DNA, 1048 bp, Homo sapiens
acctcaaaaagaaaaaaaaaaaaaaaggccaggcatggtggctcatgcctgtaatcccagcacttttggaggctgaggcaggcggatcacaaggtcaggagttcgagaccagcctgaccaacatggtgaaaccccgtctctactaaaaatacaaaaattagccaggcttggtggcgcacacctgtaatcccagctacttaggaggctgaggcaggagaatcgcttgaacctgggaagcggaggttgcagtgagctgagatcgtgccactgcactctagcctgggcaacagagcgagactacatttcaaaaaaaaaaaaaagaaatctttttgtgtgtaggattctgatgttgtaaagagataaagattgatgctgtcaacttctggcctgagtgggcagtgtgcatagctgcagtgttctaatagcctgttttctcctttctgtctctccagctgtccctgggacaccccagtatgtggacgagcagttcctgtcacgcctcttcctatttgtggccctggtgatcatgttctggctcctgattgcctaatgctgggctcctgcctacatccgtggcagggctctggactggtgacgtgccaccccaactcctggtgtttggcttcctggctaatcttgactcctggaatcagtgggatcagtaacacatcaaggagtcttgtttcttcatcagagctttggaactcgagaccagttggcgatgacccctgaatatcgccaccgctgtaaacactctataacttcaggccttggcattgagtcatctctcatgggtgacaccatgaaatcttgtttcagccagttctgcaggtcctgactctgcagagggaagaggcagaaagagagaaactgtcagagtataatttcacctgagtttaatattacagaaacaaagggatgcaccaaatggtatttctggaaattttcatgtctttaaataccccttggtaagttgcttctgaagccagtgggggctcctcagatagagaggttcccctttcaaatcccagtgccgctctgttctctt

SEQ ID NO: 103279 - DNA, 1051 bp, Homo sapiens
actacaggtgcccgccaccacgcccggctaattttttttgtatttttagtacagacggggtttcaccatgtcagccaggatggtctcaagctcctgacctcatgatccacccgcctcagcctcccaaagtgctaggattacaggggtgagccaccttgcctggcctgtctatgaaattttttctactctgcagtttatctgttaaagaaactaggttatttgtcctgttgcatttcccacagcatcatttttgctatttgcatcatggaaatgttattaagctcctcttctccatgtatttcctgtaagttggttgttagatctagaagcttgaccagattcaagcttattatttttgttttgtaagactacgtcataggtgatagtatatacttggtgcgtcttacctggaggcacttaatgtctggtagtcctactttgtgatgttacagatgccactatatcatttagagttgagaaacaagactgcactctgggcagagtggggcacaaaattacagagaacctggagagctggttgttgtaggaatggcaggtggcgcaaggcaggatgtgctcaggaaaaagcagagtcctggagtgaagggaatagggagacaagtccgcagggtgagatgtagtcagctcatgaggactggtttggcttttattttgtaggcagtggggtgctgttgaagggttttgaacagagagatgacaggtccagaaacatacttttggaagattaacacagtcagttttgggtaggatgattcagggagggcagagactggctcagtttgaagcaagtggaagtgacactgggcaagtctggttgggtaccagtggaccagtaccttcaagagggcagaaccttgagttgtttttcaaggtccaggtttcaggatcctaggctcagagagttgactgtgaggcggctggcaggatctggccctagggactgaccaagctatggccagtgaaacaaactgtggacaggtaacctgggtgctattgaaactcagttggtctactccctgcccaggctttc

SEQ ID NO: 103280 - DNA, 1030 bp, Homo sapiens
gcgtgtgcctgtagtcccagctacttgggaggctgaggcaggagaatcacttgaacctgggaggcagaggttgcagtgagcccagatcacgccactgcactccagcctggtgacagagtaagactccatctcaaaaaaaaaaaaaaaaaaaaaaattccttaatttggcctacagtagagccctccgtaatgtggcctctctccacatctccacaacctcctgctccctgcacttcagcctcacctctcttctggacaggccctccttctgacaagggctttgttcattctgctccctctgcctagaatgcccccttactctgttcacttaactcctgcttatcgtttagatctttacctggatggctcagagaaatatagaagtaattcctcaccctgaaaaataggttaggtccctgttttatgttttcatagacctttcctttgaggctttttttaaaaaagtagttttaatctcacatttattcatgtgatcatctccttaatgatatcttaagacctctaatagaacaatttggtcatggactgtggggtttttgcccctcattgtgtcagcactgagcatattgttggcataggagggatatttgttgaatgaattgctagaggtggccaagagatatgatgtaagtcaggcttttccctgcccttccccttccccttccccacatccttcctatagcagccaccgtggctgcagttactgtaaatggcaagacggaatcagttccggacattgggttgttttagaaaattgcctgcaagtgtcagggtgataagttaaagctttgtcttttgccctcagaggagctatcccatagtgagtagaagccagagaagctgaccccaggagtccttctttccagcagcaggtcttgagctgcacttctctgtagctacaatccaggcaggaacaagccctaggtacctccggagaggagggcaagagaggaagaatgagttcagctactctagccaccaaactgattatgaattgccctgaaatctg

SEQ ID NO: 103281 - DNA, 1062 bp, Homo sapiens
attcagcttcctgggatacttaataacaggaagggtctggaagtagtacctgtataggggatatgagtgttctgattttaatagtcaattcataagtgtacagagggtttgataaatggttaggtcagaaccatcacagaatgtctacacctctttggacattaggaaggtcaaaaacctgaaaggccaaaagctaggcctagattagggtcattcaccaagaaaacatcagccttgaagagttctctgggtggtccaccagtcaaccttcctttgatcacacctccttcctcgttgcttctttaagcattgacctgtaatgggtatggaattttttgctcacctaactccttccttttacagaggaagaagttgaagcccagagagatttaatggcttgcctaagatcacacgcagattttctgttaaccagggtgatttttcaggtgttccctgccagacgagggcttttttccttgaattgcctagagatttcttgagatatccgaagcatttttcccagtgcagcctggagaaggatgtccctgtcaacacagcatttgttactcaatgttagacattcaattttctaattagtatcatggagcaacagtggatgattatctataaggggttgcaattccatgcttatgtgcttacagcccatatagacaaatatcagctgttaaaatgacaaggcagtagagatgtggccccaggacaaaggcatactctgctgttagtgaacactagttggccagcaaatttcacatgggcatatacacggccaactgtagactttaggcatttatacccattcagagagccaaactggcaactaaagatcagcattctctttggcatttcagctttgcgttctgttaaaaatcactgcttgcttaaatacctctgatagctcttcactgcctgtaggcaactctttagcctagcagacttggtctttagtgctctgcccctactctcttccaccattctggcctcctgtctaattgctgcccatatgtgccatgcactagagcttacagacctgctcagcgttat

SEQ ID NO: 103282 - DNA, 1046 bp, Homo sapiens
gtaatgcttacctttcagtatttggaggcttcggagtcctcaaaaattctcttccttgattggagtcctcccagccaatagagggcttcacacaaacagtttcttgggttttgaattgtttgaccagagctttcttccgacaaaaggttggggtgattcattcacttaccacaccttgcctgaacattcacttggggctgccggttatgaaggctattgttctccagcctgtcacagacgctttgaagacctgtgcctcagctggttctaaggagtcagtttgttcagctccgtgccaggtttccaacttatgaaatgtgctggagattaacacctctcctgccattttatccctactataattgccagtcaaaggattcctgcagttgcctctggcagccataactgatgaatgttctgccagctgctctgaggacctagaagagcagttttctatccaggaccagtttccaagggtgggagggtgaaatatatcctccagtgtgacatttcatctcccagtgatgggtggcttgggccctttgaagttggctctgaggaaccacacacttgggtctgagcagccagcagcttatcacatctggtgatcaatccttcaaaggttcctcctgaagtctgaatttttggaggtcaaatggattccacctgggaggggcttctgcttcaactcaggacatggggagaaggctgttcctcttccagggggaggcagttttcatggcattgagatgtcctctcacttattccccacccacccaccaagtcctttgtaagaggagtagggggagaggagagcgcctgcagcctcctgctcacattcctagacaccgactcactgagcccgtcgccgctggaacagcagagctgtgtgaaatgtcaagaggagttatgctcataggctccctggcctcagtctctttgtggcttgcatattcttccattagtactgtgttcatcacatggaaatcagagggtacaattaaaagataatttgctagtcccagacttaatttggggcccccttc

SEQ ID NO: 103283 - DNA, 1091 bp, Homo sapiens
tgacacagatggtaaatggcagagaaggaatatggatccaggtcttgaaagagaaaatctcaactgattatcttttttaaaaaactcatatgttctctgctgactcaaaaggtctctgtgtggatctgggttgacccactgaactgaccatcagggttccatgcactttgtatctgcccaagccctcagaacccctcagtaatgttttggaagatgagttttggaggttgtccttaggcatagcctcagcgtatgtaggcctctaggtgatctcccctaacctgaggatttcagctcaattcactctggctcctcaggacagtgggatgactggttcagacctcagctttaccacctcccagctgggtactcttctacctacagccagggcagattttgactttcacttgaaacttccaaaaattgaaaggtagaaaaacagccttggctttgggaagaacgtatgatgtccatggcctctaagcatctgaggtgggacatgttcgagtagcaccttacagttccaaagtgtgttctgggttctttgtttaaaagaacagagactgctggggaattgaacactgtgaagtatatgaaggaggagaattgtgctatttaacattcagtacttgggctaaaggagaagcatcacgaagtgttaacactcaaagggtcttgagctgtcagggctccagcttccttattttcacaggtgagaatcctgaggctcagctgttgagatgtgctgtctcactccggtgacatagtacagtggatgtggctttgcagccaagcacacatagcttcacattccagctccatcaattatgtattgggcagctttgcagaatgatttgactttaactctgcttttcagtcttctgtaaaacagggataatcctgctaccgtagggttgtcaggattagagataatataaataaggtacctcatataggacctggattatggctggcattcaataaatagtagctgttaattgatagctaagctagaactctgaagtctaccatggcaacttcttaagtggtctgagaacccagttgtgttctgtggcaaaacacagcttagg

SEQ ID NO: 103284 - DNA, 1037 bp, Homo sapiens
aggccaccattagacaagttgagcactggccacactgtgcctgagtcatctgggttggccatgggtggcctgggatggggcagcctgtgggagctttatactgctcttggccacaggtggaggatgcaattagccagacgagccagacacttcagctgttgattgaacatgaccccgtctcccaacgcctggaccagctgcggctggaggcccggctcgctcctcacatgcagaatgccggacacccccacgccctcagcaccctggacaccaaggagaatctggaggggacactgaggagacgttccctaaggtgccacctcccaccctggctctgttctgtcctatgtctgtctctcggatgaagctgagctggctttcagaagcctgcagagttaggaaaggaaccagctggccagggacagactatgaggattgtgctgacccagctgcccctgtggggatcacagtttacagccagagcctgtgcggacccagctgtctgccaggtttccttagaaacctgagagtcagtctctgtccactgaactcctaagctggacaggaggcagtgatgctaaaccctgaagggcaacatggcctatggagaaagcatggagctcagagcctggagtaggggcacagataggattgaataaattgtgtagaaagactttgaaaacaataaagcaaaagatgaatgaacgttttttttagacttgagggaccaacaacccccaaaccccagattctgccaggtccatggggaaggagaagttgccttgagtggaagccccaagtagggagacttacagaaaagaagtcaagagcactggctcccaggcagaaatactgataccctactggggcttcaggctgagctcctcccttcacaaatcacttcatctctctgagcctgtttctgcatctgtgacataagatggtaagataaaggtggctgtctcaccaattatgtaaggattaaatgtggaaaaggacataaagttgtatagtgctgccatagggacagtgttcag

SEQ ID NO: 103285 - DNA, 1018 bp, Homo sapiens
agatcccgccgttgcactccagcctgggcgacagagtgagactccatcaaaaaaaaaaaaaaaaaaaaaaaaattagccgggcgtggtggcgtgcacctatactcccagctacttgggaggctgaggcaggagaatcgcttgaacctggaaggcggaggtcgcagtgagccgagatcgtgccattgcacttcagcctgggcgacagagcgagactctgtctcaaaaataataataataacaataactagccgggcctggtggcacatgcctgtagtcccagttactcaggaggcggaggcatgagactcaggtgaactagggagacagaggttgcagtgagccaagatcacaccactgcactccagcctggttgacagagcgagactctgtctcaaaaaaaaaaaatcccatttgctcattttttggatactagtataactatcactctaaaccagttagtacttaaatcaagcagatatgggagatggtgaattaccatctacagtgttgtcatatatgtcacatactgagcattatcagctagtagaatctagttaattgttctatgtgtgatgtatgcagagttcccattttgaatgtgtttttactatgcttaaataaatgactgatgtcagcaaccccaaaatgatacatctgatgtaagagcccctgttccccaataataacatctaaactatagacattggaatgaacaggtgcccctaagtttcctccctccagggtttcttggccggtctctgaggactacacatccctactcccgtctttcctcatcttcaggcgcagtaacagtatctccaagtcccctggccccagctccccaaaggagcccctgctgttcagccgtgacatcagccgctcagaatcccttcgttgttccagcagctattcacagcagatcttccggccctgtgacctaatccatggggaggtcctggggaagggcttctttgggcaggctatcaaggtgagcgcaggcaacaattgctttgctct

SEQ ID NO: 103286 - DNA, 1049 bp, Homo sapiens
aaatgccaagtgtgtctgtttttttgttttgttttgttttgttttttagatggagtctcattctgtttcccaggctggagtgcagtggtgcaatcttggcttactgcagcctctacctcccgggttctagtgattcttctgcttcagcctcccaagtagctaggactacaggcgtgtgccaccacgcccagctaatttttttttttttttttttgtatttttagtagagacggggttttgccatgttggccaggctggtcttgaactcctgacctcaggtgattcacccgccttggcctcccaaagttctgggattacaggtggaagccaccgtgcctggcctgagtgtgtctatttgatagagctttctgctctgattctcccttgctatacaccttttctccccttctcagtggcttctcttgcctatgcttcctccccagggccaggtttgagaacatccccatgaagtcctgacctgtcttttatcctaccaggacaagactgtggtggtggcagactttgggctgtcacggctcatagtggaagagaggaaaagggcccccatggagaaggccaccaccaagaaacgcaccttgcgcaagaacgaccgcaagaagcgctacacggtggtgggaaacccctactggatggcccctgagatgctgaacggtgagtcctgaagccctggaggggacacccgcagagggaggacagatgctgcccttgcatcagagccctgggaattccaggggaggcctgtgaagcgtaggaccggatacccagagctgaggatatttttcccttgccaggtggggcctcacgatttagctcctgagctcagggggctgggaactgatcagtgtcccatcatgggggataaggtgagttctgactgtggcatttgtgcctcagggatcgctaagagctcaggctattgtcccagctttagccttctctctccatggtgagaactgaagtgtggtgccctctggtggataatgctcaaaccaaccagagatgctggttgggattcttgaaatcagggt

SEQ ID NO: 103287 - DNA, 1021 bp, Homo sapiens
tgttccacctgcctctaatttacctcttttccttctagaccagcattctcgaaattggaggactcctttgaggccctctccctgtacctgggggagctgggcatcccgctgcctgcagagctggaggagttggaccacactgtgagcatgcagtacggcctgacccgggactcacctccctagccctggcccagccccctgcaggggggtgttctacagccagcattgcccctctgtgccccattcctgctgtgagcagggccgtccgggcttcctgtggattggcggaatgtttagaagcagaacaagccattcctattacctccccaggaggcaagtgggcgcagcaccagggaaatgtatctccacaggttctggggcctagttactgtctgtaaatccaatacttgcctgaaagctgtgaagaagaaaaaaacccctggcctttgggccaggaggaatctgttactcgaatccacccaggaactccctggcagtggattgtgggaggctcttgcttacactaatcagcgtgacctggacctgctgggcaggatcccagggtgaacctgcctgtgaactctgaagtcactagtccagctgggtgcaggaggacttcaagtgtgtggacgaaagaaagactgatggctcaaagggtgtgaaaaagtcagtgatgctccccctttctactccagatcctgtccttcctggagcaaggttgagggagtaggttttgaagagtcccttaatatgtggtggaacaggccaggagttagagaaagggctggcttctgtttacctgctcactggctctagccagcccagggaccacatcaatgtgagaggaagcctccacctcatgttttcaaacttaatactggagactggctgagaacttacggacaacatcctttctgtctgaaacaaacagtcacaagcaaaggaagaggctgggggactagaaagaggccctgccctctagaaagctcagatcttggcttctgttactcatactcgggtg

SEQ ID NO: 103288 - DNA, 1043 bp, Homo sapiens
caccattctcctgcctcagcctcctgagtagctgggactacaggtgcccgccaccatgcccagctaatttttttaaaattttaatttttagtagagacggggtttcaccgtgttagccaggattgtctcgatctcctgacctcgtgatccgcccgccttggcctcccaaagtgctgggattacaggcgtgagccactgcgcccggcctttttttttttttttttttggtagagatgaggtctcattatgttgtccaggctggtctcaaactcctgggggctcgcatgcaatcctcccacctcagcttcccaaagtattgggattataggcgtgggccaccacatgcggcctgatagctcatttccttttggcagtgaataatatttcattgtttggatgtaccacagtatattcatttatttacctactgaaggacatcttgattgcttccaagttttggcaattatgaataaagctgctgtaaacctgtgtgtggaggttgttgtgtggacttaagttttcaactcgtttgtgaaaatatcaaggactgtgattgctgaatcacatggtaagagtatgtttagttttgtaagaaaatgccaaactgttctccaaaatggctctaccatcaattttgcattcctaccagcaatgaatgaaagttcctgttgctccacatccttgtcagcatttgttgtctggattttggccattctgataaatgcgtagtagtatctaatcgttgtttaaatttgcatttctctgataacatatgatgtgcagcatcttttcatatgcttatatgccatctgtatatcttctttggtgaggtgttgttaaggtctttggtccatttttaaaatgcattgttttattttgtttgtttatttatttagagatggagtctcactctgttgccaggctggagtgcggtggcgtgatctcggctcactgcaacctctgcctcctgggttcaagtgattctcctgcctcagcctcctgagtagctgggaatacaggcgtgcgccaccacgcccagctag

SEQ ID NO: 103289 - DNA, 3238 bp, Homo sapiens
cacagtgggtatctcactccagggcagtgagtgaggctttagggcactgccgagatccagcctccgcctcctcttccccagccctcctcctttcctcctggccagcccccactgtctggagccctgcagggatgccccgggccctgggcagaagaagagccctgcatgatgagtcactatgggcctgtcactgcctgctgccctttaggatggtgtggagctgcggctgaatgctttctcctcttttgacccagtgggccggtgggagccaatgtctggcttctctcacagtaggagtggttggttactgtgagtggccctttctggagagcctctggctatggttgtgagatgcatggcaataatgagctatctgactcctctgacttgggagttggtttgcagaaagctccccaggcccaccttcacttgttgattcaggttgttttgtggtatgtcacgttgtcgttgccttggggatgaggccaggggcttggcagatggtagaaacagcagagatggcatgctccatgctcccatcacagacctcccttcccggcatggctctctggacccaggcaggaagctgctgattggtggaggactccagtgtgggccgggcaaggcagagcagccagggttgtctcttggcccagcttgtctggggcctagggtggggacacccagccgactgagtagtacagagttgctttcaatctctgtgcttgggctgcttggccctgaaaaggttttggcagaaggaaggcggtaaggacagggctatgtttgcagcattaggaaaaggattggcttctgtctgagccattgatggggtctacccaggttgaggacctaatggctctggttctgcctgtcttgctagggtgcagctagtctggtgcaggaggcgaggctactattacactggctcggcatcatcagaataccaattttaccctcagaggcacccaaaagagcgcctaggagttgggggtctttgagttgttctgggcagctgtagcagagttgccctctctgtatcccttccttgaagcaggctgagatgacggtgagcagtacatgtgcagctgcatgaagagtccacagcaagggaggctggcagccctagggccctgccgtttcacccctgtaggcactccaggctcccagactgaccagctgaccctccgtgggttctgccagggcagtggctggccaatggctgccctccacaggtctgtgagctggcccctcatgacccctccaggagggggcatctccagagcctggcctcatcgctctcctatattttgttttttcgtagaaggccagaaatgctcacatcaggatccgattgagagctctgactcctatggtgacctctcagatgccagcgacctgaagacgccagagaagcagagtgccaatggctctttctcctgcgacatggcagtccccaaaaacaaaatggagtctgatggggagaagaagtacccatgccctgaatgtgggagcttcttccgctctaagtcctacttgaacaaacacatccagaaggtgcatgtccgggctctcgggggccccctgggggacctgggccctgcccttggctcacctttctctcctcagcagaacatgtctctcctcgagtcctttgggtttcagattgttcagtcggcatttgcgtcatctttagtagatcctgaggttgaccagcagcccatggggcctgaagggaaatgaggcagctgctgtgtccccacggaaacaaccatctggggactgctgggaaatgctgtgaatgcggagggaagtgatgtttgggttctgtagctgagagatttttattcatttttaactgccccccaaccccactccaactccttctccaccacccattctcccaatggtctttagaaatagattttcatctgatattctgcagaaatatcaatgagacttggtatgggacaggggcagaaaacactacataggcctccaaggcaaaaccagtcccagtttctttaatgggaagaagctggaattcctggtgctcaattcttagtgaccccaatcctatacccaaatctatgatattctgggacctcagtgattttggtcccctcccacttctctagttcgtcatcctcccttcccatatccttcaaaagaaccacactagggtctccacctacttatacaatgcggatgcccaactgtttttaaggaagccagaagcatcccatggaccatggggtgagtgtcctccaagagccccctgagctcagccctctgcctggagggctccagacctttctgagccctgcttggaggcgagcattttcactgctaggacaagctcagctgttgaggacacccccaccccaaatttcagttcttacgtgattttaaccattcaacatgctgttgggttttaattctctaattattattattattgttattattttttaggaccagttgtagtgaattgctactgaaagctatcccaggtgatacagagctctttgtaaaccgcagtcacacattagggttagtattaaactttgtttagatgtaccataattaacttggctagttgattgtttgaagtctatggaagaaatagttttatgcaaaattttaaaaaatgccagtctggtcagggaagtagggggtttcaatgctgttgggaaccaggaaggtgggacagccggcaggtagggacattgtgtacctcagttgtgtcacatgtgagcaagcccaggttgaccttgtgatgtgaattgatctgatcagactgtattaaaaatgttagtacattactctatctgctcccttgagtccagtttttcagctgtgggggtctttgggacccagaggtgggcagtccataccccagcacctggggtgggagtgggatcccaggagaccccttttccacttcattgcaccagttccactgggattgacaggtagatggtcccactgaagacttagaatgccagaattcacccatgtgttcaacaaatatccactgcttgtcttcactgcttgtgtgccaggcatggtttcatgctcttgagatatggtggtgaacaagacaccactgtgaggcttaatgggatagacagacaacttaaatatgagttcagataatgagaaatacaaggagaagaactgggcaaggtgaggggacagtgacagcaggagggtgagtagggtggaccagggaggt

SEQ ID NO: 103290 - DNA, 1033 bp, Homo sapiens
cttttttttttgagacggagtctcgctctgttgcccaggctggagcgcagtggcatgatctcagcttacaggtgcctgctaccacgcccagctaattttttatatttttagtagagacggggtttcactgtgttagccaggatggtctcgatctcctgacctcgtgatctgcccacctcagcctccctaacctcacaaagcctcttatttctttatctgtaaaatgggtataatagtaatctgtagcacaaagggtgttgggcaaattctatagaatagtgcatgcggtgtgctgggccctggtgtgccatcagcacttcctaaaggtgaacctttattacagttccagcagcattcaaaataccatgccaattcagacttttttaaaacaaatctcatgcagacattacacagtactcttcagcctctgaccctttaccctttagcagtggatctcactgttatcctgtgactgtgtaattttgaaagtgaatggaaacacctgatgatgagtcaaccagatctgaagtggattaaagggacactgtcagggtgctggcaccctaagtgggccttatactaaaaagcttcagttcctgctaaaagcaccttctgatccttgactacagtggggtttgatggcatacctccttcctgtgaaacccaagtcaaaatccttttatcggcctgcctgattctgtatccttggacgcatggctgctgtggaagttggcccaagatgtgttcttcccagcctgagatatctcgtggatcagactgaccgaagcatctgggaggtgggctggaacagtcccaagaaggccggattgtcctcccccaaaataaagacagagatcatccgtgtttcttctcctgtacgcgaacctggtggatgctccaaaatcgaaccaaaacactaccatgaataagagatgactgcactcctctgacacaacttcctatttttgtctttgttcttcaaaaggtctaaacagttactaaatcctgttatgctgaaggtggggaagttaga

SEQ ID NO: 103291 - DNA, 1154 bp, Homo sapiens
tattttagagaccccacaagggattaaaaaactaaggaaaggccgggcacggtggctcacgcctgtaatcccagcactttgggaggccgaggcgggtggatcgcgaagtcaggagatccgagaccatcctggctaacatggtgaaaccccgtctctactaaaaatacaaaaaaaattagccaggtatggtggcgggcgcctgtagtcccagctaccagggaggctgaggcaggagaatggcatgaaccctggaggcggagcttgcagtgagccgagatggtgccactgcactccagcctgagcgagagtgagactctgtctcaaaaaaaaaaaaaaaggaaaaaattaccttctaaagtggtatcatcatattatcagaaagttctaatatcttgtactgattggtgggagccaatgtctcctggttctgctttgttttaggggactctacagtaccaccccaaggggcagggctaacagcctctttcccattagccttgtctcctcactcctgactacagcctccctcttagggatgtctacatgggaccctcttacaccaatctatacccatgatcagcctcaggcagaccactgcggtcatagcacaggacaacttgctctaccaggcagggcaggacaccagcacctggtctagacagatctttgaagtagctgtattgggaaaggaaggaaaattggcccaatcccacatttcccttcagaaccactaactgctgctgtcagaggagaacttgttaaataaagttcccacaggccagccctgtttttccagcagcttccattctaacataccattatggtcgaaaaatacatgagtgtaaatggtaataatgaaacctattgtaaaagtccactggatatttctagggctcagggctaagacacaggaaccaattaacccatttatgctggaggttacaaacttttttgtgaaaaatcagactttaatgatgatcttgagcagtaggatacaaataattcctaaaaggttagcgtcccaataatggaacatgaggcataagtgggttaaagcatctgcccagtagctaagggccaagttctggtggcacatgatcctggggttggagtccaggctctgccactcagtagctgtacgtgtgaccaggtta

SEQ ID NO: 103292 - DNA, 1051 bp, Homo sapiens
agagcccaaactcaggtagattgtggccttgagagaggaaagtggaaggtgctctgagcagggcagcatgcttgaggacaaggtgggcctaagtagtgtctaactctgtggcagtggtgttgtgttgggtgaagtcaagcctgtccccaaggttctgccgggtctagttggctgttggaagtgctagatgtttgtgttttgcaagcacagcatcagtggaggcttgcactgtgtctgtgctaaaggaggttggagcagctatctgtgaacgtgaggatgcttctgcatggtgtgctttgctttggccagtggggagcactgggatgtccttatctcctggggcattcttgcttgtcccaatgcttccgaaagcctgcttagtgggtgcagcactgaaccaggagtcaagagacccagggtttagtcccagcctctcactaggtggcctcgagttctcccattccctctctaagcttgagtttcttcatctctcaaatggggttaagaatagccccctttcccacctcacagggctgttatgaggatcccaggagacaaggtaggtgaaaggagccgcacacttgggagactctatccttgcactttgtaacaatgttgggaaagacatgcttgttgacactctgggttggaccaggcacaacactcctgcaggccttggcggaatcgttgggtgcctgtgctgtgttcatgtgccgaggtccacggtggaaggagattgctgagtagctgggtgttcttggtgtcctggaactgggtccctccttgcagcttcatacctggggtttgtaccaccaggacacctgctgtgaaagcagggaagtagtagtgaaggtctcttaagctgtctgttctgttttctgacatgtcattagagcccattgctgacaggagcttcctccaggttgcaagcggtgggcttgcgcatgcagggagagttatcaggctgtggctgactgtcttgactggggcttccccagccctagaaataatgtcgtttcttgtcttgcttcatcctaacctggcttcctga

SEQ ID NO: 103293 - DNA, 1532 bp, Homo sapiens
ggatttttttttttttttttttttttgagaggaagtcttgacttgttgcccaggctggagtgcagtgacacgatcttggctcactgcaacctctacctcccaggttcaagtgattctcctgcctcagcctcccaagtagctgggattacgggagtctgccaccacacccggctaattttttatatttttaatagagatggggtttcaccatgttggccaggctggtcttgaactcctgacctcaggtgatccacccatctcggcctcccaaagcgctgggattacaagcatgagccaccgcacccggcccacagacacttttgaagcctctggcccttgctgtctgctaattctcatgtcgtcagaattgccactatcatttaatgggctgctttttcaattcaaactcgtgaaaatattacgaataattatctctgcactttgtcctgcctttcctttccatttccctggccaagactaatgtcacttttgaataaaatgaacaaatataattctttgtataaaactaggggaaacccagggatacagaacaggaaggctggtttatatgccaataactcatctgtaaattcatgtaaatgtaattctgtgcattatagctaatgcacctaaagtcaattcttaatgtctaaggatgagcaaatgtgtaactcttcattgtgtagaggggtatagagcttagcttgccatgtcctgggtacatttccagtagtcatttagttagtaccagtgattcccactcaagtgtcccgtaaggaggtaccatgggaaataagagcagcctcttggcattctgggtagggagcctgagccaaactctaaagctgtctttataaagggaggtcatgtgatggccagaaattgcctttgcttcatggtgcacttggtggggagtcaggtgtggggtgctgggtttcacatcatcccattttcttttctgccttcagacctgcaatgcttcttttgccacccgagaccgtctgcgctcccacctggcctgtcatgaagacaaggtgccctgccaggtgtgtgggaagtacttgcgggcagcatacatggcagaccacctgaagaagcacagcgaggggcccagcaacttctgcagtatctgtaaccgaggtaatctgcccactgtttcctcacttccagaggatgggcctgagcgtgtatgggaggcctaggggtgtctcaatcaccctgcctcagactccactctttgcacagccaccccctacttcccactgaatgataaacaccttcatcacccaactagctatttgctacctcttccttcccaagaagcttggggtgcttagaatgggaagtcccaggagaccagcaggtcaaaacagaaggagagaggttcttcccaagcttgggcccataactctcacctgctactcagatggcaggatggatgcattttgcagacaccactgaaccactgaggttggtgggggagttagtaggtcccaaagtgagagaaaaagaggttggtccggcttgagagc

SEQ ID NO: 103294 - DNA, 1866 bp, Homo sapiens
caggtgtgcctggacttggttaaacagcaggggcacctgttggcatagtgtggggatgctgaaaacataagaggtgaagagacggctctctgggagttcattccttgagttccccactggctaggcacagtccgtatcgctcatcccctcctgatgccagagagaatgaaagaggccagttacagagactagtgccatagcttaagtagaaaggccatctgaatgtaggggcaggaagcctcaggcttgacagtggcatgtctctttgggacttggcctgagtgtccttaactggcccagatgccccaggtactgctggatttatgagcttagtgggctgggacatttcccccacatggagttcaacctgaagctgagaggctggagcagctcagacctccctagcttccacgggctccacttcttgggggctggttagagaaggaatgcgttgagatgggcatatgctcgagaagaagggggccaaagagcccagggagctgaaccttcatgcattgcccttagagttttccagggctgtgggagaaagctgcttgagactacccctgaggctgcctgagttcaagggctactaagggtgggggtgtgcactagtgcccttggtaccacttgggccccattcccaagctgctcaatccttaggaagaaaagctttaggaagtctgggaagggagcaggactggggctcagtgttgagtggtgatgacctgcactcagggtgcctgggccaggacctggcaggcatggcccttaattacagcaggctgtctaactaagcacagggctgtgggccgggcagctcttccgagtgccacaggcagtcaaagcattctgcctctggctcactctcttcccatcagcgtccctctgtcttctccctgtctctaggacaaagaatgctcttctcctgacaccccagcatggaagttctggatgttccctttgagatctgtctccctccgccccttctctcctgggttgtgtgaccaggctctttcatgttctgtgttgtctgaacttctgctgtgcctagactttggactttcacaggctccccagaaaacctggggactgcagcagcagagggtcaatcctggcacagagaagccaacaatcacttcagcttggctttgaacacagggaaagcgtttgtcatgtttgtgttttttcccccagcagcagatttacattcctaattctgtttgctcaggcgaaagttagctttcattccttgagagataatcaatggaggacagggtgggggaagccagcccagtctgggattttaattttgcttagctaatccccaaatggataagccacttgtgggtaactgaagtttggctatccatcatctttaggtagcaaagcatgacaggcaaagcctttagaggacagatcccaaaagaaggttggcaagagaaacaaggcatctctttcctatccctcttgtggctccctctcccagagactgtggaagacaaaatcctgaatatgctttcagcccccgagtagctgggactacaggcgcccaccaccatgcccagctaatttttttgtatttttagtagagacggggtttcaccatattggccaggctggtctcaaacttctgacattgtgatccacccgcctcggcctcccaaagtgttgggattacaggtgtgagccactgcgcctggcctcagccctgttttcttacacctgatccatgttggttcctttgagttctgaggcttagaacacaccctctctcaccattggaggggtggtctttgggtcgctgcctggcaaagctagctcttgtccccaaataaatcaacaggtgtacctctctttcccggg

SEQ ID NO: 103295 - DNA, 1032 bp, Homo sapiens
ctgcactctctgccctttttccaggtgtgggttgggagcagcagcggcctgccgcccctggaacctcttcctagcgacctgccatcatgggactttgcccagcctgctttgtggaggtcgtcccattcggttcctgacaccgccttttccctttctctaaaaaaatcattcccagcccttgaaaacctgggcccagcacactccagcaacactctcttctgcccagccccgccgggatatctgaggcagggctggaccaccccagagggcagcagggcctttacccagtggcctgttggctagcctgggcctccctggagagggttgacagtggaagggaacaggaggggcatttggcctgagacccctgcttttgggagaggctagcagggtggttcctgcccagcatgcccagctcctccctgggtgactcggagtctttcccatgtcagagcccccaaatgggggtagcaaggagcacctttctggaaccccctatagcatccaagtttctttctgggctctcttgccttttcccccctttcacagatggcacccctgggcatctgtccttgcctaggtgattttggaggttggtgccttcctgggaactagccaccagcttatctgcttcccttcccctggcatcacttcccataggcctggggtttctagactggggcctggccacccctttccccactccacgagtgagtcggcctccagagaagactggcacaattccaactagagtcaacccatgctgccctctgcccttcccactcagatctagatcctgctttcatttctggctagtgaagtagacttttgtgtttttgaggtttattagcaggtctgctcaggaaccaaactaatgagtagctttatattgggccaccccaatatatggctttgggggctgaaaaagcagatgtagaccccctccctcggatccttattggtgtgccctttagcactccgcagactctgcggggtgaacaggagtgatgataaaatttttcattctaacat

SEQ ID NO: 103296 - DNA, 1062 bp, Homo sapiens
gcacacttctgagcggcctcacaagtgtcaggtaggggctgggtcagggcagagatgggctgaaggagatgatgctgttctcacggtcgcagccttgagccagccgctgcgtgtgccgggggcccggctgaccgcccaccgctttgcacacctcccctctgttcctccaccctccctctgctctcctcctttgttcttcccccaggcccccttcccccacagctgacgttcctccttcctggttgcttggtcctggttcccaccctgtctttgccttcactctgttgcttggctttcctctcctggtgtttgccggctccttggatggtgggccgtatcacacagatgttgtgttgggagacccggcactgcgctgggcctgactgttggtttccagcagtttgtagggactgcaggtttttttaaaagggctcctggtggtccagccaaccactcttccccttttctgacctcagttagagctcctcctgggtcccctcagcttagggcacaaggcagtgggggaggtaggaggtagggagtgggtggtcccctctcccacactggcatctgtttaacccatcctaagccagggtttctggaggactggagagcaaagtgggctcttcttcttttagctctttgcaaagtagcaggtaggaaacgctggaccagatagattctcacccttggtttacctgcttgaacaatatctgggggccctgctggtacccaaaagattgagtttcctctcctggccactgagccttcctgtgtggatagcgaacacacctctgtcttctccttggttatctcccctctcccatgccaagttcccatcaagtgagggcgagccatgattgtggggtgtgcactgcagtctctgataggataacctgcttctccttatcctgttggtggcaaggggagagggttcagggagaccagcagggagggatgaatgtgccgtaagtagggcagagcccctgggggtcaggcgtggacggtgttcacaggtgctgggctaggcagtctccctggaggatgacccagggtgggcct

SEQ ID NO: 103297 - DNA, 1091 bp, Homo sapiens
gtgtatcatcttaaccggcacaagctgtcccactctggggagaagccctactcctgccctgtgtgtgggttgcggttcaagagaaaagaccgcatgtcctaccatgtgcggtcccatgatgggtccgtgggcaagccttacatctgccagagctgtgggaaaggcttctccaggtgaggaaaggccccctcttcctcccctgccacacgttatcttagtcctgaaaaggctcctgccaagatctgggggtgtgggatttgtgggggtcatttgaccttatagaaccatgccaggtttgggtagagtgtttttaagggcccttattttgagatggtatgcctgagacctgctttccattccctcagggaagtttttttgacgctaagtgtgccctactgtctctcctcctggggccggattcctcaggccagagccaccggacctcaccattcttcccccagggctccctttgtgtttccggcaccaggcgtggggccccctctgggggcgggagactgggctcctccagcgacttccccgcttgaatggctgccgagggaggtactggaacaagtgcatctgggactccctacactcttgaggcaccagattccccaacacagaacactggccatcctgatcagtagactccagctgtgcctctcacaccaccctgggatcatgggacacagagctggtcacccagagctgctgcttaacaccaaaagctttgatctgctctgacctggtagctctagagcctaatgggacccacgagcccctttatgttttcaggacagaaaggaatggggacaggatctctatgtaggttcactttctagttagcctgttggggaactgaggacttgtctgggagcagagggtgattttgtttttctcctaaaaggccggttttaacctggattgtaggaccttgtgtgtgtgaacacagggatggagaactccctcagagggccccgaccaggaaccagtcttaccggtcaggcagcccctgcccacctgctcaggcgggcatctggcttaccagcccagctggggacttaaggctccactgctggcctctggggact

SEQ ID NO: 103298 - DNA, 1745 bp, Homo sapiens
cgggggctcaggctgctctagcattggcggatctggggaatggggagggggggcaggaagcggggggagcggactgcggggggggggtgtataaatagggaaggggggacgtgcatcctcgtcttggtgaggggggggcgctcggcacaaagaaagtgtaaagtttgcagcgccaggcggcccgggctaggcatccgggcgcgcacgtgcaaggccggggacgccggggcccccactctgagctcgccgtttcttttttttctgcaagcgagagggggggtgttgttggtatcgccccctccttctcctccccccaggggtgaaagtgcaagaggaagtgcagccgctgccatctttcctccgctccgaacacacggagcccggggccgcacagccgccgctccgccgccgccttctcccggcctgaggaagggcctactctgccgccgccgccgcccgcccgctccagccgccgccgccgccgccaccgccctccaggctccgggacccggcccgcgccaccgcccccgtgcgcgccccgccgccgccgccttcgccttcgccttttgtttcctccgctccggcgcccccgccccggctcgcgctttgcaggggacgcagcgcgcgcccccagcgggcccgggaaaagccgcggcgcgcgcgcgcgcctgcgcggcggacccctccttctcctccccgcgtgcgcgtgcccttcttggctgcgcgccggcgccgcctggcgggcgggaggggaggtggcaggcgcgtttgcaggaggggcgcacctcttcgctcgcgcacccccccggaaggtagaccgggaaggggaggcgggcgggcggagaggagagagtggcgcgcagtccagcgagggcgggggttggctatgtggggggtggtgcaccccgcagtctagacagtctgatccgggctgggggcgtgtacactcggcgcacctgcgagactacagagcctcgggccggcacgtgtggggagtgtggacacgtctgctgcgccccgcttctcgctgctgaggggaagggagggggcgggcaggtgcagcggccgggctagtgggagggggcggcggccatggagcgggtgaacgacgcttcgtgcggcccgtctggctgctacacataccaggtgagcagacacagcacggagatgctgcacaacctgaaccagcagcgcaaaaacggcgggcgcttctgcgacgtgctcttgcgggtaggcgacgagagcttcccagcgcaccgcgccgtgctggccgcctgcagcgagtactttgagtcggtgttcagcgcccagttgggcgacggcggagctgcggacgggggtccggctgatgtagggggcgcgacggcagcaccaggcggcggggccgggggcagccgggagctggagatgcacactatcagctccaaggtatttggggacattctggacttcgcctacacttcccgcatcgtggtgcgcttggagagctttcccgaactcatgacggccgccaagttcctgctgatgaggtcggttatcgagatctgccaggaagtcatcaaacagtccaacgtacagatcctggtaccccctgcccgcgccgatataatgctctttcgcccccctgggacctcggacttgggcttccctttggacatgaccaacggggcagccttggcagccaacagcaatggcatcgccggcagcatgcagccagaggaggaggcagctcgggcggctggtgc

SEQ ID NO: 103299 - DNA, 1052 bp, Homo sapiens
cacaaaggaatgctgtaggtgatggaaatattccatgtcttgattggtttggtggttacacaggtatatacatttgttattgaactgtgtgctttaacatggatacaattaaaaaaaaattgtacctcaataaatttggttaaaaatttgctaaccaagggtgggcgcagtggctcatgcctgtaatcctagcactttgggaggctgaggtgggcggattgcctgagctcaggagttcgagaccagcccaggcaacatggtgaggaaacctcgtctctactaaaatacaattagccaggcatggtggcatgtgcctgtagtcccagctactggggtggctgagggaggagaatcgcttgaacccgggaggcagaggttgcagtaagccaagattgtgccactgcactccagcctgggcaacagaaaatgtgtcaactcttgggcaaataggtgctgatttcatggcatacaaagcaaattgacttctggtataaatcttctgtagctataagaacttcacgtatgcatgtatgtattacagaaaaatcctttgacacttaaatgtagggggaaaaaacacctctacttgagtatttgggttagttaaggctttattgaactttcttgcgtatgtttttttcttactcttcagtggcccgaacctgtaacttgatcttgattgttctggatgtcctgaaacctttgggacataagaagataattgaaaatgagctggaaggctttggcattcgcttgaacagcaaaccccccaacattggctttaagaagaaggacaagggaggcattaatctcacagccactgtaagtggggaatatgacatggggcaggctgctgcaggaattggaatggggagtggattggggtgcatggaccctgacattggaaaatttcctggcttttccctgcactaattgagataacacaatgactttataatgactgacaagaaaaacttcaagattaggataggagccagtctcagacttacctttgctacttatttcctcttttggattatctattgggaatg

SEQ ID NO: 103300 - DNA, 1045 bp, Homo sapiens
gcctcactgtgtacccatctctgcccatcaccgctggaattttgatgacctattggaaaagatctgggactatctgaaactagtgagaatgtaagtctttgtggatagggtaatgttgctataggaattaaccagactgtcctaaaatgatactttctggagctcattaacaaaatctggctctttttgaaaatataagtaaattggttcctattatctactaggtcattaggtcatattgaggacactttttcccttaagttggaggttgtcctggtctgatgtcaggggtgatggagggttgctatacattcaacacatgagatagtctaagaaggcagtaatctttatgccctctctattctagttacaccaaacccaaaggccagttaccagattacacatccccagtggtgcttccttactccaggaccacagtggaggatttctgcatgaagattcacaaaaatcttatcaaagaatttaaatagtaagtatcatgggcctgtggtccctcctttttcctatgagttaccaattttactaactagtaattcttaggatagcattttaaaaaagaaggcaggaaggaggctactgaaatgtttgcttggctagaactctgcagtgtcttcttaaaaccgtgcctaattagaataggaagagctctagaaacctctttaggtcaggaagcctgatgacacaaacaaccctgaccttccctcattatttcatcttcctcttggcaaacacaaatattaataattcctgccaatgtcacactggcctctactgggtactgagcccccttctaaaccttaaacatgggcaaaacctccctaatctcttacatttttcactgctgacacaggctgaaaaaaaattattttatttttgcgacggtcttgctgttgccttggctggagggagtggtgagatcatagctcactggagcctcaatcttctgggctcaagcagtcctcatgcctcagcctcctgagtagctgggactacaggtgcacaccattatacccggctaattttt

SEQ ID NO: 103301 - DNA, 1093 bp, Homo sapiens
ttcattcacacacttagcatatgcaattttaatcaaccaaaagaaaatcccaaatgtacaagtgaaaaaaatccaaactgttgacacaggcctaactaatatcagctacttttatgtacagctgtatagttcaaaaaagctatcctatatgtatatacaaaagttgtttatacacaggtctgtacataagggtctatacatttatttcctcagaacccttaggtgccacctcttggtgaggacaccaacacttcattcacatatcttacaaaaaagaaagaccatttccaggattgacaacattgtgcatcctgtattcagacaatgtacactccactcgactggttaagatccttccatcataatgcggaccacaccagatgcatgggttccaccaaacagcttcacacagagtgctccaaagtaaaagcccataaaccaacccgagatgaagcagggtcctgcccagtgtgccaccacaggtccgggcttagttgagtctgcctgccctgctcactgtcggtattccaattcatctacactgataactttggcgggcatggagggcaggggttgctgtagcacatctgagccaaaccatttggcaaggcccacaggggagctgctcctctggctggggcgatgctccagctgggagtgcatgtggggcaggcctgaccggctgggcacgttctgaggggttgtctgaacgctgacagctgctgcatgggaaccagagcctggaggatgcagaactgtggagataagaagggttatcattcacagcatgagaaggaaagtttattagaccctgcttcattcaaaccctatccaaagaaaagtctttactagaggattttttctagggcttctttagaaactcctttgcaaaataccaacaatgccagaaaacagtaccatggaaagctgagctattcagaagctaccagtattgaaaacccaccctggatgacatgaccgctacttctcatggctaagtaaccacatcacagaagcagcaacatgaactggtgagggggtatataccctgggcaggccggatgctgaacctctgttggattctcagccctct

SEQ ID NO: 103302 - DNA, 1017 bp, Homo sapiens
cctccctagcgcacctcactggtgtagtctgcagtaaactatacaccagctctggataaccctacaactcccaagttcctgtacctattctgtctacctgaactgttgttctctagcttcttcttgatcgcacccaatggaatgcagcttcttccccaggaagcatccctgcagtgccttgttatttcttctaacccctccattttcccattgtactttgttggtgcctaatatctacatgccttggtttgctctaggtgattgtctcccccgctagactgagagctcttacaagactgggactgtgtttcattttccttttgtcttccctcagagcttagcatgtgcttttgtgtatgttaggcctaaatgcttgggaaattgaattggataagggaaaggggatgttaaaacttctaggctggtcttgagtattatatggttttaagacttgaagttaagcagattggggttcatgctgataattggtttgttcacaggcaacagcgagtgaccaagtcaccagcacccgtgcatcgagggaattcctcttcccctgcccctgctgcctccatcacaagcatggtcagtgacctttagtaactgtgaaggactttaaggcttctccctgtttggttgtgcatggattgtaccactgtgtgccctaaatgtccttgagttccttccacggaaataactgacctagtagtttttcataactgtctattaggtctttcccttttaggacacagtctaagtcttaggattttaatgaagcccctatattggggaaaatatgttccagcagagatgatcatgggccagggcacacgaggtgatatagtatgttcaaagaaatgaaccaggtgtggggagacaggaggacgatagtgagagacaggaggtgaagtggacagaggtgactgggtcagacagtggggagtctattgaaacttgcaggggagttcacaaattcggattcaccacttcaggtctcagtgatataaactaaggctg

SEQ ID NO: 103303 - DNA, 1867 bp, Homo sapiens
ttgagttttgatagacaatctgctgttaagtcttatggctaattcagaatgtgactgaaagaaaagttccagaaagtgtcttagcaaagtatttacatggaatgtcgtagtgttcctgctatcctaggccactttaggctgctggccactctggctcctgccaaacaaaccttgagaggcattttttgaaatcttctgtccacagtcaaacaatggagagaatgtgtattctcagagcaatggtgtctattttaataccagctggcttagtgataacgggacaaactgctggctaggaaagctcttctctcccagagagaggtcttggctttaaaaggagcaatgctgatggcttagttgagaagcaatttggacagtgctctggttgaggtccacatagcccactgttggggcacagagggagagggacatctgtcagcccaataaatcagtgctttccaagagatggcgttcagcaagaaatgtcatgcattaatgaaaatgcctccctgatgcacacataccatcttggtactcactgagactaactttcccgacaggtttcacaccaggaccacagcagctactcggagatccattccaaggcatgcgcaaacccatgagccccatcacagcccaggtcaggctgagctttctcaaactcaatctcttgcttgcccttcaccctcttggtgcatggggagtggagagctgaactgttgtgattcttaaaaatggttttgaggccaggcatagtggctcatgcccgtaatcccagcactttgggaggtggaggcaggaggatcacttgagcccaaaagtaaatttaaaaaatgagccaggtatagcggcatgcatctgtagtcccagctacacaggaggctgaggcaggagaatcgcttgagcccaagagtttgagactgccgtgagctatgatggtgccactgtactccagcctaggtggcagagtgagaccctgtctctaaaagaaatggttttgatctatatttcaagctcagtgaaggttagacaatttgctgaataattcaagtaatacttaaattgttaatcttgttcactgcgatggcagcacaatctagtcagtttcgcagtatctaatttttttcagcttctgcttaacatacctttctaagagtgaagagaaacctttgtagaaagtgtggtgtccttactcttctcctgaccctcccctctccttttcagcagatgagccagctggagttgcaacaggcagctttagaagggctggccttgccacatgaccttgctgtacaggcagcaaacttctaccagcctggttttggcaaaccacaggtggacagaaccagagatggattcagaaacaggtaaattactaatcctgctcatgtggagatttacggataagttttcctgaaactaataaattacttatctgcagtataattctgttgtacatactgtggtatgttcagtatgtggtagaaattccatcccaatccaaatcaatagaagaaatagatttaatagcggaaatatgattaaattctactgcaaggcatagggctttcattctatatggttttatttccgttcttgatttataaattactttttttccttgagtttgctaattagccatatggaagggatgctgctcgcctaatttacctcacaagattgttatgagtaaatatattttaaaatcttaggatgtttctaccagttaaaccattcatttttacaaatgaaactagcatagctccttattcctttccccacagattcaatgttcttatcaaactcccttgatgcaggtttgctacatcagcagttttttggccagagctgacaggtttgttgatca

SEQ ID NO: 103304 - DNA, 1047 bp, Homo sapiens
aaaaatacaaaaattggcctggtgtggtggcacatgcctgtaatcccaactccttaggaggctgaggcgtgagaatcgcttgaacccggtaggcagaggttgtggtgagccgagatcatgtcactgcactccagcctgggtgatagagtgagactctgtctcaaaaaaaaaaaaaaggaacctctatttatagcactaacttagagcatatgttgctagctgaacattcagataaatgtgttgcatgtacacatgccaagtccttcagttgagcatgagggagatccatcttgtggctctcaaaagttaatccataattcacagcctctgagtagaaggaataactaagttcacagggatttggcttttctgcctttaggaacttctgggtcaaccagttcagagacctgcttcttccaatcttctgagtggccttatggggagcttggagcctacaacatctttactgggccaaagagcaccctctcctcccttgtcacaggtgtttcaaactcgagcagcctcagctgactaccttcgcccaagaataccatcaccaattggtaaatatacttatttgtcaaaagaaatatgaatttatggccaggcacggtagctcatgcctgtaattccagcactctgggaggccgaggtgggcagatcacctgaggtcagaagtttgagaccagcctggccaacgtggtgaaaccccatctctactaaaaatacaaaaatagccagacgtggtggtgcatgcctgtaatcccagctacgcaggaggctgagacaggagaatcgcttgaatctgagaggcggaggttgcagtgagccaagatcacgccactgtactccagcctgggcgacagagcgagactctgtctcaaaaaaataaataaatatacttttgggggatggggtaccaaacgtggaagataccagctgctcttctaggtgaatatgttcatgttatagattttttttttattgaaatctaactttgatctagctctttagtcttattccttattttgggaattcaatccaaaa

SEQ ID NO: 103305 - DNA, 1111 bp, Homo sapiens
cctcacaaatctgccctagtcttccatgttcttgcttaggctataaattctcaacataaaaacttagtgatataatgaccacggtgcaggcagcaatcttggcaatgttgggctatctgggattcttgtcccaggtaacaagtctcccagaagactcatatccttctgcaggatgcacagcaggagcttgtcaagttttaaagaatagcacttcatagttgtggtcccccagtttctagcatctaaacattttaggtttagtttatgccatctcttagtacacaatttgattttaagtgttattagtttatttttggtgtcagtcttttctgacagtctcatctcaattttgaaataaattattttcatcttatctgtcatactagccaaagagaattcctaccagatatctctttgcttgatttaacctggacgttctcaacttctcagcacattcaggggttgtgctttcagtggaggaggtagaagcaggtctgaagggcttgaaggttgaccagcaagtgaagaattcaactcccttcatggcagaacacctagaagagaccttgagtgccgtaaccaacaatcgacaactgaagaaagacggagacatgactgcgttcaacaagctagtgagcacaatgaaggcaagtgggactttgccttctcagcccaaagtcagcgtaagtatctgacacaaaccccccacccttttctcctttttttttcttctttttcccaccacaataaaaggatttttaaaaaggtattctgagtaagttggaaattctttagtagtcatttggtccttgatgcttttgtgtgttccttaattattgatatgctatttgttactggaaaaagcaggcttgtggttaatttatatgtattgtgggtgacagtataaagattaaaagattcagtcttaatggtaatgcctgtataactttaagtcactgctaaaatgaggtataaaactatctttttggatgaactccagagacaattttcttgttattcagctacttaagttcatattctttaccatatttgtatagtaaaatctttattcacatcttctaattattcccagataccagggattacctgc

SEQ ID NO: 103306 - DNA, 1057 bp, Homo sapiens
tgaacttaagtagctgaataacaagaaaattgtctctggagttcatccaaaaagatagttttatacctcattttagcagtgacttaaagttatacaggcattaccattaagactgaatcttttaatctttatactgtcacccacaatacatataaattaaccacaagcctgctttttccagtaacaaatagcatatcaataattaaggaacacacaaaagcatcaaggaccaaatgactactaaagaatttccaacttactcagaatacctttttaaaaatccttttattgtggtgggaaaaagaagaaaaaaaaaggagaaaagggtggggggtttgtgtcagatacttacgctgactttgggctgagaaggcaaagtcccacttgccttcattgtgctcactagcttgttgaacgcagtcatgtctccgtctttcttcagttgtcgattgttggttacggcactcaaggtctcttctaggtgttctgccatgaagggagttgaattcttcacttgctggtcaaccttcaagcccttcagacctgcttctacctcctccactgaaagcacaacccctgaatgtgctgagaagttgagaacgtccaggttaaatcaagcaaagagatatctggtaggaattctctttggctagtatgacagataagatgaaaataatttatttcaaaattgagatgagactgtcagaaaagactgacaccaaaaataaactaataacacttaaaatcaaattgtgtactaagagatggcataaactaaacctaaaatgtttagatgctagaaactgggggaccacaactatgaagtgctattctttaaaacttgacaagctcctgctgtgcatcctgcagaaggatatgagtcttctgggagacttgttacctgggacaagaatcccagatagcccaacattgccaagattgctgcctgcaccgtggtcattatatcactaagtttttatgttgagaatttatagcctaagcaagaacatggaagactagggcagatttgtgaggaaatggtaagttatgctctgga

SEQ ID NO: 103307 - DNA, 1011 bp, Homo sapiens
ccagcctgtgcaacagagcaagaccccatctcaaaaaaaaaaaaaaaaaaaagacccccctccactatagaaaatatgaagttcccacgaagggaaccataatcctccccacatcccattggtattctagctttattaaggcttttttccttttctgcctcccgtagaagggggactgttttattcttgcaagtacagtacctgcacgagaagtctgctttttaagtcatgtgtggctcttctacatgtatactgatggctgaagccacagagggacactggagtgatttacttatcagacggtttttgtcctggttttgctttcaggtatagtagagtgcaatggaggagtggccgaagaggatgaagtggaggtcatccttgcacaggagcctgcggctgatcaggaagtgccaagggatgctgtcttgcctgagcagtccccaggagactttgactttaatgagttctttaaccttgataaggtgccatgcttggcttcggtgagtgtagcagcacacttaaaaaatgtgtggttaaatttgacctgagtatttaagacatcggtttgaaagtgttgttttgctagatgcttttggggtttttggcttttattcttacatatttaaatttttgttggctttgttttgagaggcttaatggataatatgagatttttgtaccagttaactcttttttaagctggtggtgttagactaaaaattctttttttgttgtttttttttttttgagttggaatcttactctgtcacccaggctgaagtgcagtggcacgatcttggctcattgcaacctccgtctcctgggttcaagcgattcttctgcctcagcctcctgagtagttgggatcacaggtgtgtgccaccatgcccagctaatttttgtatttttagtagagatggggtttcactatgttggccagacgggtcttgaactcctgaccttgtgatcctcctgtcttggtctcccaaagtgctgggattacaggcg

SEQ ID NO: 103308 - DNA, 1008 bp, Homo sapiens
gtttctccatgttagtcaggctggtctctcaagctcccaaccttaggtgatcggcctgcctcggcctcccaaagtgctgggattacaggcgtgagccaccacacccgacctgggtttgtcttctagattctttggtagttcatgtgcttggggacttgatattcactttttttataccaggttactttgagaacaggcatgaacacagcctgctcttaaaccagtcagggaggaaggggtgggggtggtgatgggcctcaggtatacagcatcatatcttcctttcactattgaacattacaacgaagaccttgactgaagtagaaatggcttgactagaaattttttaatcttgctttatgtacttttccagagagagtttggagatagtaagcgtgtctttggtgagcgtagaagaaatgattcttacacagaagaagaaccagagtggttctctgctggacccacaagtcagtctgaaaccatcgaactgactggctttgatgataagatactagaagaagatcacaaagggagaaaaagaacaaggcgacggacagcctctgtgaaggaaggtcagttcaaactttgggagggaagttcgctgttttaaaatgagatgtaggctgggcgtggtggctcacacctgtaatcccaacactttgggaggccgaggtgggcggatcacctgaggtcaggagtttgagaccagcctggccaacatggtgaaaccccgtctccacaaaaattcaaaaattagtggggtgtggtggctggtgcctgtagtcccagctactcgggaggctgaggcacaagaattgcttgaacctgggaggcagaggttgcagtgagctatcacaccactgcactccagcctgggtgacagagcaagactgtctcaaaaataaaatagagatgtgattatcactggctaattgtacacttaggaatgggcaccagatgtataggaaatggcaagtttttcatgatgcatcctgattttgaaat

SEQ ID NO: 103309 - DNA, 1043 bp, Homo sapiens
gcagtcatgaagctttattttagaaatgggtttctggctgggcgtagtggctcacatctgtaatcccagcactttgggaagccaaggcaggcagattacttgaggttaggagttagagacctggcctggccaactggtgaaaccccatctctactaaaaatacaaaaattagcaagatgtggtggtgggcacttgtaatcccagctactggtgaggctgaggcagaagaatcacttgaacctgggaggcagagggtgcagtgagctgagatcacgccactgcgctccatcctgggcgacagagcgagaccctgtctcaaaaaaggagaaatgggtttccataactattagctgaggaggtttagaaatcacactgcctatatggttcatgggcgtaagtgctaacagttgtattttttgacctgtagtgatggtgtctgggaccctgagaagtggcatgcctctctctacccagcttcagggcggagctcaccagtggaaagtctgaagaaagagttggatacagaccggccttccctggtgcgcaggatagtaggtgagcacacagtcactcagaagtggggttagtgattttggggacatgcttttgcctgctggtttcattcttagctctgagaattttatgctttgaggggaaatgtcattatcaggaaactgatttatcggttggatttttcctaatcagcagggtaaagtcatagtctactttgtcacagctatataagaagactgttaggctgtgtgcttctgaattaaaagtaccgattatctttcactggcatggataactgagttagatgtggtgggtagcataaagctgtgctggaaatctcattatgctttctttcatatgtgagaccagtcctccggtataaattagttctggcaattcttttttttttgttctgtttttttttgagacggagtcttgctctgttgcctagtctgcaacctctgcctcctgggttcaagcaattctctgccttagccacccaagtagctgggattacaggtgcctgccac

SEQ ID NO: 103310 - DNA, 1047 bp, Homo sapiens
cagcctcccaaagttctgggagtacagatgtgagccactggacctggctgactcctatctttactggtgatttataggttgtatgttctttgacagttttttttcagaattttgaacagcctttaggtatgtctttgtatttggaactgtgtttatctcagtcttacaaatttttattcgtatttctatccagttataagacaggtaattgataaataaatcctaaataaatgcaaatgcctgattgatatcctggtcttaaaactgaagtatcatatagtcctaaggcggcatcttgtcctgaagaaaacatttagatgcttcagttttctgtaaacactagagaattcatggtatgctatacccagtgattcttgtgggctgattgagcaaatctgtccctccatcctcaccccaagatgttgaatcagtgatctgagaagcagtgcacattctcctactacaaggcctgggatgggagtgttgccaaagtcatggcatagtggtatgtgcttttttgcaaggcagttgcagcattttactggtgctgaaagtttcggaattgctttttaactttattataaaaaatatttcaaagtataccaaaaggaggcagtagtttgttgtatatatgggtagatatgtgtgttagtgtgcatgtgtgtatatatatgtgtgtatatgtaagtgtgtatatttcctaactctactgaaagggccttcaagcaaatgaggatacccagttcccagaccttggtgttttatgcaattcctcacttaaagaaactaggatttctcagaaatagctgattccagggctgggacaggatgaatacaaaataagctagaacgtatgacagtctttaggaaaaaaaaaaaaaaaagatggcatgttgaaaaagacacatgggccagtttgaagaggcacccactggcaaaatctgggacagtttgagcgccacataattgaggacattaatgagttatagaccaacagaaaaaccaggagtcagccgggcacggtggctcacgcctgtaatcccagca

SEQ ID NO: 103311 - DNA, 1050 bp, Homo sapiens
tcttccaggtgcagagcattgtagaccaaggagccatggataggagaagtatgggtgaaacagaaagtggagatgctttccttgacctgaagaagcctcctgcctccaaatgcccccatcgctatacaaaagtaaggtttgccactaatgaaatagtgtttctttttaggtggcgaagttagtaacattgtataactatttcattcctattaagtggtaatctcattctgactcactacatggactaaatattaactaaatttagtagtgcattactttgaacatttttctgcaagtgtagatacccagcgtttaagctggaatttgctttgagaggcttttaggtgaagggaatgtaggcttagatttttttaaaattgcggatcagtatactttgtaagttctgtaacagctatgtaattggtacgtttattgatttacatactgtactgtgaggattaaagccctaggatgcgttacaaagttagtgtcctctgtattgatgtttccttaagaggcagactccccataggaatgctcttgagtgtgcttttcatgggtaactggcttttcaatcctgtttttttattttctattacaaattggatatggactcaaaaaagtaaggcttcagtcatatttcccctagctaaaaactggagatgcttaaactgcttgtccagataactgcttttgggagagagaggaagtcatatttattaaagatcttgcatcagtacatgtcttgttggctactgaatgtttttgaagaggttgacaggactcaaattgtaaattcatttctgggtccctgaaatgtgtcaggctggatcccataaaacttgctcaacagtgttgaagcagttgggaccactgatgacaagaagggttatatcctagttgggcacacatccatatatttccttagtatggatttttcttttttttttttttttttttgcacccgacagggcgtcactttgtcgccgaggctggaatgcagtggtgcaatcatggctcactgcagcctggacctcccgggctcaagcc

SEQ ID NO: 103312 - DNA, 1051 bp, Homo sapiens
cttggctgtttcttcagaagctgaaactttttaatctctcaaaacagctagtgttaaaaacaagtccccaccccaaaattatgctataaattagaacttggagatagaatcattggtactcagttctctttcctagtatcctaagcatcaacatggtaaaaagtagaaggtgcccaattcaaggtatataacctttaagcagctttaacacaagagaaaccaagattagtagctgccacccatggggatctttcaagactggtggggaagtttcccggagtgggggcaggtagaagactggttaggctgggaacccgcgaagtctgttggaaagtgcctgtcacttgccaatggacggcgccagctgccccttgttatccggcgatcagggactggggacggggcccgagcgcccctcgccaggccagccgcacctgtggccatgtcaggggcgccgatggcaaggaaagggcgagcaccggcttcagctccgaaacttggcttccccgggccgcgaccccaacccgcagcccctcacgcaggcccgggcccagcggcctccttcggaggaagggcggagaccgtactcactgaggggcggccggccgcagggaggagggaggccgaatctcccggcccgggcgcttcaagctggagctagcgcaggcccgcagccgtcctccccggcccggcggctcggtccccgccagccagcccgccggctacccgccggccgccttgcgggcctcgcgcccctgcccaccccctgcgggcgccccggcgcccgcgctcacgcacgcgaccccgggagcaatgcgcccgcgccccttctacacccgggagcaccgggcgcgcggtgccccggacccagccgccaccgccgccgacccttactcggtgcctccgccgctcggcggccctttgcctcggccgccgctcccctccccgctgcccgcaccggtcccagcgccgctccccgcagccttcgctctcgcgcccccaccccgaccggcttgggctgtctctcttcagccgccgtaactgcagcccg

SEQ ID NO: 103313 - DNA, 1003 bp, Homo sapiens
gtgcagagggaatgacagacaccctgtgagctgatctctgtgatatggtgtcataacattacaggaggggtttgaacagagtgctgagagtacacagctactcactctgtttacattggagaaggttcaggcatttgccggccattttaggcaggaagaataatatgaacaaaagaattattatgtacttcctgtacctcatttttgaagtttttaatctcttcactgacaatttatgttgaaaatattttttaaaaataatctgcttgattttagctttataaatctgccccatcctatgccctgtatgatgcaaaattagctatgataccgccttttgattcatactaacatccctctgctgagaccttaaaggcttcctttcctttccagaaaactgctgatgtaagccaaatggaattttaaaatatgtatatgctttttttccttctttcagatgcgtggccagaaagttcttatatttatggattcgaatgacttttggaagagtatttccctctaaagccaggtagtattagctcagaacaacataattgtgttgagttcattctagggttttcttttatattaagcctgtatataaacttcattatggcttgtgctgttacattcctccccagcctccagtaggtagaagcagtccctaatataaccatgtaatacagtggtaacttcatatctgttagttgactgcagctgcattcatggtgagctgtgaatgttatctacaaagtagccagtaaaggttaagttttagtgttcagtggtgtggcctttagctagctactgtggccttcagcttcaaagaaaaagaaagaaaaaaaaataacaagcaagtgaccaaatgaaagaatcaggcagggcgccgtggctcacgcctgtaaacccagcactttgggaggccgaggcgggtgaatcatctgaggttaggagttcgagaccagcctggccaacctggtgaaaccccgtctctacaaaaatt

SEQ ID NO: 103314 - DNA, 1043 bp, Homo sapiens
ctcctgcctcagcctcctgagtagctgggactacaggtgcgtgccaccatgcccaggtaatttttgcatttttagtagagatgcggtttcaccatgttggccaggatctcttgaccttgtgatccacccgccttggcctcccaaagtactgggattacaggtgtgaggcactgcgcccgaccgatgtttacttttttttttttttttttttagtagagacggggtttcaccatgttagccaggatggtctcgatctcctgaccttgtgatccacccgcctcagcctcccaaagtgctgggattacaggtgtgagccaccacgcccggctgtactttttcatgagacggcaagaatatgtgatttgggaagagatgttagctccaacatcatcatatatatatatgattttttttttgccgtagattttactatgagcagcgattactacggaaggtcttcgaagaatggaaagaggagtggtgggttttccagcacgagtggaaactctgtgttcgagctgactgtcactacaggtcaggtttcatgttacactccttcagttttactgatgcacattatcagatgattatttgttggcgtgtttatggtcaaaagaagcaaactttgggtcacttttggtttttcttcaaatcctttttggagttagcaagatcagagttccaaattaaacccaagcatgcatgcacatgctgggcacgtgcacacagacacacacacacacctcccacacctctaattcaggtaaccattatgtattggttatgctaatactttgaatgggattttcccaccgattttcatttctatataatttctcattctgaaagtattctgggttttttgtttgtttgtttgttttgttttgttttgagacagagtctcactctgttgcccaagctggagtgcagtggcacgatcttggctcactgcaacttccgtctcctaggttcaagcgattctactgcctcagtctcccaagtaattgggattacaggcatgtgccatcacgcctggctaattt

SEQ ID NO: 103315 - DNA, 1349 bp, Homo sapiens
aagagaatagagttcattgtgattgtaggaaatgaaattttagctttggtgcagatatggcttttttttttttttaatcagaagcgtccctgttcatttcttctgagtatagaacagacttggtgtgttgggttaggagttgttttgttgttgttgtttgtttgtttgtttgtttcttgagacagagtcttgctctgttgtccaggctggagtgcagtggcatgcgatctcggctcactgcaacctccacctcctgggttcaagtgattctcctgcctcagcctccggagtaggtgggattatagacgtgtgccaccacacccggcacacggtatttttagttgagatggggtttcaccatatcggccaggctggtcttgaactccttgccttggcctcccaaagtgctagggttacaggtgtgagccaccgcgcccggcctgttattttgaagaaatgccatttactttttttggctcctcaggtattacctgtacaacctgatgttccagacgtggaagacctatgtgcgtcagcagcaggagatgaggaacaagtacattagagccgaggttcatggtgagaaaaagaagtccatgtctgaagaagatgcccacatttactttgcagaaggtcataggaaggacaaacacattgtctcagagagagaggaactctaggccaaaggaagatttgtttgattctctttcatatttttcagaaagtgtgatctctgagtgggcacctgtatgattgatccctatggttttctccatatggcatggtttgagcccttaaaactcatttaatcagaatttgtgtgaactggctgttcctggcctgctggttcagtgggctggctgtgactctcctgtggcacctggggctgccatctatcttgctgcgtcaagttgcccagagactctggagcagagctgcagtgctcttttctgatctgctttgctcaagttgtcccttagtgatactgtggccactttaggtctggtcagagtctggtttctcttgtgaattgagcccagaaacacatggagagtctaagggaaaaagacctagagtttcaaaatgataatacaggctgcattagcagcagaatgtcctaaaggtagctcaaactctgcaagtcacaagtacaacctgtcaactcccctaccacttacacctgctgttcctttgactcttctgtctaggaagacttacttaggaatggtgtccattcctcatgcctcatgtcatcacttacctaatcttttaagaaggccctctgaggcatcacttgcaatcatcgttgcattgctactgcctgagagtaatcctcatctttttcccag

SEQ ID NO: 103316 - DNA, 1006 bp, Homo sapiens
gtgagccactgtgcccagactgaaagatatttaatagaataatgaacctccatgtatccattacccagctttgattatcactcatgccatttttgttagatccatctctccacttctttgctgcctgtttattcatatcatttcgtctaaaaattgcagagtatatctatagaaataagcgcttttaaagcaaagggtttttgagcagttcagtacatgggttttcctttaaatgctttgtaaatgtcgttacttgcacagagccttcatgtgttcttgcactctaattaattttctagtgcttcacaacttttccagcaggggtcacttgtaggctggagggatttaggtattcaaaggagagcccttgagcttttatcataacccagagtaatccatctctccccatgccttttgaaaaatctctttggtgaatctagatgcaaagcaaaagatgcgacaggcctggaagtcctggttgatctacgtggttgttcgtaggaccaaacttcagatgcagactacagctctggagtttaggcaacggattatcttacggtgagtctgctcaactgccctacaaagtaccagccatcattttacctcatcagctttatggtgctggaaaacagcataaaacctcaccttaaaacaatggtttgtatttggttttatttttgtgttttgtttttttcgagatagggtcttactctgtcacccaggttggagtgtagtggcccaatctcagcttactgcaacttccacctcccaggttcaagcagtccttccacctcagcctcccaagtagctaggactacaggcatgcgccactatgcccagctaatgtttttttttttttcatttttttgtagaggcgaggttttatcatgtttcccaggctggtcttgagttcgtgggctcaagcgatctgcccacctcagcctcccaaagtgctgggattataggcatgagccaccatgcccccttcccaccttgaaacaatatt

SEQ ID NO: 103317 - DNA, 1362 bp, Homo sapiens
gtgtcctgaatggtaatatattaataattcacttcctgcctgaaagttgggtattgaacaaagtatggataataggagaggctttgcagctgcacttacttgggtttgaatccctcttccaacctgtattattgggtcatttcatctcttcagctcttattttcctcatctgtgaaatagttacaccatacttaaaggtttgtcatcaggaataaataaagtaatatctgtaaagtatttaacagtgtccagaaaatcagtggacataaagaagttatttaagtagaaataaaataggcagagtgcagtagttcaaacctgtaatcccaacactttgggaggctaagatgggaggcttgcttgaggccgggagtttgagaccagcctgggcaacaaagccaagaccctatctctacacacaaaaaatttttttaaataattaaaatcattacttaaaatgtatttagcaagtatttcaaaatgcctaattagtatgcagttttacttgagtctgagtgaattttttttttttttttatgagatggagtctcacactgttccccaggctggagtgcagtggtgtgatcttggctcactgcaaccttctgggttcaagccttccaggttcaagcgattcttctgccttggcctctcgagtagctgggattacaggcgcctgccaccatgcccagctaattttttgtatttttactagaggcagggtttcaccatgttggccagccttgtctcgaactcctgacctcatgattcaccggcctcagcctctccaagtgctgggattccaggcatgagccaccgcgcctggcctgagtgatatttttatataattaattcatttactcaacgtacatttatttatttatttgagacagagtctcactgtttcgtccaggctggagtgccatggcacaatcttggctgactgcaagctctgcttcctgggttcaagtgattctcctgcctcagcctcccaagtaactgggattacaccatacctagctaattttttgtatttttagtagagatggggtttcaccacattggccaggctggtcttgaactcctgacctcagatgatccacccgcctcggcttcccaaagtgctgagattataggcatgagccaccgggcccagcctatttattgagggtttaaaatgttcttggtactgggccaggcacagggactcatgcctgtaatcccagcactttgggaggctgaggctggtgaattacctgaggccaggagtttaagaccagcctggccaacatagtgaaactgtctctactaaaaaaatacaaaagttagcctggtttgatggtgcacgcctataatcccagc

SEQ ID NO: 103318 - DNA, 1052 bp, Homo sapiens
gtgatctcagctcactgcaacctctgcttcctgggttcaagctattctcctgcctcagcctcccgagtagctgggattacaggagcatgccactaccacctggctatttttgtatttttaatagagacagggtttcactgtgttggccaggctagtcttttaactcctgacctcaggtaatccactctcctcggcctcccaaagtgctgtgattacaggtgtaagccaccgtaccaggccataacatatcttttaacaaatcaaactgtgtaggtcaaacagagcatgtctgtggtgtctaaagcaggatctgaccgtaggaaccataagtttccaaccattaatgggcagatctgggactttttctcaattgttttgttttatttttttccccagcagtgaatctagagatggtactatgaaggagaggactagagctgagggtctgaggccccacactaactgctcctctctttcctgagtggctttttactgatggattccatctttgatttgctgtttcacagggtgtggtggagcacgtggaggcagcgactaggacaggtccgtgtgagccgtgccctccatgcctctgctttgaagcacagggccctgagcctccaggtgcaggtgagtccagcagacgtgggatttggcatcctctgtcagtgttgtcaagcctctcacccacagagggcagtgctgggccttccctgcagctcagggcctgagagggggtggggacagaggtaatctggaaggctgggctcttccagagggaggctgctgttaggaataaagtagaggcttgtcctagatgagcctagatcagtggcttccagagtgcttctggtaattgtggagctggagagggatttatgaattagttataaacatgtttagagaaacagcagtatactctgatttcctcgttgctgttttcctacagcaaatcagaaaataattggggcagaaaagaaacttaagactgaaaagaaaacctgtcttccttttctttatagttttgattgtcttagagtgttcttttaggc

SEQ ID NO: 103319 - DNA, 1030 bp, Homo sapiens
atggggtttcataactttggccaggctagtctcaaactcctgacctcaggtgatccgcctgcctcagcctcccaaagtgctgggattgcaggcgtgagccactgtttccggcctcttctgtatattttttatctaaatagggttttcattttgctataagtattgtaattattttgattaatatgttgataacctatggttttgtatcttccttttttccacacagttaatcaacacttccctacatcttaagtatttgtcgtaaatgttattttttaacaactattcatattttataggatggcttaccttaatatacttagccattctcctattaatagatatttggatagtttctgtttgtctccagttatgcaaatgcatgtgattttgatgttgagttttttggatactgtttatatggttttgtttcccaattagattcagaagtaataatacatagaaatgtgaacattagtacactttttaacttaagtttattgagtttataccaaagtaagtcaagcactgtgctagacactgggttaagggtctctggcgttcacccaaacctccctgcagaaatctcttacgctgccaacactgtctcttgggagagtttgaatatgttcattggaggatagtgaccccagaccaacagtccagttgcccagtcctggaatgtgaaggcattaagctgtttagtatgataagctatagactaatgcctgcctccaattacagcattcaaattccaggtctgattcccatccccttcccaggccctagctcatcagaccattatctgactagcattaaaaggagatgaagctggcagccaggatcaggttggctgaaagctcaaaaaagcctatgccagcgtggcaactgaattttatgtcattgactcaatctctaagtcctatccaggagacatttgtttagaagcaaaagtaaaacagtcctttttgaaagtaacagttttcatttctgttcatcagtatctaactagaagcctcagccctttgat

SEQ ID NO: 103320 - DNA, 1050 bp, Homo sapiens
gtgaaaccccatctctattaaaaatgcagaaaaatcagccaggggtggtggcacatgcctgtaattctagcaacttgggaggctgaggcaggagaatcgctggaacctgggaggcataggttgcagtgagccgagatcccgccactgcactccagcctgggcaacagagcgagactccaactcaaagaaaaaaaaaaaaaaacttagtgcgtgtgtgtgtgtgtgtgtgtgtgtgtgtgtgtgtgtggccttgaacccctgctctctgccagtagtggggttcagcttgtcttaaagatgtttccagctcatctaaccttaggggagtagcacttaagttatttctctgttgcagagatggctgagcgattccatcatgtcactgtgctccagatatacttctgtgactggcagcaggcctgggagcggagggagagcttgtacgctcaccatgcccaggtggagaaactggccaggaagatggccctgcggcgcgcctttactcactggaaacactgtatcctttcagatactcaggctgtccattgcctcagccaggacagcatgagctcagcagcatgtgaaacgaaagtcatgagatacatgggaaacaattgccaaacgattcaaaacagccttatctctgttgacagtcttaaaatttttgtttaattgggattgtgtataaaaagagtgcttatatatagtttaaaaataataaaatgaacaactatatatcttatcacccaactttcaaaatagaaccttcctagcacacctatttgctcctccctgactgcgttctttttcttttccctcagaggtaatcccactttcctgattcacattttttggtgttacaatttaagtgcttttctctacccactaggtggtggaaatagccaccactatctttttcttggtgataccatcaccgtgatcatagtttccatttattgcgcttttactacgtagcagacattatgcatcatcctcttcatcctcatagcaacgctgtggagtaggtgccactattaccattttacagac

SEQ ID NO: 103321 - DNA, 1081 bp, Homo sapiens
cccttgccctacagcctgggtgacagagtgagacccagtctcttaaaaaagaaaagaagtgcagtcagatttgtgctttggaaaggataattctggattagcggagagaggctagcactggtgggagaccagttatgggaggaggctcacttaccagtctacgtaagggacgagttggatgaactgcagggtgttgggggtggggacagaagagcagaaggggatggagagagccaagagatttaggaagggaacagatggacttggcgaccgattagatgagagtgggaggagaaaaggtttgaaaataactccaaggtttttagctcaaatatctaactggattgtgatgccaaaacagagactatagaaaaaggagcagattctgctttagatatggtgatttctaaatgtttactgaaattgatagcagtttatctcaggtattttttgcgtctcatctcatgggcattcaaggggaggaatgcaagaccagatgtttgatcagtaactgacagggtttccctttgcccactgcttccctgggtcatcaggagtagacagaggtggacctcagcccacctggcacgtgtgttatccccgatagccacggcccttcaaggtggcttgctgagaatgcactgtgtaggggtcagaaccttgttgggactggaggccttcacttcctggcagacatgctgctgtgtgcagaagaagctgcccagtttgagatggcagaagagcaccacaggcacagccagctggtaagagccctgcatcctggcacgggtccgcttggcagccttgcttgggtatccactcttgggggaccctgacccctatcaccttcattaaatgcagtcagctatgggtgagttttggtcatgaagccctcctttcattgtgggtgtccttcttttcattttggattacaggtgctaatgttgtagggtcagaggggtatggagctgtaaaggaacctcagagattatttagtcctgagctttttttacatggtaaaaccccttttgagtggcggaagcctcacctataaaataggtcaaagtagccatgctgtggt

SEQ ID NO: 103322 - DNA, 1855 bp, Homo sapiens
cccggcctaattttttagtttttttatacagacggagtctccttctgttggccaggctggtcttgaactcctgtgctcaagcagtcctcctgcctcagcatcctaaagtgttgggattacaggtgtgagccactgcacctggccttttaggcattattgatggagctggatccaggtccatcctggcccaactccaacccttcctttcactaaagattccttcttccattttagcagcactgcatttataatcatacaaatgtatgcactgagcccacatggtaaaaaaacaaaaaccaccacagacaaaaagtctgtcttctcctgagaggcaacagttgatgtttaccttggtctgtagaattgtcatgtgggtcatggggttctttcctggtgtgggtgtgtttgttcttgtgcagtatagatggacagcagggagggttcagcaaatatttattaagtgcctgctgtgcaggctggcttgtgttaggctcccagttgaatctcaaagcagagaaacactcagggagatggaacagctacaagaagctgtgaccaagcttctccccgctgatttgaggcactgtttgccttcctctactcttagtttacagactctactgatcccagtccttgtaatcagttgtgtcctttctttgcacagtatttttgctttagagccctaaaagacaatgtgacccacgctcatctccagcaaataagaaggaatcttgctcaccagcagcatggtgtcacggtgagggttgtcttctgtatcaagggacctcttctgaaggccattctctctcgctctttttttcagtcttgccaaattaagcagaactctttttaaaaaaactttttgtgcttcaagatttgtccagactgtcaactgtaaaaccttagtttgcattttctttctttcttttcttttcttttttttttttttttttttgagacagtctttctctattgcccagactgtaatacagtggcacgatctcagctcactgcaacctccgcctcccgggttcaagcaattctcctgcctcagcctcttgagtagctgggattacaggcatgcgccactacaccttcctaatttttgtatttgtagtagagacgaggtttcaccatgttggccaggcttgtctcgaactcctgacttcagatgatccacccgcctcagcctcccaaagtgctgggattacaggcgtgagtcaccatgctcggcctttttagtttgcattttctttggtaatccatacctgctgatagaaaaacttgtttgatcccatttttttatctatttgccaagaaatggatagttgactcaaagttcagggactgtggattttaaacctgacctaggggatatagtgatacaaatactttctttttttctttacttatttagaggcagggtcttgttctgtcacccaggctgtagtgcagtagatcactgcaggttcaagtgatcctcctgcctcagcctcccaagtagttgggactacagctgtaagccaccacacccagctaatttttgtattttttgtagatggggtcctactatgttgcctaggctgatctcaaactcctgggctcaagtgatctgcccaccttcgcctctcaaagtgctgggattacaggtgtgagccaccgcacctggcccaaatatactttttttttttttgagacagggtcttgctctgttgcccaggctggtgtgcagctgcagtggtgcgatctcaactcactgcaacctccacctcccaagttcaagcgattctcatgtctcagcctcccaagtagctgggatcacaggtgtgcaccaccaagcccagctaattttttt

SEQ ID NO: 103323 - DNA, 1090 bp, Homo sapiens
cctgctctcccagggctcatactttagcaccagggtgacaaatgagtgtgaccttacaagcccgttctaccaattgggagtacctgtctggaatgttgaagtgagaaggatttcaaggccatatttacactcagtgggaaagggttcagttgatggcatctgccattgtgagaagtgccccctttttggtcatctctggcagtgaaacagaggaagacacaaaccaaactcctcccagttattttcgtgctgcccaccctacccgtacctccatcttctgttggagtctaacaggtgaatctttagattcacctgttagctagttccctatagtttggggatagaatccaaatttttagcaaggcctacaaactccttcgggagctggtccctgtctgtttctctcccctttcctgttaccactctgttccttcacaactgcactctgaccagttaagctgccagtggttccctaaaggtcctctgtgccctcctgcttctctttgtacctccagttctctatttcacactcccttccagctcagatgtcacctcctcccccaggccagtccacctccacccctaccccagaggcatagctttatcagaacattcatcttatagttgttcactggcttctctttccccacaggctgtgaagtcctttagagtacagcctgtcccttttgcctccttagcccacagtgcttggcatgggatatgtgctaatatttggatgaattaatgcacagaccaacaaatgaactgctgttgatttcttcagagtttttttccaaggatgatctaagtcgatagagcttggatgctacagggcatggcctctttttgcgtcactcttgcctcctacacttaagaaatgctagagtcactgcattctttgacatgcctttggattatgttactggctttgaaaagacattgccacttgttatcttaagttcatgtaatacaagttcaccagaatgcaggaaagcctttcagaaaaagactatgagtgtcagagttgaaaggttgtatttattcaaggtggagagcagagggtctcttttatttccttcctggaaaacga

SEQ ID NO: 103324 - DNA, 1181 bp, Homo sapiens
tgagactgtctcaaaaaaaaaaaaaaaaaaaaaaagaaaaaaagaaaatactggttctgataagaactagttcacttatgatgtgttatgtttctatttaatgcatattggtttgtaattcagtaaaaaactaaacatgtgcccacatggatgtttgtgtgtgtgctggaggaaagttacccattttctaggttccttattcagttcaaatctctggcaccaccccctacatcccacgccctcaccagaacacagtcccaactctcctgggtgaccagcttgcctccttatacctcaccttggaacatatggtccttctgtaatgagtacttgcttgaaaggtttttttggcttcatccactcgggccatggtgttctctttccagcgacgtaatgccccgctgcagatgcatgggtgcgaggaaggcagatgacaccaggatagagagagaagggaggcttctgtgaatcattcctacttcttcccctactcctgagtcagggactctacacctaagaatgtctgtttcaccaacacctatgtttacttgcacatctatgtccaacaaatggctactgagcagctgctctgggctgggcaccaagagtgcatgagggacccagcactgctggagaccaaactccaggtgctacggggataacagggcataaccaggcagtggcaacacaggtgactcacactgtgataagagaagtgtggagagacagggaacctggaggaaggttgcctacgcctcagcttgctgctgagttagctcagggagttcttgcttattccaccctgtctgaagagcgggatgggtgctctatgggactccatatgagggatggaggcatttattttatttatttacttttgagagacagggtctcactccatcgcccaggctggagtgcagtggcataatcacggctcactgtggccttgaccttcaaggttcaagtgaccctcccacctaagcctcccaagtacctgaaccacaggcatacatgaccgtgcctagctaattttttttatatttagtacagacaaggtctcgctatgttgcccaggctggtctgaaactcctggtgtcaaacagcctcctaaagtgctgggattacaggcatgagccaccgcgcccagctaaggatggaggtgtttaaagtccacgagaccc

SEQ ID NO: 103325 - DNA, 1277 bp, Homo sapiens
cgtggactttaaacacctccatccttagctgggcgcggtggctcatgcctgtaatcccagcactttaggaggctgtttgacaccaggagtttcagaccagcctgggcaacatagcgagaccttgtctgtactaaatataaaaaaaattagctaggcacggtcatgtatgcctgtggttcaggtacttgggaggcttaggtgggagggtcacttgaaccttgaaggtcaaggccacagtgagccgtgattatgccactgcactccagcctgggcgatggagtgagaccctgtctctcaaaagtaaataaataaaataaatgcctccatccctcatatggagtcccatagagcacccatcccgctcttcagacagggtggaataagcaagaactccctgagctaactcagcagcaagctgaggcgtaggcaaccttcctccaggttccctgtctctccacacttctcttatcacagtgtgagtcacctgtgttgccactgcctggttatgccctgttatccccgtagcacctggagtttggtctccagcagtgctgggtccctcatgcactcttggtgcccagcccagagcagctgctcagtagccatttgttggacatagatgtgcaagtaaacataggtgttggtgaaacagacattcttaggtgtagagtccctgactcaggagtaggggaagaagtaggaatgattcacagaagcctcccttctctctctatcctggtgtcatctgccttcctcgcacccatgcatctgcagcggggcattacgtcgctggaaagagaacaccatggcccgagtggatgaagccaaaaaaacctttcaagcaagtactcattacagaaggaccatatgttccaaggtgaggtataaggaggcaagctggtcacccaggagagttgggactgtgttctggtgagggcgtgggatgtagggggtggtgccagagatttgaactgaataaggaacctagaaaatgggtaactttcctccagcacacacacaaacatccatgtgggcacatgtttagttttttactgaattacaaaccaatatgcattaaatagaaacataacacatcataagtgaactagttcttatcagaaccagtattttctttttttctttttttttttttttttttttttgagacagtctcactctgtcacccaggctagagtgcagtggtatcatctcagctcactgcaacctccatcccccaggttcaagcgatttctcctgcctcaacctcccgagtagct

SEQ ID NO: 103326 - DNA, 1020 bp, Homo sapiens
gtgacttttatctggcactaggctcactgcagatgtaattggttaggatggtgtcacactcaagtagggtgggcccttcatccgatatgaccagagtccttctaagggacccagacacaggaagggaacgatatgtcaagatggggcaaagactggagcaatgggtctacacgtccaggaaagccatgacaagcaagaaacaagctgggagaggcaaggaaggaccctcccctagagcctgtggagaagcatggccctgccacaccttgatcgctgactgccagcctccagaactgagagggcaattttgtgttgtttgaagactcccagtctgtggtactttgtcatggcaaccacagggaactggcatgtatgaggaggagacagacttatgcgggccacagggatctccacaacagcgctgtcttcacattcctcaacatgacttgcttctggggccccacttacccctgtccagcaccttctgggcctcccagatggcacagtcctcctgctgtcggtaatacatctgcactgacacagcttcccgccactggaccaggacctatgggcaggcaaggagcacagcaagagtcactatacctcctggcttccgggtccaccccaggtctgtgacggtggctcctggagaggcaaggccaagctgttgccatttgcttctcacacacggtccaggaagtaactgccttgcacgcagaccactgagcaataggacagggccccagcccctcacaggaagcccagcatttcagctgctgggactcttctaccaggatttacatatcataccatgccataaagtagtgaagtcattatatacatgggtcttaattctatttttatatatatataaaatatatatatgtaattttttttttgagacatagtctcgctctgtcacctgggctggagtgcagtggcatgatctcggttcactgcaacctctgcctcccaggttctagcgattctcctgcctcagccttctgagtagctgggatt

SEQ ID NO: 103327 - DNA, 1834 bp, Homo sapiens
gaggtgaggcccaggtctccctgcttagagctcccccacagaccaggtgccctccctccacccaaggcagggctaaggcctgagggagaggcagggatggtaggatgcagagccccaattacctttgcctgcagcgagaaggcccagaaccacagggcccgcactgtcgcccgctgctcctgcctcctggctgccagctagggccagaaagaccagatcatttccctatagccccttcaaggaggccgtggtgatcacggggccctgcccagctcgtccctcttggctccctctctagtcgaggctcccacttcctccactaggaagggccagccttgtgcctggcggtgagatgctcaacacacgctccatctgtggcctgaggaatgaccttcatgaaagaaggtggcaaagggctcctgcagggggatgcgtggaggcagcggcctgaggtccggggaatggtgaaaacaggacaacagaacgggaagagggagctggggacgtgtggatgctgctctgtgtgatccctcttggctttttaaaaagcaagatcccagcaaagccttaaaacacatttcatgttaatttttaagatattatgctgatttttctttttgagatggaatctcactctcatccaggctgaagtgcagtggcatgatcacagctcactgcaaccttgacctcccgggctcaagcaatcctcccgcctcagcctcccgagtagttgggaccacaggtgtgcactgcctacacccagctaatttttctgttttgtttttgtagagatggggtctcactatgttgcccaggctggtcttgaacttctgggctcaagtgatcctcctgcctcggcctcccaaaatcctgggattataggcgtgagccatcatgcccggcccactgattatatatatatatatatatatatatatatttttttttttttttttttttagacagagtctcgctctgttgcccgggctggagtgcagtggtgctatctcagctcactgcaagctctgcctcccaggttcacgccattctcctgcctcagcctcccgagtagctgggactacaggcgcccaccaccacgcctggctgattttttttgtatttttagtagagacggggtttcaccgtgttagccaggatggtctcgatctcctgacctcatgatccgcctgcctcggcctcccaaagtgctgggattacaggcgtgagccactgcgcccggcctccactgatgtattttttaatacaacactgtagagagagaaactggccttgaagtaactgttcttatgcagactgcagacggaaggaagctgatgtgcctggaaatgacaggaaggtggtagaggaggtggccctggggagggtgatagtaaaaatactgaactagaggtgtaggctgaaggtcattcactgcccaggcctcacaggccagaggatggagaaggaagtgcagaggggacatctcctgggttcccacctgttgtctccactggcggaagcaggtccggctgagtctctgtgccagcagttgggtgctctgcctgtgcaggagctgggggagagcaagtgcacagagagtggcgtcctgacccagcctagacagcctggggtgggtcctgatctaacccagcctctgcccagctgaatgtcctcccattgctaggagtcctggatggtgccaggggtctcctgcataggcagggagtgccgcctagaggactcactctgtaggtcccccagcactgataagccacgggtcagcatgaaccgggtttttccgctgagccgtcttccctgggagacactggattct

SEQ ID NO: 103328 - DNA, 1958 bp, Homo sapiens
agtgagctgtgatcatgccactgcacttcagcctggatgagagtgagattccatctcaaaaagaaaaatcagcataatatcttaaaaattaacatgaaatgtgttttaaggctttgctgggatcttgctttttaaaaagccaagagggatcacacagagcagcatccacacgtccccagctccctcttcccgttctgttgtcctgttttcaccattccccggacctcaggccgctgcctccacgcatccccctgcaggagccctttgccaccttctttcatgaaggtcattcctcaggccacagatggagcgtgtgttgagcatctcaccgccaggcacaaggctggcccttcctagtggaggaagtgggagcctcgactagagagggagccaagagggacgagctgggcagggccccgtgatcaccacggcctccttgaaggggctatagggaaatgatctggtctttctggccctagctggcagccaggaggcaggagcagcgggcgacagtgcgggccctgtggttctgggccttctcgctgcaggcaaaggtaattggggctctgcatcctaccatccctgcctctccctcaggccttagccctgccttgggtggagggagggcacctggtctgtgggggagctctaagcagggagacctgggcctcacctcctgccctccctggaggtgtgggccacgtggctggcctttgtactggaaaggaggagaaagaaggcgcggctgcagtgggcgctccaggcctaccaggggcagctcctccaggagggtgccacgcggctcctgcgctttgcagccagcatgaaggcctcccggcagcagctgcaggcccagcagcaggtccaggtaggcccagggccccttcctgtggggagcaggcagggtgtggcatgagctgaccagaggctgtgttgtaggcggctcacagtctccatcgtgccgtccgccgctgtgccacgctctggaaacagaaagtgctgggccggggcgggaagcctcagcccctggcagccatcgcacccagcaggaaagtgacgtttgagggtccccttctcaaccgcattgctgctggggctggggatggcacccttgagaccaagaggccacaggcttctcggcctctgggagctctgggccgcctggctgctgaggagccccacgccctggagctgtgagtagcctgtgctcaccttgtcctcgcttccaccctgggcaaaaggttggatggcatagcagggaggaaaacagccctgacgggatgggacgggctggtcacggccttgtcacagctgagctgctgggaaccccctcttctccagccagatcccatccctcccacggcaagagggagagaatggagtgggatttccaaaccctctctcctttgcctgccaaagctcaggaaataggtgtcccctcctctgcaacaccttcctaccctctctcccgtcctgctgacacgatcttttccggagtcatacacgtagttgacaaagggaacaagctcagctcctacccgtgcctgccggcctctcttctgctccatcacagccaagacactggctttttgtcagaagcccctctttcttgtgtgagctggcacctgtccctctgcccacccctactatggtctcctcaaaccctaacctgccctgccccatgctgatgaagctggtggctcccacagcaaccagcactacccgagagccttgggcctcgggggagatgtcaggtgggtgcatggggcctgggtcccggtccctgctgtgctcctcactgtttgactgaccttgatgggatcctgaacgtctcagaggctgctcccctgtgacatggaccctggcgacctgtacaccagcgtcaccagggttgttctgcaggtcaaaagagacaatgtgggtgaagcagtcccctggcgtcaggtaccttttgtcgg

SEQ ID NO: 103329 - DNA, 1411 bp, Homo sapiens
agtgttgctggaaagaaacatggggtctgttcccctgggctgaccaggggctgcaggggggtctgagatctctgtgggatctccaattttatagggagactgaaagtcaggaaaggcgaggccaaggtcagcaagtaagctggggtgggcctgggccatagagctcccagcagttccgacaaaaggtacctgacgccaggggactgcttcacccacattgtctcttttgacctgcagaacaaccctggtgacgctggtgtacaggtcgccagggtccatgtcacaggggagcagcctctgagacgttcaggatcccatcaaggtcagtcaaacagtgaggagcacagcagggaccgggacccaggccccatgcacccacctgacatctcccccgaggcccaaggctctcgggtagtgctggttgctgtgggagccaccagcttcatcagcatggggcagggcaggttagggtttgaggagaccatagtaggggtgggcagagggacaggtgccagctcacacaagaaagaggggcttctgacaaaaagccagtgtcttggctgtgatggagcagaagagaggccggcaggcacgggtaggagctgagcttgttccctttgtcaactacgtgtatgactccggaaaagatcgtgtcagcaggacgggagagagggtaggaaggtgttgcagaggaggggacacctatttcctgagctttggcaggcaaaggagagagggtttggaaatcccactccattctctccctcttgccgtgggagggatgggatctggctggagaagagggggttcccagcagctcagctgtgacaaggccgtgaccagcccgtcccatcccgtcagggctgttttcctccctgctatgccatccaaccttttgcccagggtggaagcgaggacaaggtgagcacaggctactcacagctccagggcgtggggctcctcagcagccaggcggcccagagctcccagaggccgagaagcctgtggcctcttggtctcaagggtgccatccccagccccagcagcaatgcggttgagaaggggaccctcaaacgtcactttcctgctgggtgcgatggctgccaggggctgaggcttcccgccccggcccagcactttctgtttccagagcgtggcacagcggcggacggcacgatggagactgtgagccgcctacaacacagcctctggtcagctcatgccacaccctgcctgctccccacaggaaggggccctgggcctacctggacctgctgctgggcctgcagctgctgccgggaggccttcatgctggctgcaaagcgcaggagccgcgtggcaccctcctggaggagctgcccctggtaggcctggagcgcccactgcagccgcgccttctttctcctccttt

SEQ ID NO: 103330 - DNA, 1811 bp, Homo sapiens
gcggctgcaccagccagggtacgtcctccaccaccaggcctgggcactggggctctcactctggtctgacttctggtgctttctcatgccacagctgtactagtttctggaaaaccttggcacagggaggccactcatccatttgacaagcataggtagccactgcacaccaggtccaagggccacagcagtgaacagccagccaagggccctgccatcctgaagcttatattctagtcagagacaagcaaagaaaaacccctgcctgcaggccagtaaagtggctgcagatcacgtagggtcctgcaggccacagtgagaagtagcctgggatttgagaagagtaggaagtcggggaagggttttggcagggagcaccatgtcaggtttctgtgcaggctgtggtcaccatgaccacgtggtccaggcaagtagtactggtggcctgggctcagcggttgccacagaggggacaggtactctcttggaggcagatgaggcaggatatgctgctctgagggagttgctgaatgaggggaaagaaggaatccaggctgatgtgggctgctggcttgaataacttgggaaacagagttctttgactggaagaaggaactgggggtggggactggtttggggtgaagtgtcaagagtgttttgaaccaggctcttgatgtcaaatttgagagaaagcaaacgttgagtctgaccttcaaggaagaggtcagggccagagattgagaagaatcttcagcacaggccgaaggtaaccccagagccactgcggcctctaggaggagagtacaggggaaggagagaggggaggaggctccaagcagggagcctgggtggggatggccagggggtgtgagagctcagtaatggaagtgacagctgctctaaggccaccaaagcagctggttcctgaaaggggatgaggggacaggaaggaaccagttcctgtggtgagttaggccatgtggggccacttaccctggctggaatggtttgaatgtgggtttgaaagggttttgacccctgtccggtgatggaaggggcaagtccactctcaccaggagaggagggcatggaaaaggctgtagagcagtggcctctcactgaccacttctcactgatgtcaaagctcagcaaggtcatgagcttagagcaggtgggggtggagggttgggtaaggcaaggctaggaacagctgctcaggcagtggaggcgtgaggcggactgtggtgacacggggtgctccctggttgcttgcgggactttcccctacagtaccaggccctgtgtgcaggggcaggctagacactgagctggcacggccagtgcctgggaagcccagctcctgcagctgggagcctggtcttcccccacccctgcagggcaggcagtgacaaggacttggtgtccccctccctggcttcctcctagcttccttgctcagcatctacccttctttcctttgcaggtgtcagcacagcgggctactcctagggataagcccccggtcccctcatccctggccagtgtccctgacccccatctactccttcctggggacttctcagccaccagggctgggcctggactttcaactgcaggtgtgtacctggggcctgtcagggcagaaagcactcaggccactcccggacctgggacttgctatttaccctggtccccgaggggaaaatagtctgaaacaagcttacttctgtcgccataggcagcctggaccttgaggctgaacttgaggagatccagcagcaactactgcactaccagaccaccaagcagaa

SEQ ID NO: 103331 - DNA, 11095 bp, Homo sapiens
gttctcaccagggcacctctcgtggcttcccgctcatctcattcctcagatgctactttgtaacctgaattgaaaatgggtcaggtcctggcaagggaggggccaaactgcagaccggctgacgcggtgctgggcctgggcctggagcacggggctcaagttcccactttgtgcgtttggagccaagtggggcctgaaagccctggcagcagtggctggtcccctccctgtcatggcttactggaccgggcagccctagggccttgccccctactgcctccccaggccagctgaggaagaggatgagcagtgcaggctggctcagccctgggtagcagggacagagcaggtggccaggactggggacagtgggctttagtgcaggggcttttgcactggactgcaagccctgagcaggtgacctgagcaggtgtgtgaccagtgcctgtctgtctgcaatagccctgaccctctattctgcaccctgtgagccaccgagactgaaccaaacccaggaagcggcgccaccaaccagcctcgcagaggcagaggccctggagcagtgacagcacaggagatctgctggctcgggggaaggggaggaaagaggaaaacaaagggagtgatcgagtgagcctcgccccgccctccctgcgccggcccatgatgtgtcagtcagaggcgcggcaaggaccagagctccgcgcggcgaaatggtgagatgctgcccaccgcgccctaaccccacggttccccgccacgacctccggaaggtcagagttcacatccagcggcctcgcagtagaggtggcggcaaggggactggtggtcagcccccgaggctggaggagcctggcctggggggcctgagcaccctgagtcggagagcccgcttcaggtatctttggttccaaccatgaggagggcccagcagggggaggctgccagcgagcctcagacctcatgcctgcgatcttccctaccctggtgctcccaggccccctgctcgcagcccagacccttgcctctgcaccccacctaggagagaggcttccccattccccttcctgcccatgggaggggtgtagctcttcccagttggtccctgctcttctgcagtgagtggggcaggtggcaaagccagaggggagcagtgatttgtctttgcttggcccctgccaccttcctggaccttttaaaaatacaccggggtgcgatgggagagaaagtaggcacccgggagctgcgtggatgcagccagctctgagcctgagcctgagcggggttcgccactggttcgcctgccgtctgctctgctgctatcagctgagatgctgctttgttccttggtttgctcagcaactgggagagaggactcagcttctcttgagagcacagtcccagatggcagccgtagattagctaaatgcagttactttgcagatgaggaaactgagacctggggacgttctgagtggatggcagtgtggtctcctgctggctaccctgggcctcaggagcatttgctaggcctaggcacagacagggtggggtgggccttgtttaggcgcaggaggccagggttgtggtggaaaggcccgtccagcctctgcggctctggtgaagctgagcccctgctgagtgccctgcatttgtgctgggagggtggggagaggccggatcacagagaggctggatgcagaaaggaggggcttgggtctcgtgtgtgtgtgtgtgtgtgtgtgtgtgtgtgtgtgtgtgtgtgtccacctttgctgaaaggaggggcttgggatgggtgtgtgtgtgtgtgtgtgtgtgtgtctgtctgtgcagccccagcagagcagacaggtggcttgagagcttgtggtggggaggttttgttcacaaacctgtggatgggttttcagaacctggcctgttatagaaagaccatgcagatggatggagccgtagctgtgtggtggtggtaggcggagtgtaaatgctccctttgagatcttgtctggccttggccccgtaatttagcagatgaggaaagggggggcctggaaccatgaaaaggatatcccagatcctgcaaaggatggtagcggaagactcagcaaatggttacccagctggctgggtcgtagctcctcagcgctatgtgctgccgtgccagtgcctgtgtggcagagctggcccctggggcccactctcctgggctgcggaggctgagggatgtgaggcaggccctacaccctgctctccccttcctgggcccaggtgcttgggcctggaggcccttgctgggagctgctgcagctgagaggtgccccgcagctgggcctgactctcctcttgcggctgcccccacattcccagtcctccccagctggctggcgggtgggagagcctgggaaatgagtccgctagccagaggcagccaagcccctgaatcagaatggggttgggacgagggggcacagccagtgcttgctgggctccatcacccccatggagaggcagcttgccaagggtgggtagacaggaggaatcctgccctgggtgcaggtggcagcctcctgggtcctgcccagagcctggccactgacctggctgtgcatggacctgtgccctgcaggttgcacttcccccagctggccctgaggcggaggctggggcagctgagctgcatgtccagacccgctctgaaactgcgctcctggcccttgaccgtcctctactacctcctgcccttcggcgccctcagaccgctcagccgggtgggatggaggcccgtaagcagggtaagtgtgcacaggcccctgtggctcggacctcccttccgggcaggcctgaggttggggtgcaggagagactgaggtggtggcgagctgtcagaagcagaggtcaccgctacatcttcagggggtccgggtcggaaggttcattggtgggcaaggccaaggcagcttttgagaaggccactacctgggccgcgggtgactgcgagggcatgtcgtgccctgcccactcccctagcctgcctcatgtctgccatttggggctctggttctggaaggaacccagtctggggattcagaaaatggtgtctgtctctgatttttctgtgttcaagcaaaaaagagcttataggtgattttgaacagaagccaaattaattccgggatgccaaaggggtggttcaggatggatggatcctgtttgggtcccttagggtgaggacacccttaaggaacccagaggcatgccccaggaatgggcaagggaactggcttgtcctctcctggtccctagagggcttgctcttgcccttggcttcccaggcaggttgaccccaaggaggaaaccctgttcctgggcctttgacagtcacatgggtgtcatcagagctcaggggcactgaggcaccctggacattagcccaggctcccacctgtgcctgggaagggcctgggctcacatagcccttctgtgtgactgggcatcagctggaagggataagagcagctctctgggagcttaccttaccttggagaggtgttgaaagttggaatgaaatcagttttacaccttggggagttggtgtcttggttgtgtttagagaagcagcagccaccaattacaggcagcttctacagtggcagcagcacctgaagtttaagaggctgccccttcctgggtacctggccctgccggagagctctgggaccatctagtgggacccagtgcttgtccccaggccatcgtctgtcttaggtgctccaggcttccctgaaggaagagagaacagaggggcctgaggggatgacttctctttgcctcctgggaggaaccccaggtgcagatggctttatggcctggctcagtcacagtagaacgttgaacacaagtcctgccgtggggccaaggtggggctcagcagggctgggcttctcagactggctgcatccaggccctcaagagtgctggctggacctgtgggggctgcagaccctgtgtctgcagctcaggcccaggtgacagtgacatcgcagacctgcatctgaaaatccctgttggtgctcagggtatcctccttcttcctgttaagacagagggacacactttgggctgtagacttgttccatgcacttgggagcctcctcctttggtggtctgggatatgggcagtgaccacgggcaagatgcccaccacctctccacacactgtgatattggggtcaccgtggctagggtcacacactgtggttaggatcagatccgtttccgacccccactttaagaagtaagactgctgggcgtctcccgttctgggactggagcagttgctatttgacttttgcatgaaatgatgaaatccactggagttgtatgtaaatccagcactccgtgtggcaggtgcagtctggttcccagtgagaaacagccacatcacaaaagcagcgtggggcacctgggccctggtgtcctccgtggggtgcagattctcccctgaagtgagagctgggctaatgacactacttgggctctctggagctggggcagtgtggtcaactcagccccttgccctgtggcctgcaggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtggtgaggcctgaccctttcctcctgcaggaaacaggactttttcctgcctccccagcacagcccccctggtctccagcgtatctggaaggggcaggatgacaaggggaggtgggggctgtctcctggggggaggagaccctgctctccctggcagcaagcctctcctgcccttccagattagcccatcggatggaaggatcctcaactttgggcaggtgaagaactgtgaggtggagcaggtaaagggggtcacctactccctggagtcgttcctgggcccgcgtatgtgcacagaggacctgcccttcccaccaggtgggtcactgcacaggcggggctaggcagccctgctgctgtgtggctggaccgggagggaggggaatgctggggaaggaactgaggctggcatgtggggcctccctgagaatccatgtgcagaccacactcgggctccgtgctgggtgctcactgtgttggtggcccccacgtctgctcctactccacagccgcgtcgtgtgactccttcaagaaccagctggtcacccgggaagggaatgagctctatcactgtgtcatctacctggcccctggggactaccactgcttccactcccccaccgactggactgtgtcccaccggcgccacttcccaggtcagcccggggccagcgtggggggagctgcctctgtgggcttcatatagaggctctcagcttcttggtgttgggggaccaggctccagatcagggtcattgaggccaggagttgactgctttatgcaggctggttgtgggcaggggaccgtggggcccagtcagctcagcatttggagtgacatcggggcaacaggccatgagtccctttgggtcttggctgccatggggtggacacaccgggctctggacggggagtagcggcattccctgcctctgcaggctccctgatgtcagtgaaccctggcatggctcgctggatcaaagagctcttctgccataacgagcgggtggtcctgacgggggactggaaacatggcttcttctcactgacagctgtgggggccaccaacgtgggctccattcgcatctactttgaccgggtaagcaggatctaggccctgccaaagcccaagggccagacctcttgggtctacctgccttgtctgctgtgcggcggatgcgttgggactgaattctagggaggccacagctctggtcaggcctggctctgctgagcagctgtcctgagaatggccgctccacctgccagccagctgaggcttccctccctccttgcactgctggctggaagtggctggaagagatggagggaattaacctccttgcctggcacctggcttctgctaggaaccatggtcaaaggtgagagtgaggagggaacagaaagggagtgttgagctcggggtggctcatgttggttacagcatgaggggtcagcactcgcaggtctgctgcccaccctgcccccaggggctgcctttttgggtgtcagtttgtgaccaacggccttggctcccacgggtgctgctctcccagcaccatgcatggagaccactgggccccactgttccctgtcctccctgggcccagttcacagcaggtgtcaaggctgtgtgtgagatctggctagagcaggcccacctggccctgagatgccatccccacctcccttttggagctgggttgggtggtggtggggacaagcaacagagggagtgggactccaaacacatgtgggggtgacactgtgcacttggtggcctgggccccactgacccccagcctatcaccacaggacctgcacacaaacagcccaaggcacagcaagggctcctacaatgacttcagcttcgtgacgcacaccaatagagagggcgtccccatgcgtaagggcgagcacctgggcgagttcaacctgggctccaccatcgtgctcatcttcgaggcccccaaggacttcaatttccagctgaaaacaggacagaaaatccgctttggggaagccctgggctcgctctagagtctctttcctgattatggctgctaagggatcttttccaaacagagtgagggtcttttcaagagggaggcccatgaggccatccaggtaagggcctgcctcagcgtggttgggagtctgaccaggtaggacttgaatgattcggctaccacctgttccagaggtgcagacaagaggtggcgagagcccccatcatgcccctcaacctatcccgttccttctgcctacaaataaaaagtgcaggctggaatgatctcagtcacatttggatctttttaaacactgtatagacggaagagcctgcattcctgaccgaaccttcagttggtctcggttgtcgttttttcttgctgctcctccccccatcacctgagctgttttctgttggccccttttgttttttggccttaacgctcctgctgcacagggtgaggtgcctccttggcacagactgtggatgcctctcccccagcagagccacacagccttcgtgacaactgctttccgttcccacattcacctcatcctgctctttagaaaaagcagtctttgtgcttgtggctgaacgcatcaccctggactctgctagtgtcttctgaggacactgatgacactgattaatgatacagacctttgcaggacctgatgagtgacccttctggagctggccaggtcctctgcagcaggcaagaccaatcaatcactgaacctgcctcatggcaccagagtgaacagggcaggcaggtagtaggcccagctggggaaatgggagagttcctgtccccctccacatatccctacatgaaatatgggaaagttgctgctattgattcagggtctgtcttggaggcagaggacccttggtggatagttggtcagtgcctggaaaacctgtcccagtttatcaggaacgcaggcctggggagcccccagtggcggggacagggccagatttcatgttgaccctggggatgctgtgaatttctcctgcaggagagacatcattgaattttttcaactgtatcagtagcacagtatttttgtatgaaaagtgggagacttctgaacagtaattcatttaattgcaaagcattttgaaataaaaaaaatcaaacttaaaactgtgttctgttcctggaggtggcctgaggcctccccgacagcccagcacctgcgttcctggtgcgaacacgctagcacagggcctgccgcagggcctggatgcgggcaacgcaggcgccaatgggctggcgctgagcctggagctcctctgccagcagctggatctgcatttccacctggggccatggagggacaggcagggctgagagggagcacagcccggggcgtccccagggacacctggggatggcctggggcctcacctgttccagctctttctgcacctgctgctctacttcctggtcctcaggccccggctcctctctgttcagctccagccacctgcgcaggctgctcgcttgccgccgacaggacctgaggggtggagatacccactgcctgccaggctgggtccttggcagagccccatccggctcagggagaggcacctcagctaattctgatgcgggtatcgggtggagagaggtggtctggtagggcccctgacctgaactgcaggcccctgcttgggagccaaacacttgttctttttcctctcccagtctcctccgccctccccagcagacagcaactcaggtgggcctgggcaagaacacactccttgtctctctccccctgtgcagagccaaggatgaggcgccagtctgttgccctggaagctctgaggttgctgcatgttgaatggtccccagaccactgagtgcagctgagtcacgggcctgtctcctctgcatttttttttttttttgagatggagtgttgctgtgttgcccaggctggagtgcaatggcgtgatctcagctcactgcaacctccgcctcccaggttgaagcgattcttctgcctcagccttccaagtagttgggactacatgcgtgcaccaccatgcccggctaatttttgtatttttagtagagatggggtttcaccatattggccaggctggtcttgaactcctaaccccgtgatctgcctggatcacagcctctcaaagtgctgggatgacaggtgtgagtcactgcgcctggcccttctctgcacctttaatatcagtgttataattagtcactggggacagcatggcctcatcgggtttttagagttttgctcaactttatcgtcccccccataggaagcagagcctctgtgcacaggtgagtctgacgacttgggccttcctaagcagcactgagccgggtagagagccatggtggagatggggtctttctggacagcacacactgagggctccccacacccctccatggctagaccgagaccacctacaggaccctggcagctggctcgggggaaatggaactgcctgcccacctctccaggcaacacctgctcctgtagccagggctgcagggcgtttcgcagggctcaccagaggttctgcttggtggtctggtagtgcagtagttgctgctggatctcctcaagttcagcctcaaggtccaggctgcctatggcgacagaagtaagcttgtttcagactattttcccctcggggaccagggtaaatagcaagtcccaggtccgggagtggcctgagtgctttctgccctgacaggccccaggtacacacctgcagttgaaagtccaggcccagccctggtggctgagaagtccccaggaaggagtagatgggggtcagggacactggccagggatgaggggaccgggggcttatccctaggagtagcccgctgtgctgacacctgcaaaggaaagaagggtagatgctgagcaaggaagctaggaggaagccagggagggggacaccaagtccttgtcactgcctgccctgcaggggtgggggaagaccaggctcccagctgcaggagctgggcttcccaggcactggccgtgccagctcagtgtctagcctgcccctgcacacagggcctggtactgtaggggaaagtcccgcaagcaaccagggagcaccccgtgtcaccacagtccgcctcacgcctccactgcctgagcagctgttcctagccttgccttacccaaccctccacccccacctgctctaagctcatgaccttgctgagctttgacatcagtgagaagtggtcagtgagaggccactgctctacagccttttccatgccctcctctcctggtgagagtggacttgccccttccatcaccggacaggggtcaaaaccctttcaaacccacattcaaaccattccagccagggtaagtggccccacatggcctaactcaccacaggaactggttccttcctgtcccctcatcccctttcaggaaccagctgctttggtggccttagagcagctgtcacttccattactgagctctcacaccccctggccatccccacccaggctccctgcttggagcctcctcccctctctccttcccctgtactctcctcctagaggccgcagtggctctggggttaccttcggcctgtgctgaagattcttctcaatctctggccctgacctcttccttgaaggtcagactcaacgtttgctttctctcaaatttgacatcaagagcctggttcaaaacactcttgacacttcaccccaaaccagtccccacccccagttccttcttccagtcaaagaactctgtttcccaagttattcaagccagcagcccacatcagcctggattccttctttcccctcattcagcaactccctcagagcagcatatcctgcctcatctgcctccaagagagtacctgtcccctctgtggcaaccgctgagcccaggccaccagtactacttgcctggaccacgtggtcatggtgaccacagcctgcacagaaacctgacatggtgctccctgccaaaacccttccccgacttcctactcttctcaaatcccaggctacttctcactgtggcctgcaggaccctacgtgatctgcagccactttactggcctgcaggcaggggtttttctttgcttgtctctgactagaatataagcttcaggatggcagggcccttggctggctgttcactgctgtggcccttggacctggtgtgcagtggctacctatgcttgtcaaatggatgagtggcctccctg

SEQ ID NO: 103332 - DNA, 1242 bp, Homo sapiens
cacgccattgcactccagcctgggcaacacagcaacactccatctcaaaaaaaaaaaaaaatgcagaggagacaggcccgtgactcagctgcactcagtggtctggggaccattcaacatgcagcaacctcagagcttccagggcaacagactggcgcctcatccttggctctgcacagggggagagagacaaggagtgtgttcttgcccaggcccacctgagttgctgtctgctggggagggcggaggagactgggagaggaaaaagaacaagtgtttggctcccaagcaggggcctgcagttcaggtcaggggccctaccagaccacctctctccacccgatacccgcatcagaattagctgaggtgcctctccctgagccggatggggctctgccaaggacccagcctggcaggcagtgggtatctccacccctcaggtcctgtcggcggcaagcgagcagcctgcgcaggtggctggagctgaacagagaggagccggggcctgaggaccaggaagtagagcagcaggtgcagaaagagctggaacaggtgaggccccaggccatccccaggtgtccctggggacgccccgggctgtgctccctctcagccctgcctgtccctccatggccccaggtggaaatgcagatccagctgctggcagaggagctccaggctcagcgccagcccattggcgcctgcgttgcccgcatccaggccctgcggcaggccctgtgctagcgtgttcgcaccaggaacgcaggtgctgggctgtcggggaggcctcaggccacctccaggaacagaacacagttttaagtttgattttttttatttcaaaatgctttgcaattaaatgaattactgttcagaagtctcccacttttcatacaaaaatactgtgctactgatacagttgaaaaaattcaatgatgtctctcctgcaggagaaattcacagcatccccagggtcaacatgaaatctggccctgtccccgccactgggggctccccaggcctgcgttcctgataaactgggacaggttttccaggcactgaccaactatccaccaagggtcctctgcctccaagacagaccctgaatcaatagcagcaactttcccatatttcatgtagggatatgtggagggggacaggaactctcccatttccccagctgggcctactacctgcctgccctgttcactctggtgccatgaggcaggttcagtgattgat

SEQ ID NO: 103333 - DNA, 1022 bp, Homo sapiens
cctgaggagccccgcggacaaggttgagcgagtcgtgggctttttttccgtccccacgtgggcacggcccgggctgcgtgagctcacttcctccacatcttatctcctgccgggcgcgggtacgggaagtgaagagcgtacgggaagtgaggcggccgcgggaagtgagggggtgcctgcagtgaggcggctgcaggaagtgagggggtgccggctggcattggcggggcccgggctgagagctccgtctccttggtgctgccggagggcctgggggcaggccgcctggggaagagggcggcgcccgagggccagggagcgggtggccggcttactgcctttgcccagagccggttcccctcagcacccagagttgtctgagaggaggttccctgtctttgggcggctaggatagacccctgcgagtcctgcctgccctcttcccagggcctcctgggctgcctgccactgactctggtccatgtcgcccagggaggaccattttccccgtctcctacttgggaagtttgcctgcttctagctcaggaatgcagggaaggcagggttgtcgccccactagacgcacgccgctgcatggtggccaggcctcagctgagctggggagaaagtcagccccttgcccccaccctcgcccccgggggaagtgcatggcccgcagtcaggccactggacacaggatttggggccctggaagtttctgctgaggcttcaagaggggtggtcctggcgttccaggcgcttcccatcagacagcaggagccagttctcagggtccttggctgaacacacaagctgcaaagctacatatactccggcagagctggctgcgggctgcagactgcaggtgacagtgccatatccctcactgcctgctccgccttgctaaggcttgaaccagaatccactaggagcaggactgtaagtgtatacacgcatacccctacacacacacacccctgcacctacacacaccctcatgcacacaccccctacctacacac

SEQ ID NO: 103334 - DNA, 1034 bp, Homo sapiens
actgcaacctctgcttcctaggttcaagcgattctcccacctcagcctcccgagtagctgggattacaggcgtgcaccaccacacctggctaatttttgtatgtttagtaaagatggggtttcaccatgttggccaggctggtgttgaacttctcacctcaggtgatctgcccaccttgacctcccaaagtgctgggattacagacactaagtcaccacgtctggcctaaagcactttttctgaattccaccccagtctgcccttcctgagtgcctgggcagggcccttggggagctgctggtggggctctgaatgtgccaggggtatccgggacatcttgcaggctagtgggactgccaaaaacgattctcaaagatgagtggggagttgggcagggataggagaatctggtgtgtagagaaatagcctgaaggcactttgtgcttgcctggcctctctgcccagacgttggggaggctgatgcctgcctgtggtttcttgtactagccgttaagaccccagccatcttccttgaggggcttctgccagcccccagggaatgagaattagccaagagccaggaaatgagaattagctgaggacaccttttacccctgttccgcagctaccttctgttccctggcacagggcatccccttagaagtagtgcatgaaattcacacagctgggacctggcagagaatacaggtggcttgactgaggcagggaggcctccatctgcaggtggcctgagagcctgcagagcctcacagtggcactaggtggcactcccacccaagggagtcctaacagagtgggaggcgtggaaataaaggactccatggcctgaaggaaataaatacaaggtaggaaagtaaatttccagacaattttttttccctaatggaaattcacttgtaagtgattgttcaaaatccagaggcatttccccactgaaaatatgtgtggtggaggtctggttggaaggtggggtagtgctaatctcggccaacttgtgggctggtttatgggt

SEQ ID NO: 103335 - DNA, 1052 bp, Homo sapiens
gctgaggctggtggatcacatgagatcaggagtttgagaccagcctggccaacatggtgaaaactcatctctactaaaaatactaaagttagccaggtgtggtggcgggtgcctgtaatcccagctactagggaggctgaggcagaagaatcacttgagcccgggaggcagaggttggagtgagccaagattgcggcactgcactctagcctgggtgacagagcaagtctctgtctcaagaatgaatgaatgaattaataaataaataaatatttcagtccttcccctacaaggacattttcttatctacagtacagttgtcaaaaccaagacatttacattgctacaatattgttattgagtgtttaaattttgccgattaatccagtaattttaattttaagaataatatttaatggttcatttttgcttggttatagcctccatccctgtgagatcactgccctgagccaatccctacagcccttacggaagctgccttttagagcctttcgcacaggtaaggagcaattagagatggtggtgaccctctctctgcctcagtttggtcatctgtaaattgggataaacatagggttgttgttagagttaaatgagttagtatgtggaaagtacctggcatgcagttatcactgaagcgttaggttttctttttctttttttttttttttgagacagtcttgctctgtcgcccaggctggaatgcaatgatgcaatctcggcttactaaacctccacctcctgggtttaagcaattctcattctccaagtagctgggacacagatgtgcaccaccacgcctggctaatttttattgttaatttttgttgtttttttaatatttcaaagactgtgtgcatactggctaatttgtgtatttttagtagagatgaagttttgctatgatgcccaggctggtctcaaactcctggcctcaagtgatctgccgaccttggcctcccaaagtgttggcattacaggcctgagccaccgtgcccggcctcattatgtctttttgattatagccattc

SEQ ID NO: 103336 - DNA, 2038 bp, Homo sapiens
tcttcatatcctcctgggagccactggcatggagcagccgccgatgggaaccgtcagagttctagggacatttccaagtcagtctattagagaagagtgagtggcacgtcctggaatgttggccaactctcctaggtttcttttgcttccccatttgctagtggatggggagatgggttgggggtggggggtctctatgtgccttgcttttgcaggttgacagtctatgccacactggagcagaaaaactgacatgagccagagggaaaagtgtgccacggctatgttctaggcccactgcctcagacatagcattgagacgagtgaaatacacacttggtcatccacggaggcttccaaggccatggccaaatacagttagaagagagccaggcttccgtaccagctctgaatgatgctaaccagattctgtcattctacatccactttgcccagactgtatagacacgacctatgtttcacctcaatacctctcccttcctgggacagggttcttagacactaaatgcttctctctgacttttttgcttaagggagtgggatgagtagtacattttgcccttgtccaggcatgtttaaggagctcctactggacaggttgcagactagcagtgagtcaacagagccctgtttgccagctctgttgccagtatagatgcagtgatgtggcggctatgtttcccagagacaacagtgggcacagctatagtgtcaccaacatggcagagatagtttcaactgtgcctgttacaggtgtggcactcgaaggaccagaagcagcggtttggaacatgggtaactgggagcagaggactggaagaaacagagctgggctccttccctgtcctgacaatgtaggagaggagttgttgtgaggccagccctgcccgtcgttgaaattctggacctaccctctagctaggtcccttcccctgctccaaagttgagaagggggccccactgcaaacttgaaattacttacctgaaggtgatgtatatacctaggctccagctgcgctcagccacacctgtcttaacattcagtttcggcactgagccagctgcagtgttgtcaggggtccccaggcccgtggtccctaaccacgatgggacatggtaatcggctgctggcacaccacctgcccagagctacaggaggtctggttctggggtggagttggtacagtttctgagtatgggaacttccctccccaagtggtgggaagttacagttaactacagcttactcaactatcacttccagaggtttagtgtttttaatatgggaaagaggagaaatctcaggtctaatcagggttctgcccatcagcttttcactgaaactttcaactgtgttttgttttttgtttttttttccatctttcagtttctagctgtgtttgccttctccctccgcgttccctcctctttttttgcttttggtctcctttccagcttcatgtctccatgagttcagctgtacctcatctcctgttaaagcagatcatgtccactttttcttactgaccttactctaagctacagtagctgagggaggtacggtgaagacatgtagcgtttgccttattcggagcctgaggagcccagaaacccatgctgtgaatcccaaaactcagcgctcctcaagagctgtgaaaatcatgatactttgtcacaattttgcctgaaagggtctttggcacgggctccagagccaacctgaggtccattccagatcccactatctgggcgtgagacctcccccgtggctccttccttgcccactgagccaagagcagcagggagcgtacaggacgggagcagcagatccaaggccgcggtgcagccaatgaatgcacggccgtcgctccgtctccaggctggaattccgtctcataatcaatgccatgtacattaagatctgcgaaagaccaacttttaggcagtgatacttttctcccattccctggggtggggggagtatgcagttggtgctttctgtaattcccttgttctg

SEQ ID NO: 103337 - DNA, 1052 bp, Homo sapiens
gctgtgcagagtcgagagctggatgctcttttgatacagaaactaatggaactggagaccttctttgccaaggaagaggagcaggaacaatcatcaggctgttgagaagcgattcagtttgagggtctcaattttagggtttttttgttttgttttgtttttgggttttttttttttttttggacctccttggaaaaggttgcctaattttgccctaccgccaaaccactcaaaaatgcacagtccatgaatttttacctatttcaaggtgcaacctttttagaaactggtgaaggagggtcctctacttttactgctgagtatagaacctcaggaatgctccctttctcctggaaatggacctgaacgacatccagccacctcctcagtctctgccatccacaggaggaagcagcagcctatcttcagtaacactaggattccaaggacacacaggatttgcacgtccatatgaaagttccgctttgtttacggtggtgctagaccaagattattagaaacgtggcctagggagggggacctggcgtcctgtcctgtgtggtctcactggctcatttcagtagttgaggaaagatgagctgttgtgttttcttatcttttgtctgcccaggacctattgatgtgagtgtatgtgagagtgtttgtgtgtgtgtggctttttcccatcgttttctcccctctgtgactgggtcactagtgccagaggagcccgtccaggccccattcgaagtaagttgcactttttaatgttgtggtgtggattattttcatttgttttattttcttttttgttgttgtttttgtactattattgctgcatgtgtggagcctttaaatgtgattttaaaacatttttttaaggagaaaaacaatacatgtcttaagaatacatgataggcatttgacccagttgatcgctgcatggaagagacatttttcctattcatgtgtttcaggcaatcccttccccatctccagcttctagtgtaactcattagagggagcactttttttcatctgggttctcattc

SEQ ID NO: 103338 - DNA, 1045 bp, Homo sapiens
gctacaagcgcctcagatataaaagactcctggacggattttcatccagcacagagcagctgaatccatatttggcagctagtggatgggataagaggcctaacagtaagcccatggcactttattctctcgaatccatcaagatgaccttcatagatttgagcaacaagatgccgtccctgctgtttggttctgaaatcttcccagtatcctttcatgtgaaatcatccagctcagattgcacgactgagtcctcaaggacttttcctgagcactgtgctccggcaaggcttgccttaggagaggccctccagtgcccgtctcaacctcccaagtggaccttttctttcttcttgtcccacggttgccctgggatggcaacattcagggaagacactggcgtccatagtcagacccacactcaggctcctccccagcctccagctcctctccaagactatggaggcactgccatagtccagaccagagcagactgctctgtccttggccttcacacacttctagcactttgttccccaggatgttaccgaatctggacaaaaaaacggagcttctccagccacatgcctaccatgcagaggctcttcatgacccagtttacacagggcctgaaagggttacggtctccagcctccatagcagacaaggtcttctgttctctgccctactcggtgggcagagtcctatccatttggagccagcatggtccttctgtctgctccttcgaaatctcttctcttcattcccctcactgcaagcggcaaccaagtctgggcaccacaagcaggtaaaatctgtcccctgttctttacaaatgtcccatatttgcttcctgtctctggggagatgagaggggaactgcgggaaatgcaaggctatttagagtcctcttgggtctgcattttctatttaccttgcgaaatctctgctgagaaaaatccaatagtaattcttaagcataggacccccaccccctgctcagttttcctgtagaacctacttctgtatttcacaccattctttt

SEQ ID NO: 103339 - DNA, 3030 bp, Homo sapiens
atgaactggttgtaaacaaagtagaaagtgaatgtgttttaaatcaacaagtgtcccttaattctcaagaacatgcaaatttgccaactgactctctactgcatttaaacaaagagatgcctttagcaacaggcagagatgcccatcagagccatcaccctccattagagggtagagcagatgtcattgctgatatacaaaccattcccattcagacaaaaataaaagacatctctccaccaggtaaccaaacctgtggtgcctcttcaaactgtcccaccttaaacatcaaaccagtaagcctagagagaaaaaaggaaatggctgattcaggaacaaaagctctacattccaggctgcgctcaaataagagagaagcagctggctttcctcaagtggtctctgtcatagaatgtcacagcgttcaatctcaggatatctctagctgtcatcgtgtaagaaaaaatgtatcccaggaaaacatgtgttctgcttctgctgctttcaagtccagcaaaatcagcctgcaagttgataactctttgataacaaaatatgaaaatgcatttcagcaccgtgatcactgctgccaaggaacaggacactctgtggaaaaaagcagctgtaaagtgagttacacatcacaggaaagggaacttgatgggaaagaaacgaatggcagccttccaggagataagatcagaaacaaaatggtagcaggcttgttaaatagtggaatttcaaacaaaaccattcacacctccagtagcatcaaactcagtgaggaagggctggaaggaaaggagcaggatgtatccaaagaaactgtattttgtaagtataacatctctgatcatgctatacaagaactaaaccagactgtaaacattccaggtcctgaaaaagtgttggaccagtctcctactgttatgttctccagttttaaaaatgtaaaatcagttgaaacactcgatcagaaggcagatgaagtccttgactgtcagagtaaccaaaacagaccagatgaatgcaaaagtgaaggtcagtcagccaaggagatgctaagtagtgaccagagagagactgtcaccgagcctcacggggaggtaaaccacaaccaaaaggatctgctggtcagctcaggcagtaataactcactaccttgtggtagtccaaagaaatgcaatttgaaaggagcctttgtcaagatgtctggttgtgatgagtccacagaaggtatggtagacatcgtctacacggactgtagtaataagcttgcagaaggtgtgctggacgtgaaggcatctaatctactggattgtggtgcaaggcaagagaaactggcatttcaagaggactccaggagtaccttgtctcggagagaactggatgctgcacatacaggaacaactggtcaggattcagatttcccagttactgctgcttctacagtggactttctcaaaataaaaaaatcatgtgaagaaaacgtatgcagatctttaaaagactgtgaaatggaaaagtgtccagactcttgtgcccatgagatggagtctgttgcagatcatgaaccaaataaaagaatattgggcagagtaaatttgtctttaaatgatagccattatggacagcaagataaaggaacatctctcagagaaacacaagaaatgactgaaggatcaagactagaaccaaactctgagtttggcaaagaaagtacctttggaatttcctcaaaagagtcgatgtcttgccatgatgaaagctctgtttccctaagaagcctgaaatccattgaaataatgccttctcaagaaaattcagaaactaatgttaacagtgaagaaactgacctgaaaaatctttgtaaaccaaaagatggtgaaatgctttgtgaaaatgtaaaggactgcacagtccttcctgagatgaaggaaatagtatcaagagattggagtaattctagtgacagagacagcgtatgtacctgtgtggaaaagaatgcttgcaaagcttgtcaccctcacgagaattcctctgacagacatttgcctttgacagtgaaaacagatattaaagtgaaaggagaagaaaccgaagagcatcagaggggacgactgggttacttaactgttggggagcaatctgaggagttggttaccagagaaactggcgatggcgatcccgtgagcaacatctctcagacccattttaaatgccgggggatacttaatcatgctgaaaaacagcagagccctgaggttttggactacatgttgcagaaagaagagaaatatatacgtcaacaaaaagcacatacgatatcgcaacagtgcatatcatctagtctgttgttagatgatgcacaaaatcagaaccaaccgaaggctgacaaagatgagtccaccatgatcaatgaaatcaccctagcaaagctggccaaggacagcattgtggcacagactcagaagttagaagaccagaaggaggaaaggttacatcatccattaaggaaggacactgagtcatgcacaagtccttgccttcttggtgcccctcggaaagcacaagacccctcctctgctgggtgtgatcaaatacatggtgcctttgcgaagaaaggagttcttcccttaaagaagcagccccatcgaacttgtaagaaagtttcctatcaggagcaaatcattgttgggagaaaaataggtaaaatcagaagttctgcctttttaaagagttcttccaatcccatccccacaaaagcgcacagacttctcagtttgtgtactctgtctgcacctacacgattagaacctgaaacagcacctaccaagagcttggttagtcacataccaaagcagatgtctacaccgtgccatcccttgaggagcctgaattttaggaagactaccaaagaatcagccttactaaacaagctgtccatccttgcctccaaactggccccagccatgaagactcagaagctaagataccgacggtgttcctctgaacttcttccaatggcta

SEQ ID NO: 103340 - DNA, 1142 bp, Homo sapiens
tcagaaggaaatgtacagattacagctgaaactctgctaaaatccgccgaagtacaaggtatgaaggtcaatgggactaagacggataataatgaaggacacaaaaatggcaatgtgagtaaagatctctcagctggatgcggtgaattccaagaagtagacaaaatcatgaccagtgatgaggtttcagaaaccagcacattagttaccccagaacctttaacctttgtggaccctgtattaacagaagcaactcctaaagaaaaagaatgtgaagaattaaaaagttgtccttggttgtcattaccaggaaacagtgccatttctaatgtggacaatgggaaggaagagttgtgtaaaccaaacctggtctgtgaagcagatgacaatcaccaacagcttcatggccaccataatgaacaacccagttctacacatgatagtcccacagccacaagccctttgaaagaaaattctgaagtttcatgtttcacatcagacttgtctggtccagaatccagaacaatatccttagaaaactgtggttttgaaggtggtggtttgctaaagagatctgctgaaaagacagacagttcttatttttataggggggatgatcaagggaagaacttggcttctagagaagaaaatgaggaacggcttttgattcctaggagtgaaagaggtggaccttttctttttaatgccagggaaccagaaaaggagattagtggtcgttgttctggtgaaaaagagcctgttgtttctccaaaggaaaatatccacaataactgcattcaagacagtctccatacagggaactctagttctttaatgcccaattcttttactgaagccacagaagtaatgttaaataaaaatgatttgaaaattactgtacacgttcaaggtaacttgacaaaccctgaggaccataaagaaacttttactaatatgagccatcctggtggacactctgaagaaagcagtttttcctccttgatgcagattgaagaggcaggacagacaacccctgtagagcccaatatattaagtaaatctttttacactaaagactgtaactccttagtcagcatccagagaaatctggaaggcaacacccagttaaatgaagcatcatg

SEQ ID NO: 103341 - DNA, 1030 bp, Homo sapiens
cgtggtggctcacgcctgtaatcccagcactttgggaggccaaggtgggcagatcatcaggtcaggagatcgagaccatcctggctaatacggtgaaaccccatctcgcctaaaaatacacacacaaaaaattagccgggcgtagtggcgggtgcctgtagtcccagctactccggaggctgaggcaggagaatggcgtgaacccgggatgtggagcttgcagtgagcggaggttgtgccactacattccagcctgggcgacagagcgagacttcgtctcaaaaataaataaataaataaatttgcaactaataattttgggatttgatcaagatcaccctgctgagggtgaactatcttagaacaggcacagtggaagggacagctgcaagagccaagctgaattgtgaaagaatgtattcagttctgaactccactcttgtaggaggaaggtcaaaatctgttacgcatgcaaaggttactagcaaggatgtggaatagattggtcttatttaagaactgtgcaccaaagataatcagagatggacatgtgacatcccacatggatgatttagcattgagaactctataccatgcttggtttttattgtttgtttttttggtgcttacatataagctatagagtgttaaactttttacatatttttttccccataatggtagatccacctgggttgaatatgttgtaaacactttggttctaggatacaatacattggttgtattcaactcagacacagaaaaagttcagaatttttttttttttttttttttgagatggagtctactctgtcgcccaggctggagtgcagtggcacaatctgaattgtcttttaactgtaacatacaaaagcgtagtatacgtttttttttttttttcgagatgaagtctctgtcacccaggctggagtgcagtggcgcgatctccgctcactgcaacctccgcctcctgggttcaagccattctcctgcctcagcctccagagtagctgggattacaggcacccgc

SEQ ID NO: 103342 - DNA, 1019 bp, Homo sapiens
aggtatttatttttctacaaattcattaaggagaaatttttggtgccagataatgctggcatttaaagtagaacttattttcttcgttgtagccggtttgaactgaggcagccttcttctaacctatcaaggttttaaacttttatcccttcctgtgatttgtgtcagggtgaatcatttgatgtaaaagacttgactccataatctgcatctgtcctaatgctgtcatctggagtagagactcagccagttccacttgattcctccatgtctgccgtggtacaggaattatactctgaactcccagtaagtgtctccagagagcttcatgctgaccctgagccaagtgtgattccagatgtaaaacctggagcctcaagctctcttttaagtcagaatagggcattgcccttggagctgcagaggactcatgtggagagttgttgtgaagaaacctatgagaccttggatcatgggagtgagcctgggcgatgtgggctagtggactccacagcaggaggttctgtggcatctgggatcttggatagggcaaagagaagcgagagcatggagccaaaggtcttcagagatccagggggccaggcaggaattataagagaaccctctgagggagcaaaggaagatccacatcaacattccacagctgctgaagaaaagactagcccgagtcaggtaagaaatgaaatctccattccgaagagttgagtgtgaatgacagctttctctggataaaatacagatgctgacggttggctcatgatttattcttgaaacatttccgaaatgtcgattttgaagttaactttgttttgatgatcttttaaaacatttatgtcacatcagacacttgaagagaggaagtgcttagtaaaaaagtgtcagttctctgaagcagcgactgtatatgaaatgttgagtctgtgaaaatcatggtatttcagcatttgatgttaagaaatgatatagatatactcagtccttatgttttggtaggttgg

SEQ ID NO: 103343 - DNA, 1589 bp, Homo sapiens
tcggggcgggcctagtaggcgcttcaggcttaggggcggaacagcgcgggccgcgcgggcgtaggcggggtatctggaggaggcgcagggaacctggagagggtccagccctcagtgccccggccagaggcgggaaggggctctagagcttcggtgagtggagctgcccgccccggactggggattgggggggcttgagataggggaccttggcccaggttcgagttccaggctccatccccattccgctgtgtgaccttggacaagtctctctccctctctgagcctcaacggcctcagctgtgaaacggagtcagggaaggtctgctgagagttcgcacagaccgaggtttggggaaggaacttctgccttcctcctctttgtggttgccttgctcaggacattggcagcaaaacgagaatggtgggagtgtctcttaagtctcgagtgaccttgagcaagtcccttgcccggagtcacactttcatcatctacaaaatgagtgggctaacctcttttaagatctctttactatttgggtgttattggtgtagatggagacaaggtgatgagcacccattcagcgcaatgcttcccctatgggggtgtgatagaatatcttctcctaggtttgactagcccctggcccgaattccccttagttcctggattctgtggttctatttgttctccatcgctccttgtaactggaggagtgacttcttccgagagtcacttggcaccacttcacagcagaggaacaccagtatcttcactggcctaaaatcaaagagtggttgcaaggaaaaatctgacattccaaccttttcgtttgtatttctgtggcagggaggcaagatgacttctctgccccaagcttggaacagctaaagggaaaaacagtgcaagatgagaacaacaaaggtctacaaactcgtcatccacaagaagggctttgggggcagtggtcagtatcgattggtctttagaggttttgtaagttggctgaggttctggtgtgtgcaatacctagaaattacacactgactcgtgtgacaattgaggctaaacaggcgactaaacagactaaagcagcaactgtcatacagtaacaataggaggatggcaggacccttctaatgcatttgcattcagacttttaaggaacattgtgaatgctgccggtttactacccttcatttgttgaattgcattattaattacaaatcttccgtgtatgttccataaaattccagcctgcactggtttggcagataagagaaactaaaatcgtttatcagtttttacattgagtgagagagaagtggcatagatgtgcatagagcaggtatgatcaaagcatgaacctttgcctggcttgtaggcatgggaagaaggagcaggatacagcatgttattctgcactgagctatagtctgagtatctactctgcttctaattttcctggtgaccttgggcaagctcctagtgtaccttatctgaaagttgaagggctttagaatagtttctcttaacatctattttttttcctttcttttcttttctttttttttttgggacacggtcc

SEQ ID NO: 103344 - DNA, 1034 bp, Homo sapiens
gtacgatctcagctcgctacaacctctgtctctggggttcaagcgatttgtatgcctcagcctcccaagtagcttggattacaggcgcccaccatcatgcctggctaatttttgtgtttttagtagagacagggtttcaccatgttggccaggctggtctcgaactgctgacctcaggtgatcttcctgcctagacctcccaaagtgctgagattacaggtgttagccaccatacccagcctcttccttcttaaattctttattttccctcccttctccctttttctctccatttttgttgattgcttaggctctggtcttatttcacctaaaaagcagagaattgtttaaattctaagctcctgaaaggaagagactgtgtgttgcccgtgtcagatgatcaattgtgttgcttactgagttgagtgtttatagattagaatatatggatctgctttttcaaaatatgttatctgagccagatattgtttctgttttagaaactatcagtgtggaccagactgtgactcaagtgttccggctgagaccttatcaggatgtctatgttaatgtcgtagaccctaaggtatgtctttgttttgtacttgaatatctttttggaataagcacccttcctcaaggttagattactaaggaaacaatgggttacttaagtgtagtgttagcctattaaatgtgtggcctgctaggtgtggtaatttcagtacatcaggaggctgagacaggaggatcacttgaggccaggagttcaagaccagcctgagcagcatagttagaccttgtctttattaaaactttcctttttcttttttttgaaatggagtatcactgttgcccaggctggagtgcagtggcgtgatctcggctcactgcaactggtgcctcccaggttcaagccattctcctgcctcagcctcctgagtagctaggattacaggcctgcaccaccgcacccagctaatttttgtatttttgtagagacagggtttcaccatattggccaggctgttctt

SEQ ID NO: 103345 - DNA, 1059 bp, Homo sapiens
tatgtaggttgcatttaaaacccaccaccacttttcttgaagcttgtcctaaccattttctgtatgtgaaactatatgtaaaactttctattaaaatactaacattttaaaatgtattctcatttttcttcaagaagtgatgttataatagataaaaattattgtccagaaagtactattgacattaatagggaaataaagtacataggtaagtgtcatgtttgtgtgccagaatccagactaaaatacagaatgagtcccccactacccatcacactcaatgtgctacagcagctataggatcagttgtagatttaccaactatactgaaaagtgtgcttttgcaggatataattctgttcatcagagttctgctactgaatggtcttccagtagttttcttttttgcaataagtttttttccatggtaagtgggcattaccttctgactataaagtgtggcaaagtaatgtcagagatatcatttgattattccttttaggatgtgacccttgacctagtggaattaacttttaaggatcagtatattggccgtggggatatgtggcgactaaagaaaagtttggtaagatgtgattttttttgaaagtctgttactttttccattatgtgaataatccctgtttattatgggagaagaatataaaatcgtttctgattttatatcagcatctacagacaattattgtcaacgtcttctgtgttcttccattctcttttcactgttcttttgatcttttgtttactgttacagatttttactcagcatttttggtttagataggaagttatactgtattttacattggaatagaaccgtacttttcaggttttcactttatcccatttgctcctcacatctcctcatggacaggtatttattatccctaatttatagaggtagaaactgagattgagaagttaggtaattgcccaaggctagatagtaagttgactcttggccaaaacccagatcctgtggcttccagatcacactgctttttgctataccctcttcccgttttccacatgtattca

SEQ ID NO: 103346 - DNA, 1115 bp, Homo sapiens
aagcagtggaggcgtatggatgtccatataataaaatgtgtaaaagtataaaatgttagattgttggctggccacagtggctcacgcctgtaatcctagcactttgggaggccaaggtgggcggatcacgaggtcaggagatcaggaccatactggctaacacggtgaaaccccgtctctactaaaaatacaaaaaattagctgggcgtggtggcgggcgcctgtagtcgcagctacttgggagactgaggcaggagaatggcgtgaacccgggaggcggagcttgcagtgagccgagatcacgccactgccctccagcctggacgacagagcaaaactccgtctcaaaaaaaaaaaaaaaaaagttagattgttgtagctcaaacaaaccacaaaatgcactatagtagtttgaggcttattaatggaaaaagttgatgaagccccctggcattctgtaaaaaaggaagtagaaaaaaaaaaggagatagagactcgtaattttacaactggaaaaaccctagatgcacgtattgaatcatactttctcattttacaaattaggaaacaggtttagaaacataaaatgactggcacattggctcctgatttgttacctttttaactatattgctgtactcttgatttattaaaactatttctatattttagtttgtgaagaaaaaagagactttgtgaaatcccctttaaattcaaaaagtggctgggtgtggtggctcacacttgtaatcccaacactttgggatgctgaggtgggtagattgttgcttgagcccaggagttgaagaccagcctgggcaacatagtgagaccccatttctacaaaaaaatacaaaaattagctgggtgtggtgacacacgcctgtagtccagctacccgggaggctgagaggtgggaggatcgcttgagcctgggaggtagaggctgcagtgagctgggatcacaccactacactccagcctggatgacagagcaagaccctgcctcaaaaaaaaaattcagaaagtatttcaggtgcggtggctcacacctgtaatctcagcactttgagaggccaaggtgggctgagtgtgcttgagccccaggagttcaa

SEQ ID NO: 103347 - DNA, 1088 bp, Homo sapiens
ttgagcccaggagtttgaaaccactctgggcaacgtagggagaccccctctctacaaaaaaatacaaaaattttgtggcctggtggtgcactcccatagttccagctactcgagaggctgaagtgggaagatcgtttcatcctggagcctgggagtttgaggctgcagtgagctgtgattgtgtcactgcactccagccttgggtggcaagagtgagatcctgtctcaaaacaaaggaaaaaaagaagtccaacattgcaagattcttttatcattgctttaaaaaaaattgtggttaaaaagcctatcataaaatttaccatcttaaccatttttaagtgtatagttcaatagtgttaagaacatttacactgttgtgaagcagatcttcagaactttttcatcttatagaactgaaactgtatatggcattgctttttaatacaattgtgtttttatttcaggtggtgtttcgttctacgtcggctatggtttacatatttattcagatgagctgtgaaatgtgggattttgatatttatggtactgtgtctatgtgctgattgtaactgctaaggggagaattttctggaactgcaaatgctaattcatgaatgcccagggtcccccacatcatcttctaacaaactttaaatatcattgtgagaataatcatatttggaggttagagtgttttctcgttctaaagatacactacttttttcaataatcaaatttttttcaaactgcattgtatgttgaagtcatagcctcttagtagtgaggcagatattaaatttggcttcaaaaaataaagaaataaataaacttggcttcttagtttgagaatgaaaccactttgtacatctggcttttatgatcttgttttaagatgtacaaaacaggccgggcacagcggttcatgcctgtaatcctagcactttgggaggctgaggtgggcggatcacctgaggtcaggagttggagaccagcctgaccaacatcgggaaaccccatacctactaaaaatacaaaaattagctgggcttggtggtgggcgcctgtaatcccagctactcaggatgctg

SEQ ID NO: 103348 - DNA, 1053 bp, Homo sapiens
gcgagcagagatcacgccgctgcactccaacctggttgatagaaaaagacactatctcaaaaaaaaattcttttttttttttttaaataaataggctggctgcagtggctgacacctgtaataccagcactttcggaggcttaggcagcgggatcacctgaggtcaggagctcaagagcagcctggccaacatggcgaaaccccatctttactaaaaatacataaaaaacttgccaggcatggtggtgcatgcctgtcataccagctacttgggaggctgaggcaggaaaatcacttaaacctgggaggtggaggttgcagtgagctgagattgtgccactgcattccagcctgggtgatggagttagactgtctcaaataaatgaataaataaataataaataaaattgtaaaagtaaccatgttactagaatttgaatatggagaggtatatcaagtaaaaaatgatacccttctcctgctccccagtgtgagtccttttttaaggggaaccattgttagcagtgtggtatgattatcccggcatttatgtgttagccgaaatatattgtttgcaaataacagagatgtactgatttagtttaaacaaaaagcgaaatttactgtaaggatacagaggcttaaatggagcagccaggaaaggctcaaacaccatgtcgaagaaccttagtggctctgggaaccatagcagcaggaattatgagagccatatttcagcttccagcaaccctgtctctgctctctgttcagaatttacattcctggtagagagggtctgatctgttcagctccagttaggtgtccatctgccactggccagaggtggaagtgatgatacgcgtacacatcactatgtatatcatcttcccacatgtctgtacccaggtgctcagggaattctagagcataatgtcttctattagtaaatcttcttgtcatattggaatatcactgatttttcatagtaagaatcatagaggctagaaataaaaagtgacttgccagatttacaaagtcatcccaagattttgg

SEQ ID NO: 103349 - DNA, 1021 bp, Homo sapiens
tggagtttcaccatgttggccaggctggtctcaaactcctgatttcaagtgatccgcctgctttggcctcccaaagtgctgggatttcaggcatgagccaccatacccagccctcacagcatgaaatttgagcatttaaggctgcacagggcaagtatgaggtgtcaatgaggggtattaacaaaggtgacagcgacttattcctgtggtcaagtagttcttaatatggaagagaaaagacagatgcgtatacatttaactagaatgtggcagttgctataataaaaatatgggcagaatgctctgagagtgtagagatgcttgtctgtgacagggttctgaaaagctgtaacatcattattgtggaatttttgttttatttctagtgtttgataagcactacatcaaccgcaactttgaccgaactgggcagatgtcagtggtgatcacgcccggggtgggtgtctttgaagtggaccgcctactcatgatcctgaccaagcagcggatgatagataatggtaatgctctctggtttgtgccctgtctccacatgttcctagcctgatttccccttagaactgtgagcttcactgacttcttagagtgtgaggagctctacatagtgttctgtgtgtcacaacgtctgtggatgtcaataggtgtcaggtgctaaaatttcatggtcaaatcagtttgggaaatgctgggtcatgcaaagataagcaggttccataatgacaggtcttcctcagtttttaatatgttagtgtaggttgtttttctctaaaggttgtgtcagggtactctgagttccccaaacatatttggcactagagaagccttcctggagggatgatttcaagggacccatgtgctgtcagccgattttctttctttctttttttttttagacggagtctcgctctgtctcccaggctggagtgcagtggtgtgatcttggctcactgcaagctccgcctcctgggttcacactattctcctgcctcagcctcccaag

SEQ ID NO: 103350 - DNA, 1051 bp, Homo sapiens
cttgaacccagaaggtggaggttgcagtgagccgtgatctcacgccactgcatgtcagcctgggcagcagagcaagactgtcaaaaaaaaaaaggagtttggaaagtaaatcctgatgccactaaagaagctctgttaagtgatgtggattgttttactttttactgagatattacaaagttactgttcctttctggccttaaaaatttaaacatggaagtttggttgtctttttttaaacaagtcatgacctgtaggacagtcaaaggctaattgtcaagcaccgaataatgatacgttagtagggcacttggaaaagaggaaacagacaaaatgaatgtatttacttctttgttggataggcagcactatgaggttataaatcatacaatggtaagttagctttgcctactacccatttaaataacatgatttatagatagggacacttgtctctgccattccctccccacaattctttttgtcttttctttttttaggaattggtgtggatttggtgtgcatgggagagcaaccgttacatgctgtcccattgttcaaggtaattagatttcggatttgtttactaaaggccagttggagtatagttagaaagagaaaaattccaggcgctgtggcatgcacttatagtcccacttactcgagaggctgaagtgggaagatcccttaagcctaggagtttcggtatagtttgctatgaacatgcctatgaataaccactgcactccagcctgggcagcaaagcaagactctatctctaaaaaaattatttttgagacgatgtcttgttcttgtcctccaggctggagtgcaatggtgcgatgttggctcactgcaacctctgcctcccgggttcaatcagttctcctgcctcagcctcccgagtagctatgattacaggcgcctgccaccatgccaggctaatttttgtatttttagtagagacggggtttcaccatgttggccaggctggtcttgaacacctgattgcaggtggtccgcccgccttggcctcccaaattgctgggat

SEQ ID NO: 103351 - DNA, 1089 bp, Homo sapiens
aagccactcagataccagtggggataaagacaaagatgcagatatgcattgcagcaaaggggaaatatgataaaaaggtcagatcttagtataaagaaatgaaaattctggctgtgtgcagtggctcttgcctgtaaccccagtgctttgggtggctgaggaaggaggattgtttgaagccaggagtttgagaccgatctgggcaacaaatatagtgagaccccatttctgtaaaaactaaaaaagaattagccaggtgtattggcacatacctgtagtcccagctacttgggaggctaaaacgggaagattgcccaagcccaggaatccattgctgtggtgagctataattgcgccattgcacgctaacctgggtggctaagtgagatcttgtctctggaaacaaacaaaccaagaaaataaatgaaaattgtaacaagagtgggaattcttgttttcttctttccaaagaggtttaaaatatattaataattatatcacatgctacaaaaagtgtggtgaaattgacacttgagtacctggttggtgtaccatacttttgcaaagcatttcagccatgtgtattgagagcaaatgtttatgctatttgaaccaggcacttccattttggggcatgcgatgtaaggaaataattgaagtgataatatgcaaatacatctgggtttagttttatttataattgtgagaagttgaaaacaatagatcaatggctgaaatatgaaatatccacttgatggaatatatttgcaactgataaaaatgcaagttttaagaattttaacaagtgtttgttgttgtcgttgtttgtttttttgagatggaatcttgctctgtctcccaagctggagtgcagtggcgtgatcttggcttactgcaacttctgcctcccaggttcaagcaattcctgtgccctagcctcctgagtagctgggattacaggcacccgccaccacacccagcctaatttttgtatttttagtggagacagggtttcacatgttggccagggttgtctcaaactcttgatttcaagtgacccacccgcctcagcctcccaaagtgctggga

SEQ ID NO: 103352 - DNA, 1058 bp, Homo sapiens
gcaaacaaatgcaaacatatttcatttctttatagtttgacagttttgctcatttctctcactccctgacatttataatgcccaagattcttgtcagccttggtttatcattctacctagctctggtttcactgtggttctgtggtttttctttgtgactcaactccatgataactggcagatgtcctggagaacatgatggagccaccacagcgagactccagtgcaccagggaggtttcacgttggcagtgcagaatccatgctgcatgttcgacctggtggatacacgccccagagagcactgattaaccccttcgctccctctcggatgcccatgaagcttacgtccaacagaaggcgctggatgcacacttttcctgtgggtaagttggttgcttaagagagagccttggactaggagctcctagccctggtcctcagtgtcggtcacccatgtgtccttggtcaggtgcctctgttgctccacctgtaagatgggataaccatgcccactttggccatcccaggggttcttgtaaagatccttgaagatgcacttgggaataggctttgtaactaattagctgtataaacctgagggcttttttgtttgtttctgcccttttttttttttttttcttttgagacagggtctcactctagttgcctaggctggagtgcagtggtgcagtctcagctcactgcagcctcaaccttcagggctcaggtgattctcccacctcagcctcccaagtagctgggactgtaggtacgtgccaccaggcctggctagttttttgtatttttagtagagacagggtttcaccatgttgcctaggctggtcttgaactcctggacacaagcaatctgcccaccttaacctcccagagtgctgggattatagatgtgagccaccgcatccggccctttgtttctatttgagaggaactatgcattgccacctgctttctttcctaagtcagatgtccctcattcttgttcattccttcttctcttagatctcttggatattgatatcctgtcttggttacaag

SEQ ID NO: 103353 - DNA, 1086 bp, Homo sapiens
ttgcctttaatatttaaaagttaaataagtgagaaatagatctgaatcatttggctgtaactggggggtcatgcctaaaccccgttctgcccccttatctctgctataatcagtcacactacttgtttctttctgtgtcctttcccctccattattgtctccactggttcccttccaggtcacttagaactcttggtgtttcttcagtgaccttcatcttttcatgcttctgtgcttctcctcctcccactcttcatgtacactttattggaaccatattctgcaaacagtttgcttcgcttcttcctcctgtttagctggcctttcagtagccaaggccctccttcatcagggttccctgtcttcctcattcctatcctcagaggctctcttccttcttggctaatcttgtggtctcctgcacgttttgcctctttcaggtttgggatttcacaggtatcatttcatctacccagatgccctcttccttcaatcgctgttaactttgttgaacacttagctctacaagttctcctttcccaggaagcctcattttgtagacttgactaattgtaatttgtttcctactctgccttttttgcacttaaacatcttctgcttcttagagtcacagttgttactctcctaggtattaacagaatcatttggtgtttcacttgtatttccctcttactgagtttgtgttagccctcctggcaaggggccatgcctcctatacttgtatatttcactgtggctattcagttgacacacctgaggcagaatatcctaaaatattcttaacagattagacaggatgataaaggtgaggctccttagtaggatgggtcctgcttggaagagcagatgtcctttgggagccaccctctgtggtgtgttcttctttcaatctcaccaacatctgtatcccagtagctggaaagaagggagagtatagttaagtgcacagcactagctatcaggtgggaatgatgctcagtggttctttatctgggtagggccatccggagaagccatccagatccaccaccagacccgacagaatatggcggagctacaaggcag

SEQ ID NO: 103354 - DNA, 1001 bp, Homo sapiens
aaaataagtggcaggttgctcgtgtttgtgtgatctcttttagcaaagaatgataccagtaacctcagagtaaagttctggctcattcccaattttagattgatcatttttctttgatcgattcttttgtactgtttgaaatactcagcacagaatttgcacttggtttacatttttatttttagctccagtttgcctttttcaaccataactggtcagaactcttttgcagagtgagccttcttaagacaagctgtttttatctttccataggtatgaatcctaggacccagaataaggattctctagaggacagtgtttctacctctccagacccaagtaagagggggcagctgactggggaaaggggtagacagggagtgtggggtggtcagagcatgaggaaacaagaggaagccctgtgggaagtgagtggtcctgaggtacacatacctctggggtatgggaaggcgatgtggtgagggaggactctctggactctgtgatggaaagtgagggggtgtgtgactgaatgacctgttttggaaggtgattcaggggcacctgggaaaggtagcagattccctataaggcccccatgctggtccagagctggccttcacccttaactgcctaatgatatctccatgaaaaagttggaaagacataataggctgttaactggaatcatttacctgcctgtagttgaaatatttggctgaattgcattccttttgattgtctttttgaatagctatgcagtaagagaatgtctaaatatctgtaataataaaatagcagagaaaatcctaccatttgataaactttacttagctgtgaccaatggatgtatatcactgagtctttttgtccccacttttttttttttttttgagacagtgtcttgctctgtcacccaggctggagtgcagtgacgtgatctcggctcactgccacctctgcctcccaggttcaagtgattcttctgcctcagcctcttg

SEQ ID NO: 103355 - DNA, 1009 bp, Homo sapiens
tagatgattctatttctctacaaccctgtcaccggagtttgttacctttgctcatcattgttattttagtggttctgaggtgtagaacttcctcagagtccctcttttcagaaccagaagatactggggttagaaaagaggctgcactcttttcctagagacagaacacccttaaacttacaatcaggatcctttctcatcatgagatctcgaactaagcatttgaacagtctgtgtcttgttgtgtgcccagcagaaagcatttctacaagatttttgtaatcctgagggtcagaaggctgatgatggccaggatgatctaagaggacataaagatagatttgtcttctgtttctggcttccccactggggctttgatcaggtcctcatcttctgttttagccaggaagtaaaaacaagctcaccttctcggctgccatatagaaaaatggagatgattaattaggctattcgggcctatgttttggattcctgaattattaatgagtttataaggcctgtgtagagcatgaattagatctgttgcaggctaaatcatcttccccaagtcagtggtgccacgtggggcatctttctgctgtgacttagcacacaaattttgttcttcattgacgggagggctgatgaggcagcaggggctacaacacattataagctgttagcatggtacaaaaataaagtgagtatcccattcagaacttagagacaaacgctcagagtttttcggcttcgtattgctcccttctttggaaagttaaaagatagtcttcacttaaattacttaaagaggtaactgccctattattttaactcagtgaagctcaaccagggaggattttcctaaccagggaggatttccctcccccaggggaacatgtcaatgcctgcagacatttctggttttcacagctaggggatgccactggcatctagtgagtagagtccaaggatgctgctgcggtacccaggacagcccccacaacaaaga

SEQ ID NO: 103356 - DNA, 1004 bp, Homo sapiens
attgttaaaactctgtctcttaaagttccagcctcctaactttcccagatatccttacttgatttttcctcccacccttttgaatctgttacttatttttgcagtgctagaagtattccttatttctgctactgtatgctgtttgctcccaaacgaggctgagctcccctcctttccccacctagccactctgcagtccttgggagaggctcgtgcttgggcctccctgctcttggaacgttgatgtgcttcgacatgtaattctgcctgccctgccgtaatctcacctgcattgcggctgcagctcacagtcagcagaaaatgaaaaatatcagctgtgaatcccatttgcatgatgggattggataagcatgtgcactgcattgtctaacaaactctgtttctctctctttctccctcccctaccctgtttcttcccaatcctggcaattttaccatctttcaccctgaacttttttccccactcttccctccccttccctcccctggccccccatcccacacttgccatggtgaccacatgtaccttttccccctgttacgtgaggcagttctgacactgtctgctccccctgtagtgccaggcttctgttgcacagttggagtggactggaagtctctcactactccggcgtgcctcccccttaccaccgactacttccctgaccgccagggcctgcagaatgactacacagagggctgttatgatctccttccagaagcagacatcgacaggtcagtgtcagagaaaaaggcacttggcttggttggtgagggtttcggatatatcccacacatgcatcagaacactggatttgtgctggcttcagcaacacatatattaaaattggaacgatatagaggagattagcatggccgttaaataaaaaattttaaaaaaacattgaattgtattttatctttttttttccttttttttttttaactgagagagggtctcactctgtcgctcgggttggagt

SEQ ID NO: 103357 - DNA, 1126 bp, Homo sapiens
gcagcccaagacacagaaacccaatcctgctgtcccgcccccgctgagcagtagcccactctatagccgaggtgagtttttctccttggatttctatttttttctcttctactgtgtatgtggaagtgggttttcaagatggtaggtagtagataaatttagtagtaatcgttttcgacatagaagttttctttataaattctacttaagtgaggaataaagtctcctttaggtatggatttattttaaatgctctctttaatttacaactctccctttaaggcagtggatgtggccaagttcaggaatgggacagcctggcttggacagacacctgggaatagtaggcagctgagtcactactgagctgtcaacgtttctaaacctatatttaattgtttctagtacagtacctggcacacagcagattgtcagatgttacctaaacctgaagtttacatttgttcttattttcttattctggattcatctgtctcttctttatcactgaagcttggtggcttgaagcaagaatgggtcatctatgagtggcagattaggctagtaagtaacagagaatcggtgttgctaattgaatcagagccaggcaatggagagctcctctaaaataagtctaacagagggaattaagtgcaggtgcctggaatcagaaagcagtaatcacttcctggaacaatcaatgagctgtcttagtctcctgtctcttcattattgctaacaagaccccccctcccctgatcacctagtgataaccttggatcatctttgtccccatgaaagcttcttgggccagaggatcagagaactgtggccctgttggagcatgcggtcatccagtccaggccctgttgtttatgtgtgaagctttggactccccctggattttctttgaaagccccttgtgacatttatcacatgttgccttgtattcatcttccagaccctactgaatgttaacctttttgagtgccaagactatttctgttcatctttttgtcctccacaatggaaactacatgcctggcatacagtaatatgcaacagtatgggttaataagtatatgaatttggctgggcgtaatcctagcacgttgggaggctgagg

SEQ ID NO: 103358 - DNA, 1037 bp, Homo sapiens
aatactaagtgtgagccaggccctattccagcagggaacagaacagcatcagccctcccctcagagtctacagtctatggcagagtcagatgttaaactaataaaccacaagtatatatttgatcacagattgtgaagaataaataccatgcaggataaacacagaaataactggggtgcacctaatttagaatgggggtgtcaggtacgatgtcagatgctcatgaaccttgtcccatggcattgtcttcccaacagccagcagagtgtttgttgcatgaatgaagaaggaatgcttggatgagggcttgccctctttcttgctgtagaaagtgagatttggtgcccaagatcacacaagctggcaagtgaaagtgctggggttggacctggggtcccctgagtagcttctgttttgtatgcagctggcctgctactcccttggcaccatcggggaaatttccacattcacagtgaatattatttcagcctctgctgtcctcctctctcctcttgaccgctcacatgctgcctgtcactgtgtgactgtctcagagctgaatgagtgttaccagtggaaggtgtccaggttcttggcacctcaaagagttggacaaaatgcacaaacaaagcaaggaaagaatgaagcagcaaaaggagagatttattgaaaatgaaagtacactccacagtgtgggagtgagctggagcataggggctcaagggctcctttacagaattttttagggtttaaataccttctagaagtgtcccgttggttacttggtgtacacgctatgtaaatgaagtggtggctcgcaatcagtctgattggttgctgaagtgaagttacaaagttacacttctatgcaaacgtctgtttggttgtaaaaatcaaaccaatcagagacactttcagttttccatctgcctcacagaaaaagcggagagtggtttgtgaagggagtaacctccggtccttttgttacttaggtgtggaaagttggggttttccttttgatttagttctaggaagt

SEQ ID NO: 103359 - DNA, 1066 bp, Homo sapiens
ggctgagacaggagaattgcttgaacccaggaggtggaggttgcagtgagccgagatcgggccattgcactccagcttgggcaacaagagcgaaactccatctcaaaaaaaaaaaaaaaaaaagaaacaacatgagcaaatatttgcagcaaatcaataaatggtccttttagactgaaacttggtatagcagtttaggattagtgagagctaggaccagaaagctaggttggctgccaccttggagtgagaacctcgaatgccaaggtgggcagcttatgctggtgtagtagagttccattttagtaacacagtcatctcttacagaactttcctctccagaggatgaggtatcaggttgttcagctttgagtgtgccatctaggtgctatcagctagcaccttcaggctctaatctgctcctggttggtttaataacagaaaaatctgccaacctcaggagttttttgtttgttttttttaaccaagaataactttcttccatgaaactgcccctaagagaaagtgttacattgttttctgaatctatatggatgagaaacaattgtctgttataggaatgagcttcaaacagatggaggaaattattatttttctgttaggccttgtgtcccgaaaccgccctgaggaggaggaccagtattggctgagtatgggcagaacgttccacaaagtgacgctgaaggataagatgatcacagtgacgcgataccttcccaagtgagtatttggatatttaaagtcttcagttattgtcctgaattatggccacatactaaattgtgtgtatagtacatcattcaaactgaggaagttcagtggttggtttttcttttggagttttgtttgtttgtttctagggttattttagggttatagcttacctacttccaaaagggatttgattcatcttataatgtttagcatgattcatgacaagcctatttcaaataaagattgtgaggagagaagaaggaaagagtttaagaagatctgagaaatttctagtaccgttccctgggataagttggttactacagttgag

SEQ ID NO: 103360 - DNA, 1036 bp, Homo sapiens
catatgccttggtttcacactctggtcttaaacttgtctcacacactcagtcatgctagctggctggcttttctaggcctttgggtatgtggcctctttataaacagtaagtgttaacagttgataagacactgttgggaccacacttggttgggaaggcaggaagagtgtggtgtcatgggaggtgggattcaaactggcattgtaggaagcaaagcgtttacatgggggtgggtgagacttgaggaagagaaaacattgccttgggctgccttccctgcccctctccacctcacagctagatcaggttcctccctgtgcttgccagcatcctgggcctacgtccatcagagcacttaccagtattctgctgggagccagttgtcagttgacttctccctgacttgactgtgtgctctgaggccagaggctgtgtgccatgcctggcacatagtaggtgtgtaatggatatttattgaatgatgggttgggggatgctgagggtctccctgtagagatgtgaggtgagcatgttaggggaggctagaccttgactgtatggtatgagggtctgtcatgcccgcaggaacctgcacacattaggctttccagaagtaacattgaacaagcaaacgtgaggtatggtggggacatggaattggaaagacagtgtgggaatttggatgctaggctgtccttacacattctcatggcaagaggaatcctttgaaagttttaaaaattctattacaggccaggcgtggtggctcacgcctgtaatcccagcacgttgggagactgagaggtcagggttacttgagcccaggagttcaagatcagggtaggtaacatagtgagaccccatctctacaaaaaattagcctagagtggtggtgaatgctgaggtgggaggattgcttgagcctgggaggttgaggctaggctgtaattagcctcagttgcgccactgcattccagtctgggcgacagcaagaccctgtctcaataaaaaatgaaaataaaaattttattagaa

SEQ ID NO: 103361 - DNA, 1055 bp, Homo sapiens
ctcagcctccccagtagctgggattacaggcgtgcaccaccatggccagctaattttttttatttttagtagagacagggtttcaccgtgttggccaggttggtcccaaactcctgacctcaagtgatccacccacctcagcctcccaaagtgctgggattacaggcgtgagccaccatgcgcagccgtaaaaaccattcttagctcactggctgtaaaaaaatcagagggctggccagatttggcctgcaagctgtagtttaccaactgctgctctagggagtggcattaggtaccaaggacagtctgtgtgtaaggaatgatctgctgaccatgagtcttttcacctgaactccttcacatgtacataaacctcaacaccatcagcacctctgcttctatatgttctggcagttagaagggacacagtggaacaatgagataaaattaccctgtgtgctgtccaccaggttttgcctctactcattgccatctttgagggtcagaaacagtgctgaggacatgactgaaaagcagagaaattatagtcgcaaatatattagattgctgtttagaaccctctcctgattgtccaggtgaacgctaaaatccacatgcatgacccatcagtagggctggaagtaaactcctgaatagtcaggggaaacaaaatgctatgagatggccaaagcagagagccctgctgacatgctcagaaatgcccaactgtttccccaaggaacacttcatgttagaatgcgttgggggtacctgcatcagcatctccgcagccacaagtttccaaggtttcgtattggagtttgcagtcacttacgggaagtggcagcagtatcaataaaatgggcacccaaatatttcagttattctacctttggaattgaggaaaagttccagaaaagcagagaacttgagatgtgtcaagtgccattcctgaatttctatgataaccagacataaaaagtaaaaagattccgaaaggaaagagggtactacttaagaatgatggaaggaggggtcattgaaaaagtcctccg

SEQ ID NO: 103362 - DNA, 1433 bp, Homo sapiens
atttttgtttcacagacatggctgcttgaattccacaagggtagggtagggagggaatgacagctttagaaagcccctcacaatgtgagtgcttgtgtatctgacattatatatgtcttagcttgctgatgattttgttacacaaccagtggaggagaaggtatggctgcttctgtatcccctgtttgctaaaaaaaaactaagcaagaacttaccctgccttgaatcctctcctcccatctggctgcccatgtttagtaacaggcagaaaaaacctcctggctcaatgtatctctccaagagggcgactggtcacccagccaggtgggaggccaggatgttgccaccaaagcccttaccctgcagccccaccaagctgctctgcggccttttcatcttccttggcataggtctgaaggaatttcagagctatgtgggagggtgagagcatccaagccacactctgatgagacctgagagagcttggacacaccttccaacctgggtgctttctcccacacagatgggatattctgcccaggaaggtgtgagtttctgctaatgcttcgcatttggatattgtctttctgggtggcgctctctctctctctctctttttttttttttttaattttccctatcctcttcatatgtccttgtttctctccttccctccttgtttttatttttattttttgttttttatacctgtctccttcccctgatggttaaccactggtacacattccgtttcttcgcttccttgcaactgctgctgctgcttcctcctcctgtgacttcaggacggggccttctttatggagtttgtccgcagcccacgcacagcatcgtccgccttctaccctcaggttagtccaactccagggcttcgcatgcctgtcccactggcagacgccatgagctggccttctgttaggctctgaacacatggaattgggctgcaactaagtttggggggcagttgaacttgaatttggtctcagaattgtacattctcttccatgttgtttgtggcggcgaagggggggatggaagaggttaatgtagaagaacatatgattgtaccagtgatgactcaagtgtttctcatcactgtctgtttcacatagttgtcactgattctctgccactttgcagcatcttcacttttaggttttatgagcaacatgaaatatgcttagttaagggctgaacacttatttttttcccctcccaatacaaccagataaatttataacagtgtggcaggaagtggtgaaaaaacacagcaaatatttattcataggcatgtgctaatgcataggccaaaggtgtagctcacctagcttctggatttcacttaaattatttgtcagttaaaagatttggatgagccgggtgcggtggctcacgcctgtaatcccagcactttg

SEQ ID NO: 103363 - DNA, 1330 bp, Homo sapiens
aaagttttcagagtaacagaatgatgggattggaactgttcttgacagacgatgcaaatggagctggctcacagggagggtttttgagggagaggctgcaatcaggggctatttagaagaatgttacagccctccctggccagaggaagtacaggcatgatttagagatgcatgtgaatctgcagagggcaggccgtgggactaggcctgtctttagatgcaaagctggagaagagagctatcagatggctctgagagttgaacctgagcaaactgaaaggtagaagaaaggaggttttgggtgggaaagggtgagtcacggtaggcagaagatgtacattgtgatgttcacctatttgtctctaaatgtggtctttcagtcctgctgtcctcataaggagtgattctgacttctccactctttctatggagatttttctttagtgtaaatcgtgtggtttgaggcaggtgctgaagcgatttctttggtcctggggatttactgtgaagagtggcctctcatctgccctggttggagggtgggagttcccagctgctctgatagaaggcagtgcacacaagactgggtagagtctctagacaactttagctgtgccactagggaccaaggggtagtgggaatgagcagaatgggaaggattgcattaatttttgtttattttttgtgaatgcttactgagtgaataagccagtacagcttatttactgtgttttcctgtcagttatttttggaatcaagtattcatttttaaatctcctgcaggtatctgtggaccaaacagccactcctatgttggacggcaccagtttgggcatatgcacaggccaatccatggacagaggcaacagccagacctttgggaactcccagaacataggagaacagggctactcctccacaaactccagtgacagcaggtgagattcagagtggccaaactcatgttcctggggagtggggacagtctgatctcaaaggctgcagaggctgaagtccaaagctctgggccgagttctgactctgccacaagtcacatgcgaccctgggcaagttagtccttaaccacatctgtatgatgggactaatgatctgtttcctgccatcctcacaggatagctaagaggttcccacagagatgtaggaaagtgtcaggcaccacacaggagtacagggcttccggaagggggctctgtccagtctgtcttgttcactgtggtgcctgtggcacaatgtcttgcacgtcatagcatgctgtcagtaaggaaaagaacaaacagtggatgaatcactaattgtggccaaacatga

SEQ ID NO: 103364 - DNA, 2065 bp, Homo sapiens
ttgggggaatgccctccctctgacctcaagccgccagtttcccctggtcaatgcatgcttattcaagactcaatgctggattcaaggctctgacccaggggccttctgtcaccttgtacttactctgtcagagctcttagcacaacagaatgaagatctttctctcatttgtctcctgcctcaaccagctccttgagagcaggatcacctcttattttccatttctgtatcaccagtgccaggcatgttgcttggcacctggtaggcacttagcaccatgcttgctggatttaattacgctgctcagaactggaactctggaatatggcagaactggaataacaaggaaatgggaaacggccagttgactgagccagttcatgccatcctgtctatacggaggccccaactggaagtcagtactgtttccttaccagctgagttgtcatcatggaaatgttaaaattgataactgatttgaaaaagcatgtgattctcagttctcactctgagggtcttgatgtgctgttttgcacagcctttgccgtatacactctcgtctccctgagaatacgatttccttattcaaataatgaaatgctactacagcagtttaaatgaatgagctgaaggtacatgtatcaacatggataaatgtcagaagcatgatgtggactggaaaaccaacttataaaatgatataatattatgccctttatttaaaaacttagaatcccgaaagaataccttatattctctatcatacgtgtttatataataaaattatttaagaataatattacactaaccatttatttctggggagagagaaagagtaatgggagtgggagagtctaaggagatttttttttaataagaatatctgaaatcagtatagagaagtgtcaaatttgtgaaagtagaatagtggcatatgtggatttttttttttttttttttttttttgagacagagtctcacttcgtcgcctaggctggagtgcagtagtgctaatctcagctcattgcaacctccacctcctaggttcaagtgattctcctgcctcagcctcccgagtagctgggattacaggcatgcaccaccataccagctaatttttgtatttttggtagagatgggatttcaccatgttggccagactggtcttgaactcctggcctcaagtgatccacccccctcagcctcccaaagtgctggggttacaggcgtgagccactgctcccggccatctgaatttcttcatgcccttctgcatgtttgaaatatttgatgatgatacgagtttacattttaaaatataatttatatcaagtacaacatgtctaatctgggggtggagggtagggtctcctcagtgctcctgtcactcccttgtctccagagcatgactgagggctgccccttcaagatgcctctctgcaggaatttcagagtttcaatgtctctcctagaaaatgctggaagagcagctcatcacacatgcatctggcgaagcctggcggaccttcatctacggcttctatttctacaagatagtaacggacaaagagcccgaccgaggttagagccgaggcgaatgcggttgcccacaggggcaagtgtttttcctggtgacttgctctttcacatgatggtgcttcctgagctgcatgtgtgactttgtattataagttgacagatctgtcaacttccttgagcctttgtacttaatttaagcatagccagagtgacaagggtttcttaagctacagtgtgttcttggtgagaacagtgtgggtgaaagataaagctaaaagaggccaagggacctggtgtgaggaaattcccacacatcagtttttggtagctgtttttaattagagtgccccacccccttgcccacccagcccaggtggttctgattatattatcatgggctccagtctgtgatttatagcacttttcacttgctagatctccagttcaggctccatttctaaccccaggaaactatcaagtcctagcaagttttccaagtaatattttaagtatctgtggggttttt

SEQ ID NO: 103365 - DNA, 1064 bp, Homo sapiens
aggatgtttcagagacgtgtcaatcaagttcctgaccaggctaaggccctaaaatacgctcagaagcaaagaaaaggtcaggcttctgttctgcctggctgggcactgccagacctagggtttctgtttgttttttgcctccctgaggcacagtcttaagagatcctgagaacatgtacccccagacctagggtttctataaactataatccacccctcattctcccttacccccatgaattcaacagttttcttcagctgaagtggtcagtttagttctgggttctgcagatagaagccctgagtgggtttttctcactgacaaagataaacagctcttgcgtcagcaattttaatgagcttctgttgtaaggcaggagagctccagctaggtcactaatggcattcaggcaaactggcattcagctgccagatgtaccactcaccattctctcaaaagactaagtccaggaagtgtggttagcaagatgaatatgagagcagagattaaccaaaagttgacagaaaccggagtaagagaacgcctgaaagagctgctgagctaaattaattgaatgtggctgaaaggatgagttgataaagataatgtaaagataatgattttaagtgatatgttttttgcttttgcattaagaggtaattaaagagaaaggactagaacacgttattgtcgatgacttggtggctgaaatcactccaaaaggcagagccctagtacttgacagtttaaagaaggagctcctacaaaaaaataaaaacattccttgctcagcctgtcagtctttaagattgacctagattgtgttgttctgtggtattatttttgaaagtaatatctgccataaattagaaaaccattcccaaaataaaattcattttttagccgggcatggtggctcacgcctgtaatcccagcactttgggaggccaaggcaggcggatcacctgaggtcaggagttcaagaccaacatggagaaaccccgtctctaataaaaatacaaaaaattagccgggcgtggtgatgcatgcctgtaatcccagc

SEQ ID NO: 103366 - DNA, 1054 bp, Homo sapiens
cttgcgtcggcctcccaaagtgctgggattacacacgtgagccactgtgcccggctggtgttgtatattctgtaggtttggacaaatgtatagtgacacgtatctaacatgatatcctacagaatagtttaaccgccctaaaactcagtctgcttttataaagttttattggaatacagccaggcaccttcattatgtaacgtttgtggctgcttttgcactacaatagcagagttgagtagttgcaacagaaaccatatgtctcacaaaatgtaaaatatttataatggggccttttacagaaaggtttccaatatctagatgatttccaggaaacttctggaatctgcagttttcttttaggcacttgtatatagtttcatatctggatacttagttatttgttcttcttcatcccactccttttctcactctcttggggcccctcctgtgtgctgacatagctgccactgtcccagagcagaggactgtgaccctggatgttgacgtgaacaaccgcacagaccggctggagtggtgcagctgttattaccatggcaacttttctctgaatgcagcctttgagatcaagctgcactggatggcggtgaccgcagcagtactcttcgagatggtgagaaccttcatgcatgttgtcaggcctttggctcacctcacagtgggcatggagatgcttgatagagattcatgtcactttaattttttagttcaggctcttattaccattcatcgggactattggagtaacctttttaaaaaatttaaacatagtaaaaattttaagcaatcaaaaaaggtagaatcagggtttcttagccttagcagtattgacatctgaggccagataattctctgtgggggagtcctgcaccttatgggaaattgagcaacaaccctagcctctacccactaaatgctagtagcacagccccaggtgtggtaagcaaaatgtccccagatattgtcacatgtccccaggaagggggagtattgctccctcttgagaatcactggtttagagtgaaaagtaagt

SEQ ID NO: 103367 - DNA, 1055 bp, Homo sapiens
aaagttagccgggtgtggtggcatgtgcctctaatcccagctactcgggaggctgaggcatgagaatcacttgaacccggcaggccgaggttgcagtgagccaagatcgcaccactgcattccagcctgggtgaccaagcaagactctccctcaaaaaaaaaaaaaaaaaaattagttggccatagtggtgcatgtctgtggtcctagctacttgggagattaaggtaggaggatcacttgagctcgggaattcaaggcttcagtgagctatgaccatggcaactaacatgcatttacagtttatcttctgtttgtactttaatatcatgctcctttcagctttgggtataagaagtcattcgaatgagccttatattgagttctggtagctcacactgactgctgaggacttcaccttcctagacccagctatagcttgcttgggggaagggatggtgtgaacacacagctgtcctttctttgacccttgggatggaggccagtctttctcaaagggcgtagtatggagaagcagaggttaggctcaaggggactgattgccaagagtagtaaagggtacagaagactggcccagagagaattacaaaccttgtgatcacaacccaatatttattcttattttcctttcaggctttgaacccgaaacgtactgggatcgaatgcacctcttccaggaagccattgcacacaggtttgtcccttagcaagtgtgaagagtgggaaggaaatcagtgtttatcttgaatagcagttaccaaagtgaaactcatttttttagctcctagagaaagggatgtattccaccaatggcaaattcactgcttatctccaacaggactctttacattggtttttgagataagcgctgcctccctgtttcctgtaactattgtttttcagacctcattattttcttcttccagttgagtggagaacatagaactctctccttagcctccaacaagaccctaggccaagctattcaggaaataatataaaatgaaaaattaaaaaatgtgtcaagagcccaaca

SEQ ID NO: 103368 - DNA, 1076 bp, Homo sapiens
cacctaaaccccccaccttccacacctaaagccccccaccttccacaactaaacccctccaccttccacacctaagcccccccaccttccacacctaacctctcccacctttcacacttaaacctctcccctgttccacacctgtcagaatcttcctccagggattcccaaatgtttcctctctgaattcctctttccctttctttcaaaacactctgaatgtattccagtgacttgggggcccttggagggcaggggtatgctttttcctatttgtgtttccttctataatgcctagcaaggtgcctgcctagagtagtttcatatgtagcttttgcatagggtggagctttaagtgcaactgtggctctaaatgacacatcagcccacccataaggtccatctcagaaagagctaaaaaagtgtccatcttcctcagcccctaggctgtgacctacagctcctccttcatcttcctcagcccctaggctgtgacctacagctcctccttcatcttcctcagcccctaggctgtgacctaccgctcctccttcatcttcctcagcccctaggctgtgacctacagctcctccttcatcttccttggggcaggtggagatgattatatcccctcccctgcccttactgcgtttctgtcttgcattctccctgagtggacagtcaggtggccaggaaccatgtggttaaattgcctttttgttctttcctggtgacctaaggaagaaatgaggtaaaaaaaaattactctggtaaaaaaaaatcaggctgatccatgctgaggaaatcagtagccttaattagaaagtagagagaaagcaggctgggtgtggtggctcacgcctgtaatcccagcagtttgggaggccgaagcaggcggatcacctgaggtcagcagttcaagaccagcctggccaaaatggtgaaaccccgtctctactaaaaatacaaaaattaactggtcatggtggcgcgtgcctgtaatcctagctacttgggaggctggaagcacaagaattgcttgaacccgggaggtggaggttgcggtgagccaagat

SEQ ID NO: 103369 - DNA, 1018 bp, Homo sapiens
gaggatccccttgaactccgccttagacctatacattcagaaattcgggcggtgagactcagacatctgcattgtaaccagctctcacaggcgatttttagctggcttaagtctgagaattactgcccatgattatagtaaatgtatcctttgctggccttttggagggagttccgaaaaaaaactgccaatacaaaggctccctaaaatcttaagtcatttggaaagctcatttgaaggcttttgatgttaatatcagatgaaatatgtagttggggccaatatttaggattgttcaggtaagaaaggtgcttgaagagttgcctttcctctggtgtccttgttacacacataactgggtgtgtttggaaaccagcaacaccgttgcccgtatgttgatttgttggtgatcttgacttgagcactattagcatgctgttgtggtgaggcaggttttcttccagaccgggggacggtctaggtctggaggctgaactttatgtaattcagggggtcctttaaaagaaaatctaaaatatagttttgcatattttacaaaaatgggactgacgaatgcatttccttggaagggaccctgaaccttaattttctgtgggataaagctgcctctgtccacagcaggtcacacttaagcccctcctccccagtaactgagtggtgctgggattatgcaggctgaggcctctccacacattttcatgaagtggttgctcaccctctaagtgagacgtaaagactgcagtgttcggagccctttgggaaataaatgtggtgaaaagaaaggagggacgaggtttaaaggaaggggaaatggaggttaaggaaaaatggctagaaggtgtgttctggaacaatcagaaacctgaggcaacttgaaatgggggaaaaaggcaagaatggagagatgttaccagaacgaaatctagtttgagcagagaaaaagactggctttctagtaggcttgtaaaatgctttcctgcagcaagctacttgtgtc

SEQ ID NO: 103370 - DNA, 1184 bp, Homo sapiens
tctccataatttgaagaagcaagaaatgtttctgaagtgaagcataaaggagtatcttcaagctctatctcatacctaccagcttgcatagagtataatagtgggaagaaatattgtgaaagattctagaacctaagtcctttctaggctaggcaattctaggctacacaattcgtagtctctgtaaataccatttgataactgaaataaacctataaagtgggattaaatgttagtccagaagactaagtgatttaaggaaagagggaaaataaccagatagatttctggtggatattcatagacagacataatttcatcatgtattatggccctaagtcatctattttatattaaaacatagatggtaactgtaaagttatcaaatgtaaaaattactgggctagcattgtgttttaacactgatacaccagttgattacagtgttgacagaaaacgggcagaaacacgtttaaagtacctgcagaatatatatatagaaatcttttttttttaatcagtgttgaccaggttggcctcgaacgtgtagcctcacctccccgagtgccagggcaaccggcctgagccacagcggctccctagaaatcttaagtgcaggaaacaaaactacagtttaaggaaacaggagtcggagaggaggggcatttggcccaaccactggcaaaaggctgttgttgcaacaactgtgagattctgggaagtggggaaatgagcaggtgctgtgtaaaagtgcacagctgactgccccaggtgagacagatcagtgtcacagagagtaggaggattttgaggtgtgattagtattttttttttttttcttaaagagatggtctcgttctggaacccaggctggagtgcagtcgtggcacgatcataattcactgtagccttgagctcctgggctcaagtgaacctcctgagcagctgggactacagatgcatgccaccgtgcccagctaattattaaattgtatagacaggatctctatatggtacccaagttggtctcaaactcctggcctcaagcagtcctcctgcctcagcctattaaagtgctgggattacaggagtgagctaccacacccaaccagtaggaaatcttaaagccacattgatactacagtttgaaatatgtaaaaactagggagctatgtttcccacta

SEQ ID NO: 103371 - DNA, 1033 bp, Homo sapiens
gcagtttcagataaatcatgggcattgctggactgatggttgctttgagcccacaggagctccctttttgaattgtgtggagaagtgtgttctgatgaggcattttactatgcctgttgatctatgggaaatctaggcgaaagtaatggggaagattagaaagaattagccaaccaggctacagttgatatttaaaagatccatttaaaacaagctgatagtgtttcgttaagcagtacatcttgtgcatgcaaaaatgaattcacccctcccacctctttcttcaattaatggaaaactgttaagggaagctgatacagagagacaacttgctcctttccatcagctttataataaactgtttaacgtgaggtttcagtagctccttggttttgcctctttaaattatgacgtgcacaaaccttcttttcaatgcaatgcatctgaaagttttgatacttgtaacttttttttttttttggttgcaattgtttaagaatcatggatttattttttgtaactctttggctattgtccttgtgtatcctgacagcgccatgtgtgtcagcccatgtcaatcaagatgggtgattatgaaatgccagacttctaaaataaatgttttggaattcaatgggtaaataaatgctgctttggggatattatctctgtttggtcttgatttttcccccctcgaggaactgtttaaccagtcacaaattgtggtttgaatctctcaaacatggaagcatttgtagtacattatccaagttttcctcccctctcattacattacatattttgcagcacacacataggattcatagattttaaatagttttctgtgaacccagctaacatagcctctctgatcaattttcctgataactggtgctttttaatgagcctcgcagaacaaaatgcagtcttccacagtatagcacctctgaaacattgtgggctctgttgaacttgagagtgtatttaacactgaaggtaaatacggagcttatacacgtcctcaagttttctt

SEQ ID NO: 103372 - DNA, 1511 bp, Homo sapiens
ctctctctctctttctttctttctttttctttctcagagatggggtttcaccatgttgcccaggctagtcttaaactcctgggctcaaacaagcctcccaccttggcctcccaaactgttgggattgcaggcatgagccactgctcctggctccatttattttcttttatactgtatttttactgtaacttttctgggtttacatacacaaatcattaccattgtgttacagttgcctacagtattcactacagtaacctgctgtacaggtttgtagcccaggagcaacaggctataccatacagcctaggtgtgtaggctatcccatctagtttgtgtaaagacactctgtgatgttcccacaagggtgaaacttcctatgacgcatttctcagaacatatcctgttgttaagtgacacgtgactgtatgctaatcgatagcctgcttctctgggctttccacaactgaactcccaatgagaaaaagggaaagagctcttttaccaaggacccgccaacatgtgccgcgtttgcaccaaaaccgtgaagaaggcggcccgggtcatcatagaaaagtactacacacgcctgggcaacgacttccacacgaacaagcgcgtgtgcaaggagatcgccattatccccagcaagaagctccgcaacaagatagcaggctatgtcacgcatctgatgaaatggattcagagaggcccagtaagaggtatctccatcaagctgcaggaggaggagagagaaaggagagacaattatgttcctgaggtctcagccttggatcaggagataattgaagtagatcctgacactaaggaaatgctgaagcttttggacttcggcagtctgtccaacctgcaggtcactcagcctacagttgggatgaacttcaaaatgcctcggggacctgtttgaattttttctgcagtgctgtattattttcaataaatctggcacaacagcaaaaaaaaaaaaaaaaaaaaagggaaagaagaaaaaattatagcagctctcttcatccctcatctttgctggtgtctcattgtcaatgaggccccttcacacccatcatttgagagagtcattgctgtcaatgctgtattacagatgttcaaagagagggttgcaaatgccaagtgagctgtcaatggtctactgcttgttggtagctgagctgagaatcaaactagccaagtaggttctctcttcagccccttacttcccaaaactcacagactctgcacttaggctgttgatttctttgtgtggcaagagttcaggagctggccattccactgtggggtcctttgccaagaagcacagtttagccagtgagaggtggacattgtaccattgggtctcctggggagaagctcccaggctggtaggagaggtggaacccccaagggtcctggacagatgagtgtggaaggaggaagaggagacaggacagttcccacatagtgatgagtccttaccctgcataatgctgggttct

SEQ ID NO: 103373 - DNA, 1013 bp, Homo sapiens
gctcaagcgatgttcccacctcactctcccaagtagctgggactacaggcatgtgccaccatgcttggcgaattttttaattttttgtagaagcagggcctcactatattgcccaggcttgtcttgaactcctggcctctaataataatagtagtcgtcataataaatgtaattattaattattattattgttattattaaagctctctaaatggcattttactctgtgtaaaccagggaagaggtgaaggagaacccagtgctctagctgtggcccactgctgtgatgttgatgagcagcctcctgggctcctctctgctgttttctagctgctatttccatgggtcagttaggcagcaaaggcctcctgcagtctctaacggctccttaggggagaacatgctgggtaatttttctgcagcagctgaggggcccttcaggtggcagggatgggctaagtttcctcctaatttgagtccaccttttgtgttcatttcaggccctggttttggtggttgtgctgggctggctgtttgtccccatctatattaaggctggggtaagtatctgctctgttatttcatttcctgctggcaaatgtatctgtcagcttggtcttcctagagggcagaggagacattatgggataaatggcagaaaaatctgtggattggctttcactcccaggttatgaaattcccgactgtctgcagtggcattatatggatatattcctcctcctcctccagggcaagggtctggctccttagtgatgcccagtgacaggtttattgggctgggataacacctagctactcctacagtggtagggcatatgggattaaaatgagcaaatggctggaggtcaggggccatctggccacctcgcagacttctctggccagcaaaagttatgaatccttgaccacacttctgtggctctgatattaggatggtgtcactgttctgtctgctctgggccctctggtcactgtggctggcagtgacctcc

SEQ ID NO: 103374 - DNA, 1023 bp, Homo sapiens
gtgttgaagggaaatcagccagttgtaaattttgcccaggtggataaatgtgtacatgtgtaattataggctagctggaagaaaaccattagtttgctgttaatttatgcatttgaagccagtgtgatacagccatctgtacctactggagctgcagaagggaagtccactcagtcacatccagaaaaaggcagactaagaatcagaagccatgtgattgatgtctgacgtgagtctgtctcaggtagattccgggtgtcagtgtggtttataatccttgaatattgttttagaaactttggtctccctggttcctgccacttttcctgtccgtcctcctccccattttttttttaaaagaaagctgttttcccctcatcatatccctcttgagttttgcctggactttccctctcaagtgtgtcaatcaggtaaactgaggaatgcatggaagctgaggatggagcttgatgggctccctgtcctgggtgtttgctctctgaagtggaggcctgaggaaggtagtacttccacaaaagggagggacccgggccccagcctcaagctagtgggggaggcagatagcctgaatccaggggattttctgggcttcttaaaatgtccattgtgagttccccgtgtttgggattccactcattttggcattcacagtgcctggaatgtcttagattttcagcaatgcgtgttgaataaatgaatgacataggcatttatttttaaatctttgcttgctttttacatgagcctggcccttagttaaccttttcttgtggctacacaaagtatgctcactggttactaatgacttgggatgcatttgtcaaactgattatattagttttctagggatgccataacaaagtagcacagaccagatggctcaagcagcagacatttattttctcacagttctagaggctagaagttggaggccaagatgtcagcagggttggtttcttctgaggcctctctccttggttgcagatggtcatatctcactct

SEQ ID NO: 103375 - DNA, 1077 bp, Homo sapiens
gctctctatagccatgagttcaattgtttttgatttttagatggcacaagtaagtgagaacatgtgatgttttgtctttctgtgcctgacttatttatactggattattctcaggtgaccaggaaaatatgcaggaaactccacatgctgatgtgtattgataaggacatcagttaacctatgttccagatgatacttttaacctttcaaccctctctggtttagcaaggcagtgtccagccactaaccagtgcttgtaccctttcccggctccaggactgcgaggcctgatgctttcggtcatgctggcctctctcatgagctccctgacctccatcttcaacagcgccagcaccctcttcaccattgacctctacaccaagatgcggaagcaagcgtcggagaaagagctcctgatagctggacggtgagtgaaccctggttcccacctagaatcctctggagaagtacagacgtagaagtgaactagagttcccttgtctttggctttggtgaaagtaatcatagcatctgggtagagggaagagacattggagtacatcaaattcaagtgatcactttccagatacaaaaatttgaaccatacctttaaatgaaataatcactttttcagtctttcaaatgcttctgaatggctcttatttcttcccctcctcacatcacccccctatccacatcttcataaaactccaccagtattttaatagggtgtaaaatttccacctactctgataggtgaatgcattgtctctagcagtttccatgtatatcacatggaggtaatggattaagtcttccacacatgaacacagaggagtttatcagtcatattcattaatgattgggctgtgttacaaaggagcagggaagggactaattccaagaggatgcttggagagttaagtcaacccaggggaccctgagcagcctgggggccttgaagatagtggaagtgagatggagggaaacaagaggaaaaaaatcgataccagaatgtcctttttcaccttcacaattttcgagaagaccctatattgtcatagcattttttttttt

SEQ ID NO: 103376 - DNA, 1050 bp, Homo sapiens
cctgatggactaaaattaggggtttatataacagggaagatatgtaaccatgtgtgggaaaacaggaattaggggtggggataaggaagagaagtcggtcaacaggaagctggtggtgggttagacaattataatgggcaaggggtctggcttctcattgtccaggtgtgttgatctagtgagtttcagctctttgaccctatctgggagaactgatggttgatttcctgagagaggaactcagataagacaaaggtaactttctcaagttgtaacactgggaggatcagtttctatgcttattcaaataaaccacagacatcagttctatgggacaactgggccagttccgtatccacagtgtttgggtaaatctgtcaggcattcatttattcacttattttttctcttcaatcatgaaacctgggtccctgcccttcacctggcctattgctagaaatatacagaagacaaaaaaatcaaatttcttgcctagagaggtttccagtatagaatgtggctgcagccagtggggaaatcaatggtgcccctgcataatgaccctggagcagagatgacaggtttgatggcagagtaaaagtgaaggcaatggagggggaagcattatgatcagctctaagacttgaagctcgagggtcggagtgcccgaggccaccattaatggagccagggattccagatcagaggcaaatgatggatgacaaggagaatgatgacttcacttatgtttggtgcattcaaggcactaaggtggagacacccaaccggcagtgggaaagtgagatctgcagattggtcaggagagagaccttggctggagttatccatgggggggtccttctcttcagaagcatggtttaagcacccaccctctgccagtcactgtgcatggcatcagggatgcctctatgagtaagaagccatggttccatcaccaggaaggggccacacacaggactttcactcacaggtgcttaggaaatgctgaataatctgaacgcacagggccctaagggtaagttaagtccc

SEQ ID NO: 103377 - DNA, 1010 bp, Homo sapiens
aggttctggtgtgtgttttatttacttacatttactacatttcctagttatacaagtaatacatgttctttaaagacattttgaaaaatacagaaaaaaaaaaaggtgaaagtgttttggaaatcagcactgaccaacatcaggcttacttcttttttaaatttttgctaatttcataggcaaaaaaaaactctctgtattattttagtgtgcatttatttcatcacaagtgaagtttggtgcttgtaaagactgtgttttcagtggacttgtacaatgtttaaattcctctcctgcaggctcctgagtcctataagaatgtgacagatgtggtaaatacctgccatgatgctggaatcagcaagaaagccattaaactgagaccaattgctgtgatcaaaggatagaaccttggacagcagggctgcctgacaccaccaaccctctctgaagtggaagtggactgacatgctcttctgacatcagactcaaggcgggacaagttgcaaagtgtgcagctgtaactgctcacgccaaaatggctgatggggaggctgctgctttcaggggcccgtgcttgtaaaataaccttccaggaagaggcacattgcccacctttggaaagggaggaatatgccttctccttggttgttccacagagttttaggaaaatctgttagggatgggtagatgtcaaactgccttacgcagtcatactgatctttagccatcagattgatcttcttcacaccaagctctgtttacattccgagaggtgtcatgaagaaagttctgttcaataaggttttggaatgtttcctttcgtctgttgctttgtcagtttgtccattcatccacccatttaggcatcacccctgcactcagcaaaaccctaaatacccctcttacttggagagcacccagggagttgtaatcaggctgttagatgaatggatagtggaacacattgaagagggagtatggggaggtttaaggaatagcggcccaaa

SEQ ID NO: 103378 - DNA, 1026 bp, Homo sapiens
agtccattttattgtgtgagaatttaataatttgtgccagcctgaccctctagactatttaacctagcagatgtacgaagtgtcaactagtgtttcagaacattcccctgagtacttctctgcattttgtcatggatttgattaatcatgaaggcaacaaaatgtattttgctactactattcccatgcattcacatattgagaaaggagtaatgaagaccatcttgtggctatttgtttacacatcccattctctttcaagttcctagagggcaaatgttgactttgtgtcccacaaactgtcactgcactctgaaagattctcaagtacgtcttgactgagcaaatagatgaactcagaaacacattaaagggaaagttggctttcattgggtttttttgtggaatgaatttgaatgtagcctacctttctgcagtaaatctgaactgttcatttaagggaaagctaactggtttggactttgtggctcttgttccagatgcgctggtagctatggagaaggccatgaagagagacaagattatagtcaatgatcggcagttggcttgtgctcgaatcgcttccccagagggtcaagactatctgaagggaatggcagctgctgggaactatgcctgggtcaaccgctcttccatgaccttcttaacccgtcaggtacagtagaagttgctcttctgttccgagtcattcatgatgatgttaagtgctttaaaacatagtgcagtccaggctggacacggtggctcatgcctgtaatcccaacactttgggaggccgagggggggcggatcacaaggttaggagatccagaccatcctggctaacacggtgaaaccccgtctctactaaaaatacaaaaaattagcttagctggtcgtcgtggcgggtgcatgtagtcccagctactcgggaggctgaggcagcagaatggtgtgaacctggaaagtggagcttgcagtgagccgagatcgtgccactgcactccagcctgggtgacagagtga

SEQ ID NO: 103379 - DNA, 1308 bp, Homo sapiens
ccatggtggtttgctgcacctgtcagtccatcatctaggttttaagccccacgtgcattaggtatttgtcctaatgctctccctcccctttcctcccactcctcgacaggctctggtatgtgatgttcccctccctgtgtccatgtgttctcattgttcagctcccacttatgagtgagaacccgtggtgtttggttttctgttcctgtgttagttttttatatgtgtataccaagcatataatgatataacaaaattcaggagctagtctacgttattttgttgtgtagaatattgtaaatgaaacacttctatagcttaggaatttttttgttactgaaacactatttgtatgtttattttgttgttagtttgtttttatctttttggtttttaaatagattaaaaaaaaaactggaataaaaactatcttaccagacatttttacatttgcagttggggaccctgggagcaggcaaccattatgcagaaatccaggttgtggatgagattttcaatgagtatgctgctaaaaaaatgggcatcgaccataagggacaggtgtgtgtgatgatccacagtggaagcagaggcttgggccaccaagtagccacaggtatattctagactttgtgctaaaatgtacattttatgggcaaccagatagaaatttaagagcgaaaactctgaaatatactgcatgggttttatcctgagtcctcaacaattaaataacttggacaaattcactgggccataactttcttgtctaaaaaaatgagtataatagttatttcatatagaattatcatggaaagttaataatatatgtaaagcacttaatgtttgacattagtaaacactcaataaatgttagttgcagttattgttatgtttactcttatgagttactatctggccaagaaagagcaagaaatgtgtaaagagtggaatttatgaaataggctttcatttggcagattatgtatcatatacctgctctgcaacagtagatgtgatggtggatttgctgatgaaagaggcagatactttgcactcaaattgtctcatgaagtaaaggtcatgtccatttaaaagaaaaaataaatattaaaaggtagcaattaattatataggagagtcaaacaaaacacatttaagaaaaagattttggagatggcttcatggacccagtgttgagctggatctcacagtttggacaattacacacaaagactggtgacaaaggcagcatgaacaaaagcaggaagcagcgaaatattggataggtccttttggatagcttgg

SEQ ID NO: 103380 - DNA, 1621 bp, Homo sapiens
gaccgtaattcataaatgattaaggtgtgtacctggttgaattagtcgttagagagtgatagctgattaaggttacagagttgttgttgttgttttttgttttgttttgtttttgtctgtttaatcactacctcatggaattcaggatcagagaggcaaaactgaatataaaaaagatttgaaaattaacaaggagcagtataaatgtcaagtagaactataatgatgtctaatagggcatttatcattttatattggaattatttatatgactgcattcctcaaaaaaccagttactgagagcttaaactttgtatctgactcaaggcttggaacacaggagatagtaaatgtcgagtttttctctgccctttaaggatgtggtcatccttaggttttgatctgcctttgctgtgagatgactagcaccttttatacttatccagagacttggaggaggccttggagatgggggtggactggtccttaagagaagggtatgcctgggctgaagacaaggagcactgcgaggagtacggaaggatgctgcaggctgaccccaataaagtttctgcaagggcgaagaaaagaggccttcctcaggtaactcactttggaggggcaacatgttaatttttttttcatattttgtttttattgggggaaaaaaatctatatcttacatttagcaaacatattcccaggtttttttatggtatatcaaaaaatacaaatttgtttatgcttcatttttattctaaaaaaactatcagggctggatgcggtggctcacaccagctttgagaggccaaggaggaaggttcgcttgaggccaggagttcgagaccagcctgggcaacataagaagacttagtctctacaaaaattaaaaaaaaaaaaaattagccaggcatggtggcacatgcaagtaatcccagctactcagaaggctaagacaggaggactgcttgagcctaggagtttgaggctgcagtgagctgtgatcacgccagtgcactccagcctgggtgacagagcaatcaggagcttgcaaatgttcataaaataagaaataatgaattagaagtgaatgggagaaaaatagaatatgtttatcaggttcatacgtcaaaattacatatatacatattttgacagtctacagatggtatccatgagataagaatatactagatgtttgaaattacagctagttgtgaaggctttgccactaattcagtgtgacacgtgggcaagactgtcttctctggatctcattttcttatggaaaactgggatggttaaaactaggcaacctctaaagactcttccagcactgacattctctagttctctaaatcatctattaatattagctgtagttgtggtatatgttctttcagttataaataatggtggatgtccatgaactcatagatgtttcaaaatcatttgaacttggaccttgtctaagagtcaacatttaccaacatttatcccaaaatttgactctttgtgatgtttaaaatatcccatgaaccatttaaaagcttgattttttttgtttatgaagctttttttaaaaaattaatttatttactttaagttctgggatacatgt

SEQ ID NO: 103381 - DNA, 1061 bp, Homo sapiens
aaataaaagtacttatgtctaaaattttgaggtcactgttaatgtcctttttgaatggaaacatgcagccttaaatgcacaaattgggaaagaagaaaggctggaatatcagtgaccctagaaagcacaacaaattataccctaaaaaagtagaaagatggaataattaggagtaaaattagtgaaatggaaagatatgttatagaaaggaccaagaaacgcaaaagttggttatttgaaaagactgaaaaaattcatgaacctgtgaaaacagtggtcaagaagaaaagagaggcatattttgatctctgttttacatgttactcaatgttcattgctgcctcccttgtccataaagtgcctttagtgtgtatgttactttagattatcttggtgtcatcaagctttactcagcaaagaaccactttgttgtctactttaaaacatagttatctttaaaagaatgggtatctttatagttccatattaatggcgagaaactgcaggtaacagtgccttaccagctggttttgctaacttttctctattttgtaggtggtgtcgggtttgacatcaactgtggtgtccgcttgctaagaaccaatttagatgaaagtgatgtccagcctgtgaaggagcaacttgcccaagctatgtttgaccacattcctgttggggtggggtcaaaaggtgtcatcccaatgaatgccaagtaagagcacacgtttccagtacatggtatgggagggataataaccacatgaccttcagcttcctttccagtgcagtacacttgagagatgaggattgttcagttacttttcaggaagtagtaagaactgtttttttaagcatgaggtacagcccatttattggagacattagtcaaccgatgttataacagcctttgacatagagtagtatttataataacatcatatccaccaacgtttattgagcactttctatgtgtaaggtgctgagcatcatatcatttcatccagacaataaccctattatcttccctaacttacaagaaagaaaactgaggtttagagagg

SEQ ID NO: 103382 - DNA, 1056 bp, Homo sapiens
aggctacagtgagctatgatcacaccgctgcactctagtctggcatgatctcaaaaaagaaaatccatatatttggaaattaagtagtatacttttaagtaacccatgagtcaaaaacaaaactatggaaatgagaaaataactaatgtaagtagaaaatacttgtgtctaaaaattgacattgagttaagtaaaggacacccttctatgctattggagggagtgtaaattggcacagccattatggtaaacagtatggagattcctcaaaaaatcgaaaatagaactaccatatgatccagcaattgcatcactgggtgtatatccaaaggaaatgaaatcagtatccaaagagatacctgccctcccatgttcattgtagcattgttcacagtagccaagatacggaaacagcctgaatgcattattcaaccttaataaagaaagaaatcaatcttttaaaattgaagggaaaagacagggaatcctgccatttactacagcatggatgaaactagaggatatgctgagaaataggccagacacagaaacgaaaatactacatgattttgcccatatgtgcaatctaaaaatgttaaactcacagagagagtagaatggtgctaacagggtggatgttagagtatacagaatttcagttttaagatgaatgagttctggaaatctaatgtataacatagtgactgtagttaataataatgtattgtattgtattacttttaatggcaaaaagcacaattacttttgcaccagcctaatacctatagtcccaggcaattcagaggctgaggtgggaggatagcttgagcccaggacttggaggcttcagtgagctatgacctagcctgggcaacaaagcaagaccctgtctctaaaataaaatattgtgtacttgacattttctaagaaaataaatcttaaatgttctcaccagaaaaacagaaggggaagtaactgtgagatcataaataggttaattagcttgattgtgataattacttcacaatgtaaatgtacattgtgtacacctaaata

SEQ ID NO: 103383 - DNA, 1063 bp, Homo sapiens
agtcaccactagagcacaataaaatgtaatttgctattggcttaaacacagaataaacatactaggttagatgactacgttttatgtttagaattggactttttgattcatttggtttttttttttaattttcaaaaaaccattgatatttttgaagcttgaggattaagacctttgggctttgtgagagtatagttggaagatttttctttatcacaaaaagatgctgaatctgttgaattcttaaatgtggttttgagggtatgagaataaacaaaacaatttgtgaacattgcagaatttttcttaaggtatattttccgatgggagcagctcgtagtctttgataggaagttttctgtgtgcttaaggtaacgtgaaagtgtttggtaaagagtaaagcacagtaaatattgcatacagtgcattctgtccagtgcctacacttgccgcgcatgtactcagacattgcttttcactttccttggtactaggttgaaggtgttttctatgtgaatgatgctctggagaaattgatgtttgaggaattaaggaatgcctgtcgaggtggtggtaagtacattagagtttcacttgtgttagtacggtagtgccttccctgtggcctgaaaaagtggcaactcaaataattataattctgaaatattgtcaaggagtgattacaacttaaaagtaagaccaaaagcacttacttatttgtgatcacattgtcagccagttggcgttatagaacggatttgaagctccatctggaatttgaagctgggtagaacttgtttctcagctaaccttgaacaataatagcaagtgacctaccatttgttttgcacttactatattccaggcatgttactaggtgctttgcagagattatctcatgcaatacttacagtgactctaaaaggagctcccttccatcttgcatctcaaacatccttctaggctttgttgtcttagtagccctaatgactacctcttcacgttatacagtctaaaaacatgaatataattcatgctaaaaatcaagtgtgttgtcttttct

SEQ ID NO: 103384 - DNA, 1463 bp, Homo sapiens
tgtatatccagattcattctgaaacataaatgttcagctatggtatttactcaaacaggtttttctttctcagctgctggcgttatctttttcccctcccagctgagggtgtaaactccaagccaatgcaccgaacctgacccagactcaaggtgttttcataagctgctgaaaagcatttccaaaacaaaagataactagattatactttaaacttctggatttcgcttagctgtagtttagaggaaatcgactaataaagatcctaaagttatacactacaggacagtacaacttaaccagaggaaagacattggcctgaagaattttgagcctcggcgcttgccgttgctcatctgctgcggcgctggtcgcgcctgcgctttggttcttggaaggcggtgctctgagaagccggactacgcggcagcggctcttcaaagcggagccgggagtttttgctacagttttcgccaccatgagtcgcagctataatgatgagctgcagttcttggagaagatcaataaaaactgctggaggatcaagaagggcttcgtgcccaacatgcaggtaaggcaggagagcaaatggcggggccttccgtgctccgtccccggcccggccggcgtccactgcgccctctggacctcccctgaccactgggtccgccccggccccttgcagagtttccctcatcccgtccttctcccctcacggttctggggccgcccaacctgttccggcaccacctcccgccaggagaggtccccgaaccacgaggacaagctaagtgcggtggatatgggaatctaaataaatacgaaattggggtttccaaagcgttttcacagatcagtctcataaacgtatcgtgagctgttttacgttcacagaaacttcagtgatcttttccagggtggaacagccagccccaggttcatttgctgggactggaattcacctcctctgagtcatgctggttatttaaataacgtttacaaacctttgttcactaaaccaggttttcagcattcagtatcgcatgttggtttttaataaagcgatgtcatttcttgcagtagcgcagggcagggcctgtttgattttaatattcacttcacagaaggacctcgaggatctgtcggtgacatagcttcctctacccacctaggaagaagctcagccaggacttgatgtccggtttacttctttgacgtcccagatggagacttgagggctcaggatcatcagatagtttgaaagcctgggctctgtatctctcggccttcatcaccatctgtgctcatatttttattaatgtgaaaaaagaaaacgtttatgaagttttgcaacgtatttttaaatagtttttgaaatccctgaaggtgccaagtaaatgcttcaaaggtttaccgtctcgtctcacgtcttggtaaacagctcccaatagtcactccattct

SEQ ID NO: 103385 - DNA, 1071 bp, Homo sapiens
gctgtgcacctgggggtacaggtacgctggggccggggctgggcggcccgcggggagtggggagtgcttggggtgggtgcagggcgggttggcgtcatctgtgggctgcaggcgcgggcgtggccgggcgataggccaagtgcggggacgccgggggggccttcacgggaggcccgggctcttccgggcgtcgcggagccggagggtgcaggcgacgggaagcgcgggtggtcggctggggtccggctcctggagaacatggcccggcctcccgggggctctggtcccctcctcggtgagtcatggcttctggttttgcagtaaacggaaccagggagaggagggaacgcacaatttccacaactggttagatttcaagttggaaatgatgagcttggcttgggttaaacctttctggactgtgaggggtccgagttaatttcttcagctgttggagtatttcaatgaaaaagtttggaaattgctagaagttaaaaatctgccctcaatccgaggccaccggtagcttgtatcgctgctgtgaagcggcaacaattttagattctgttgtgttcatgcgccgagcaccgcggtgagcgcttggacttcgccgccgaaaagttttagaaaggacagcgtgtaggcgtgtttcagaccatttcattttcttgggtgaaatgttgcttttttgctaaaactgaggcaaacgttgatcttgagagcttgcagtttgggggcagtaaagttgagaaaggatcatattctgttattggtttgtgggactgcaggtgaagctgctttgtttccctaaaagatactttttggggacaataatttgggagtaaagcggcaaggtaagagtggtcctcttcaaatactgagctagtgaatttgaaacttgagtgtgctaaggaaaaatgaaaaagatgttccctggggatttttaggtgaattcttcaaaacaaaagcaaaccttcctacgttttcaccttatttttagggaattgggtaaaatgaggccgttattctgaacttctcgccctttcattttcctggttaagacattattag

SEQ ID NO: 103386 - DNA, 2591 bp, Homo sapiens
tttcaaagatgtcaaaaaaaatttgtgcatcttagaattgaggaaagcatggattagtgatagaggattactgtatcccgtcccccaggtggagagttttagccattagaaatctatagattaggcattcattgataaatacttttgataattttctcaaaactataagcttgatagggtaatgcgtgcctatagtcctagctcctctggaggctgaggtgagaggattgcttgagcccaggaatttgaggctgccatgagctgtgattgtgccacttcactccagcctgggcaacagagtgagactctgtctctaaaaacaaacgaaaacaaaaacaaaaatgtagctggacatggtggcttatacctgtaatcccagcaacccaggaggctgaggcaggaggattgcttgaggccaggagcttgagaccagcctggacaacatagtgagaccttgtctcttcatcacttagttcttctagggtcatactgtgtacttatgtatgcttcagatgtgctattgaaggtattagaagtaggtagttcttactatgcttatctgtctttcttggcagttctaatacccgatttacaattacattgaactacaaggatcccctcactggagatgaagagaccttggcttcatatgggattgtttctggggacttgatatgtttgattcttcaagatgacattccagcgcctaatataccttcatccacagattcagagcattcttcactccagaataatgagcaaccctctttggccaccagctccaatcagactagcatgcaggatgaacaaccaagtgattcattccaaggacaggcagcccagtctggtgtttggaatgacgacagtatggtgggtattaaacaccaatatatcaaatagagtaggtgataagtcatattgaacacctcagttgaattctgttccagtcaggataattatcatcgatagattgcacattttatatatatttttttctttttttttttttttgagacagagtctcactctgtcaccaggctggagtgcagtggcgcaatctctgctcactgcaacctctgcctcccagttcaagcgattctcctgcctcagcctcccgagtagctgggactagaggtgcacaccaccacgcccagctaatttttgtatttttagtagagacggggtttcagcatgttggtcaggatggtctcgatctcttgacctcgtgatctgccctcctcggcctcccaaagtgctgggattacaggcatgagccactgcgcctggctgcagattatatttttatagaatatattttttttaactgccaaatgcctgtaccaatatggggctggcatcccaaagtacctagtgtctgtctgttttgttcacatactctccttcagatcagttattccttgacttctattattgttcctaagctcatgattcctagccttgcttctctgatctggtccgctcattaaggctatagatgtggtctaattatttccagatgacttgcaggatatttatacctggattttaaattgtcattgcagactttagatgttgaacataaatttggaaatatgtgtgctcagttcccttctttgtcagtggcactgctggttttctgtgatttttgactccttaaatctagcccattaataagctttgtcagttcttcttttccatttcgggttccatggctttattcctcagtctgttttctggatttgccttcttcctacatggttctgatgctattgttcccttgctgtctttcataactctatctcataaacttgtgctcataatttttgagctgaaaaagacaatatatctctagttcaaccctgtcattttacagaagaggaaaatggtgtctgtcctcctgtacctagtgctcaaggctttctgaaaagttactccactcaacttttttagggctagtttctgttcttccttcctttaaactgtcatctccaatcagaacagacccatcattttcccccgcccccaccaaccagcacattcacctgcttgcatgcatgtgcacacacacaacctggtgactacttttgtgactttgctcttgctgttcacccagactggaacctgttacctttcctccctctctagtctatatttctacccatcttcctaagcccttgccaaccatagcccaatagttttctttaatttctttgtattgattatctgattatctttattgccttgtacatgcctcctcatttttcccaccttttttttttttggtgacaggatcccactccctcacccaggctggagtgcagtggcacaatctcagctcactgcaaccctacccttccggggtcaagcgattctcccacctcagcctcccgagtagttgggaccacagacaccaccacgcctggctaatttttgtatttttggtagagatggggtttcaccatgttgctcaggctggtcttgaactcctgacctcaagtgacctgcccaccttggccacccaaagtaatgggattacagatgtgagccaccgtgcctggcctttatccgcccttttaattttttgaatggtg

SEQ ID NO: 103387 - DNA, 2754 bp, Homo sapiens
ggaaacaagctttctgagcaaacttaatataggtaacttagttttttttgaagccatgtattacatctcaaagccctgaactgcaagtttagagatctgggttcgtttcaaatttttattagctggtaaccttgattatgttatttaatctttctgatttataattataggatctataaaaaggcgatacctgccatgcctattttataggattgttataaagtgcaaataagaaaacattttgaaaataaagacattatgaagttgtaaggtattatccttcagcatttgttcagcaaacattgaatacctgctatgtgctaggtactttactggggttacaaaaatgggtgacatgtagtctggttttttataaacttgcagtcatggaaggatgcagatatgtaatcagaaaattgcaatacagtgcagtgtgataaggtgcagtaatcaagcccgttgcaaggcagagttgtggtctgtgttacctcttttgaagaagtggaaaatactgggatgagtaagaaggcactggcagaaagtgaacttgataatgagtcagagatcaggtaatgaaggactttgtatgctaagggatttagaagtttggtcttcatttgtagacctgcatttctcagtgtcctctgaaaatctagtttcatgagatggtgtcacagggatgttgactgctgaggacggaggatagtgttttttggtaaagtgttaggcacacactattattgttattagactcctcagtgcttatataatgcgaatagtgtattttgtgaatatggagggtgaagttaggtggctgcagcatgcagtattttccacacttattccgtgtgcaccaccttttttcctaagaacatctaaggcacaattgagggaaatgctgtttatgttggggaggtactggtgaattttaagctgcgacatagtacatgatcagatttttaattgtcaagaaaattctggcagcagggactggggtgtattggaagacaagaaagttgaagaagggatacttgcaacggaagctcttgctggatgtcgggaaataaatgatgagagtttgaagtgccaatagagcaggaaggggcaaattttagacatatttaggagttagtttcagggaactttgaagactgatcagatgtggaacaaggtttagttagggagggaggagtctaggatgatttccaggttcttgacataccagctagaattaacagaggtaaggaattcaggatggaagagtaggtcgcaggcttatttatttgtaaggactcacttaaaatgtctcccatttctgaacccaatgatgtactttgactttcagcacttagttcactttaggatacaaaaatgtatagtgtaaaaataagtctttaattaattcattgttttgttttcctttttcagttagggcctagtcaaaattttgaagctgagtcaattcaagataatgcgcatatggcagagggcacaggtttctatccctcagaacccatgctctgtagtgaatcggtggaagggcaagtgccacattcattagagaccttgtatcaatcagctgactgttctgatgccaatgatgccttgatagtgttgatacatcttctcatgttggagtcaggttacatacctcaggtaagtactgcaagcaaaacacagacatcttatgattgctcatacatgtggatggttcctgctctcaagttgcccgtagtctgagagtggcagagagagacaaaaatataaagcactgtgctatattggtgaagttctgggagaaacatactcatatataggatgccaggaattcatggaggagaacatttagaatattgcttctcaaactttaatgcgctttggaatacctggggaccttattaaaatgcagattctgatttagtaactgtagaatggaccgtgaacttcttcatactcctgcataataccaatgttgctggtctgtgagccatgttataagttacaaagatacagagtagttcggtgatcagtgcacacctgcagcatgccatgcactgacctagaaattaggatataaaaatattgggatatttcttgtcttcaaggagtccatacatagaggagagagatgaataaaaagatactcagaaataacacaggtaaacatagataataatacaattgaagtgtaatggaaatatgaatagaatgctaggggatgaaaggaaatggcaaacaatttttctttgaaaaaggctttacggaggaagtgatatttgagccggagttttaaataatcatatggctttgctaggagagaagtgagtctttgaagagagagatcaatccctgtttccatgatgcagttttacctatttgaacaaaaattttgattaaaagtgttctaatatattatcttatacaatatggttatcctacaatataaaatatattggcaatgttaatgatttgatgcattttattaagaggactgtgtggagtgattatttcaaacaagttaggagtcttttggatttttaatctttttgagagtaacacctttcttcattatttgtttccctttcatttcgttccccagggcaccgaagccaaagcactgtccatgccggagaagtggaagttgagcggggtgtataagctgcagtacatgcatcctctctgcgagggcagctccgctactctcacctgtgtgcctttgggaaacctgattgttgtaaatggtaattggatagc

SEQ ID NO: 103388 - DNA, 2848 bp, Homo sapiens
tgtaatattttgctctgggggataatatttaatattatccaatattatcagtatttgataataggagtgaaatgagcctattacacatgaactccttggagaatactttttctttatgcctgtggatggctttatttttttaacgaaggtcttgaactgagacatggggagctagacctggggtcaccatttatccaagttggcatccctgtgaccagcaatgcacaacaacaatgctaagtttactggggccttagtaagtatgtgttttatttgctgggcctcccccaacaaatgtcactctgtatgaataacttttcctgtttatttttcatattaagaaatttcactggaatagcaatgcattccatctctgtgttttagttcaggtaccactttgtttcatatcaactcctagtgttctgtcataatcacacatactggagatccatttgaatgactaggagctttcatttttgttctgttttgttttttgagatttatccttttagttagaaagatagcgtggtaagattgggagggctgcgtttgttgtttttttattcagtatagctcatctttttcgtttagcaaaggcagttgctttggtaagccttaggtcaaaggtttaggtcagaggttttcagtatgttctgtagctactcctttctgctgagatgaaagttaggtagaagccctatcaccacttaaaccttgagcagcaaaatgtttatctgtttcatttattgaagttctgtgtaagattctgtttgaaaaaatgttggtttttttttttcctgctaaaatctattttgaaagctactgactcatgccatcttgatctttgacatgttggatagttctcattcccctcttacaaagtttcttttttcttttttttgagacagggtcttgctctgtcgcccaggctggagtgcagtaggcagagcatggatcattgcatccttgacctcctaggctcaagcagtcttcctccttggcctcctgagtagctaggaccacaggcgtgtaccaccacacctggctattttttattttattttttgtagagatgaagtgtcactgtgttgcccaggctggtctcaaactcctgggtttgaagcaatattcctgccttgacttcccaaagtgctgggattacaggtgtgaaccatgcctggcctcttacgaaatttctatttctttagtcataagattctttgaaatgttatttaaaagtctcaaaactaggtttaatagctttggtggtacttcacatttgtcaggacatgactgtctgatgacactaggacctagcaatgtctattcagcagttcatcataattagcaaatgtagcttttactttggcattcttgtacacagagtgtcaacagtttctgccttcatctaatcattctgctacatcacatcataacttgcaaggttggagttaccaaatagtaaatgtgtagttgcaaattttgccttgattttttataaaagcacttaatgacgtgtataataacctctattcactagattcaggatacttaatataaaaagaataactgctgaatgtcttgatgatttcctaatttctgatgttttgtttctttactgttcttggcaaatcagctcttggcagacttgcatggcagccagccgttccaggattgattctttgaaaaggagcagtgtgtctttaaatctttccttcacccaaggcatcctgcttggtgcacatgtgcataagcacatcactgggctctttcatggaatgagatgaagtgcgcctttgtatacatgattaaaattgaaccctctggtgatgtcaagtatatttatcctttgggtctggaagagagatgatgctgtgaaaactagcaagattattttaatgaacaaaggaagactcattgccaagggttaaataaaaaataaatggagtttttagtgacttcattagaaataatgattttattgtgtttagttgcctctgattaaccttgttgcatatctttaagttactaataagctgctgcctagtggattttatataaagatgcttactgtagtttttaaaggtggtgttgtagagtgattttacttcatgtgatgccaggtttacacttttgaacttgctatcagagaaagaaataggcgaagaacagtttgttttgtataatgtgtccttagtatattaggagctaggaaatgcaagcccatactaaaaaagaaaggcagttgatgaagtgacagaattctttatcatctttcttttgtttatttacagctacactaaaaatcaacaatgagattagaagtgtgaaaagattgcagctgctaccagaatcttttatttgcaaagagaaactaggtaatacaaacattatttaacttttggggtgaaactctgtgaaattcatataagaaaaaaatctgaaagataatgttcaaaagactgaaaatttctatatgagattaaagcatattgaagacaatgtggtttgtttaagaatgcaaaggtttaaaaaatgtgaaagttttgcttataatttgaggagtttgtttctttcctgtttttcttagggtcatagtgtgctgaattatattgttatgagataacactagtatgtaatttattacactctgatgatagttcatagtttctgtactaatctttggagatctccctattgagatctccatattggtatttaaccaatatggaggggatctgtgtttcatgaaagtaattcaatgtcaagttcattattgaagattattggaggaaaaactacaatcaaaatgtttgtttaaacctatataaatttgatggctatttta

SEQ ID NO: 103389 - DNA, 1060 bp, Homo sapiens
acgcttatctggtgtagtggtggtgtctcctttaaacagttgagcaaaaaggtgaggatcagaggggcaggttatttgtccaaggctatacacttggtaaatagcaaaacaagtgggaacctcggctgcagtttgctagtgcgtccgtactttactatgagtcacctggggatcttattaaaatataggttctgatttggtaggtctgtgggggcctgagattcagtagttctaaacagttccaggtattgtcagttctggtgatctgtcgcccacatgttgagtagcagtgtggtgactaaaaatgagtgcttttgagccacacggacttgggtttgtgcactgttctgccactaaccatggggccttggacaggctttctgtaccttgacctgtttttaaaatggagatagtaattaggaaagaacttctgatgtgaaagcttgaaaaacgcttgacacaggtgctgatacatagtcatcatgcgataaatgctattaatttaccaggttctaagcgttaacaggagcagttctccactgtatccttagtgcccagaacagattgatagctatcaggaaatcttcgtatgtatgaatctctcacaagtcttttctacaactgcagcctatgagctagagaggttgggcacagctctactaatttgatatcatggaatttttagcttttatatctaagattcagtttcatcaagtcttgcactgtacttcttccatgagggaatttggttcatgcttatctttgtgaattatttgtgaatatttattcaccatgttgattgggtttggcagaaatagaggacagttttttcacttgattttgggttttgattttactttaaaaaatattctaggggaaaatgtagccaacatatacaaagatcttcagaaactctctcgcctctttaaagaccagctggtgtatcctcttctggcttttacccgacaaggtaagagatgaaatactgtcacaatttaaatgactgtaaagaatagtaagtatacttaatattcttggtgagtatgacatctgactgccc

SEQ ID NO: 103390 - DNA, 1105 bp, Homo sapiens
cctgggctcaagtgatcctccctcctcagcctcataagtagctgagaactgtaggcatgcgcccccacacctggccaatttttgtttgtttgtttgtttgtttttagtggagacaaagtcttgcagtgttgctcaggctggtctccaactcaaaaaagaattgaaaatatagtaaaaaaagaaaagacagaatgactgatgtatatggaagcaccgagaaaaagcagagtatgatataaatacttataaaagcaacaaataccctttcacttgtatattcaagtttaggattaaagcacaattattctttaatttttagattgtggcccacaagctcatttgtaagctgttcagatttttctgtagataaaatgttacggagctagagcttttataaatcttacttccatgctaatgtagtaacttgtagagaagatatcatcttttattcaaactcttttgtatacttaaagttgaatgggtttctctttcctcatttcacatatttcaaataaataagtacattaaaaaatacttagttatggtcatgcttctgatagccgagtcattcaggacatcgttgggagaaagtagtgtaaccagaatatggatgaaagcctaagtcagcttgacctccagtaatgaacgtgggctgtaacacagaagctcagaggttgttgcccagtttggtgtaacgtgagatgttggattagaagcaggtgacacacctaaatgagattagggggagaagaggtagtgtaggaccagttaatgcaggaagagagtagccacatgttcctccatagtccctgaggaatcacactgcattgaattaccatgtagcacagagcagcaatgatcacccttaaccatcaataaagtgtttgaattagataagaaagtacaaatgatatagtgtgtgttatataaatggttagtttttttttttttttatgcttaacgggtaagtttcacttttcttaggagaaaaacaaaacccactgtttaatgcaggacgaatgaaatgtttttaaatccttatttttcccttttcctttgtagacaatactgtcagagttcaagacacagattggaaagaagtagg

SEQ ID NO: 103391 - DNA, 1139 bp, Homo sapiens
tgtgattgatttgtaatttcatttctggagctccatttgtttttgtttctaaactacagatgtcaactccttggggtgctgatctcgagtgttattttctgattgtggtgttgagagttgcactcccagaaaccttttaagagatacatttatagccctaggggtggtatgacccaaaggttcctctgtgacaaggttggccttgggaatagttggctgccaatctccctgctcttggttctcctctagattgaagtttgttttctgatgctgttcttaccagattaaaaaaaagtgtaaattacatggtggtcttgacttttattacagaaagatatgtagtaaatattcagaacagatacacaatgttacttggacatttcagaattatcagagaacatagcataggcagataatttttgtaagggttttctgtttgtttgttttttttttttttagcagcgctctgtcttctaataaaggcctgatttatgaaatgaatgaaaacagagctagtttggttgaactggacttggggtgggtgctttggctacacacctactcaaatccacctcttctctcgacttctctctctctgcagctctttcttgggttctgtggtggaactttctgggctgtgaagcaatgctgttgaaaggccatttggtattagggactcctgtttgtggctcctgggatgaggtggttatgattttgttttccttgtgttttgaacacttagcccctaatttgtaacttaagtagaagatacctttttaaaaagttttactgctttgagtgctaatcaggtacttgttcttcaaagatagccttttatttgaagaacattttgcttttcagacttaaatacacaaaattcaagatttattttttctacaagaaaaaggccaaacacaaatgacttacacaaacaactgtagaaacatgctatagtgacaatctgattcacaacataggaataaaacactactagcatctacagaaaataggaatattgccaatgtcttcctgcttttttaaaaattctgttttgcatataaggaaatggcttggaatgttatgtgctgcaagaatattttgagtcctacatacaagtgaatttttttttttgctacaca

SEQ ID NO: 103392 - DNA, 1035 bp, Homo sapiens
atctttttacttcaatcttaatacttttgtttggattttatttcatagttttctaggagggctgagctaaaacatgtcctgaacacctgctgggtgccaagcaatgtgctctgagcttcactctcttgacccatgcacaagatacctgcactagcttgccagatgagaacttccagaaggcagttgatgttcagttttatggggtttgctgctgtgtttgttaccatgtgagtgaagacctatcatccccttaaattttggaaagatagaattgagtgttagttctatcttgaatgtatctgaatattagttaattcagcagggacggaatgttaggctagagaatgtagtaatgaagagaatctagggaactgatggaagagaaaggatatgccactgttcctggaaagctgattttacatttaaccaaagtacggtaccattttatcgcgctgacgggaggaagatctggaagaacttttctgtggctggtagagctgtccgctaaggctgcgtttttaaatccctgttcattgtgaacaaatcaaataggtctttgttgtgtttcagcttccccgagtcagcttggagggaaaatgctagcctctctctggctcaaagttgtgaaacaaagcaagaaaaacaacaaacataacattttagagtctatacagcatgactcccctctccctcctttttgccctttcccatttcaaaatgtcacaattattaaaggttacatgtttggaaggaacaggtactagtctatgtgacagaacagactattttagggtcgccatgagacctatgtgtccttggttcctatgttcatacacagaccaatggggaaagtattattattattattattattattttgagacagagtctcactctgttgcccaggctggagtgcagtggtgcgatctcggctcactgcaagctccgcctcccgggttcacgccattctcctgcctcagcctccctagtagctgggactacaggcgcccgctaccacgcccggctaatttttta

SEQ ID NO: 103393 - DNA, 1081 bp, Homo sapiens
tcatctgcctttgtaactagctctgcccatggccgtggcccacaggttgagaaactttgtccagcctattaccattcagttgtatgttttgagctgtcttttattactaagtgaaaactgggtgagattgttgaagagggacgattgccacaggggtttcctgtgttcttaatctcctgaaacttgaggacctcatggttacaccctgccctacaagttttctcttacccgtttattcaggatgtcacacagcattatttattaatatttgaaaggtctacccctgagtaaggagggtggatatatatttttttaagtggaagaaaccaaacttcaactcctatagctctctgtgcttgaatcttgtaacaggctgctcttataagcagtgccccagatccttctaatgggggaacctcacctgcccttgtcaggaaagaagggggaagggcccaggaaccttccagtctgagaggctggtattctggttctttcatcgtgtgacttatactagtgatccctatcttcttgggggcaagtggggaagccattctcctcttgaagccggttatcagagaactatgaactcatagcgaggtgacaggattttaggatgtgcatttgtcaattccaagttattgtccaggcgtgtgtgtgtgtgtgtgtgtgtgtgtgtgtgtaaggggactcctagaatcactggctaatcatcaaaccttatgttaatcaatatttatactctcttctgttagatttcttttaacagaataactttaaaaggtacccacatctgatattttgaatttcacctcccgtctcttttccctatgccccacttggctttcttcagaaattccaagggagtggtgaaagaattaagtgagcagcagcaggaggatgaagcaaagttctaccggattataaatggtctgatctattccttgccatcacctgacctcccccaagcatgactgtgggatattgaccccaggacccccacctccacccaccttgggggtctagaagaatgtgtcgacaatgatgcctgcaaagcagcagcttcatgtgtctgactgcccac

SEQ ID NO: 103394 - DNA, 1133 bp, Homo sapiens
cccaccaggaatgccgtttcctttttatggatctgttgggaaccagagagaatcaacagatcaatgacataggatccgaagtgcaatgatagtcacttctagtttggcatttcacaaactctgtacagcaaggtattggtaggttactcaatttcaaaagggccccatggccaaatatgtttaggaaccgctgtttgtatttctttttttggagacgcattgtatataatatatgtcaaaggctttcggaattcctgcaggaaagaaatcagctttgttaaatccaaactgatgatttgactcaataagttagttgcagagctggaaaaagtagtctaactcccttcccagtgctctttcccctataccagtctgcctctcatgcttagacagcgttcagcggtgatccaaatcaccaagcacctggtgctggaaacattgtaggtgccagaagcagcctcctggtcccaaagagagcccaagatattagaacatagccatgttagccccttgcctcccacttcgcaacatgagacatgtcttccttttgctgtccacagggaagggagagagggaggtaaaaatggaagtggctttggcctggagcagcttctagttatgcccaagcaatgtagattgtttggtaatcagccaagatccatccaggttcccaggagcataaaagcaatcatctcctttttggtccttcaaaaccaaactggagtggtgacgtcagggccagagaccctctccttctgtgggcattggatcacttagaactctcaacctcagaaaagcctgccttcaagctggcttttgacgggctattggctggagactgggtcagtattgaaagtgctagctgtgcacctggctgccagaaagccacttggcctttaggacagtcctcttcacattgccctcttccctcactcatgatcaggtctggatttaagagcaagagaccccaggataattcagaagtcctctctctcctcctgttcaagactcttggtctgggattcaataataagtagcagacctgacataagaaagatcagataggtccaattgccagtgactattgggagccataatttggcagctggagactggtaggctcaggcctgatt

SEQ ID NO: 103395 - DNA, 1127 bp, Homo sapiens
ttgctaaatgcggcatactcagagcacacttctcagcaccccaccctctccctccctcctgagactcctcccccgaccctactacaccccctttccctactcccagatctacctgggagagaaacatgcacagcttcaactccaaaattaaaattcaatgttttaatcagaaaacaaaaacctccaattcttcctaacctcagcacaacgctctagaccctttaactttggtaaagtgagtcacatccccatctgcataaaaaaatctttactgcttttgggaaatgtttacaatggcctttaatttcccagtatttcacaagggagccagacagacaaggagtctagccatcccctggcgggaccccacgctcagcatcctcctccactgtctgtcttttggatatagacaaacccctcccaagtcctgcaggacagtcagcaggctttccagtcctccctagaaggcagtgtgtgtggagggaggttggttaaataccatgtttaatcgacctcggaagctatgcatgagcaagataagtccagccattgtggcacctaacacaccctcagcatggcccgtactaaaaacacttttcagaggactgggagaggggtgtccatgcccagaaaacgtaagccatcggggccagaaaaatgaggacaatagctttaatgctattaatgtatcctggactttacaaaatctctagatacctttttgataaaggtgcttacggttaatgacaaacagctaacattcgttgctttgtgcctggcactgttcaaatcattgggccagtttacttctaaatcttcacagtaactctgtgaagcaggtactattacaaaccccattttacggatgagaaaattaaggtttagagaagttaagaaatgtcccaaggtcacatagttaggaagtagtaaagcctgactcccaaaccatgctcaaagccataccttccatttgtggagtatttcgtatttttaaaactcttatgcatgcaataataaccatcacctagaagaaatagatagattttatatatatatatatatagagagagagagagagagagagagagagagagagattgattgattttagatagatatagatagat

SEQ ID NO: 103396 - DNA, 1023 bp, Homo sapiens
aaaaataataaataaataaataaatgctgctgttaggtcaagaaagacaaggactaaaacaccgaccactagattttcccctgaaaactatttattacttttaaccaagtgctggccaagtctccctggccttggatggaaggcatatcaattgcacatcatcagccaagtactgattggatggtttcaattgcaaaggggaaatcttatctccaagtcataaggtgggatttctgacagaaggaagagcacacattaggtgaagaatgctagactaggaaggaatggagtcagatggcatgggcaccagtcttggtttatctacttgctccctgtgtgaccttaagactccctgtagctcttaccatcttcacatacaatatgatgggtggtgagcagagcagggttctctgagagacttttcatagtctcttctcaagtctaaaattcaaagacatttccctatcttagtcagggatggctacataatttgcaggatccctttttcaaaatgtgcagtgtggggggggaatgctgttaaagatactaaatataaagctttttctttccttccactatctctctcttgacttgtcataatgctgttttaattgctatttaatatcattctaggtaaaataaataaatgaaattttacattattcacgtggattttaccatttacttttacattgtgcaatgcaaaattttaaatgcaaatatgaaaacattgaactcataagcagaatcaataaaattacacaattcatatttcatagttcctacatgctgtattagtcagttcccacactgctaataaagacatacccgagactgggtaacttataaagaaaaagaggtttaggctgggcgtggtggctcatgcctgtaatcccagcactttgggaggccgaggcaggtggatcacgaggtcaggagatcgagaccatgctggctaacacggtgaaaccccgtctctactaaaaatacaaaaaattagccgggcgtggtggtgggtgccta

SEQ ID NO: 103397 - DNA, 1109 bp, Homo sapiens
ccatttgaaaatggaagctgttggctgggcacagtggctcacgcctgtaatcccagcactttgggaggccgaggtgggcagatcacaagatcaagagattgagaccatcctggctaacacggtgaaaccccgtctctactaaaaaaaaaaaaaacaaaaaattaaccgggagtggtggtgggtgcctgtagtcccagctactcggggggctaaggcaggagaatggcgtgaacccaggaggtggagtttgcatgagccaagatcgtgccactgcattccagcctgggcaacggagcgagactctgtcaaaaaaaaaaaaaaaaaaaaaaaaaaaaagaaagaaaagaaaagaaagaaaatggaagctgttatgattggtgtttgtctggagaaggaggctacactgagactttgcactggcacagggccctgtccacacacctccgggcttctgcagatagggaaactccctaggacaagctggcagttctgacaaatgcccagataaatcttgctggtgccaagctgtctgggacctgttgcctctgcccagctccttccaaatacccaggcccttccctgatgagatgactggcttccagccctgggatacgccttaatgaaccagcattgtggacatcacccagaacttctctgcaagtggacacactgtgaaggcaggaggcttgatgaaagacagtatttctttcaatatgcgtgctcaagggcaggggctgggagggctcctcaggggagatcttgggccagtatcatctgagatacctttcaggtagtcttcatcctcagagttcatcctggggctggaagagtgctctggaccactggataggggattgaccacacaatgacagtttggatgagagctgaacaatgtcttcaagacagatatttcctccagttcacctgtggtcctcatgcaacaacaaccagcaggacacctgggctctgattaggtttctggccatcatggggctcctagggcaaaggggaaattcttccccctcactgggtccctgtctgtgatctcgcctcccgctcaccacttgctagctcagggagactttcatcaagtttgcagtgagaagaaa

SEQ ID NO: 103398 - DNA, 1088 bp, Homo sapiens
aaacagtaaaagtcatagaaggacatcatcttaaagggtgagcaagcatttaaatgtgagtatgctgacacaggagacaataggaggaagatggtctcttggggaggggaggtgggcaggcagagagaaatgtcctgccctctagggaattccaggggccagggaagaaggtgaagagagagtagggttggggtgagcaatttgggaacagagagaaggagaaggagcagccctgggacaacattcaggactctacaggaaaagaggcaaaagaaaacagtggggtacatatgaaagagactggtcagggagcaaagggtgcctcagcaccaaaaggctctaaatcagtcagatcaaagtcagtgtgctgcaaattaattctttctgagtctcccttctcaggtcccccatctgcccctcagctgccccgtctctttgccatggtctccctttttctacaccttggtctccccacttctgcctgaagaattcctgttaacattgcttttagggcaaatctactggtagtgaattatctcggcttttatagatgtgtaaaagtcttcattttttcttaattgttcaaatatatttttgttgcgtgcagaattctaattttagcattttctgcatcaacactttaaatacgccatcccattatcttctggcctgcatagtttctgatgagaagtctgctgtcattcttgtttttgtttctctgtacttatggtgtcgcttttttctggctgctttgaaaaattcctctttgtttcactgttttctgcaattcaattaaaagttcctcagtatgtaggtattgaaggaacatacctcaaaataataagagccatctatgacaaatccacagccaacatcattctgaatgggcaaaagctggaaacgttccccttgaaaaccggcaaaagacaaggttgtcctctctcaccactccaatttaacatagtattggaagtcttggccaagagagtcaggcaagagaaagaaataaagcacatccaaataggaagaaaggaagtcaagctatccctgtttgccattgatgtgattctatacctagaaaatcccca

SEQ ID NO: 103399 - DNA, 1049 bp, Homo sapiens
ttcgtttaatatttattgaggatctgctttgtgccatgcactgctctcaagcccggaaagaggatggtgacctagaatgagaggtccctgttcttgtatagctgatcgtctagttgtgggtagggggaacagacaattaacaaatggatagctgaataaatgagtaaaacaacttcagacagagttcagaactaaaaagaaaataaataaaactgtctggctggagaagcactagttaggatggggtaaccccaccccacgtatcctgggcccaccgttgagctcactggcaccttctgtggtcagttcccaggcatgcagacagacattgctttcctgcatctcctcttctccttctgaagactttctctggtgccacaggagtgtgctctgcccacacacagggactgactacccaccgcacccccagggcaaccttcaacccatgagggcaagagcctgttggataaatacttcaactcctctatctcttagtgggacaatttggaggcatgtttcacaccatacctcaggggtctccaacaagactgagtctcagtttccctcaagggtaaccaactcagtaacacatcctgttaacacacccatctgtgtcatactttcatgactcccccaacctcttgtgctccctgagattgccttgcaaataatccacctataccaagtctctttcggtgtctgattggcaggaagccaaactgagatacatggtcaaggtcagcctctctgagaaactgatgtttgagccgagatgcaaatcatgtgaagtaaccaagatgcagaggtctggaggggagggctttccagctaaaaagaggagcaagagctcaagccctaagacaggaaggagctgatgtgggctgggcccagaggcagctggtatggccggagcacaggaagcacaggggagcatgatgggagatgaagctggagaaataggcaattaaacttcattcaccctgatgatagtttcctttgctgtgcagaagctctttggtttaattagatctcacttgtcaatgtttgcc

SEQ ID NO: 103400 - DNA, 1038 bp, Homo sapiens
aggaaggaaggaaggaaggaaaggaaggaaggaaggaaggaagcaaggaaggcaggcaggcaggcaggcaataataccaagttgctctcattaagtgcttattacgctgggtactgctaagtgccttacctacatgaaatcatttaatccttataataacaagcctacattgtggttaatattattattacctccattttaaggataaagaaactaaggcacaggaagttcagtagattgtccaaggtcatgcagctggtaagtcagggagccaggattccaaccatgcagtgttatttcagtgcccaggctctgagccagtgacgaaaacagcaaatatttgaggtcaaggtgtaatccctcccatatgcaaggcacctggtgaattacaaagctctttgtggaaaggcttccaagggtggagatgggggcagaaatttccagggtcctcagccagagattctctgataacacaggtagaaaataccaagggctgcagagatgcgaaaaggaaaccagagcggccaacagcgcactgcacagaggccctctggttttagagtcaactcaggtgctgctctgtctccatctcctacagcagttgtccgatcacctgtaattttagcccccagaacaacactcctgagacacttctctcattcacctcccggcaccccccagggccagcttcagcccgtgaaattccagcacagttcagcaaagcacagaccagacatggcgtcccacaccagtgagctggcagctgcttcctttgtaaccagacaggtacacaaagaaaagcagagatcagggcagaaggcttcgggctcagtcagggcaggccatttctgttttttttctctttttttctctctctttttttttttgagacagaatctcactctgtcacccaggctggagtgcagtggcgcaatctcagctcactgcaatctttagggcaggccatttctctgtgggccttggcaaggcctggaggcagatgcagaggtttgcaccgcctcaccataaaagggagcg

SEQ ID NO: 103401 - DNA, 1099 bp, Homo sapiens
taagactcaaggtcacttcagggcctgtcactgattgtgggagggcttggtaaaaattgaacctcattaacaccactgaagaagctgatagacaagaaatgggattaagactcaatactcatcaaaataaggctttccttatccacagcctacctgagcagtgcctcactctggaaaatgtggttcatggctcggctcaaacattttctgttgctgagaggacttctctcatggaagtctggctcagatgaacacatgtgtgatctgatggaacctttgtttaagtgaatgaggagggtatttggaagacttagatcaaacgtgtgccccattgggcagtcactatctgctcccctgacagggagaaaccccagtgacaggatagaaagctccaaagatcctgaggaagtttggaaggtcaaacttcaccactgcaaggactgagagatccaagaatctcagaatccaggttggtctccagggtgcagttctgaacaaatgagtgcagtggataaaaagcttatacttaaggtgggaaggtgggtgtgggttccagttccttctttggctgattctcttttggcctggatttcctcacttgtcatccatgccatgtcacaaacccagtgcctacagggaccaggcacagaagctggatatttgagtatcagacatattggaatattactcactcctaccaaatatgtttatggttccccattctcttggtttccattttggagagctaaacaggtactaaaaatgatttctttattataagacaagcaataaaacagtgggcaagtgtgatgataaacagcatctgagctttggctttggagttggggagacaatagagagtggcagtaactgtggtgaaccgtacagtccaggtcccttctggaggggacagctgctgtccagctccagcctatcaggatgtgagtctagtgatgccagatttccagtctcttaggacaagcaagaaatccaaatttttaatgtaacatcttctgaaaagatacacacacacacacacacacacacacacacacacacacacacacacacacgtggaccaaacaaaacatgtccatgg

SEQ ID NO: 103402 - DNA, 1037 bp, Homo sapiens
gtgctcgataaacatgggtgaaatacaggaataaacaaatactgaaaatgggtcattgggtgagcacttagccagtaaaaatctgtgctttgtataaaaagaactttggactgaggttatatgagtcttcctgcaggctggagacctctgttacctttacttctctacttttgttgtcttgagaccagcttttttatttttggtgaggagaacagcaggcagttcaaatgtcagggaaagacaagttcagcttgctttttccttatttctgtcttgttacctgctatcctgccaggttagaaagatggaatcactcccttttgccctatcatcaagacttcagtgttccctggagcactctaaatttgccatcagacttggatcatcctctaataccaagctcctgggtccttcctgaaggctgcctccttgtcttgctgagaagaattaaggtcgcttccctgggaggaattcagcagcacctcttgtaagtcatcaggtgtgctgtaaggatggggcaggcaacatttctttgtactgtgggaaggcctaaatcagtgtttctcaaggtgtgatccttgcaccaccaatcttaagaaatgttctttggagccgggcacagcggctcacgcatataaccccaccttgggaggctgaggcgagaggatcgcttgagcccaggaattgaagaccagtctgggtcacatagtaagattccctgtctctactaatttaaaaaaaaaaaaaagaaaaggtggttgggcctgtagtcccagttactcttgaggcttaggtgggagaatcgcttgagtccacgaggttgaggctgcagtgagccatgattgtaccactgcactccagccagggtgacagagcaagactctatctcaaaaaaaaaaaaatgttatttgggagagctgtttattgtattcccctcttggagagacatgtggctattagcatagtaaaagctctgagaagtcctgctgcatggtgacctgtttagctctgtttaatccagtgttctctgaacatat

SEQ ID NO: 103403 - DNA, 1124 bp, Homo sapiens
gagggaagtatgttcctgtgcatcgaaagcctcaaacatgtgcatacactttaactagcaatcttacttctagaaatttagtcctaagaaataactaggcaatggagtccattgctacattgtttatccccaaattaatctaaatgtctattgcaaatagactgcttagattatggtgcgttcatacagtgaagatctgcacttcctcttctgctaaccgctaaggtgtcatcagtgctgtgctattaaaatcagaagtcaaaggaggtgggtgtggccctcatagccagagttgatagaaatggatttattaatataatggatggtccaaagaaaggtgaatgaaagagtcataaaagatgttgaggtagttctctattgatgccagaatagccctatggtgcacttttgagtaacagaagccaatttgttaaaaacaacaacaacaacaacaacaaaaaaaaaacagagagagagagatgaatgtgcatccagatgcttagagaagagtctgaatgtctgtatactaaatatcaacactagttactctgcgctgtgggattttggatgattttaatttgatccagtgttttctggaaaataaaatttcactacattgacacatcatttgataatcagataaaagaacaatggtgggaaagcaaggactcaagtgacccttgcttttgggtctagagcatcatgtaggaagccagcacagcccatccctttcctaggcgccaccttctggctcctggtgggacttgtaagtcccgtggtcagttacctgattgctcttacggacctgacgctggaaatcctctctctccaaggtccctgcaggagatgggacctgccacagagaatgccgcaagggatgtttctgttgggagctgtgagtggggtggatgtcctctgcctctcttaaatagatgagctagatttgaacctggggctggccaaagggagtctcctctcagaaaccaggatgcagtgggccgtctgtgtcccagccccaaagcagccagggtccagtggattagcacagagccgaccaggcctggagggtggtggtctgggattgggtgagcagccaccagcaggaatagcaattggagggaagg

SEQ ID NO: 103404 - DNA, 1017 bp, Homo sapiens
ccttctctcataattcagtcttgggaattttccctatctccgcatttccaatgcatttgacttggtggggtgtttcagatttgttaaatatttagtagtagaaagaagatgagctttgctgctgggcatatttggattcctagctgtgtgacttctgacaagtttcttaactatcctgagacttgttttcttcctatactcagtggaaataaagctacacattttggggaatggttttaagagtaagatgtactgtttgtaaagtgtgtctgtcttgttcacttttctgtttctgccacctgacacaatgcctggcacatagtaagtgctcagtgaatatttactgaatgaataagaggtttaggcaccatgattgcacagacacgatgttcatagagtagttggtcttctccttctttatcaatgactccatctccctgtcacacttcaaggccagggcaggtggttcagaaataccagaggttggctttatagttctgccattacccactttgaccaaagagggcagcagttagcattctttacttatttattttatttaaaatgaaggtttccttaaaaggatttggatcttctctttaatcattcctccgcaccttcagtgctattgattcctgataatggtcttagggcttgaagacctatgtatgggctcgtttttctcgtacctgttcctacctgagtgcccactatgtgagtgatgtggttgtgagctggaagggaggtgctgagtgagtaggggaacacccgctgcagcaggtgggccttccaaactatggccctgggtgtccacaaccttacagaatgaagcttgtggaacttaaaggtgaggaaagcctacactattttaaaagccacatgaagggtaagttatagatgtaccagggtctccttggcatctgtgctgtataaaatccatagacagagcagccattggctcttgttcaaaccacaagaaagtctcctgcccactcctggtgcattctgggaacagat

SEQ ID NO: 103405 - DNA, 1017 bp, Homo sapiens
tcactatatgaacctgtcctatgatgccccttgcctaggtgagaatcacttcctccctgtgcatctgcctgcacctttggcttcctgcaagacccacccagctgaaatgctacctcctccaggaagccttctgtccaccccaggccaagctagtccacctctcttctgcttggctttcctctctttcttccagcacgtgttctttaatgattggttccttggacactcactagcatcgctaattaccggatggcagggactgcatctgggactccagcacatggcatagagcctagattgtggccagggttcccaaaaatgttgaatgaatgaatgaatgaggctgtgggagggaaccaaaggtaatacaataacgaagacggggatggttttgtgtttggcttcctggagtgctgggtcaggagtccttgttccatagagttactcagaaaaggaagggacaagtaaaaatgtgatctggagaggccgaataccgacattgttccaaaatattgaagactgacctccaaaaagaggcaagtcacaggaccctattacaggagacccccatgaacttgttgatgtgtctgtggaaggacagcacccaaaagctaccaacacatgaagatcccaaggctcagcaccctcaaggaagtcagtggtgacaccaaaattagccccagggagtctccacccaaggcactccttgctagacctgctgactcctctgcaggccctctggcctccagctgcccctcttccttgtggtagcactcaggaaatatgaagagcatggcaggctgtttatccaggccccatctccaggtcctgtgtccctctctgccatagtgtttattgtttgttttattttgccaccccccctccttctcctcaagtccacttgaaattcattgattcactcatctgatatttattcagaagtatttgaggaactatgcatctcagatcctgtgccatgtcttggggattcagtaataagcaggcagacaaggttcc

SEQ ID NO: 103406 - DNA, 2798 bp, Homo sapiens
atgttcctgagtctggagcaagcacccaggccagaataacagagctttcttagttggtgaagacttaaacatctgcctgaggtcaggaggcaatttgcctgccttgtacaaaagctcaggtgaaagactgagatgaatgtctttcctctccctgcctcccaccagacttcctcctggaaaacgctttggtagatttggccaggagctttcttttatgtaaattggataaatacacacaccatacactatccacagatatagccaagtagatttgggtagaggatactatttccagaatagtgtttagctcacctagggggatatgtttgtatacacatttgcatatacccacatggggacataagctaatttttttacaggacacagaattctgttcaatgctgttaaatatgccaatagtttaatctcttctattttgttgtcgttgcttgtttgaagaaaatcatgacattccaagttgacatttttttttcattttaattaaaatttgaaattctgaacaccgtcagcaccctctcttccctatcatgggtcatctgacccctgtccgtctccttgtccctgcttcatgtttgggggcctttctttaactgccttcctggcttagctcagatggcagatgagagtgtagtcaagggcctgggcacaggagggagagctgcagagtgtcctgcctgccttggctggagggacacctctcctgggtgtggagacagcttggttccctttccctagctccctggtgggtgaatgccacctcctgagatcctcacctcttggaattaaaattgttggtcactggggaaagcctgagtttgcaaccagttgtagggtttctgttgtgtttttttttttttttttgaaataaaactataatataaattctcctattaaataaaattattttaagttttagtgtcaaaagtgagatgctgagagtaggtgataatgtatattttacagagtgggggttggcaggatggtgacattgaacatgattgctctctgtctcttttttcagcttatgggtatttatcttctattagtatttgtatcttcagttcattccactttaggaaacagagctgccaattgaaacagaagaagaaaaaaaaaaaaagcagcagacaacacactgtagagtcttgcacacacacaagtgcccaggcaaggtgcttggcagaaccgcagagtgggaagagagtaccggcatcgggtttccttgggatcaatttcattaccgtgtacctttcccattgtggtcatgccatttggcagggggagaatgggaggcttggccttctttgtgaggcagtgtgagcagaagctgatgccagcatgtcactggttttgaagggatgagcccagacttgatgttttgggattgtccttattttaacctcaaggtctcgcatggtggggcccctgaccaacctacacaagttccctcccacaagtggacatcagtgtcttctctgtgaggcatctggccattcgcactccctggtgtggtcagcctctctcacacaaggaggaacttgggtgaaggctgagtgtgaggcacctgaagtttccctgcggagtcgataaattagcagaaccacatccccatctgttaggccttggtgaggaggccctgggcaaagaagggtctttcgcaaagcgatgtcagagggcggttttgagctttctataagctatagctttgtttatttcacccgttcacttactgtataatttaaaatcatttatgtagctgagacacttctgtatttcaatcatatcatgaacattttattttgctaaatcttgtgtcatgtgtaggctgtaatatgtgtacattgtgtttaagagaaaaatgaaacccacatgccgccattttcctgaatcaaattctgcagtggaatggagaggaaaatacttctaggcaagcagctagactggtgaattgggggaaatagaaggaactagtaactgagactcctccagcctcctccctattggaatcccaatggctcctggagtaggaaaaaagtttaaactacattcatgttcttgttctgtgtcactcggccctgggtagtctaccatttacttcaccccaagtcctgctgcccatccagttgggaagccatgattttcctaagaatccagggccatgggagatacaattccaagttctcgcttcctcctttgggcatctcttctgcctcccaatcaaggaagctccatgctcaggctctcagctctcgggccagtgctctgctctgtccagggtaggtaatactgggagactcctgtcttttaccctcccctcgttccagacctgcctcatggtggcaacatggttcttgaacaattaaagaaacaaatgactttttggaatagccctgtctagggcaaactgtggcccccaggagacactacccttccatgccccagacctctgtcttgcatgtgacaattgacaatctggactaccccaagatggcacccaagtgtttggcttctggctacctaaggttaacatgtcactagagtatttttatgagagacaaacattataaaaatctgatggcaaaagcaaaacaaaatggaaagtaggggaggtggatgtgacaacaacttccaaattggctctttggaggcgagaggaaggggagaacttggagaatagtttttgctttgggggtagaggcttcttagattctcccagcatccgcctttccctttagccagtctgctgtcctgaaacccagaagtgatggagagaaacc

SEQ ID NO: 103407 - DNA, 1055 bp, Homo sapiens
tggacagagctgtacccgggatcagatggacaagggcttgaatcgtggctttgcctcctgttacctgggggacttcaagggagtggttcaaggttccaagctaatgtttctctattcacagaatggagctagtaaccgcaatgctactatgtccagcacacgttgagaatttggtctgttttagttaacactaagggaactttggatgtaagttgactcatttgtaaaaggaggaactgggaaatatacagagcatgtgcaacccccggccctccgctgttcaatgaaggcaatgccttccagcccagctgaggggcggcctcattatctttctctgcacagcagccagagctggcagcaagaccaaacccactggatgacctgaaaagaacttgcagttctcacattctgtggggttgctacgaggctacttaaacaggatggtaaattatggataaagtggttggatcatgagatgagctcagttggtaaatatatgatgggggtgaaaccaaaacccactgacaacacaactctactttttctagcctagagtgtctactgaaacaagtattttccaaccatgctccttagagccctactttaccacagaggtacctgggtactctgtgaactgttgggcatccttggaagagtagagagaaagagagagagagagagagagagatgctagaaagaggaagatacgcttagcctaacctgtctcctcttctgtattagtagctaacaaccaggggtgatttttgccccaatccccccaacaggagacatttggcaatgcctggagacatttttggttgtcacaacaggggagatctcctgacacctgtgggcagaggccaggtatgttgctaaacctcctacaatacacaaaacagtcttccgcaacaaagagttacatagctcaaaatgtcaatagcgccaaggttgagaaacccccttctagaccgaacaactcaaaaacacacctttgtgcaaggagccccttgggtaccctaaagacagtttatggtggtgtgggcttcactctggag

SEQ ID NO: 103408 - DNA, 1001 bp, Homo sapiens
gtctcccgagttcaagtgattcttctgcctcagcctcctgagtagctgggactacaggcatgtgccaccatgcccggctaatttttttattttttattttttttctatttttagtacagatggaatttcaccatgttggtcaggctagtctcaaactcttgacctcaaatgatctacctgccttggtctcctaaagttctgggattacaggcgtgagccaccacacctggcctacagaacaataacattgatgatggtagcacacttttattgaacatttactatttgctagatgccatattaagtgttttccatgcagtcactcattcaatccacacagtatgcctgttgctgaggaaacttgggctcagagagcttaataaattgcccaggcaggtcacacagctagtaagaatgcagtgaagctgggatttgaacttacaggtagaagccagggatgagaggtccaaacttagcactcctggcagcagaggtcacagtcaactgaaagactcaggtgtggcctcgaggagggagtggtgtttgaaatagatcaaagaatggataggatgtcaacaagtggagatggtggcgtgaagagcgtgtgaatggaggaggcagtgtgagcaaagataaggagaccagaagtacagggtatggagtgacagggaatgcggtgtggttctccaaaataggacacatcatcttcccctgcgcccaccctactcctccctaattctctctctcaatgaagagtgtggccatctaccttccaccttagccagaaacctgctctggctcccggatgtgcccctctccctgtaccactgcacccattcaatgactggaccctgctgactccgcatctgatatttcctggtccctccacttctcccttcatccccatcacctagatccttggctggaccaccctcaactctcgtccagtcttcctcatcaacagcctcacaacttcatgttttccacccatctccaatgta

SEQ ID NO: 103409 - DNA, 1070 bp, Homo sapiens
acatggtgaaacctcatctctactaaaaataaaaaaaatagccggatgtgatggcaggcacctgtaatcccagctactcgggaggctgaggcaggagaatcgcttgaacctgggaggcagaggttgtagtgagccgagactaggccattgcactctagcctaggcaacaagagtgaaactccgtctcaaaagaaaaaaaaaaaagactgagaaaatcagtagtgaaggtgggaggagacagtaggatggctgaggatgtgtctcaatatgcacctctggggtaaggcctttgggagaagggagaaaagagtaaaacagcctgcatccttactcagctgatttcttcccctttacaggtcgaagtatttccatgggaagaaggtgaatggagagattgagatccgagtggagcaggtaggtgggagctgtgtctttagcactgtcaactgaccttttctgccgctggggctgttcttacatgcaatcttggtccccatcttatgtggtcataatgagccaagattaccagaaaagtccaagcttatacttgggagtctcattaaatttcagaattgtttgggccagtggtttccaaccttttatgttttagcagagaccctttcttcaagggaaatgtcaaataggaactcattctacaaaagagagacacgtagagctgctctgatggaaatgggcaggtggagcccaacttctgtctgttctataccgttccttttggcccctggggcatctccttgcagccacctgggctagagagcatagtttaggaacataatgaagggccttgaatcctgcctctctcattttctaggttttgggtaggtgacttaatctctctctgccttgatttccttatatcattgtggggattaaattatttaaaacctcagaagggaccagaattgcaaatactatctcttgctattgctattaatatcaatatccaggtccctcattttatgtggaaagaaacacagatttttttagggctgtgtagggaggcagtggcagaatcaggagtggaaggtgtggtctcctggctccagatc

SEQ ID NO: 103410 - DNA, 1156 bp, Homo sapiens
gtccggtgtcctgacctagcacatcagataattctacagcagataatggagtaggaccgggtcttgctgtaggtaggaaatgagctctcgacatggcaggaagctaaaacctgcacagaccttaaagtgcagccttagaatatttagaattttatcctggaatgaaggagggccgtggaagaattctgatcagtgatcaggtccctctggcagctctggggacaatggatggaggccggagcatcagaaagctggtaagttgtagttgttttctggtccttggctgcaaatactcttccctgcttaagggagccccctctgcccgggagccctgctccctggcttctggacatggattcaggcaaagagatgctgcccgtgtaatgcttgcttctgcagcctgcacatcattttgatattgtttctggagcctgtgacctcagtcttgtcatcaggcctctgaagggtgcctctgctcttcttttctcatcttcaagccctctgtgtgcccttcccctctgcctgggctcccctttctgtttcacagagatccagtctcagccattggaggcaaggctgtgtgtagattggtgtagtagaaagaacaagggctcgctgggaaatcagaccagaaagtcactttagccataggctttggggacattagcaaccttcatgaaccttctttttctgatttaaaaggaaatcattgtactcacctgtcatggtttgggttccctggaaaaagacttggcgcttctgagatttttgtgcagataagggaagcagaactgggcagagggagatgttgatctatggtgcagtgcaagagaggtctcaatccctcccatgagacaaagagacgaggcctttgaagcttaatgttgatcagccagtgggtgcaggctggtcctagggagggagctaggatgtcccttcagcaggacagttcctgactagggactcacctgggagctggggtaaccaacactctggcagctggacatggggaagtcatgagtgtcttggtcttggagggggagttgagcatttccccacggtatccactacactacctcacaaatgaagtagtgctttgtactgtgcctggtgcatagtagatatcttaaaagtattcatttctctcacctttaag

SEQ ID NO: 103411 - DNA, 1043 bp, Homo sapiens
acaagatcagggcagggctttaggatgttctggatgctttttaataattatgcttcccatcataactggggagaaagggaagtcagggttctaggggttattcgtcccaggaaatagaagtgaaattgtctttattaagtgaaaactttcccctttgccctgcaatgtagctgggcattcaaacggagggcaaaccgatgatctaaaccaaccacttggaaaaacccaatggggacattgtaaccagagggtcctggaggtggggttgatgggtttccttatccccaaagtcactcctgttttgttttgtttttctttgggggttttgtttatttttggggctggcaatccaaaatagaaaatctgatcctttgaggctctaaaggaaaatcagctgcctctaccaaccaccctctatcagcagtggcccaggaaggaggtcaagcatcttcggccgatatttaaacatgggcagcttccttcaggatgatcaccgaggctcccgtgactttgaactccctactctccagaatccaggggctatagcgatggggactgcggaattacgagggctggctgttttacaccggtcacattttctattggcagtgactgattcatgggaaagggctttgaaggaactacttcagtgcacacacaaggtacgaacctctcaggcctttcgaagaactttcataattcatgaaagcccagttctgaagattcacgtatccatctggagacctacaggaagaaagtgattgggttcctctggttcttgcctgcttcactgtggatgggaagaggtgacaacctcagtctccctttgggacctgtccaagggtaggcaaccaccttcaccttcacacagattgaggagacactggactttttacccattttctttaatcttcaatattaatattgtgtttacattgatgagaacaagagttaatgccctaccctctgctgggctgtttgtattgagttgcaatgtgaccagcgaaagctgcatttaataaatgaaagtacagactgtttct

SEQ ID NO: 103412 - DNA, 1038 bp, Homo sapiens
agctgccagcccccagctctcatctcatttgacttctcagccacctccaactgccggtgactcctccatggcacacgttttattttctcctggcttttaggtgctcatcgcagtctctttgtggttcttcaatcttcttggtccctcccaggagttcccattgctggctcctcttctcgttctacctgactcccattttatagatattccatgttacagatacggaaattgcagaaccaagagattaattaagtagttagccaggatgcagacccgagcagcctgcctctagaatgtgaaccactgtgactccgaggaggtgaagttgtcagaactaggcagtgcacggcgtttccttatgtcttccgagacactttcccgtaatctcttcatgccaggaacctgggctgtttccctggttacagggacctgcctctagaggaaaggatggagttaaaaagagagaatgagatggagggagggaggtgtgtatgtatgtgaaagagatcaacagccagggtcaggttgaggattggtaattccatgccaccgtagcaccagggaaacccatccagctaatactctgcccttccatccatgctgtttctttggtttatgcagaacccgggcaagcctaccatctgcacccacccctaccccttcatttggcataggaagcctcactgctcactcacactcacatcccctcccctgctcgccagttttgccagattggagcaaaagaggatacgaactacccatatacctgagtgagctgagaggaggggctcggggaaaaaagatatacagaagaggaggctgtggggggctttggaggataacctttatcaaattcacagtttccccactggttagctctgccacgctggaaaaggtgaatttactctgtgagcaacacctgaattgtttttgttacaaagagggactcagagggctggctagagaccgagatctcataagttctgtttctgtagatgagcaagcagaagtcttccctggttgtaagtagtatgttga

SEQ ID NO: 103413 - DNA, 1078 bp, Homo sapiens
agtgagccatgattgtgccactgcactccatcctgaacagcagggcaacaccctatctcaaaaaaacacatttgttaattacttaagaatgatgacagttacaagttactgagcccttaccatgtgccagaaaccctgccagctgcactcagtctgtcattacctctgttcttcacactgctctttaaggtaactaccattacaggtgaccaaactgaggccccagagaagttaaatgttagcattagaggaggaggaaagcagccttcctccatgccagcctgctcactctgtcgaaggggccaggttactcccaaacccccagggtaccagagcaggccgactggcagccctcggcttgtacccccaaacactgatttatatcaccttttttggggttctatttggttaccaaaaaaagttcagcatgttagctctttgagcagttgcttagcaaccagctaatattacagccaaaacaaacagatcaattggaaaataatggaataagctgtacgcatggacaatagctgcagagttttactaaaatctccttccagccccttcatctactttttctgaagaatgagctcctggatgtacagctttcacttttgatctcagaaatgtcaggcgaaagtcagcggggcatggcagaggttgcgcagacttgcctttgaagccaggttccacaacactaatcaagtgtgtgagttggggctgcttgcttcatctcctcattctttcacttcctcagttaatataggagctaatgatagcctcctgtggggctatggcgggtgcccagcaggagttcattttctgccccttggcctattcagtattggacttctgtgctaggcccctgccccaacccaacccccgccattgcaaactctgccaccttctgtgcagcctgggtagcttcatgtgaccatctcaatttttttgctttctgaaaatgagaaactatatattgatactactcattctttcaaaaactgtgtagtgagcatgtactatgtgtcaggcagtatgctacattgtaggtgatgttgctgtccctgggggtcattca

SEQ ID NO: 103414 - DNA, 1095 bp, Homo sapiens
cataacagtgaatgacacttggtccctggagtcaggcactgtgggttctttgttgccctgtcactttgtttttggacaagtcacttaacttttttttttttttttttttttgagacagagtcttgcggtgtcgccaggccagagtgcagtgttgcaatctcggctcactgcagccttccccttctgggttcgagcgattctcccgcctcaacctcccaatagctgggactacaggcgcgcaccaccaggcccagctaactttgtatttttagtagagacggggtttcaccatgttggccagcatggtctcaatctcttgacttcgtgatctgcccaccttggcctcccaaagtgcatcacttaacttctttaagcctcagtttcttcatctgtgatctgaaagtggtaactgtatcattatcctcatccctaaggttgttacaaagatcagatgagagaaggcgtgccagtgcttagtcctgacatacattcagaggctcccagaatgataccagtactgttgaccagaatcttaatatttgtgatattgggtaaaaaggcactagacggaaggacagagagctccgggttcaaatcccaccaactcattcaatcctcagctggtgttctgggcaagtcacttaacatctttgggtttccgtttcctccttctataaaagaaggataaaattacttgcctcatagggtcctgtttaggagtaaataagagatcctctataaaagccctgagcacatatttgacatccagtaaatactggctagatctgaacatccttacgaaggcatgtgcacatgatagttatttaggagaggtaaagtgatgtagtagaaaagaaaaaaaagcaagacttggattcaaagtacacttgtgccacttcctagctgtgtaagtttgaacgacttacttagcctttttgagcctcacttgactcatctacgagatggtgataacgtcagattcactgattattgtctgggttctacaaaataaggtgtaaagtgcctagtaagtagttgatgtgagaaaatattaatttcccttttcttaatgtttctcacctctctgctggctat

SEQ ID NO: 103415 - DNA, 1003 bp, Homo sapiens
ttcaagtgatccgcccacctcagcctcccaaagtgctgggattacaggcatgagccaccacgcccggccaactctcttatttcaaagaagggaaatagagacacacaaaggttaaacaccttgcctaaggttaaacaccggttggtggcacagctgggatagtacctgaccttcacatcatgtgtccttggatcatgccagagaatggcaggctaagcagacgggaccttgggtgacttaagcttgagtctgttgtcttccctcagcactcatccattttttgctcctggataattttcagaactgaactcttttgagttttattgatttcagttgtccttcattggctttttacacatagctgataaacttccaatgcagttattgctagaaacaacaagattcctagaagcaaagtgatgtctctggaaattttaccctatgacagcattttccagagtgtatgtccaaacagttctaagagctgttaattggacttatttaaaatggggaactggggaggaggatggggagagcggagttctatgtactacataccaaatactgtattaggaagtcctgcagccagaaaatctgattgattttgttgatccccagcatttcccacatctattttatatcaacacacaggaaagactcccctttgattacagaatgcctggtaggacaagttccttagaagcccacacttccttacataaatactggctctattaagaagaacacaattttgagcaaaggaagcgccattgtaaagcagtatttggcgaccatggacattgagccactaactgagagcctcccctatagaaggctcaggtgcatgatattaacactgggcctcagaaagccggagggctaggcagagaaagggtggtccaggaggagttagaagatctacttttgagattctggaaaagaccataaattgaatggatcatgggttcataacttggccgtgatcagagaagagtaaccaagg

SEQ ID NO: 103416 - DNA, 1296 bp, Homo sapiens
atcctgggcaccatgggctgcagaaatccaaggagcatccatcactgagtccaccgcaggccccaggaagcactgctgaaagggaggatctgtaatttgtctcagtccctgaatgagtggggctacttgtcatcatgcagtttcctctccaggaggctcaggatgggtaacacagggctcctgcctaggaggccagaggggaaggagacttcgtttttcatatgccagtgagggtagggaagacaccccatgtctgcacatgtgagctcactggatagggccttatgagaccagcaggactctggagcttccagtcagcctgggacattcccccgtctctatccaaacattattgcttggttcctagagataacaggcaagagagatgcctcacagtgcgagccagcctgtgttcagagcaggaggttcaagagaagccctatcacaggggatgcagtgccttgagagccaaaatgggcagctggaccatccgactgtcttgactgtgtctttggctttcatcccccaggatattttcaatgccgtcatcaaacaaaaccccttccttgtgtaccagctcccctgcttctggaatgtgcagctgtcagaccacacccgctccgagcagtgctacagagacgtgtctgatctaaaggtagggtcaacacagggacatccctggaggtagggtgaggtgggccgagaggacctcccaggggcatggatggctgggagatttatgtgcaatgtggtgagagagataagggcacaggagagcagaatgagtatgcttttcatctttgtggggtgttggtttttttccacccttatttgggctttctggaaagcctaaagcctcctggcgtaagaaccagcttgtgtggttattattcttgccatctgctgctggctcttttggttcatgccagctccccaaatctattcattcaactcaagcaaaaacatttattgagggcctactctgtgccaggtgctatagatgtggatgtgaataattaacctgcttccaagtcatgtatgacttggaggaggagagaaatgtgcaaagaagtaagtatttaaaaaaggacaaagtgctatgacaggtgtgggtgggtcagtcggggagatgcaagcataaatgtctcattcttcctcacagagggcggacaatgacagaaaaagctttcatcaccactctgtaggtaccaaacactgtgaatgaacctggctatagaaagaggaagaagacagggtatattagtcatctactgctatagataatgctgcataaca

SEQ ID NO: 103417 - DNA, 1085 bp, Homo sapiens
tgtgaatagccactgcactccagcctgctcaacatagtaagacccagtctctaaaaaagtaataatagagtggtccctggcatatggtataggcatagagttcagtatatattatatgcattttcagccaggcgtggtggctcatgcctgtaatcccagtactttgggaggctgaggtgagtggatcacctgaggtcaagagttcaaaaccagcctggccaacatggtgaaaccccgtctctgctaaaaatataaaaatttgctgggcgtggtggcgggtgcctgtaatcccagctccttgggaggctgaagcaggagaatcgcctgaacctgggaggtggaggttgcagtgagccaagatcgtgccattgcactccagcctgggtgacaaaggcgaaactccttctcaaaaaataaataaataaatgcattttcacattcagccctcttaataattgatatagttgtcaaacattttacttatggagtcatcatcaggatgaggccccaaattccactcctccacacaccaccacacagccctgggcatgccaacttctctgtgccagtgttcacacctgaaaatgcggataatgggaaaacgtgtggcagagggtcgtctcgaagactgaatgagatctaaagtgtgctagatacctctgcaacccaaaagagggaagggcagacaaacagtgagggtgtgtgcgttcaagtcaaaacatggatgtttcatcacacaggcttctttgaactctgtctcggtgtggtagtaagcaggaaatcctgcaagctctcaagacggagaggataggagaaaaatcccaagatgcaaatcgggcagaggtcattgtttaaggagcagctttgtgggtcggatctcaagggatgggactgcgcagaatgttggacagaatggggaagggaagacctgcaggtggagggggcacgccaggctgtggaatgggtgtggccaggcaagtctgggtatacacggcgggaagagccgtggtcatagaggaagccttactactggacttcagagaagaatggagtcaccactcacttgctttaggtctggagaccta

SEQ ID NO: 103418 - DNA, 1022 bp, Homo sapiens
ctgtgaaatggtattggtaataattgcaagagaaggccttctgcatgatggagttgtctaaaggagccaggtggatcagatgtgaaggcccagagacatgtacgccctaagagattgaccacaaggctaacttgcctaagttgctaagatgcagcagagactgaggccaacatcaacgccagctctggggacagaggagcagttgttatctagacaacactcttgtattgatatgatattgacatgatgcttgttgacacaagataaatatatttgaaaggaagcagtgagggtgagaacaaaaaccctgtaagaaggtggacaaagagtggctcttctctttgggctctcgtctcagcaaacaagggtaatccctcctccctgtcgtgagaaaccaatcccagtccattcccagaaaacgagtaaattaatgtacagtgggaaataccagaatgggaatgcttgagaaatagtatgcctgtcaataaatatgtgctccatgagttaggaaagaaatgcatgcatgcatgcatgaatgaatgaatgaatgaatgaatgaatgaatgatttgggattctagctttatcagattcactaggtgacctgcagcaaatcagttaactgttctgggcctctatttcttctctataaaatggaaataataaaaatgactgcctaatggtgagaattaaatatgttaatgcaagttaagctgttaggtcagaggctggcacttcataaaacctctcagtaagtgaatactgttgttgtgatgatttgccattaccctgtgtcttcaatagtcactgatccagatggcttggcttctccttttaagatgtttgtattctctgtacctcacaggtcagcaagtcctgggcttggtggagaaccagagtgactggtaccttggaaacctgtggaaaaatcaccgcccatggccagcccttggaagaggctacaacacaggtaaatcctcagggtggtatgggaagagttgcagaaggtgatatgaggaccca

SEQ ID NO: 103419 - DNA, 1023 bp, Homo sapiens
gggaggcagctttgtgtgatgaaaataacaggactttgaagtcagacaaacctggatttgaatcgtggctctaccgtattctagctgtgtgccctaggacaagtagcttaaactgtcaacttcagtttcctaatccatacaaacggggattaatatatgtatctcagagagccgctgggaaaaataaaatagatgtatgcagatcttgtgttcctaggaaatattcaataaatgttttgattttgtgtcctcctttttgccaaaggaattattgatcagaagttgataagtaatgggatttgagactccagaatgtgctgcctaaagatggtgactataatagaaaaattagatgttggggtttgtttatttgtgtttttaaaaggagatgggagcttgctgtgttgcccaggctgaccttgaattcctgaactcaagtgatcctcctgcctcagtcttccaagggactgggactagaggcatcactgcacccagatcaatgggtttttttcatgttaactttgagtgacagcctagttgagatgcctggggtagaattggtgatatggggccaaaactcagctgaggcttgagaggggtgaattgtgcagagacattgatttggagagtcctcaacaaaggaatgaatgctctgatcaaagagtcacaagatcaaaacagagaccaggctgttggtgttccatgcgctcatcaacgctgttgattagcattaccccatcctaggaaacatgacaggttgcttccagatgttaccttcaagatctgcattcctttcagattgctcgtcttctgccacagctagcaagatttgcccgaacattgaggtcacagcctcaaatgagcccctcaaagcctcagaatgacaggagagaagcttggtcaggcactccactggcatctaaggtagactgagctctgccaatttccaaagacagatggggctgaagagccaagttttggtaacatggacaaaaaccaaagcaattccagatgttagagccg

SEQ ID NO: 103420 - DNA, 1064 bp, Homo sapiens
acagaagtctaacctgaggctcagggagacttagatttggttaaggtcccacgctgtaaaatagctctctcagattcatgcatggtgtttctatgagactacactgccttttactcagaggaggcatttgaactgaatctaaatgaaaccttagatggtgtgggccagaccagaatggggacctgcattcagagaagcaagtgctccccacgaagaggtcaaggtccgtgtagaggaagtggaactcacaaggtgagggcagcttatggacgagaggaatgaggggcccttccggggaggtgagggagagcatgtgcccacacggggctgagaggcttcagttaagagaccaggcttgtcaggacagcatgcactggtgtgttttgacagagaggagaacgtggagcaaaaggaatagattctaagatctttgagggcaaagactgctcattcctgtttattattcccaatacctgaaatagagtaaatacatcataaatgttcacttgaaagttgtgtggcaggttgaagccaagccaaggagtttagggttgaagccacagcaagagagggcttgtctgcctttttagagttcaataataatgccatgatgtatttaacttttattttggtttcaggggtacatgtgtaggtttgtgatataagtaaattacatgtcatgagggtttggtgtacagattattttgtcacccaaagagtaaacatagtaggccaggcccagtggctcatgcctgtaatcccagcactttgtgaggctgaggcgggtggatcacaaggtcaggagatcaagaccatcctggctaacgtggtgaaaccccatctctactaaaaaatacaaaaaattagccgggcgtggtggcaggagcctgtagtcccagctactcgggaggctgaggcaggagaatggcgtgaacccgggaggtggagcttgcagtgagccaagatcgcaccactgcactccagcctgggtgacagagcgagactccgtgtcagaaaaaaaaaaaaaaaaaaagagtaaacatagcacccaatagatggttttt

SEQ ID NO: 103421 - DNA, 1661 bp, Homo sapiens
ggggcagatcaactgaggtcgggagttcgagaccactctgaccgacttggagaaaccccgtctctactaaaaatacaaaaaattagccaggtgtcgtggtgcatgcctgtaatcccagctacttgggaggctgaggcaggagaatcccctgaacctgggaggcggaggttgcagtgagcctaagtcatgccattgcactccagcctgggcaacaagagcgaaaccccatctcaaaataaataaataaataaataaataaataaataaataaataaataaataaatatgactcactgatgctgattatcaagtaggtactaggaactggtctaaacattttctctaccttgatctccttcagtttgtcttcataaccatctctatcacataaatcctattattatcatccttatttaacaaataaggagaccaattaagagatatgcaacttgcctttgactggtaaagtgatgcaaataggaagagatgaaacagagattcaaaccctggtagtcccaccccagtattcatcttctatatgggattaggcaagattcctgaaaaagcttctaaacccctcatattaaacacaaagactctgttccagtgagtagactatgccattccctgtccccaaattcagcctggctccccctccctggtgcatgtcctgtagatggtggagtgaaaagaggtgcagtttgacaaaagagggcattccatctccttatcttctgatattactgtcagaaacaagttcctggcctctcacttcagctctcttcttttcagccagttatcccctgaacaaaattgcctcaagattacagatgagcagctgtgttttggatgcaggagcattgccatcttgctgacagctgagttttctctggggacatcagctagcccacagcaccccactctttttccacactccttattttcctgtaagctgtggttggtttcctcttgtgaccacaaatgaatcaaaaagagaactgtttcccagttattccttattatgtcaaagcagatgttcaaggtgaggctccggatgacttatcaaaactccagaggtgatttgtgtcctgataacagtgaggtctcagactcacatgtatgcaggtggaaggcaggcagtgtcaatatgcaaagcgtgccaggcataagggggtaagcgccatgtctctaccattgtcaccaagcacagcacctgtctagttgtattgccttttaaaagacagactaggccgggcacagtggctcatgcctgtaatcccagtactttgggaggccgaggcaggtggatcacctgaggtcaggagttcgagaccagcctgaccaaaatggtgaaaccccatttctactaagaacagaaaattagccaggcatggtggtgcatgcctataatcccagctacttgggaggctgaggcaggagaatcacttgaacctgggaggcggaggttgcagtgagccgagattgcaccattgcacttcagcctaggcaacgagagtgaaactccatctcaaaaaataaataaataaataaataaaaataaaagactagatacattggccaacaatatatgtttgaggccctttgagtgaaaaagattatccagatttagtaaccttgaagttcctgtgaaatatgtgatc

SEQ ID NO: 103422 - DNA, 1048 bp, Homo sapiens
tggcatttcttgtaatgctctctctcccctagcccccaacctcccgacaggccccagtgtgtgatgctcttttaacttgcagtgagacctgcctttaacatgcaggaagtagttttccaaatccagaaactgtgagtcccttgaggatccctattatgttttgttcaaccctgagcccccagttactggaacaaggctcagcatagaacaccatggcttaatgcccgataaatgtgtgagaaatacaaaaacagaagaaaggaaaaaggaaagaggagaaaagcatgaataacaacaccttgtctttgctaatattatagccatcaccgacccattgcaagagggatagagtctccgagaggtttttctaggttatgacctttcttgcaagtcaacttccaagactcctgcttttgacctcaaaccaaataattctacctaattcctgattcaaattggtcataaaatgtagcaatcattttgataacacttaacagttcaagaagtgctttcagttagatttaagagctagtttgtggagtacagtagatatgatgatgatggtaataatatctggtaggtagtgagaaagctgaaaatcaaagaagttgacctaactgtctggtaggtaggaaagaaggaaactctaatgcaggtttcctcactacagattcttgactctgtctgtgacctgtatgtcactcaaaattttattgtcctaaatgaggtggccactgcctgacttttgctaagagaactggtgccggtctctttatgaccaatttttacatcatctgtcaacctctgtttcagttggcagttgctctaacgggcaaggtttacccagggaatatccaccttgaatgttggcagttgttctaacgggcaaggtttacccggggaatatccaccttgaatgaaatctctgctcatccaacagaaaaattagtgatatacctgccgtgaatggtggtgtttctcttatctgctttagtatggctttactggtactgtttgacaagaagacaaatgaaaaattcatagggtg

SEQ ID NO: 103423 - DNA, 1176 bp, Homo sapiens
ctggagcttctttgaagtgtcaccctccaccctccgtctttgattcctccttagggtgttctaatcatggagggtcctaggctgtccaggaagccttccatgggcgcccgcacctccacccagtctctaaacccttttcactggtctcataatgatagttgtccctctcccctgagctagcacctatgctgggagtgaatgatcttctatttcttctggggctagcaatccttcctgtagtttagctgtgaatttccattaagccacttgtttggatgggcttctgtgaaagccactgttgaagtaatgatgataatgatccattccatttattgataatgccactcattagattaatggcttcctgtgtactgccttatttaatctcccaacaatcatgtaagcaaaggtgctttcatcatccccattttatggatgaggacacaaagacttagagtggttaagtagtttgcctgaagtcaaagagtcaccaaagagtgattctgcagttagagtcaggcagagggatgctccactgtgcccttacccacgttgtaaaccaggaagctatgagaccaatttttctttaacaaattcactagaatttttatatccaaatagtctcctgcgggagattccacactttaatgatgtttttcttttgctttaattgtcaacatcatggtcctcaaagagtgtttgtacctataattgaacaggtaagattaggagttttcgaagattgagataaagtaagtgccttgctaattcctttgctgcctgaagatgttccaaagcttaaattgaatggtcttttgagaaaatcatctcccacttagcacctaactgttggcaaagcagcgtgctaatcatgggggattcaaaggtgaattagacccacttcctactttgagaggcttttatgtgtaaaagaaaaaagaaacatagaagcagacttacatattatcttatagatgtacatgatacatatatttcaatgtatacatggtatctttatgatataaaattacatattttagtccagtcgtggtgactcacgccttgtaatcccagcactttgggaggccgaggcaggcagatcacctgaggtcaggagttcgagaccagcctgaccaatgtggtgaaaccccgtctctactaaaaatacaaaatgta

SEQ ID NO: 103424 - DNA, 1007 bp, Homo sapiens
tggtacaaccatcgccaccatccatctccagaactttttcatcatcctgaactgaagctttatacctattaatatatataataactgtacattctcccctcccccagcttctggtagccaccagtctcctttctgtctcaatgaatttgaatattctaggtatcccatataagtggagtcatatgatgtttgcgggtttttttttagtgtatgtctggtttatttcacttagcatgatatcttcaagtttgatccattttgtagcatgtatgagaatttccttctcctgggcatacacttcaggactgtcagcatccttagctctgcactcagagcccctctctaggattaactcccagcaccagatgcccattcagacaaccttgtttcatttgcacctttctgaagcaaacagcatacctgctctcgggtctctatgccattgcaaaagctggtccctatgcctgggatgttcatgtcatcagcctgctgaattccatctcattcttaaggcttcccttgactatcactgtgacaggggttggggggtgtttacttggatcacagcatgtgacaccatcatgaccatcaattcccttacctcttcttcccactccctcttcagcctgtgagtaccttaaaagcaaactctcccttgctcttgtgtctcccaaatagctgacatgaagtctgggggtacagtctgctttgttgtctctaatacttctcctgagtttttttgtttgtttgagacagagtctaactctgtcgcccaggctggagtacaatggcgtgatctcggctcactgcaacctccgcctcctgggttcaagcgattctcttgcctcagtttcccaagtagctgaaactacagacatgggccaccacacctgtctaatttttatgtttttactagagacggggtttcaccatattggccaggctggtctcgaactcctgacctcaggtgatctacccgcctcagcctcccaaagtgctgggattat

SEQ ID NO: 103425 - DNA, 1049 bp, Homo sapiens
agaacaaggaaaaaaatcatggctttacaaaaaacaactgtatggtcaacctacaagtaaacagttccctttcctgggcctcaggtacaataaagagatgagacaagaagatatgctacagtcccatccacttgtaggggagttagccattgcagttagacagtttgacaaaagccatctctggctgtggaatcaaaggaggaaaggctgggtactaagtagaaaaatgacatttcgtttcgtggaaaacaagcaaccttgacataactcagatttgtcttacaaggatggaatgagcagaacttgccttgccagagacgcagttcacaatggaggtagtcagagataagaagacagactagggccatgcagagctgaatgcattccttctaccaagtccttttccagggtaaagctctccatccctgtcatagggtctgcaaacatcacagctgctggggtagaggaagggtccattctctagactggatcatgagatcagtcccactggttgtacttcttaggtcacctaaaatccatggaatatttgggaactatgattacagagctagacgtgccctggaatttatcatgcaaagctgaatcccccctcactctgagtaacaacacagaaaacctctttaaatgccagggaaatatcacccttgttgtctgtatcagagactaaaagtattcttaatagtttaaagggtactcaataaatattaccacatggggtattaagcttccagattaccccacctcaaggcatacagcagtacacacacaggtacaactcatgtggctggcatcagcaacataaagaaatagcagcagtaaaagctgcgtgtgaagatacctgagtacagctgccacatgtggaaacatctgtccaaatgggaggaaagtctggctgcccccgtttggtctcatcagtcatttaatggcccatcagtaaaacaggaagaaaatcactatgtgtgtgatggattgcccgacaatacagaactgtatcggcacccgccaccttgaattgggttcatttgtat

SEQ ID NO: 103426 - DNA, 1443 bp, Homo sapiens
tcatcattctggaagccttttgtaagatccagggcgctgaccagggaactttccatgcaccaccttttgggcagattaagtccggggactactgcctcccctgcctgggttcttcagtgtataaaatgagggggtttctggggtagcttttctggctgttttctcgttgaatgtgttgttgatgagtccagagttcttgtttagctccagtgttctgggaaagatcgtcctggctgtctattttctgctccctgtgaaaatgagttcattcattcaacaaacacataccaagtgccaatcatgtgtcaggtacgctaacaggccctcagaatacagcagcaacaaacagcaagcagaccctccggagtttaccttttcatggatgtgatgtctgcagggatgaacagtttgtcatggatagatttgctgctctctttctaggtctctgtgcatcaatttgcactggaaaagccacttgcaatgctgtaaaagaaggagtatttggagcgaaagtctagggaccttcattaaaatctaggtttctgggcctcagcaccaacaagtgtggctttggggtcaagagcttgcggtctggaatcacatcatgcagcattcattcttttttgttgttttttattttttattttttttttttttagctacacctgctgaaatgggaggggttcattcttggctctactgttttctgagaacttgaacaaataaactgctcgatatcaatttgtttttattttcaatagcaaaataaagataggaacattacgtgcctgcgaggagatcctttacctaaagcgcttagcacagtgcctggttcatgctgttcacacagtgctgtgtgttcatgttattgacagcctcagtgacagcctcagtgagcttaggtcactatctttgggccttggctgtccccttctatcaaatgaagtgattgtttcacccctttataggtccgtgtttctgactcactttaataggactgaaactcgtgattgtctctcctccacgtgtagactagccgactaaaagaaggctatatgatatatatatacacgtagttgtcccttcatatccgtaggggcctggttccaggaaccccgtggataccaaaatgtagcaatgctcaagttccttatattaaatggggttgtatttacatacaatctatgcacatctcctgcatactttaaatcatctctaaattacttataatacctagcaccatgtaaatagttattatactgtatgaatttttaaattttgtgttactttcgtttatttttattttcattgttttttcttagaatatttttgatccacatttggatgaagtcgcaaatgtagaacctggagatacagagggctggcagtatacacctgtgatacatatgtgtgtgcatatgtctatgaatatatatatacaca

SEQ ID NO: 103427 - DNA, 1087 bp, Homo sapiens
gaaattgcattgtaggctatttaaggaactttccacataagtttgtcaagccagcctagctaatagaacaggatatgtttgagcaagttatttaccccattgggcctatgtggaatcccactggctcctttaataaaagaacatccagtcctcagggttggtgataagatgagtgtgaagtgcggatgcccatgggcatggggaatttatttaccagttcttttattaaaagagctggcaggattctgttaccaggacttgcctttttttttttcttttaatcagaaaattttgacaaagaatctatgaagtgcagatgtagggccaaccatacttttcacacttttttgattgtatcctacagtcagaaatacatttttcatcacaatccaaaagacatatgtgtgtatgtatgtttatacaggcatatatacacacatatatgcagatgagcaattaaaacaatattttcgtaaaacaatacttgaccttactatgttcagtgaatttttatatttcttttctaatctatttaatgtattttaatttttaaaatgcttgctcagatccactgaattattttcacaaccttcaaatgtgttacaaaccctagtttcaaaaacactggactggaagatatcctaaaatgccttttaactctgtattaagcattctgaaattcagcaaacttgccagcaatcagagaggagatcagaagctcattttctagaacccatttgctggaaggggcagtgagtaatctcttgtagacggcttccttgtcctccagtggccttccccttcattgagttactttgtgtggccgtgccaagcatggtggctgccacgtggtggggggagccttacatctcattttccttacttcccaggcaggtgccctgttttatttatctctgtattccaagcatctagtaaggctcaacactgggctcagtaaattgatggggaaacaaaataaaaaatgtggctccattttcgtttttcattaaccttcagggaagattgcacaatgtaccttcgtaatgctattcattttttaactagcttcaattcagctcagaaatat

SEQ ID NO: 103428 - DNA, 1029 bp, Homo sapiens
atccgcctacctccgcctctcaaagtgctgggattactggtgtgagccgctgtgcccgtctgccatactttataggaaaactgggcaccttctcttctctgagtgcagttgttgtcaacactgcctttaagttataatcatctggggagcacgtgaagaataatgatgcccaggtctaccccatatcagccaagtcagaacctctggtatgggcagtggcctgccgtatttttgaaagctccctacataatgctgaagtgtggccagggttgagattcactgccctaaggttgctatcccaggatctgctggctactgcaacaaaagagacactgtgtcttggttgttttgccatgggggcagtggggcagggtactgtttgggaggagtgtttggagacgggattaaaatcctggcacttgtccctcccagggaaaagggtcatcctgtttattttgtgtcaagagctcaaacagtgatcaaaatccaatccaacatcataaataccagaaaaggtcagggctgggctggtcataggatcaagcacacacagccgagctgaggttggcacttagtcaactccaaactcttcactagcaaacagcacagggggggacttggcaaggcccggcctcttggcgccccagtcacagaatggaggttcacatggctctgttgtttttgtcgaaggaggagaaatgccattttctcagcagtccttctccttgactcattagtgtagttggcaatgtggttactttttaacttctctgcaaatattcatagaaagagaaggggagtagaaggcaggagctgttaatgtacaccaagctcctattttttgcaggcctccacagggtaaaagggactggcccccgtgcaccaggccactgccagtggtgcagatgaaggacctgagcccccacaggcatctgaggtcacatggtcagtagagctgggaattttatcccgggtcagaagaacttcaaagcccatattttgtcttattactacacatcttaagagatt

SEQ ID NO: 103429 - DNA, 1031 bp, Homo sapiens
ctggaagggatcttagaggtcatgagttagctcagtgccttttgttgcaaaggtcaagaaggttctaaggtctttgacttggatgatgcaatttcaagagaacttcgcttggacagaagtctgtgtttcatctttactagctgtaggcgagtccctctacctttctgatcctaagctatctgttcagtaagtgcttcactgagtgactatagaaagcatgaatgattagtaaaataaatggatttgagtaggtgggcccagtgtctctttcaggtctatggatctgatgcaaattcacactgtcaggggcaaagccagaaccatataaaagcgggcatctttggtacctctcttgtcctcataccctacatttatcttccagtaagtcctgctggctgtgccttcaaggttctatatacctatccaagcctactagatactaaaatattagttattgaataaacaaaattaggtctctggcctctgggctctttggattctacgatatatttttctcccttctgttcctttaaaggagcaaataagagggaccctgaagtcaccaaggggacttgagtcactgagtttatatccggcatgaaacactgtccaaggcaggaatggagacacagagtgaggaagaatgacgaaatctgccccaaacagggttcccatgagagttcaactaatgaacagtgacctgctggctcagcccagggagaatctcaaaacataacatttggcttccaaatcatgctagattgtagtctatatctctggagacagatctggtagcagttacaatggaagtgggcttttattctttttttttttttttttttttgagacagagttttgctcttgttgctcaggctggagtgcagtggtgcgatctcggctcaatgcaacctctacctccttggttcaagggtttctcctgcctcagcctcctgagtagctgggattccaggcagccgccaccacacccagctaatttttgtattttagtagagatggggtttcaccatgtt

SEQ ID NO: 103430 - DNA, 1029 bp, Homo sapiens
tgtaggcatgtgctaccacgtctggctattttttttttttaatttttatttttgcagacacagggtctcactttgttccccaggctggtctcaaattcctgggctcaagcgatcctcccgcctcagcttcccaaagtgctgggattacaggcgtgagccactgtgccccgctgagtcattttattgtaatcacaataagatggctgtctacatacctctaaacagttcaggatgggagaggttcttaatatcagaggagacaatgcaaggccttggagtaaacacatttccaaaaataatctctgtcaagatggggaaagaagcctgagaaatggttatgtaaaagcataggagttgggggtttgctcctaattggaaagagctggccgtgtatctcagtggggaaagtacaggctgtagagtgggatgattccaagacctgggtttgaggccccacgcttccaggcacttcgcaattcagcttctcattctcaatgggaatattatgttaggagcaaaatatgtaattcacctagtattttgcaggtgttttgtcatattatctcagttctatgatacaggactttgcacattttcccatttccgaaactgagatgtgacttacaaaagcaacttgacagatggtctttttctcctggcaaatgttttgatatatcgtacaatcagcagcctcttagaatccagaaaatatgttgtgattatttttattagcaatatctctctagcttttctttttatctttgagttgtacaggggagaaggagggcgagtaggactgtagactaaaggagaaagagctgagtcagtcaaagagaggatttgggggtcttagcagactcttccttgatcaacttttattgtttgaccacagggtcctggagcatctgcaccattgctatttttttttcttttgtaaataaatatcgtgcttgtgtctcccgtgttgagataggtgccatctcttggtaagccctcccatgtggagactgactgtctgtttcctggaag

SEQ ID NO: 103431 - DNA, 1048 bp, Homo sapiens
cttgaaagttaaataaactgatggctcacgcctgtaatcccagcactttgggaggccgagcccggcagatcacgaggtcaggagatcgaaaccatcctggctaacacggtgaaaccccatttctactaaaaatacaaaaaattagctgggcgtggtggcggacgcctgtagtcccagctactcgggaggctgaggcaggagaatggcgtgaacctgggaggcagagcttgcagtaagccgagatggcgccactgcactccagcctgggtgacagagcaagactctgtctcaaaaaaaaaaaaaaagttaaataaactgggctcaagagagattaaattacttttcatgctcagagagctattacatagtgaaactgaaccccaatccatacggctttggagtctgtgctctgtccactgacccaggaggctgtactgcacttagaacgggtgtgactgctgagtacgtgtcaccttggacccctgcatgccttagtttttactgcacaaaacactggaaataatatgtgattgttgtcatttggggaggctgttgtgaaggcataaataataaatacacacccataatctgaagcttttggaagaaggccgtgctgaatattcaagatagtgatttgatccataagcacagatgcctcccctctaagaggatcttagtgccacagagtaaaattctcaccctacagcaggtatggtcaaactatccagcgtacatgggcactgccttcctcaccctcacggcaccgcagatgtgccatgccactgggtatcattcagggcctaatagactctgtgttgttccttacaactaacatgtttaagcacttagtctgtgccagccactctgttaaggactttatggataaactcatttaatcctcacaaccctcccatgaagtgattactgttgatgttcctattttagagatttgggagctgatgcttagggaggcatagtttacctggagtctcacatttcttaagtcatgaaaccgagatttgaacccaaacagtctaactttgaatcc

SEQ ID NO: 103432 - DNA, 1032 bp, Homo sapiens
agaaaaatgaactcaggcctggctgactccgtagtcatgcacattcatcaaacagtttttgaataattactgtgttgttaccacagtcaaaaagacatcgtccctgcctcaaggagtttcagtcaagtgcaggagaggggcatggaaaattgaacccagcaggataacatgctgtgctggaggaagggaaacagcttgcttcttgctttgggagcccctaatccagcctggggctgtgggggtgggggtggctggaaggcagtgatttctaagttgagacttgaaagagggggagaatgtggatggaggtgggggaagagtgctagatatcatgccgtctctaagagggtgagctatttgtaataaatgtacctgcttcttaccacttgttctttccccaccaccaaatttcttaattttccaccttttcctggggctttctttctgaatacaaactcatcccattgcctcctttacaactaattgaacacttggacttaattgattatgtattaagttggggacttggagtgacattcaggactgggctcatgttgagattaatttattcctgtagtcttcctgttttgcagtgtaactgagtgcctcacatgtgtgttaaaaataaaacggagagtcagggcaatctaattagacagcttaacccatcactctcgtgttcagtcttcacccagctctcctgctttgatggtaaccaaaatagatgaataagttaatcaaaggtctgattaaatagcacagctctgcagcatggactaatgattgccaagcctcagttcaggcagattgctagaggagagaggaagctgagctgagctccaaaggccagggctttcatgaggaagatgtttataaagcacatgggagggaattcctcactgagtcctcggatcttaacggtgatggctcactctaaaggaaggataatgtagtttggggaaagaacacaaaccttctcctggcaaattctgactcttagagctttgcatcttgctggctgtgggattgtag

SEQ ID NO: 103433 - DNA, 1019 bp, Homo sapiens
cttccactttcttctataatattctatacaaatggtcattaatcttctgcttttgaatacttccagagataagagatcattacctcccaaaggaccctgttccatatttagaaactctattagaaatattcgccttatgccttactgaaatcttcatctttttcattctcctcattggtccacctgagcattaatgaagatcaggtgcaagcctgtgtaccatttgtctgttccctcatctgccttctctactagacagagggaacctagagggcaaggtctgtaacatttatgttcatgcccagcctttggcatgggcatggccagatttggacaaaatctggccaatcctggcctccagcaaatacctggcttctatgttttgagctacacagtgtgcatcaaccagttgtttgaagacctgacacatttactgagtcctctcttcttctcagtaatcactactacatttcttcaactgtacctgaaatgacagtgtatggagcctaggtgacagttgacccttaaaacatgtcttctgacctgcttgtggaataaatgccttccaggttgctgacttgcttaaatgtgctccccattgtgtctccatcccatagacagagacattctctgtggttctgcaaatcacagcacttggtctagatctgcatatgtgacatgccccaccttgagctacagttggtctgagctcagagtcttaaactcatttaaaagcagtgaagtgtcccaactcaccttttttctcatcctgagcattgtttccttctcattcttatttattgtggtcttctcattcatacttcatttaactgataaggaaatgctttatctgtatcaaaacatctcttgtaccccataaatatatacacctactatgtacccacaaaaaataaaaattaaaaaaaagagagagaagtgctttcatatacctactttcattctgtcctcccaagaactccatgccacagagaggacatgtgttttattatgttttattt

SEQ ID NO: 103434 - DNA, 1137 bp, Homo sapiens
tctgtgagttttgaccaccaaggctttctggagacgctggagagcattggcctggtgtataatctgaaagtggtctatggtagctgtcatctagagagttccattacccagtgaagtaaaggctgaactcagacccccatgggctggggtttaaatttgcctgttgtcacttactgatcaaaagacacaaagtaaaccacgcatctctgctggacctgttttctcatcagtagaaaaggtggatgaaataccaaactcatggggataattaagaggctcaaatgagagaatatatttgaatgtgctttaaaaagacactgctgaataaatattaaaggttatgtcaggctggaggggtttcaaccaaatgaaacctttttggtcatctcttccccttacaatttttttgtggtgccattttgcttgcatcgtgttgagacccacagcccgattaagaagtcctgtatattctggctcttgattctacttccagtcttgtcactggcattcccgtaaaccttcgctattcctttaactctaagtagcagagcacacctctggttccctttgccccctcttctgtgtttgagtctttgcttattctgttccttccatctgatatttccttcccacctatcttgccacaactcctgttcgtacttcaggactcagctgcagtgccaactcctcttaagaaacagcctgacttccacaggaaagaggaagacattttttgttcacttgtctgtctactgaacctttcttaatggggtaggaggagaggagccgcatcttattcttttctatatttctggtgcatagtaggtacccactaatgcttgtggatttaacaaattgctgtgattagaggaacatgtaactttgcagaaatgcactgatgctctgtctctgatcaccttgggaaggactcaacacctaagcatgaggctgactctggcaaattgcttgttccaaacctcataaagccattatcttttcattttagagccatagcatttttaatagatcactgacatgccagccagagtttctgattttcacatatttcaggctctgaggttgatggagatgttcagaatttagcatttggggattgtcttggtaatttgcgtgcca

SEQ ID NO: 103435 - DNA, 1037 bp, Homo sapiens
tggtcacaggcagaactgagggagaaatggctggagtgcagggtttaaggaaggggtgtgaagatatgagctttgagggacagatagggtgagatcgttgaaggtcttttttgctccatgcgagaggctggggcttatatattgtacagtgagcaaggggctgtgtgattacattagagcaagtgtatggcttaggggctagaggatatatcagagtgagttagagagtcagaaaaacagtgaatatattcatgagaaaaaagagtgaatattttcatgagatgtccccaaggttggataggataatgaggctaacatttactaagtcctcacttcctgccagtccttgttgtaagtgctgcatatgttttagctcaatcgatctgacaataactgtaaggtaggagctattgtgatcaagcccattttgaagatttggaaactgagactcagaggtgaagaagctttcccaaggttcaacatttgttcatgacagaaccacgttaagaaaaaaaaaacaggcagttttgctttcaagacccagctcctaaccattaagctaagctgcctttcaggacttgaggttgattgagtgtgtggcatacagctgggtggggggcccagggcatacccccatttctagcttatgaggctgggtgaatgaggcacctttaacgcaggcaggaaattcaaggggaaacctgtgtaaggggccaggagagggaaaactgatttctgttttggaaattgaggaagccactcatccatgcagtcctgcagaataaacaaaagcccctccttactgtgtcaggtggtgctctgggagctaggatgcagcagtgaatgcaagacccagtctctgtccccaaggagcttaaattctaaagaagagacaggtcccagacaaacactccacaaatcattagaaacttggtgtgtagtagccgggcgtgatggcacatgtctgtaatcccagctactcaggaggctgaggcaggagaatctcctgaacccaggaggcggaggttgtggtgagc

SEQ ID NO: 103436 - DNA, 1009 bp, Homo sapiens
gagttttgctcttgtcgccaaggctggagtgcagtggcatgatcttggctcactgaaacctctgcctcctggattccagcgattctcctgccacagctgcccaagtagcttggattacaggcgcctgccaccacacccagctaatttttgtatttttagtagagactgggttcctccatgttggccagctggtcccaaactcctgacctcaggtgatccacccaccttggcctcccaaagtgctgggattacaggtgtgagccaccgcccccagccattttaactctttagactttaggttttttttttttttttttttaaatcagttaacttttgctgtgtgtcagttcaccctaaaacttaatggtctgaaacatttacttattagttcagttgtttctactgggctgacctgtacggttcttctgctgggccacttacgtgcctgcagcaagctggcaagttagcaagcgtcaaattcactgcccatcctgaatggagaagtggataggagaagtaagcaatcaacaaatagataacagttcaccgtagaggctgtcagttcttcctcatagcgctgtccagttggaattatgatttcagttgtatatttgaagaggaaatggaaacaccaaagaaagaatggccaaatggggcttgacctactgtcttctgacctgaggtgagatgccctttccacattgttattgtttctctgcagttttgaaggctcctttcagtactacggccttcatcctgtggcttaaaaccaggcattttgtacactaagcattgaatgagatgagtggtcttcagacttttatgtatttactacttgttgccatgacgtatcaggtctctccctggtttaaaaaaaaaaaaaaaaagcccactttctagaaaagggcctttgcatgatgtacaggtattcaattacgctatttctcaattatggcaaagttaaaggtcataaaaacctctggtgttgtgtataaattttattcctgtt

SEQ ID NO: 103437 - DNA, 1047 bp, Homo sapiens
ccttcaattctgccagtcttccgttctttgaactgtatcccagatggggtgcggaggtgttcctgtgtcccctttggcccttttattaggttgaccctaacccaacacatcttgtgggaacatttcactaactctctgagccataacttcttagtctgagatccctgattgttggttcatactttcaagatgtatttctttcctctctgtttaaccaattgtcattgtcgctcagcttgaggacaggagactcactgtttgcctatttgagccaatcaccatctctcttgtccccaaaatgtaattggaaggagccttaatggtttccaaatgataatagctccataagccgattaaaaaggccttaataaaactgtcttgagttattttccacagctgcagacagtgtcctttgttttctaatgatgccaacaagaaatcagggcaatttttctttctagtgtgatctgaagcaccaggaaggcctccttccgtctgtctgactgctcaccccgtcttcttttcttcccagacaatccacgttgctattgtctgcgccggatacaatgccagccgggatgtcgtcaccctggtcaaatccgtcctgttccataggtaagaacaacttctgtgctgtgtgggctgaggtctgtcactgcctgcctgtgtatttccttggggaagggttaaataggagcaaaatttctcatcaatcattctagctgccataaaaatgtaatttttgtctgaaaccctgaggagatgattgtgttaacaatgtttaatgacagcgattaggtgctgtcttgccatgtttagaattgtaactctcagacctaatgcaatcttaaaggacacctcaaatctgatgcttcagtctctctatcagcttcccctgcctagcatttaccagatctcagttgttatacatccttgtcggtaggttgtgttatggattgagttatgtccaccacaattcttatggtgaggccctcattcctggtacctgagaatatgactgtatttggagatagggtctttaattag

SEQ ID NO: 103438 - DNA, 1025 bp, Homo sapiens
gacctcaggtgatccgccgcctcggcctcccaaagggctgggattgcaagcatgagtcaccgcgcacagcaaaattagcctgcagtgatggtgtgtgccaccatgttggccaggcgggtctcgaactcttgaccttagatgatccgcccaccttggcctcccaaagtgagccacaggcatgagccaagaccccaccctttgataggaggaatgttgaatagttgtgaccatttttaatctaccacaccaagaaacttaaaaactgaacttaatagcttcaagccctaaagtcacatgacaaaaccatttttgtgaccccattctttcaaggatcgtttatctttctccctactctccccattcccactccaacccctgccccactcatggttcacttctgtaaccccagattttggaacacccaaaactcctctaagaacatagtcgatgccactgtgattttctgctttcccagggagcagggccctgctgctatgcctccagatgatgcatttattcatggtggcaggtgtattcgatgaaactaaagagattggaaaattatgtaaaatgttcaagaatgtgcatgcttgtgcttacatttaatgggcccattttaaaaagtctctgaaccctgaagccaagacaaagtttgatatctctgaggctgtatgtttaaatatttgcgattctgaagagcctgattcagcgtgtttttccccattctcatccccttcccagttatgtcttccatgtgcaggcgttttcctattcatttccctcatgattgaaatggtgacagttacatctgcattataatctttcatcctgagtcttttacagatattatccagagataagcaatggtgtctttcttttacaggtggagaaattaaaatatgcataaattagcctgaaaaaaaggtaccagaaaacccagagggatctgacattgcttcattttgcttcattttgctccctcatccctcatacagggttttctaacagcactgctcttgaccttt

SEQ ID NO: 103439 - DNA, 1350 bp, Homo sapiens
gggtaccatgtctaggatgacaggaaattagtggaagccttagcattgccttagaaagagcttttatggttcattactcaagagctttgtaaagcttttaaaaagtataaataaaatgtataaattctcaagtttgttacattggtgccgtttcctttagggatcagcaagtatctatgaatgcctgaaagtcttctgtgctttctttccagccaacaggacaagtgagatgctgaggaaaggtcctcagtgttggtcaggtcctggcaagttactgcttgcatgcttaggggctgaaatgattccaggaggggccaagaggtatgggcagggctgaggggaggcaacacagaggcaggaaggtgttaagaaacccagcaaggactggaacttgtgtgattgggcccctgacaggagccggggaaatctgacctctgagacccccactggtgcctcccaatgaccaaactcaacccaaaatcagaggcaaaaggagcccacttaacgtggtctacaaaggtcagactcaaccaggcacggtggctcatgcctgtaatcccagcactttgggaggccgaggtgggcggatcacatgaggccaggagttcaagaccagcttgggcaacgtggccaaaccccatctctactaaaaatacaaatattagctgggcatgatggccgcatgcctgtagtcccagctacttgagaagctgaggcaagagaatcgcttgaacctgggacacggaggttggagagagctgagatcataccactgcattccagcctgggcgatagatcgagactcggtctcaaaacaaacaaacaaacggccagactctccagacacaggactgttaggagaagggtagagagtgagttggaggggcaaacgagaacatcattccatcctccatctggactttgtgacagagaaacatgagtgttatgtctatacagtcatgtgttacataatgacatatctgtcaacagtggactgcatttaccacactgctcccatcagatcataatggagctaaaaattcctattgcctagtgacatcatagccatcctaacatcatgtgcaacacatcgctcatgtgtttggtgatgttggtgtgaacaaaccgactgcgctgccatttgtataaaactatagcgcaattatgtacagtacataataatactagagagaaaatggctgtgttaccagtgtatgtatttatcatactatcattattttagtgtattccttctacttattttttttaaagttaactgtaaaacagcctcaggcaggtccttcaggaggtatttcagaaggccttgctgtcgcaggagatgacagctcc

SEQ ID NO: 103440 - DNA, 1026 bp, Homo sapiens
aaagcttgggttgaagcttgtaattggccagtcggtgacaatgcaaccctaatcaacctgtgatttcacgtcccctaccaattctgcatcggcctttgatttgtggtcccaggcagtgcaattcattgagtcatatttgttgcattgataggagaagaccaggcacttaggcgtttaaccctgaggtgattaagaggaaaaaaaatgagtcatatttgttaaggcccaaagatacatcaaaaagccctgggcagaggccgacacaagcacaagtgagacctgcagggtgtaattcatcacattctttgatcctcaagtttgtgagtcacagagactctctgggacagttttgaagctcaggggtctgggcaggaaggaaaaacttgaagtatggaaaaagaggaatgtttttttgacaggcagctgagagaggacgattttctagagatatgctttttttgcttggtaacccctgaggtggctgtaaatgtagctggagcccaggatttctgcagagtggaaacagaaataagtgatagctttgggtatgccttgtgccactggggctcctgaacagtaagcatgccttgagcgcctactttatacaaggtgatataagtatccttgggagatggggtttttatactaataagtgtttgtttttttttaatgttagctctctgaatagcctataatgaaagtttattgaagtggagagtgtacaggcccagatatcagagagacctgggtgcgaattctgacatcaccattgtggtggcatcacattgagagacctgcttatcgtctctgtgcctcagttttttgtgttgtttttgtttttgttttttgttttgagacagagtcttgctctgtcgccaggctggaatgcagtggtgcaatctcggcttactgcaacccctgcctccagggttcaagcaattcccctgcctcaacctcacgagtagctgggactgtatacaggtgcgtgccaccatgcctggctaactttttgtattttagtagaga

SEQ ID NO: 103441 - DNA, 1206 bp, Homo sapiens
tctgtcaagctgaactcctgatgaaatcttctattcccctctctccctgatcggtttcgataaaacctcattcctcattctgattttctcctaagggatggtttggatttgtcaggaaagggtgaaaaaagaggtgattttttttttcattttcctcctcttatttctttttctaatatagatacttgttggaattggaatataactttaatgtaagtcaaactgataaagggtggttggacactactgtgaagaaggaaaagaagataggaaaaaggaggacagtcacttacaggcaaaggaatgtccagccaggcttttgcttgttttctcttgtttttaatttacaatggagctgaggaagataacactgatttaggtgaagtggcattttacagcagggggatgccattgaaggaatcaatgacattcacaaaagtacttgcttccatttttttttttggaatgggttagaatattctggatggcagctactcatgccgttggatggctatgttgccactgctaactttaacaagtacagagtcccccttatctttgataactagctctttctattcctctttttaccagccccatcatttctgtctctcatctggttccactatcgaagagtgaacactgcaggccagagttggacacttctggtgaagtgtggcttgcatagcaggtggtctccatagaaggctaggcaaggggtggggagtttggatgaagggcggtgatttgtctcaaagccagttgactgtagaggagatggggtatgtcagagggccccgagaatatggtgcaagtcaagtccatcctcactgatgctggggctcctgaaaagatggggcagggcctttcctcccatgttgatcttgcttacatgcagtataagggaagagaacttttgctcaggtttggcaggtgcaccatttcaagggcagtggtcagataggcaaactgaccattctacctgacgcatagcctaaagaacactctctggaccaggcttatccaacctgtggacagctttgaatgtggcccaacacaaatttggccactttgaaaacactatgagattcttttcctttttttttttttttttttttttggctcctaagctgtccttagtgttagtgttttttatgtgtggcccaagacaattcttcttccagtgtggcccagggaagccaaaag

SEQ ID NO: 103442 - DNA, 1049 bp, Homo sapiens
ggcaacagcaagtgtagaagccctgagtgggagagtgcttgctatgtatcccaggagcatatgccaggccggcatggctggtgcccagggagcagaggagcattttgaggtcggaaagataactgtggttgatgggaaggcaggttcaaagccctgggttcgaacaggatagacatgtggtctgataaccagtttttttgttgttgttgctgttgttgttgtttttttaagatggagtctcgctctgtcaccgggctggagtgcagtggcgcagtcttggctcaccctccgcctcttgggttcaagcgtttcttctgccgcagcctcccgagtagctgagactataggcatgtgccaccatacctagctaatttctgtattttagtagagacggggtttcaccatgttggccaggatggtcttgatctcttgaccttgtgatccgcccacactggcctcccaaagtgctgggatcacaggcatgagccactgtgcccggccctgatagccatttttaaaggccatctggctgtgagtgacaagtagaatgagtgaggcagagtggcctgttaggtggctattgagtgagtccaggtaaaaggtcccagaactggggtcatagtggtgggggttgtggggaagtgtttgtatccagggtatattttaagatcaaaccaacattgcaatacattgctaatgacatacatgtgggacatgagggaagaaattcaggagtgagtcctagatttttggcctgtgcagtggggagcaaaagtgatgacatttgctgagaaaagaagcagaaggttttggaggtggaaatccaaggctgtggtttggatgtggggacatgaaaggactcctaagtcatcatctccttccacagtgttgtggctgtgtaggaatggccacggtgtatacacgttgtgccaggcactgggaagcacaggtgattcagcctggctcctgccctgaacaggtgttcagttgacgtgttgagacaatggaggtggcataaagagctgttacacatggggtgagagccacta

SEQ ID NO: 103443 - DNA, 1049 bp, Homo sapiens
cttaactcatctccactgaagaacacatccaataagcaaggattcctccattccctctggtaaaggagtgttcactgcccactgaatgtggagtctccagctaccagcttactttctagtactgtttagcattgctgattgcaccagttaaactgtgtgctcagtttcatcaagcttattatagcatatctttacctataattaacaaatacagtttaattaattattccataaagcagtgaaatatgagtgcaggaaggaatgtttctataaaaaataataagttgtgtattttggaacagtagcctaaaagcaaattgccttaagaagagctgtcaaataagatgttggcaagacaactgaaaaatggcggaaaagataaaaataggaaaggaattctgtactctgattagtttacacatatcttttaagtttaccccacactatgaaagaaaaagaaaagataaaagtgtgtggcgatgtctgtgatttatgccaggaaggcaaggtaggattttcagacagcgggcatgtccttatagaaaaggcctttgccccataaccaaaaattgtccaataaatgcatgtttgtatgtgataaactaaagtgttcctagtttatacatgccttaatggtgctggtaagagcatgcctgtttttacccccatttaacagatgacagtgaggaccaggggatcacgatcttaaccaatgatgaagagacccagagttaataatttatattatgtttttaatcctgttgtctgcttctgtctttcgaatgttttaagtatacttttaggcaccttttcttggccccagtggctttctcattacaatcaggctgtagtgcctacagctgacactggtatttagaaggctctgatgttttcaagccaggctaaggccagtgttcctggcttttctcctgggagtaatggcttttctgttaaggcatcctttcctgtaggaggaggagctcagtgactttcctcacagactgagataaacgtcatgatagagataagccatcagatacttagaattt

SEQ ID NO: 103444 - DNA, 1071 bp, Homo sapiens
aaccaccgtacctggcctttctcctaacttctgatagttctttggcttgtggcagcatgactccaagtcttcacaaggcattcttcgtgtgtgtgtgtgtgtgtgtgtgcgtgtgtgtgtctgtccccaaatttcccctttatataagaacattggttataatggattcgtggacatttctactccagtatgacctcatcttaaccagttatgtcttcaacagccttatttccaaataaggtcacattctgaggtgctggggcttagtacttcaacatataaattttaggggtgggacacaattaaatccataacgctctgtaaggagcaaagtgtctggcacataggtgattgatttatacattcattgttcattgattgaatatctgagtgcttgagtcaggcactgttctagatactgagaataaggggatgaccaaaataaacagacttcctgatcttcagaagcttttattttaatggcagagatagatattaaacaaaaaatattatctggagagttctgcaggtggccgattctggggtccccaccgctacctgctgaattgaagggatccgggcttgctatctattttttatacaaagctctaaggttaattctgctacacactcagggttaagcatcgctgtcctaatgcactggcactatttctgtagtgatcaactatttcgttagatgcgcatcagggaaagtggatgggcaatgtacttcggttcccagcacagtgtcttgaccatcgcatggcaaaacggtcgcagatgcgcctcttcctcatggtagtcatgcagggttctgtcccatggtgcgctctgctctcattcgtggagggtgtgtcatcttacccacactctcctcggatctctgaatgtcattaagaaatgctgagagatctgggtcagcttggagaagcaggaaagagagaattagctgctagtgccagtgctgaaaatagaacttgagctgaggtttatcttctcgtctcctaagaaccactagaatggagaaattaaagacaataatgaggcttcctattctagcatcttcctagt

SEQ ID NO: 103445 - DNA, 1030 bp, Homo sapiens
ttgatggtagatagtactgggtgtttttcctagagcatcgattctcaaactccagcatgcatcagaatgacctagaaggcttgttggaaccccttcttctccccaagtgtctgagttagcaggtcttgggaggcctcagaatgtgcatttctaactactgtgtaggtgatgctgctgttcccaggacaaccctttgagaaccactgtccttaaggaatacgtagatttgttgcctttcctggaggcaacaaatctcatgctcctggagagaaggaaacaaatctatgtactcgttaaggacagtggttacattagaacctgcaatgtaagtcagtggttgcatcggaacctgcaatgtaaatcaatcttgaaaatagacaaaatagacatgggaattaaatacagagaaattagatcaatggatgaaccaatagagaagtgactgggatcaagagtgctttggagtcttgtttttcaatttttttccaaacaaattcacctaaccttagatgctgctgagtgtaagacatggcattgttttacataaagccaagaaatcttttaattaaatcatggcacaatttttttttatccctttgaatctttcttttatgcttattgaaagaactattttagacttgggtttttgtcatattttattgctatgcctacacataaagaaaagtataggcaaatatattggttcagatattgcaaaagcttctttgcttggaatctcactcttcagaatctgtttttcaactcagtgtcatctcctgcatctgtctacatcgtgccgtcctctgcatcatcatgagcatggagcatttcttatgaaaatcctgtgaagacgacacttaacccactttgcagctctgtggagctggcctcctcctggctctgcttctaggaatgttgctaaacacatctggttctccatttcttcctgcctcttcccacaaccatttggttcatagcggttaaaagaatgactcccttcattgtctccgggattttcactgaagcctgt

SEQ ID NO: 103446 - DNA, 1213 bp, Homo sapiens
ctgtaataaatgaaagctgtggaaatagtgtgggataactcaaagacctgaataattcagcagatacaatggagttggaagattctagggacttaaattcttctcccagctctgtctcaaaataactgcattgccttggacaagtcgctttgctttccataacttcactttcctcatcagtgaaatggggctgagcattgtgtggtattggaaaagaataactgaagtgcttagttccatgctggaatgaagtagagacgtgagcagtgctgtcttatctgacttactggtgggatcaacatcgctcttcctggagagagccaggtcatcacaagaaccataaattgtgcgtatcctttaactccatgatagacccttcaactcaatgcttttattttcagggaaatactgtctccaaatatagactctaaaagaaaagatggaagggggtggaacagactctgcaagaatctgttcatgacaacgctgttgaaaacagctcaaaattgaggcttcagcagtgcccagtgttgccaggtgtgtgttgtgttgtgctgtattgtgtgtgtttccaccacagagccctttgtggctgtgggacctgtcagacgcatgagacgtgtagctttctaatttatggggtgcaccatggtggcaagtgttggtgatggccacaccctactgttttgatggaaggacagtgacttggccaaggttttacagccgtgaaatgtctcagtgaggatttgagctcaggtttcttgtgcctgggtcctccttagtgtgggtcctctgctctggcaacaggcagagcactgctttagagcctctgcgtgtctggctgtggcctcaggggtctagcagcagtgctagagcagacccagcttgtcagatccggggctgcttagaggccacctaagtgattcctttggcagcaagcaacattcggccaaggacatagctggcgggggccctgacaaggggtgtgtgagtgcataaaggttggtgtatcaggagtaagtgagaaggaggaggccggctggaattttacccttcagtgcttttctgtgtgtagacagagattgggcggaggtaggtagggaccatgtgtaggtggattatcatcttttccaggcctcactgatgagtgtcgtgccttgcaacagtagtgctcagggaatcaggctcagttgcgagaggctcccggcagatg

SEQ ID NO: 103447 - DNA, 2164 bp, Homo sapiens
gttgtttcagccccatagtctggtattctgttagggccgccctagcaacatagtatgaggacaatcacctgaaggtatgaaatgcctcaggcaggcatgtaatgtctgtgttatggcgaggggcactcaggagggcttctggctgggctgggtatgagggtctctgtctacgcattggccaccacaacccccttccagagcgtcttttccccatagacagcctcagtgcccagtgcactgtcatatcccttagatttttcttttctctttccctccctccctccctccaatagcagctccatatcagcaactcctaacttctattcagtccgtggaggctggactcacgacagtgccaagcttggttgaaaacactcttttctcctctgggataggtgctttcttagtcctgagcctgacattctacacagtggccaagggaattttccctaagggtccttctgggtgatatttgggactggatccttctcagcagcttggacatcgtcagcctggtcaagtgtcatcctctctaaggccctggctcgttccatcctgtgtgtgtgcacagatgtccatatcctgggtctctgcttggcaattctgcagacacttccagagctaagcacactctggttccctagtttctctctggctttctcagatgtgcttgatattgttgatttttatgggggttctcgcccccagggccctcacagtgctactaaaatcataacagtgacatcagccacttgggtgtgtgggtcgactgtgggaggcagctccatctggaaactaaaaagagacacaaaatcctcttcttttgcttcccccggacttatctgtatctttgcaggtagacagggccaaatggagaatttacaaattgacacttttctaaagcagcttgatattttagaaagttcccttgattccaaagaactgagaccagggagtaagattggctgcaaagccagagcagttggagaaaggagggagcatgatgcgtgtgtgcttggacagtcttggttgttttgcatcagaaatatagccacaaaccccatctataggattttaggaacctaataaccacttccagctgttaacaccttgagactttctaagttacagtcaaagaggatccctggcaagctaacattgattttataaattttgttatagggaggttgaatgtttttcccattcacctggatactccctgtattttactaatggactcacagtaaaatgatgggcctgcttgtgccagggggcaggtgtggccccgggagctctccctttctcacctgacagatgcatctagtgtcagggcagtgagagagggaagccagcatgttttccccattccctcccacatctttagtagccatgatattattcagctagaattggtctcgcgtgccagttctggatctactgaagatgacagaattcttactggatgatggggtgatggttgctttttcaggctgctttctggtgacattctggaagacacaccttaacacatatatgttagttttctgttgctactatatcaaatcaccatacacttagtggcttaaaataatacagatttacttttttatagttctggaggtcagaagtccaaaatcagtctcactggactaaagtcagggtgtccatagggctgtttcattctgcagtggtttcaggatctgagatgtcatggattaggaagaatttgagattgtacctgcctgagggcagaaaagggccaattcacagggatttatgtgtctctgtcttttgacgaaaagaacttctaagaaggtaggttagctatgcaaatgatctgaggcccaggtatcttctgtctggatttgctgaatcatttcctttctttaaagcgatttagttgatttttactagaacctcttccatccccttccagaaggagaatctgaaattacatcaagttacttgtttaataattttattagttgtcctgtgaccaagactgacttaccccaggtaacacattgagttatgggccgagttgggacttgaacctgtggcttctttcctagccttgaagctcaccccttataccaggatactcttgctgctttctaggagctcccccttcctgtttcctcctctgcagtgcagatggtgccat

SEQ ID NO: 103448 - DNA, 1058 bp, Homo sapiens
caataaaaataaaaattagccaagcatagtggtgctcacttgtagtctcagctacctgagaggctgaggaaggaggactgctggagtccagaagtttgaggctgcagtgagctatgatcacaccattgcactccagcctgggtgataaagtgagaccccaactctaaaacaaacacaaacaaactcatattcttaccttttcccttctctgtgctctttccttttagtctggtctcagaggtgtttctgctcatatcatttggccataggtagcaggcagttttcctgtacagcatcctatgtatcggtcagctgtgggcagctcacctaacttctctccagtaaggaggtcggcctcattcctggtttccagggtatccttcagacccatggtctattcaatattttaggacacatttgaacgaaagtgtgaagaattctaaattgaggcgtagtatagcagaggattttaacacaggggttagaacccttgaaagagaccaatccattctaaccttcggatctcagttcttccctgtctcctatcctgctgcagaccccctggacgcttcgctccagcaggttacaaaacatgggagcctggtggccaccccttgctcttgcatagctcccttagcagggctcttctctctcctgccttgcttcaccttgttcacctggggaaactgctgtacctctgtgggattaagctggagctcggtgtttgtcaccctacaactgctcctataacacttggccctctcttgcttgcttgggatctatatccagcacagtgcctcgtacacagtaggggcacaataaatgatgagcgaatgatttcttacgtaaagatttgggacagtttactaccaaaggtcttctgcagctgtgtcatttgttgctttggaaatttctaagttttaactggtcttttgagaaaaaacatcatacagcatttatcgtgtactctaatgcccctttttcaaagtaatgacttcccattgaaatgtgcccctggttttaaagaattttgccatttccttctctaatgtgtagga

SEQ ID NO: 103449 - DNA, 1016 bp, Homo sapiens
ttcctcaggaagcagagataaagatctttgcaactgtaggaaccaaggcttagggaaggggctagggccatgtccatcctgtgttcctgttgttgatcttcattgtccttgatagcgcctgttgtttgggaatgggctttgcaggcccttaaataagggcacccagctctttgagggattggtggcattttcagtggaagtaaatgaaaagcctcctaatgtggctactttgaagcagaccagagtcattggatggaggaagtctggtgtgttataccctaactgatcatattattagcatatttatctctcatgatattgagcacagcaagtaaatttgattcctcatcttctggaatgcattagtgatagtttatatcccttgaaaggctgaagcttaacccatttcccatgacattgttcaatgtcccttctgtcaaaggagagagacctaattcaactcatgtctttttctcttccttctgaggctgctgccttaaaattggatggttgattgcagtcagtatctttggctgtgacttcatgtaattatttccttcccaattcctttccccattgcatattgccttttgcttaatctgcactttggtgttctatatacatgtgttttaattgtaagttaactcattttgggggagggcaggaattaaggtttatattataaatgaaacaagaattcttatcactatatcatcgtcagttcatcatctctatgcattattttatgatgacactacataaattggtttcttttctgaaataaaagctcattccaagaatgcctttttttgtggggaggggggtgacagttaatacctttgagcttctggatctttttacaaacattatcagacaagtaaagaaagctggatattatttctttggcaaagtagagaaagctgaggccaaccgcaggccaaggactcactcacctaatactatatttactcccttcctctatccgtaaccgtgtgtttgtagacttgataattatt

SEQ ID NO: 103450 - DNA, 1032 bp, Homo sapiens
ttctggttctgttctactgccctttcagatctactcattcttcttcagggcatccacaggcttcctggcccctcagctcccttttgtgaggtcttctgcagaagatcagccagaaggaaaggagggaggccagggattccccagccccgcccgctccccgaggctgcttctctgtgggcagaaggaacgaagcaatgaagaccacagctcctgcacacgacctttctgtgctgttcttgtgtctcatttctgatgtcctttctgggaccacttcaggcctagaggtgacatggtgcctactatcactaacctggggctaccgaagctcttgttgtttccgtaagccctgcttttcttttttgtttcatgaatttactgcataatagataaggtgatttcagaagacatagtatagctgaataaaagcaaggcatttgaatgcttaatcattattttcctgtagcgaaatatggtctgaatacaaggacttttaagtagattaattactgattcagtgactatatctaaagctgccttgtttgtttttaaaacgactttatagaggatgaaagacatacaaaaagctgtacatatttaatgtgtacaacttgatgagtttgcagataaatgtacactggtgaacccattaccacagtctataatccatcacctctgtttcctgctgccctctttatttattattagtgatagggcttaacataaatctaccctcccagcaaacttcgaagtctacgatacagtattgttaactataggctctgtgttttgcagtagctctgtaggacttactcatcttgtgtaactgtaatattgtaccctttgaataatacctccacatttcttcctccccccagccccaggaagcaccattctactctgttattacacgctcttcaaattacccagtttgagtatggcatctttttcctgctacagctctgacgaatacaactagccattccctttcctgaatttaacagctctgacgaatacaactagctattccctttc

SEQ ID NO: 103451 - DNA, 1033 bp, Homo sapiens
cagggaaggactcactattgccatttagcatacttgctataatagaagtatgtatgccggtgttcaggaatccagaaaaaggggcacctaagtatctggggacatccaagaaagctttcatggaagaagatgcctcctgggctgaatcttgaagcatgactaggaataggccaaggagaggagtcagaagaccacgcttgagtcctgccattgttgggctctccaggaagcgatggtcaaggtctgtgtgctgagatcgtatgccagatgtggtgttagggatcggcatgtttaacccaatcagtcagatgatcccagtaggaaaagcaacacagcaagtctgaaacactgtatcataccacacagtgcctcagctctcaaatttctctattggcttttgagccctgcagaaaatcagctgtgtctttctacattcagggggtccttctccgcttctgtactcataccttgaggtgctctcatctcatcccccgcctccttccatgccctcatctttggctctcagtgattctgtattaatagcagcgattaaactgcctcatctcatcagggaggagatattaatcttcatcaggcccaaggaagagcttaattttttcctgctcttctcctctccccaggctgccccactgagctcaggcactgtcagctgcaccactgtctgtgggacatttagtgatctgcttctgcagatgcgtttcagtgagttcacttctctgactccctcccttagcctccctgcacccagagcttcacaggctgttattgaagaccactgtcaggagagggagagaaggggaaaaatactccctcaaatagaaattcccaacttcattgtcttgcgtggctgcagggtaaattagaccaggacagtaccgcagctgaaagctgtaggttttttggtttatgaaatcctattcagcccttggagaagtatgccttttttcatgctatgattctgcagttagctgtgaactgaggatgtcagatgcccaggggcaggaacaggaga

SEQ ID NO: 103452 - DNA, 1001 bp, Homo sapiens
gttattattatttgtttggatttcacacactccagatagtgaggactcacctttccgtagtcatctccgaatccttagtctttggcaaaatacctgaaatagagtagatgctcaatgaatcttgaagtgccagaaataaaaataatattagttactatttatggagcatttattgtacatcaggcaccaagtccttgacttgtagtaactagtttcttcctcagaactgtcctatgaagtaggtgctaatattcttattttgttttgagacggagtcttgctctgtcgcccaggctgcagtgcagtggtgtgatctctgctcactgcaagctctgcctcccgggttcacgccattctcctacctcagcctcccgagtagctgggactacaggcgcatgccaccatacccgactaattttcgtgctgatattcttattgtgcagatgggggaacagaggcacagagaagtttgaaaataggtaaagctgagattgaacccaggcaggcatgccttgtgtgatctctctaaggtttctttcatttcttaaatgggtatgattctagatctcttttttttctatgtaaggtcgctccctcctggttagttctccacagggatcaggtagagttggtcctctccctatgtgtgaataatgcctcacagatcctaggaaatgtactaggtcggaacttccacccaggctcagtgggctcggttgtgtcttttatcacttttcaagccatgcattttctttgcctcctgggatcctgtgccagttgccttggcttctgtggctgatggatgattggatccagcctttcagggcagattagggtcagcctgctccaagcagtagcgagaaccgggccctcgcctttcctttcctagaagctgtatctgtgagttaacgcttctcaaaatgctgcacttagctcacttgagcgcagtttgggggcagattggttcttggactcttcaaatccccagtgcagacatgaac

SEQ ID NO: 103453 - DNA, 1035 bp, Homo sapiens
gcttgaacccaggaggcggaggttgcggtgagccgagattgtgccattgcactccagcctgggcaacaagagcgaaactccatctcaaaaaaaagaggagagcacaacctgtagcttacaccgctgttataaagactaaatgacctgttacatccgacagtggtcatttaacaaatctttgtttttcctttcattctcatatttttctagaatcctggaaagtctcctgggagggatgcaaaaacgtcacccacctggtccagagagacccttgttttacaactgaggaactgaaacctagagaactgtgatataacgaagctcacagcctcagcagccttcttcaggcattagaaaggggcagggagagacttcctaacatactgcagctgtggtcataaatgcactggcacttccttgtgaatgcattggccatgtttggagaaaattaaattatttcatcaaaatgacctgtagtgagaactttaaagaacaaagaggaaagggccatcctctgatgcagagtttaatcactttcctaacagatatgttggatggggctgtctaagtcccagtcctccttttaaatgctgtgtgtccacattgagtcacttaacctctcttaccgcaaattgactctgcgtaaattgggggtgctgttgagggtttttgcaagatgaaaacgagtccatggtgcctagcatgaattaggtttgcagagtcattttgtctcagcagctgctttggatatgttgactgtacttctggaagcaacaggtcgctcaaggagtcaacagagttgaatatttaaagctacgggatgggaggtggaagtggagatgggtgcatcacgaggtctggagattgagaccatcctggccaacatggtgaaaccccgtctctactaaaatacaaaaaattaggcaggcgtgatggcgggcacctgtaatcccagctactcgggaggctgaggcaggggaatcgcttgaacccgggaggtggagattgcagtgagccgagatcatgccactgcac

SEQ ID NO: 103454 - DNA, 1028 bp, Homo sapiens
gagtctcaatctgtctcccaggctggagcgcagtggcacaatctttgctcactgaaacctctgctccatccccaggttcaagcgattctcctgcctcagcctcccaagtagctgggattacaggcgtgtgccaccacacccagctaatttttgtatttttagtagagatggggtttcgccatgttggccaggctggtctcgaactcctgacctcaggtgatctgccctcctcggcctcccaaagtgccaggattacaggtgtgagccaccacgcccagccttaattttaattttaacctgtgtgatgactatatagctgggctcactttatgataattcactaagtatttcacttaggacttgttcatttttctgaatatgttattttagttttcaaaaaactatgcaaatcttgatggtagcagaatttgaagtgattttgtaggttttgcattgtttttagatgagaggaattttcttaacctttgggatatgtgaatctatgtcattgttgggctttgaagttcaaatgctttttaagaatgaaacttttctttagagatcattgtttaacacttctatgtaatgacattggcttttttcctttctgatataccatttggacagatattcaccctatgagagtggatcacagcactgatttcaagatctgaaatttactcataaaaaccctaatctgtatgagtgttttcatcagttggaaacaagaccagtattcttaccagctcttgcaatgacacggctctaattaatactaaaacaatattactgcttgatattgaccccaagccacattagataatattctcctttgtgttattcaacaaacatgcattttcataaaatccttattcctggaaatggaaaaaaaaaaaaccttttattattgtattgtggaagatatagaaacacaagaaggaaatgtactatttaaactataacaataatggaaactgtagcaatcgtttctatttatcgcatgttaaaccaagattggctgcatctgg

SEQ ID NO: 103455 - DNA, 1032 bp, Homo sapiens
ctttgggaatggagaaagcgggtctctttagctcgcccttccacctctagcacctactgtagtgccgggagaagatttggtccccaaatgtttgttcaatgaatgagtgaacgaacacatgtgccctcctccgactttgagtactgacaggtctcatcattgcctcctggatccactgtggactccttaccatgactctggggtcttccacaattgttttttccccaacctatactgtctgtcttcagggtataataccctgttgaactacctgaggaaactatttctctgattcttaattttcactcttgcggtcttactgcccactattcagttcttttttctgtaaccctccctcccagccaacaccttcaatgcccatattcaatgtcattttcccctaatgccagatcccatgtggaaacatctatgaccagcagtcatcaagagatattttgcttgtttgatgtctttctaaccacttacctatgagtttcttgagagaaggaagtgttttattcgtcgttacactcccagtgtctaactgagcactcgctcctaatgtgtccttagtgaatgttccctgggtaggactgtggtattgagggacacaggaaccgctggtagggaagggctcttggtgctgtgagcatctgtgatttttgagacctgaggacgtggctcctttcatttggtcgtgatgttaattccgggactggagtgaatctgctcaactatagccccatttgaatttagagcatacctgttattttctatcagaatcaccttttctcagagcccagtgggttttattgtgggatgtggttcttcttttctgtccatcaaggagatgtgttcggctattagagacttatcagcatgtggaaaaagggtgcttttcagccgttcagaaaactcttcacacatgctgccctctgataattcataaccagctcggtgcaaaggtttcccattgtcagggaggcagtccgggacaatgtgggtgttatttaaaagcaaatgtcttcagag

SEQ ID NO: 103456 - DNA, 1028 bp, Homo sapiens
agtttcaggcttgcatcctgtcctcaccaaccccagtagaaagaggattttttccttttgctaattcactaatattgcctctgattgaattgcctgtggtaactcctcctgaaaccagtcactgcggttatgggaggggagtgagggaggctggtacttttttgttaactttaagccctgtgcctatttctggtcacaggatgatggagagttgcttaaaacacgctgggtgagattgggtgactgggatggccaccaaaggcaaatggcatggtttcccaaaaggaagagattagaagttgatctggattatggagaattcataactgtctgtgtttatggttagatgtgttgatggtcaatttgaaggcagcttagaaccatcgtggccggtggagtgaatgtgatcactaactttgagcaatttcaccagactggcagatagattatgggaaactggaaagatcatgaaaatactttgaggcaacatgacagactgggtgtaggtgctgtatctatcaacatgatcctttagaatgaaccccacacttgggaccaaatcacgagctgcatttagtaggggctgggtgatgtgggcatgttaacacagtattttagctaggatgacagaggcaacagatttctgttactgagtgtcagttagtgtgcattcgggctgccgcatttgtatttgtggactctatgctgtaaggacaatctagatgaggcagcatgcttaggaaaatccaggtgagtgacagtgcccgttcaaatctggttatgtaagaaatggtgggaagaattgaggatgtttaccttggagaagcagaggctcagggtgtacatgctcagcttcagcaaacagacaaagggctgtcccctgaaagaaagattgggattgctctggtggccccaaacctatggagggacgtggcaaggagccagatgtcaagctcctcataatgaggatcatgctgaccagagctggaatgagctgcccaggaggtggtgaaatacctggcatgaaa

SEQ ID NO: 103457 - DNA, 1689 bp, Homo sapiens
actttgtcgataatgggagaaaaggttgggccctggagaaattactgagctattcatggagccatatgtttcaagagttggtccatcttttcattcatttattcacccattcaacatcgtggtggtggtggtggtggtggtggtgttttttgtttgtttgtctggtttttttgttttgttttggtttggtttttttgagacggagtctcgctctgttaccaggctggagtgcagtggcgcgattgtggctcactgcaacccctgcctcccgagttcaagtgattctcctgcctcaacctcccaagtagctaggactacaggtgcccgccaccacactcagctaattcttctatttttcgtagagatggggtttcaccatgttggccaggatggtctccatctcttgaccttgtgatctgcccaccttggcctccaaaagtgctgggattacaagtgtgagccactgcgcctggctgtgttgttgttattattggatgcctgcactaaacttggtgctgagaatatggagataacagatctggagattcacaggatagcggaggagacagataggctaagaaatgatcgcggcacgttgcgatgcgcgttgtgatggaggaaggcagggtgctgtgggagaggtttgttggagctgtcagacctgggctggggatgaaagatgatcagttacatgaggggccgagcgcagggaggcaacaaaggatttgctctccccaaacaaataaaaacaaatgatgatccctgctactttccagaaatcagtgggaacagcaagactcaccatttttctagccagccgtttcaaatacagtgcaatgttttgcctgtgaagatggttttctaggcttcagagagagagggaacggcagtggtgaagagctgactttatttttatttacccccacacttgaatttcagaaggaagatctcaaatgaaaatctgtctcaaggaagtcacaactgtgtttttaaacgtttcctttatgcataattttattggcagctcaaggctaccttttaattaggatctccacttcactttctgagatttgccttgagttagctagactgaatataaacaaggtgaaactgtgtgcctgtctagcagggagggctcaggatgctcagcccagtgccgaggccaagtgacacacccctgtccctgttcccaccctttaggtgcatccctggaacagtcagaaccttcatctaagcaggtagatagagccaattatgccatggcagtggatgggaagtttttggaaaagggactagagagaggaaggggaggtgatgttggtcttgatgtaaggaaacattctcccagagatcatggaaaagccctttttataaaagaagttagaggtaccacccgtgctagtataggtttaataagtagaacattgacttttaactaagctggtaataataataatggtataacaaggacagtgatgacagacactgtgattctgtcatcacagtgatgacgacagtacaaacaactagtattttgagtatttctacaggccaggtattgttataaggacttctacatatgtttactctttcttcacaatgattctttgtgccaggtgcgtttaatacacctgttttacagatgggggggatgaggcagataagcttcagtgatctgcccatggtccc

SEQ ID NO: 103458 - DNA, 2036 bp, Homo sapiens
ttggcctctcaagtagctgggactgcaggcatgtggcaccacacctggctaatttaaaaaatgctttttttgtagagatgaggtctcatgttgtagcccaggctggtcttgaactcctaggctcaagggatcatccaatctcagcctcccgaagtgctgggattacagatgtgagccacgacgcctggccattgattgtcttaagcacagatcccatcattcctgctcggaaatctcgagtggctccctagggactgtggaaggaagttcagattctccttcactgagcattcaagtcctgtcccagtcccattatctgagtgttctctgtaccttttcttctggaaggagcggttggttgccacactgtgtggttccagcctttcattttttctaatggttctttctgccaggaatgacttctctctccttctcactcttttgaaattgtgccatcttctggctcagctcattttttcctgagaatcatgtgtccctggctcccaacttatgttcatgtttgtggtgtttgtgtctgcctgactatcctgtacactctcttgaggcccctcaagagcaggggcccatgtgctgaccatctctgcatccccattctccagccctggacctggcctagcatgtaccccagtcagtaggtgccttgtggactgtagtgaatggcaaagcgtagagaaaaggtaaagcaatagctgtcttccctgtatcatttggcaccagagatatttgtatgaaatctccctaggccttggaacttggaagaacaatacactgcacgttagacaagtcaggacccttcaacactaagggatgccagagtgcatttcccagtattggtccttgtgaaatgcttatgtgtatttgcttaagcagaatgaaaatgtgaggcctgcctgcttacgtcgtccgtttccagaatgaaaatcggaagaacaaagatcgaaatactccaaggcagggcttcataggtagtcccatggatgtgattaagggctgatttaacattcagaagaaaaacataaaaaccagccttcttgaagctgtagtctgaccttgggaagaatgtatatcctcaggaaagataaatttgcgttaaagacctctttggcaatgcattgttgaaagaggttaatattgtaagtggaaaattttgattacttctcgattctttcctcccatttgcttctgtacctgtgtcaccccagagagatctctatgctagaagtaatgtccacaccacctgcctgcctgtggctcaattaaacttgagttcctgcccttttaaagtacaatccagattgtgtgcaacaatacaaagggtggaaattaagaaaactcattgggatgcagatcagtgcacttcacttccccaagccaagggagatgactctggaggaaaagataaagatgaccacagtgaatttgcaggtcatcttttgtgcatgtgcttggttgaaacatccttggaacctttcagtgagggaaaggtcctctctgaagaagtgcttgccttaaaccaggttttctcagtctcagccttattgtcatttggggcataatccttctttgttgtgggactgtcctgtgccttgtaagatgtttattagcattcctgaccttgacccacccgatgctggtagcatcccaccctcctgagtctttttttttttttttttaagacagtgacttgttctgtcacccaggctggagtgcagtggcgcgatctcggctccctgcaacctccacctcctgggttcaagtgattctcctgcctgagcctccccagtaactgggattacaggcatgcaccaccataccagctaatttttgtattttttagtagagatggggtttcaccatgttggccaggctggtctcgaactcctgacctcaggtgatccacccacttcagcctcccaaagtgctgggattacaggcatgagccactgagccccgccaaccccccagtcttaataatcaaaattgtcttcacattgccaaatgtcccctggggtaaa

SEQ ID NO: 103459 - DNA, 1046 bp, Homo sapiens
atcagaagtctcaaagatcttttctagttcctgcttgaaattgggtagaagataataccagctgttacgtggaagtatagcatgccattcacttaacgtggaatgaagcaaaacattctgagagggaagacctattacagtgcatgtgtaccattatcttactttttctttctttttttttttttttttgaaatggagtctcactctgtcacccaggctggagtgcagtggcacaatttcgcctcacttcaacctctgcttcccgggttccagtgattctcctgcctcagcctcctgagtagctgggtctacaggcaggcgccaccacgcctggctaatttttgtattttttagtagagacggagtttcactatattggccaggctggtctcgaactcctgacctggtgatccgcccaccttggcctcccaaagtgctgggattacaggcgtgagccactgcgcccagcctatcttactgttaagctgtaatggtgttataggcaggacaggtatttggtactgaggaaggctcttcaaggatgtgagaattaagctgagtgagacctgagggaaatgccaggggaccccctcaggaggggaggctctgaagggaggagaattctcggagaccctctggagggagtagggagagagagaggtccccaacctccttctgaggcacctctttataaggttggaatattttgtactgtttcctatctcttggagagaagagtccaccctttcccaggtaacctgtctcagctttggagaggctgagatggaattccagggaccaaatctaattaattcctcaaaagagaagtgccttttgggagtagcaatattgaatctcactttgatagctcctggtggagcaatttggagagaatatattggggatgcttttttccaattaatatgcttgaataagaactttggtgctcctttgcagtataaaatgaatgtatagtaaaaataagagcctttttcttctaagaagggccttattagaacttggaaagccaccttccctgtcttccc

SEQ ID NO: 103460 - DNA, 2782 bp, Homo sapiens
gtctgggcgatctcagggttcccttctttcttccctccctcctgagaagaatcagactcagacaccatcttttgtggtctagtgtttgggaaaagacggctgcacagtctccaccagcatttgcaaattattcacaaattatatgcacagacacatggggcccaactacatacgtcgcagacttgaatgtgggtcctgggaagcttctggatatgtgagtttgggggttgggcatcccatctagcataaacttaccatcttcatgcttgcagccttgcaatatacaggccctgttttcccctcaacattaataaactttattttccctgcagttgtaggagacagaggctctatagaaaacttacaaatgaaaacatattcttttggaaaaaaaaattatggttatcaattccttctttattagttttcttttatttttagatccatttgcatgaaagcaagagattctcacaccaccccctctttgtatgattatgacagagaggcaataagaggacagattcttatgaaaaaaaaaaagttggggggtgcttgccttatttgagaaaacagagatctgcagtgatgaagctacacataccacatagcttaagagaggagctggaaaaagttctatttagggagaaggatttttcctgtgttcttgcgggaggtaggagggactctggaagtgacagtagctatccgtattctggaataaaagctgttctcctgagaaaagaagcaatattcctcacttctcacagcctgtgccgggtttcaggtttgggagtgggaattggacatttgaacctttcatttcctaaatggatttgcaataaataaaactagagttaaggcctcatttcagtaaacatgggggagctgttggaagctgctgctccctgtttcagacgattatctcccactcagtcctggtgggcattatgtatgccaggtgggagcggagactgattttgtccttcctcattgaagcctggaaaagtctagtatcttttatcagatgtggggtggttggctgtttccttttctcctccagccatgatatttttaaaattgacagccccgttgtgatccagggtgatgagagagagactgacattttaaagtttcagaacatgtttttcagctcttctttggattgctaatgtgaataataatgccacattgaacacttatcctgtgcgatgctgtaggagtgtggtaaacatctcataaatcttcatggcactgctcgctgcagcatggccagtcgtggaactccctgcctccgtctcctcctctgggcacgctcagcagctttcgctgtttgggtggaaagctgtttgtggatattaaaggagatggtacttggtctagaagaggtgctcaatgtcagtgtcttctttagcccctcccctggccccaccttctcctttctttttcccgtggctggggttttggggaagtccctgaacacagtgagaaaggggtctgttttctcctgagtaatttgaaaatcttggctaagaatgggggagagaaaggagggtgtggatgctactaggtgagggcttgggaactcctacatttcctatggaggaagagtttcaaaacttgtgtttttttgcttctgtgctttgtttttttttgttttgaatatgtgacttgattattctggtttgtaacgttgtctttaggaaatgaaagatgcctcattattttctgattccccaatatcctgccctcttaggggtttcctagtaacagattttcctggttagaccttgccctcctgtgttagttcattctcatgctgctaataaagacataccccagactgtgcagtttataaaggaaagaggtttaattgattcacagttcagcatcactggggaggcctcaggaaacttacagtcatggtggaaggggaagcaagcacatccttcttcacatggcgggagcaaggagaagtaccagcagggaaaatgccagacacttataaaaccatcagaactcctgagacacactcattatcacgagaatagcatgggggtaaccaccccttgtgatttgattacgtcctaacaggtccctcccatgacatgtggggattatgggaactacagttcaagatgagatttgggtggggacacagccaaagcatatcacctcctaacaagtataatcctaggttgtctgtggccatagtgcgttctgttttaccgaattgacgtctctgagtctgaacactggttctgctgctaagtgctcctggactctgaggctctgcatttaggctctctgggcatctatttctcacatagaaaagggaacagataataaaaaagcctaccctgtggggctgttgtgagtagtaaacgaggtaatgttatcaagtgcctgtcttagcatgcagtatgcacttcacaaataagacacataaaaatttctttttcccttggacacaagacttagagtatttttcctaggatgatggtggtagttgtgagtagtaatatgagtagcaatggcactagtgctggcagtaatagtggtagcactagtgctggtggtcatagaagtagtaagcctttggcttggcttccataatgaaagtctataatgatttctatataataatctctgctctttagcagcatttttccaacagaaatttatccataaagtgcccaataacctaatgataaggcattgttagcagtgagatattccatacaaatgaattttcagatgaagtggcacttttccctttaggcag

SEQ ID NO: 103461 - DNA, 2761 bp, Homo sapiens
ttttgctgtaggatgtatgtgctcgtgctccattttagagcagcacggaaagccctcctggaggattcctccggatgaaagatttagggtggggtcatggtgtctgcatttgcagcctgtgtcatggacccaatgaagctagtgaggtgccagtttttctttgtgcatattcttccagtgtgtcaaggagcttggggtgcagggacctgaatgattacaccatcctcttcagatcatatctttgaaaaacgtgtcaaggtcctatgtccggggtttggagcagcagtgccagcgtggaacactcctgttgcgaaaaagccatgtgtgttggtaaagatggagaaaagcaggatgtggtcatccagtgagcactccagtggttgctccttctgtcagctctccctttcaagccgtcgggatcccagaagctttcactgtgttcctttttaacttgtacatttcatcatgtaatatacatgtttatttgtagagggaaatgcagagtatgtgcatgtgtgtaatacctatactcactatttcagacattgctaggtactttaatatctaggtacttcatttgattgattgattgattgattgattgagagacagagtttcgctcttgtctcccaggctggagtgtaacggccagatctcggctcactgcaccctctgcctcccaggttcaagcaattctcctgcctcagcctctgagtagctgggcttacaggtgcctgccatcacgcccggctaaattttgtatttttagtagagacggctatttcagtagagacgggttttcgccatgttggccaggctggtctcaaactcttgacctcaggtgatccacccaccgtggcctccctaagtgctaggattacaggtgtaagccactgcacccggccaatgtctaggtactttaatgtgtaggtacgatagcatttattgctttacgtaattcatgcaacacctctgtgcattaggattatgatcctcattttataggtgagccacatgggagtgaggcgaggagggatggttaggttacggttgtaaatggcaaagctgagataagactcaaaatcagtttatcttcagaaccattttgcaagtaagggaggatcccagatctcaaagtgcctgtatcagttaggatgcctttgtgcctttggttgtgagaagcagactctacaaactggcttatgcaggtgagggaatatactggaagtttgccataactgagaactccagaggcagaaccagcttaggggagattggtcagggctgtcacttgtctcctgcggtttcctaggctctgtcctcttccatgtgcttctcctctgcctccaaccaccgttggctcctccatcattggagtaactctggctcatgcccattggaatcagtcactatggcaagggagctttgattgtactggttgtgtaggttaacacgatggttttacacaaccatctgtaaaatttgggatggtgggatacctccccagacccagacttctggacaccctagatcgttttgggaagaagaaagaggagaaaatacctgtcaacaatgcccaaaggcagagaaaggtggagctaagggcttggtgaaggggagctgagaagggaggaggtgcaggctagggaaggcgaatgaactggctggaggggtgcccccttcttgtctttttcctctgcttgcttctgtgccaacttacatacctagccattcacgggtccatcaccctcttctgtccctgatgttctttgccaagctcccactctctttaattaacaactttggagatgcttttagaagagcccaagtctggccaggcatggtggctcacgcctgtgatcctagcactttgggaggctgaggcaggcggatcacttgaggtcaggagttcaagaccagcctggcaaacttggtgaaccttgtctctactaacaatgcaaaaattagccaagtgtggtggtgtgcccctgtaatcccagctactcgggaggctagggtaggagaattgcttgaaccagggaggcggaggctgcagtgagctgagatctccagcctaggagacggagcgacatcccatctcaggggaaaaaaaaaaaaaaaaaaaaaagcccaagtcttactgtgtcacctttaaggtaaaaatctcccctcctcctccacctggctctgtttctttgcattttccaaggtcttccacaagagggactttgctgttttctttctgcagtttctttaatggtgtgttggtatggtgcttttggtgggataattttacttggaaaataatgtttctgacccatgtccttctttgattgattttttaaagatttatattttgcttttcttacgagtcttctggattattttgggtgtttctctcttttttgttttccctgggaatttgagtctagcgggggctcaaaagaggttcatttcgctagtggctttgcctggtgtcctcccagtcagaagtcggcgacgctggtcagtggtgcagccttctctccaaactctgtctgccttcctcttttctgatattctgaatccctagctgcgtattctccacttctcgttgaaaccaactcttagaaaaagggctgatgacatgttaaattagctactttgagtatgtatgtgtatggatgtatacccgagtaatactcaaactcttaatttgttttaattattatgccttgattaggttatttaaacttcagaactcctgtgaggtacatacaaa

SEQ ID NO: 103462 - DNA, 1020 bp, Homo sapiens
ttacttgtcaccttacctactgtatatctaagcatattgtccatacaaagagatcagtgcaggagatgtcctgtgtccctgtcttcataaccagaacggggaagaaaacctcctcctgtgagttccccgaaggttaatttaaaatattcttttcatttggctttaagattactcagagccatctttaatacacaattagggacataaccattcctaaaggtaggtggcagctgccttcattcacctgccagtgataatcaaaggaagactcccagcctgtctagtctggaacattcagcagggcctaagagctcttctctaagtgatgatgggactgaagccatctctgtagtgcttcccttgctgttctgagccatttgcagtgggaataagtgcttatggagtcagcagctgtgagttgggggaggcaaattattacttttatttttggctctgcctggggtcagaatttcttttgtttctgatttaccttttatttgagaaacttggcatgatacctgtgttcagaggattcattagtcatctccctctcaaccaaatcattcctttgcacatgtgattgttaacccctcttttttttttttctccagagttagttatcaggcattttttcagaggactttcataaggtagtctgaacaaatgaagatattattttcattagtaaaaatagtaacagcaaacactaggggtgtcagacagtgttttaagtgcgtatatagctttactcttttgatacaacttatgaagtagatgccataattatcttccctgtgttacatatgaggaaactagtcactggggaagcggggggtatcaggtaatttgtccaggtacctcttctgatcttggattttaaaaggagttggaacaccaaaagcacaattcgtaaaacaaaatggatgaactggaattaatcacagtttaaaatgtggctttgtaggagaatctgttaagagggtgaaaagagacgccactgactgggagaaatgtgtgtaa

SEQ ID NO: 103463 - DNA, 1017 bp, Homo sapiens
ctgggagagaactcttgaagcttgagcctggttccctccagactttgcctcatagaccttcttcctttgctggttctactctatgtccttttgctgtgatgagtcatagccatgagatgctgtaagtcatagccacatctacatgctgagtctggcgagtcctcctagtgaattgttgaacctcacctcctctgcatttttggttgttggtgttgttaaacagccagtcatatcatcttacggagctatgaattccattagcatttactggattccagctatgtacaacatacttgtaaaactccagtttgccttagaaactgagtcaaaccaccaaatgtgtccaggagtaactcgttcccaagacatttccagatatcaggcaatatggaagctacagagatgaagtctctgaagctcaattgagataggaaatgtaagttgtatagaagttgtatagaagcagaacccctagaacattgagggaaatgagtgctctaccaattccataatgtaatagtagcttttattaagaggagggtcatgaatgctgtcttgggggagttagagaagtgactttaaggcattggtggactttgctggtgttgagaaagaatattttgatcttccttggtatccgtcgtcatcttttagctttcatttgtgtgttgatctatccacccatcttcctgtccatccaattgtctgtctacccactcacccacccatctatctgtccagccttgccaggcagcttgttacattcatgagctttgattatgtgttaggctgtgttcaaggcactgaagtactggggtgaattgagtagggtccctgccctcttgtgcaaaggaaggatttggttgggtgggagatgactaatgaatccgtaccctggtggtattgtttagggagagggagatagacctgggaataaatatttattcctagatagaagtgcacaattctttctagggatacacaggtacacatgcccaattcaccttggtgggttga

SEQ ID NO: 103464 - DNA, 1059 bp, Homo sapiens
ggtggcttagaccaagtgtagtggccaaagtgttgggatatagtccaaatccaggtgtgtctttaaggtatattcagcaggattttctgagatattggatatgagactaacagaggaagaagagtcaagggtgtgtctagttttttatttgagcacctaaaggaacgaagttggtggagttcgggagctgtccatatattctaactgggaagattgcaagagaaacaagcttgggagagaacattaggagttcagtttcagtcttattgaatgagtggtgctttttcgatatatccaagtgaatatattgggccagacagtgggatatgagccaggagttctggaacaaggttagggtgggagatacagattggaggttgctggcctttgcaggccattgaaagccgtgaacctgactgggatcagctagaaaatgcatgatggtagagaagaggaggctgaacttgactgcactctctgcatgctctggaaaaataaaacctgggttgcactggggacattgggggctagttcagtcattttttagagctggggttttgttgttgtttttgtttaagccaggcactttagtcttaactttcagggaaaatcaaagtaggttgttcaaggtacccaaaacacacagatatgcagctggctttctgcaaagtgttcatgtgaagaggtgccaggtgtgtgcctggtaagtgtgtgttttactgagcagcagggagctgaactgtggatctcttgcagcctcccttttgatatgtgcgtctcaagcagtcaacctgcaaattgctttgtattcagaaggtgccaaatacatgttcatggaatgaatggataaatggtccttgccctttgtgcctgaagaccatggtagaaaggtgcagtttattattttattgttgacttctggtttgaaccaaagaggtttttgcatatacgttggctattagagatcaagtctgcgttcaatgttggagatttattatattttggatagatagagggctctaaaggcaattcccagagaaatccaaaactattgtcaac

SEQ ID NO: 103465 - DNA, 1080 bp, Homo sapiens
gttgaatgagcaaataaactgtgaagaaacttcttgatctttgttggcctggacagctgttgaggcttgactgtgcttatggaatgaaatatccacacaaagggaaacttggtaatagcccagaaccccaaggggatcattgcagagggactgatagatggacaggatggcctggtgaggcctgcgccatctgtgccttcaacccggcggatcaaagatgaatgtgtgattgagtgaggcctcactgatgacaatgcaccctggctggaaaatgcacagcaggaggctctggtttgaatctcagttttcctaggagacctgaatgaagagaaaaggcaccgcagtatgcaaagagagagtcatcacttgtgcatgtgtctgggggaagtaacgaatagaagacattacatgtcaaaaagagcctcgtccaaaatgaagccaagtgactgtcacaagttctgggcaggtgagatgctgtgtcagaaccgtgagaaggcaggggaggccaggcacaattcccaatatgttttagagcatacctggagcttagcatagccctaacttcatggtccagccctttggggcatgtgctcctggaaccttagctattaagtgcccttgagtgggaaaataaatgagtttttaatgtctgtgtgtacatgttgttaatcgttttctgcatttgccacctgggttgaacctgtcaaattagtttccagtagtcccttttaatgcattgttatatacccaaggtggaaatctcagtcatccttagagactttctgtagccaatttcccctttccttgttcctctcttacttaggtcatgcaattgagcgctaagcccgggtcagcccatttcctgtgttctggtctttttctttccatttgtcacagttctgggctgggctcccattatccctggcctgaagtatttcactagctgatgctccggcctcctccttcctgtgtctcctaatccatcattcttatactgccagaatgacttttctaaggctcagagcagctcatgacattccctgctagagcctctttgattacttcttcttgcctctagaa

SEQ ID NO: 103466 - DNA, 1029 bp, Homo sapiens
tgagactgcacactcacagggctctgctgagccgtctgcatggatgtgaatacatacatgccttccggtgtggttcacagaaagacagagttcagatccttgctacaattctctgctgagaactcatggccaggcagtctcttccctgaagtggcaagcccaggtgtgtgagtccctgggctgggttgatagacagatgtttgcactttgcacactatcagattactaagaatggttcttggctgaagagtcctttctggttgtagaagccaccatcaaaagccagtccctcaaccacttattttaaaacagatgaaggcaacccagtgctttttctctgatggcacattctccccgcatgaggaaaggaacataattggaaaatgggcaatattcacagaacaattactgtgcctcttaatgaggtttgcatgaaggcttccagtgaattaatgaagagcaatgattttgccattcacgttgaacagctggacaacaatgataagggtgcagactgtgaggtctctggcttagacgaggtgatgaggaccggaggaagttctagcttctgcccttcttcagttctcctttggtctcactactgtcctgggagaaactgaacgtgctaggctgccagactgtgccgccccaacaaaaagtgagaagaaccagtttggctgggctgtgggcttgcatcttccttggactgtttttctagatatattcagtggcagatcattaaatctcctcctttactgggctattcttattaggaattatggtgacttttggagggcagtgtgtcttgcggaaagcagcataccatgttgagttgaagatatgagtctaaattatggccttgtcgtttaatgtctgtgtgttccttgcacatgttgtttcgctgcaggcagggagctgcagtttcttcacttgaacaaaaggcgatcatacttacataggtgacctgttgtgagtatcaaatagcctgtatgaaattacattatgcatatgttagtatcagtcagggtt

SEQ ID NO: 103467 - DNA, 1098 bp, Homo sapiens
taacaaccaacaaaaatcacaggcaaatctgctttgttttcattgttcggtaggtatttgctgtgtatcatttcttctggtccatgaagcacagcagggcaggatacagagaggctgccctcaagaagcagaaggaacaattttaatttattcaggagggaaaagttaggcttttacaggctatcaacaaatactgattgggaacctccctttttctagggctcttctcagggccacagtcccccttctttctctcaggtcagttacaagctggtgcagctgctgaatgaacttcctcccctcctcttttctccctcttattcttccttccttcccctgtcctatatttattcagaaaatattcattgaacacctacaatttatcaggctctggaaagacatccctgagtgagttgatagggttcctgtccttgtagagtgtatgttctccttgcagcgacagactacaaacaaactataagcaaatacgatgatttcggattttaacccatgccctgaatcaactgaagacagcagggtttggtaagtgacttgagggggcacagctggatgggaaggtgtgagtctcaagaagccctatgagaaggagctaccatgtggctggaggaccagtgcctaatccaagggtggagacatgaaccatccccatttttacaggagagaaactaaagcatagaacctgtccaaggttaaattagttgtggatctggggtctgaacctaggtcatctgcctgtaaaggcccttcctccacagtgtgaagctgcctgcaccaccatgctaccctgttcttccttcctctcctccccctttcctccctctcctccccctttcctccctccttcagcttctccatctatcatgagtggataatgattttgtcctaccttaccgctgacccccttgataatattgacctagcggggaagttgtaaggcataactaataaaaatgacaatgaagcatttgccaacagaaggtgtactactgaatgctaatatcggtgagagcctgtctgtgatgctagggcagatttattagacagctgtttagccagcatgagtttccctgcccccaa

SEQ ID NO: 103468 - DNA, 1046 bp, Homo sapiens
tggacttcccccttgctgttctcgtgataatgaatgagttctcacaagatctgattgtttaaaagtgtatagcatttccccttttgctctctctttctccttccaccatgtgaaggcatgcttgcttcccctttgccttctgccatgattgtaagtttcctgaggcttcccagccatgcttcctgtacagcttgcagaactgagagtcagttaaacctcttctgcttataaattacccagtctcaggtagttcttaatagcagtgtgagactggactaatatagtaaatcatggacttggggaaatacatataatgaagaaatgttggtcaataaaatgttagcaaaactcaatcgggcatgtggcatcaaccttttgggtctatcattttctcatctgtaaaatgaggataatgatatcagccttaaaggattgttctaaggatgtgatgggataataatataagtacttaccatgatggcttgaagttactgagcactcagctaatggcaataattactattaactggtagacacttaacagggcaaatgaggaatgaaccatcactgggctgtggggtggtgctctcgggtaactgtgaagccctgtatcgagacgtgccctttaaacaggacagcatggaggaatgaactgcagatgactcagttcgaacaaagatatcctgaccccaaagggcagcagaaagagctctctccataaatgggcctagctggaaaattcctcactatctatggggaaggcacaatgggcaggagaagtcattggctgtgtgcagatgcatctgtctacagtcacactgtgtatagggatgagtcattgctgtgtcctcagatgcggagggcaaggacagggacaaatcatgtcgtcggacctatctgaggggtgcgtgaggctgtgttctggaagtgtggctggacctcatttccttttccagttacaagttccatgtaaacttagataagctattgtaattattttttacttcctgatagatagcaagatggttaactgagatgaatattta

SEQ ID NO: 103469 - DNA, 1049 bp, Homo sapiens
tttccctccttttggtcagcgtttctccttgctgccaccatgtgaagaaggacatgtttgcttccccttccatcatgatcgtaagtttcctgaggcctccccagccaccctgaactatgagtcaattaaacctctttcctttataattacccagtctcgggtatgtctttattagcaattacccagtctcgggtatgtcttttattataatttataaattacccagtctcgggtatgtctttattagcagtgtgagaacagactaataccccatcccatatttggggactggataaatatccgtattctgaaatgaacaaactgttctctggaacattcctttacaaaggatttccttcataatgcaaagtcatttggggctcctccatagtgctttgtagtagaagccagcattctctgcagagcaaactgggggaattgtctgagaagctcagtctttaagttgctcatcgactgatcaactgctggaatgacaaatcatagcattttaagactggtccctggagatgaccaaattcacttccctcatcttgcaaataagaaaacaaagacccaaagtgttcctgggatgagctgtagtagaacatagcattatacttggcccttgctgaccacctgtgtctgtcccttcttccccaaaactgtgcaaaaatatgttgctggacaatagctgttattatattcagtgttataaactgacatttattgaagccatatcgtgtaccagtacttctcttgacacttttcttgtattaagtcatttcattttcattatagtcctatgagttacatgctactattattagaaaatgtttggactttataattggtcatatttttaaattctggagtcaccattttgtggttaaatataaacctcgtgtgtagagtgggggtcatgtggttccagcacaggtcctcaatgaatgtctacaggtgaaaggaataacatgaatgagtgtgtaagtgatatggtttggctctgtgtccccacccaaatctcttgtcaaattgtaatccccatgtgt

SEQ ID NO: 103470 - DNA, 3355 bp, Homo sapiens
cagctacttgggaggctgaggcaggagaatcgtttgaacccaggaggcagaggttgcagtgagctgagatcacgccattgcactccagcctgggcaacaagagtgaagctccatctgcaaaaacaaaaataaaaataaataaataaaaatgacaataattgtgcacaaagactgacctcacctagtgtgttagtttgctagccctatcgtaacaaggtaccacagactgggtggcttaaatgataaaaatatattctatcacagttctgcaggctagaagtccaagatgaagttgttagcaaggttggcttcttccagggcctctctccttggcttgtggaaggctgtcttcctgtgccttcatatggtttcccctctgtgttgtatccttatctcctcttcttataaggacactggtcattctggattagggcccactcatacattcccatcttaccctaataacttctttaaagatcctgtcttcaaatacaatcatattcttaggtactgatggttagaactttaacatatgcattttaggggaggcacagttaagcctgtaaccgagggtcactggtttgattagactttataattggtaatccgccattcagatgtttcagtattacattagtttcaaatctaattgaggagataatgtaataaaaggtaaacataaataaaagtcagctacctctacaggctgagacatcatctgcttggtgagcacagtgctcttggggttctggagttgactgccacccctgcactggggcatcctgcagttctcccgaaggatgaaggcacaggtgcctctgagacttactgaatcactgtggcctgtgtttacccacctgagggcagtcaccacacctcagaccagatgggcccgtagtgcctgccaggccatgtctggcccagtccaacaacagtcgtctaataacatttagcacttattgagtgcttactgtatactggacatagatcctgggcctcagtccagagttccagttaactgcatgtgccagaccacacagcatgtgccagagtcagtgtcaggctctgtgctctcttgcctgctgagctggaccggttcccagggaagatatctttttgctggcagctgggagccccagccagtagcaagtctggggctgcagcttaaacagcctatgcacagtgggtacagtcagctgattccgagccctctggggttgccgcatcttaatcgacccttcctgacttccatgctgttgaggcctgtattggagggtccaagccacagcttgcgtgaagcctgggggctctgggtccaggctcccttggtcactgacagcactgacagcactgtcccttaacactgacagtgtgttaaggctcgagtttgtcccatgggccctccagttgtgttttggacctctgtacctccattccctctcagttctgttcctgatctgtcttgttctttagacagagctcacagggtacctcgggcttgggctttgctgtctgggacttttcaccgatgagaatgggactccatacatgagagaggaagatggctgtgtgctgtcttctggttctggagctcgagctaagtgagctctgcatgtttgagcttcctaggaatctggtcattatgactgataggtgccaggactcatgctgaaggtactccagtaagaaaagcacggtattatgggagcccaggaaaggggccactgactagaggcttccagggagatgtttgattcctgaatcttgaaagctgagttggtgttagctgggtgaaaggaagaagggagggctttgcagccagtgggaactgcaggaacagaaaggtgagaaacgtttgaggtgtgaaagagagcattattctagggctgttactacccatgtccagaagcttacgacttggaaaggtggagtggttgcctcgggattacgcctgggccaggctgggaggggctttgtgtgctaggccaagcagcttgaacgttatcctctttggaggctcaagtctgtgtatgtgtatgtgtgtgtgtgtgtgtgtgtgtgtgtgtgtgtgtacatgcatgtgtgtgtgttgtgttaggacctgaccctgtagcttccactgtttgctagtggtatgtctatgtctgagtttgcaaactgcaagttcttgtccagttatctttttttaaaaacttaggaatacttttccaatccaatcgctggttttgggaagccactgtgagtggcttgagagtgctcctctggccccaggggccacttagggacctgggcaggcatcggtcctagggcaagaggagaagaggcagcttccgatgagcctcccactccgtcctcacggcagggctccccgccctctcacctgacatcttccagctctccaggccctggcttcctgtcttcagagtgttctggaggaacaggaaggcaaagcagagggggggtgcatgtatgcacgcacatgcaagatcagaagggactttttacgaattctttccttgacactcctttttttgtgtcgcaactttgcctgtgaacccttagaatctctgctaatgagccggtcgcagtggctcatgcctgtaatcccagcactttgggaggcagaggcgggtggatcacctgaggccaggaaccgagatcgtgccactgcactccaggctaggcgacagagcgagactccgtctcaaaaaaaaaaaaaaagaaaaaagaaaaaaataatatctgctaatatgtgagcagtatcatcgtcatcaccaccattgtcgtctacattgctgtggaccaaatgtttgtgcccctgcaaaatccataggaaacctaactttcaaggtgatggtttaggcctttaggtgacacttaggtcatgaaggcagagccctcatgaatgagattaatgcttttatataaagagacctcagagagctccctcacctcttcttctacgtgagggcacagcaagaagactgctgtctgtgaagcagcaagggtgccctcaccagacactgaatctgctgcttcctgatcttaagcttctcagcctccagaattgtgagaaattgtttataagccacccagtctatggtattcagttaaagtagcctgagtgggccaagagaacaaccaccaccgccattgtcatcatttccagtctctataagcttgcttgtatcagctttgcttgaggtgtgtttaattctcacagtaaccgtaggagttagatacttgttgcatcctcatttcacccttgaggaaactgaggcagggaaatgttcaataaattgtccaaggtcacacagctgataagtagcagagctggagttcaaaggcaggccat

SEQ ID NO: 103471 - DNA, 1832 bp, Homo sapiens
atgtgtaaatggggatcttctctgccaggggttgaggaaaacatgcttttttctcgctgatatggtttggatgtttgtctcctccaaatctcatgttgcagtgaaatccacagtgttggagatggggctggtggaaggtaattagatcatggggactgattcctcatgaatgggttagcactgaccccttggtgatgaaacagttcttactcatgagaaatctggttgtttaaaagaatctgagacctcctccctctttcttgctcccacttttgtcatgtgacgtgtctgctcctcttttacctcccaccatgattgtaagtttcctgaggccctctccagaagtgcagaagatgtgggtgctatgcttcttgtacaagcctgcagaaccatgagccagttaaacctcttttctttataagttactcagcctcaggaatttctttctagcgatgcaaaaatgaactaatatcctaaattatttcttgactttttggtgggtctatggactgggctatttctgaagccactgtttaggtaaaagcattggtttctatcagaaattctacattcacttcctctcctggcaaaggtttttctattatgggagtagttcattcctttcatttttttcctccctgatataaacaaaaaacgtggagagccgtcacgggtaagatggattggattaattctgcagacacaatcagggagacccaggagcctttgggggagtgagggagatgaacatcatctcaggaagaacttttaacctctggaactccccaccagtaggacggactgttccagaacgcagtggtgatctactgccaaagatgttttattaggatagaaatcgctaaaggacaattatttatttatttatttattttgctggggacagggtggagtgcagtggcacaatcatagctcacactgcagcctcaaactcttgggctcaagtgatcctcctgcctcagcctcccaagtagctgggactgcaggcatgctcaacaacatccagctaatctttaaactttttgtagagatggggtcttgccctgttgctcaggctggtctcaaactcttggcctaaaggaatcttcccatcttggcctcccaaagtgctgggaatacaggcatgagccactacacctgtccaattttttaaaacacattttttgagatcctagtggctgtatgagtcactgaagattgaatagacgagatttcagcagccatagtccccacatagaatgtcagaagcttgaagttccatgttactagagattgtgtaggggtaatgattgagagcaagagtctgcattctgtgggccagtctgtcttcctttagcccatgagctaagaatggcttttacatgtttaaagtgtccaaaaaaatcaaaacaagagtactgttctgtagcacgtgaaaattaaatttcactgtccataaattaagttttcttggcacacaaccatgcctgtttcctcttatctgtggttgctttcctactacagtgattgcgagttgccagagagaaagtatggcatgcagagcttacgtgatttactatctcaccttacacataaaaattttgctggcccgtgttctaaagtagaatatcctcaactttcccaccctgaaactttgtggaaaatgataatgtttgttcagtgtactgggataagtggaagatatcttgctggcctggggctgaaggcaccaccttagcacacctgaggctcatttggggcagagcctcttgaagttctcattgagagccggctctggccataggcttcagccctacctgcagctgtttgatacg

SEQ ID NO: 103472 - DNA, 1054 bp, Homo sapiens
gaagcaatgtacaattgctcaagatatgaatattagtaactttgttttattttttagcactgctcagatgaatatataaaaatccgaagaaatatgttatttcccctctaagccagcagagctactagttttattaagcagacaatggcaaatctatttttaatttaattttttattaaaaaatgccctactgcttgagattctaatctctagctgaatagtaagtgtcattttcgagttgcgaatcgccagagcaacagcgtgcgtcgaaggcacttaataaataggattcggtgctttacgtccgtgtagagacaaaaatagatcaaaaagcttttcgattttacttttgagtacagtgttctgactttctagatggtaaggaaccatttagaactataaagggatttcgatttcgataacagtaactgtgtttaatgttacaaactttctattttgtaagtggctttctttgaagtcctgttggcagtttgttaaatattttagactgttatttgtgaccaagaggttcagtttggaggactttttgtgattcacccgtgtgctttaaaataatttgccactatttttggagtactcggtcccaggagatttgtgcatgagtcctgattttgtctcttagtagcagtgtgactcagggcaagtcacatagcctgtgctgaggatctcttggctttctgactttgtatttattcaccctgcttagttttcccagggagacccacactcacacccaccctttagcccatggactttggtggagatgatattgtgcagggcttcagggggagacataggactcagattattcctaatactggcttatagtaattggcttagaggtggtttcatgacctagttggagcccacaagatgtgatgaggcttttgttggggctgttgagaggtatgtgtgttctttcccactggccttgaactcagaggttggagctgcggatattgtagctacatccaacctagtagctgtcttgctactgcatggcatctgagtatgaagtccgtgtggatgagag

SEQ ID NO: 103473 - DNA, 1065 bp, Homo sapiens
actctcttgttttaatgtttttaacatttttcataatacaaatgttaagtgaaataatgatttagtctatttcttagccatttcctaaagatatgcattataaggtccattataggccaggcgtggtggctcacacttgtaattccagcactttgggaggctgaggcgggtagatgatctgaggtcaggagttcgagaccagcctgaccaacatggagaaaccccgtctctactaaaaatacaaaattagccgggcatggtgacgcatgcctgtaatctcagctactcaggaggcttaggcaggagaatcgcctgaacccaggaggtagaggttgcggtgagctgagatcgtgccattacactccagcctgggcaacaagagtgaaactctgtctcaaaaactaaaaataaataagtaaataaataagatccattatacatcccatcctggaatttttcaacttgatgtgatgctacaaagatgatctagttccctaatatcattccatgaacttctaggattctgggtttcccaggggctgggggaggtaagggagagagactcaggtaagtgggactttagaatcctgtaaatacacttcaatcacagatgcgtcacctgtgtgttttagatctttgcatttcccggaagattttattggggacaaaaagggggcttgttatttatagaaagaaaagtttgaggccaggcgcggtagctcacgtctgtaatcccagcactttgggaggccgaggcgggtggctcacgaggtcaggagttcaagaccagcctaaccaacatggagaaaccccatctctattaaaaatacaacattagccaggcatggtggtgcgtgcctgtaatctcagccactcaggaggctgaggcaggagaatctcttgagcccgggaggcggaggttgcagtgagccgagattgtgccattgcattccagcctgggcaacaagagccaaactccgtctcaaaaaaaaaaaaaaagtttggaaaccacactcttattttataaacaaggaaaccaaagcacacagaggggaggtgatatac

SEQ ID NO: 103474 - DNA, 1549 bp, Homo sapiens
ggtggagagagaaatagagggctggccaaagactctcagtgcctgccctttcttacccctagggcccatgagcctggtttaaaaaccgcttatccaccacctcgttttcattctcacacactgagtcctttagacgtaagcctgttggtgaggaagactgttgcagtggctgagatgtgctgggcgaaagattttcaactagtcttttcctaataagcacctacttgtttatattctgagctttcacagcagcattctagaaaaaagaaatacggaggactcaaaaaaaatacgctgcctgatttagttttgattgctcacgtctctggcttctttcatggaactattaattgactatagggagtagctgcttttcgcacaataagctcctagtcatgaagcaaaatggtgacattgatcattttggggtccctcagactctggcaacgttgaaacaggctgtcagttttttttgtaaccaccagttagcatgagtgggggtggcagaaattaccagtttgatttttgatcaggggctatggcttatacttaagctatttggagggaggagaaagcgtgaatgagcgagttaaggcagtagaaagatggagccatgctgggtttttaggcagttgtttcaaaaacaacacaaagtgagaaatggtgaaaaccaggaactgtttggctttttctagtttacaatgagagaagaaagatgtttggggaattttagaagacttgagtctatcgtgtagtacatctggtggagtccttgtacaggtcagttcacagcgtaccactgcttagaagtggactggatttaatggggctggctatttattcagcaacaacttattattcaccttctatgtataaagcactactctgaataaatgtcttctaaattgttagaatctaaactatactcaatattgttaccatgtgaagcatatcttatggaattatgattttttaaaaaactgttactcccatgtcattaaatgaaaagtttcagaacaatggtagttgaatgcagtttgggtaaaactgtgaatatctaatattctatatttgtgtatgcatgaaacattttggaagatggataagacactgtaaaataatcagtctaataaagtcagtgttttaatccatggttgccagcatcacaaaagagaaacaaccagatgtcatgtgcctcttgatggaactttatcggggaacctgccccgatagtcacgtaggttcttttctattttcctaagcgtcggctggcttgagaaataaaggacagagtacaaaagagagaaattttaaagctgggcatccgggggagacatcacatgtcggtaggttccgtgattccccacaagctgcaaaaaccaggaagtttttattagggagtttcaaaaggggagggagtgtacgaatagggtgtgggtcacagacatgaagtacttcacaaggtaatagaatatcacaaggcaagtggaggcagaacgagatcacaagaccacaggacaggggtgaaattaaaattgctaatgaagtt

SEQ ID NO: 103475 - DNA, 1061 bp, Homo sapiens
ctgttaataatgtatcgcatccctcgtttgaaggatgtagtcctaatttgagtttttttcagtagactggagctcctgccctcaccctatagcattcgtatcctctgagatacatggatactgttgaagttatggtgaagatgatggggtgctgggaggtggagtggaatgggattgattgatgaaaaaacgacattagcttgctaaggacacccaggtggttgagatgttctgcgaagtgggcctgtgtgtctgctggacctggagttgaggggacagctttcttctgaggcagcgtcttatcctggggtgactccgggaggcaaaagcattaactattgatgagactgatgacacactatcattcctagaccagaaatggtgcaagaacagagaggatttatcctgctcttctttctctacacagtccctgtgtcagagaaggtgtctgctgagtggacaggccaagaactgttctctgggacggagtgcagatgaagtagggggtgtaaacccatgaagaacaatgaagcagagcgagtgaagcaggacaggctggggtggaggagaaagaatttgcctttattgtgcaattagccttttcgattctttaaaagctttaggagatagtgaatatgtccctccaatctacagacccgaagaggcatctcgggaaagtgatttgcccagggggacagatcaaggacctgaccccaggtccctctctctgcctcagaggccctctgggatccattaaagggtcttgtcttgagtaattaactgaatactggtttattcagaatgaggggtctttaattgggggataggcatacctttggtaaaaccactggagtttttgggcccagtgtctggcagtgtgcaaggagcgtggggcatctttggcacaacgcggcttcaggaagagccctccttcccttcctgagtaaggcagagtttgagtcaggctggggtgggctcctggtgtggggacaggttattgtgggtgctggagggaatgactttcactctgagtcattcagtggcctgcaggggtgcagggc

SEQ ID NO: 103476 - DNA, 1054 bp, Homo sapiens
gaaggcaagggttgcagtgaactgagatcacgccactgcattccagcctgggcaacagagcgagactctgtctcaaaaaaagaaaaaaaaaagttattttagctttttctgcttgctcttggaaaaacaaaaattagggagcggcggggagacaggagaggataatgacagacaggttcatctgacaactaaccttaaaggggccttgtctatttttcagaacctacattaagaaacgcattcagatgcatcagccgtttgtaaagcacctgtcgtgagccaggtaagatgtgtagcgttttcaaagctgttttattaaatcctcacagaaacctttccaagttgccgtttttcagcagggcgatctgtgctgaagtaagctacctcgcttggctcacacagctaaaagtagacgcaccagcctagggcttggcgttgtccgcctctaagtttagggctgtaatccggttctttcaccaaagaagacacagtggctgcctcacagggacctggaaacagtgtctaattcccagttctggtgggatttcccctgtgtcttactctcttggctgatgatcagtagatctatttatcacttctaggagctgcgccttaagtcttcatttcagcctcttcgtatggacctcactgaggctctgagggggaagtgactgcttagacccaccacccacccacccagcttgttctgtcgggaatggttctgaccctcttccatggagaggcatgtgtttgtctgggtggagaacatttccagaggagcatggccccctgagaactggtccgggtatggccacagttcagcactctggttggattctgcacatgaaacattttgaaatcttttcagtggaagtttggttcttggacagctctcttctgctgtcccctaaaccccctattcctactgagatcagaggccatttgttgtacatagtcatcgcccaggtgccagcgtagggctgggtgcccgggaagcctccagtaagcagcacagaggtgcggggtgcgtctcaggatgccaagacttgatccc

SEQ ID NO: 103477 - DNA, 1397 bp, Homo sapiens
cggtaggatcacttgagtccgggagttcaagagcagtctgggcaacatagtgagaccctgtctgtacaaaaaaatttttttttaatttaaaaaaaaatttaaaattttttaattgtaaaatacacataagattgaccatcttaactatttttgggtggacagttcagtagtgttaagtatcttcacattgtcgtgcagccaatctccagaactgtttggatcttgcagaactgaaattgtgcatcctttgaacaagaactccctattttcccctcctcccagcccctggcaagcagcattctctatgggtttgagtcctccaggtactttatatgagtggaatgatatagtatttgttgttttgtgactggcgtatttcacttagcatgaggtcctcaaagtttacatcacatggtgtagcgtgtcgatgatatttccttctactttatatgtatgccacatagcaccttggtttgcccatttatctgttgctgaacatgtccttgatgaaccatacatgtcataatgggttgcttccagctcttgaccacattttgttgatttcgttaatcattcaagaccaagaaaacatacctggatttaagccccggtctctgtttgatacctgacttctgactgctttttacttccaaggatcctccagctttaggagttgagaagaattttatacaatgtggcctttgttaagcctgaaactgctttgggcctgttgaaaactcccttttattttctgagtccctactcagacaacacttcttccagaagcctggtggggaccaagtttataccgccagaggccacaatgtaaggtgaaggctttttgtttgtatctgttgggtgcccgttgttttcctagtgtcatttctaccttttcccaaagctcgtgcgtttgtttccatattttaaaaatgactatgatgagatgtcgttctgaaattaggaagtacagtaatacaacattattatcatgatacaggtttgcatttataaggtgagctcccttggggctagtcatttttattttttttaattatactttaagttctgggatacatgtgcagaacgtgcagttatgttacataggtatacatgtgccatggtggtttgctgcacccatcaacccgtcatctacattaggtatttgtcctaatgttatccctcccctagcccccgaccccctacaggccccagtgtgtgatgttcccctccctgtgtccatgtgttctcattgttcaactcccacctatgagtgagaagatgcggtgtttggttttctgatcttgtgttagtttgctgagaatgatggtttccagcttaacccatgtccctgcaaaagacatgaactcatccttttttatggctgcatagtattccgt

SEQ ID NO: 103478 - DNA, 1060 bp, Homo sapiens
gacagagtgagaccttgtctcaaaaaaaaaaaaaaaaaaaaagaatgtctgggtcccaaaatccacttttcttctactgaggacataggaatggtcaccttccctgcccttttctagggccatgtggctcattctggccgaagggtggtgagcagaagtgagttgcataatcccagtgaaagcatttatttgcgggtgcaagatctcctggggctggcgcgaagtgctggggggcaggactgaggagtggcaccaaatgctgcgtaggagagttctccagatttgacagtcaaggatcctcatggcagcatggagaggccaggcgtgtctgcgtggccattctgtgggtgaggagcctgaggcttagtgaggttaattgcttgtccaagggatcttgtgcaaattccatggcttgttctatggcaatatgctacattcgctgttatgatttcttgttgttgctgtaaattgtaggctaagggtgtgtgtgtgtgtgtgtgtttgtgtgtgtgtgtaggtgggtgaggagtgggagtgaggaacagctagccgagttgcagtgcttggtccttttgcagaatgggtgttagcaaaggctggcatgcttagcccaggtggtggctgtactcggccaccaagttaacgaagagaaaaacgagttagctgttacctcctctcagatgtcagttttcctttaatgtggagctttggagagaataccaagatagggctgtgcttactgaccttttccttgccgcacagatgggaataaggggggtggaagaaaaggaggaagaagagaggtgttcgaggcagaggctgcctgggcgatgccgcttcgttacccactctcagcctaaggaagcgttgcccaccctgagattcagggttgaaatctctctagcgacagtgcccaggagtgcaggcttcacactccaaggaccttgctgagggtgcatggatgtacgggcaagggtcgtggttgtggtggcagtgcagtaggtcatcagaaaggcctcaggctggctgcgcccacggtgttccccgtgctgactccagc

SEQ ID NO: 103479 - DNA, 1175 bp, Homo sapiens
tggcacgcccgagataaaggagtgactgagtggcaaagctgagacttgaaccctaaactgtcggctcccgtgttcctgtgtgccacggtgctgtgtgagaagtgggaacggtgagttccctgctgggctcagtatggaggcaaaccgctttctgcaacacattcctatgctctcggacagcttaattgacttctgtgccttaattttctcatccgtgaaagagtataataataacaacaataataataatagactagaaattggccaggcccttggtgaggactcggtgcgtgctacctctgatagatactaatatgtaggtatagtaggaacatcaatcatcaatattgttttgactcttttgacctctgataaaaaattttgaccatggactgccctttttgtgttaatagatttgttaggtcaatgaaaacacagctctcacaagaagaacttatgttttataacaccaagcccacaaacgaacgtcatggtggcccccgaggacacgtgacagagctgggatttgaacccaggcctatctagcctctgtgtccccacactgtttctcttgggacccaggtgtccggctggccctcagcttcctgcgttcctggtgattcggccctggcggtcacagtgtcaggtacacccactcagagtgggtttatgatacagttaggaaggagcccaggccacagcactggaaaagacgaaattgtagtgttgatcaaggccaggagcctctttgctcagcgactgccgtcaatcctcttccctgagaagatcgcctgtattgttcaagatgttcggatataacctcccccaggaaggcttccctgatgtcacacacacctctgtcgaaggctcccaggtgggccgaacagagtcttcctttgctcccatggcagcttacaggatctttggcagccttttccatgatgttttcttcccaggggtttgtgtagcttgtcttcaccacttgccgtgagctctcgaggacagaggatttgtctgtgttagaaacatctggttcctgccgggcacggtggctcatgcctgtaatcccagcactttgggaaggtgaggcaggtggatcatttgaggtcaggagttcaagaccagcctggccaacatggtgagaccctctgtctactaaatatacaaaaaaatga

SEQ ID NO: 103480 - DNA, 1149 bp, Homo sapiens
gaaaacatttatttgcacaaagtggagttgtgtcagtgtcactttgaaaagaaaaagacgccaatattccctaccaggatgttctgtcatgaaaacaaacagatgaaacaaaatctacttcgaggtcagagtgagaagaagagaaggtccggctgaaattatctgcagtcttgctggagggaacaaatggttgcagctcatgggtatagtggcattttacggctcccagctgtgccttcccttcttgaagatgggtgaaggggagtaggttctgggctagacttggggctatggagcaaaagcagagggagcttgtcctgcacagacgtggaagcagaggtcactgaattctgttccacagtagaagtcagcagtactttatgataacagtgcatccaaacgtgttctgtctgctgggctgggcctgacacccacggctgtgactctttcagaaactgcgaaccaacctgtgggtgggccagggatccaggtcaggagcagaagtaggttaaaggtgatcgagagagacatgtgagagagtgagcgagagatagaggcctgcaggataaggccacatcaggagtacagtccaaatataggcagtgattgtgaaacccagggactgtgggctaaaagtgctgtagattctgaaagtaggaagaggaaaaatgtggccacgggcctctggggaaagccctgttctgtgggctttggccacttaaatctatatgtcttctgctgctgtctcaaggcagtgatgcagccctgactatccttctgcccatctatccattcatccatccatcagtccagcatttgagtctctattctatgcatggtactggggatagtgtggtaaacagggcaccatccctaccctcaaggagcttacagtcttgcctggtaaaatgtacagaagcatgcatttttgaaacaagtaaaggaagaagacttaggcgctctccactccaaggccacctgcaccttgcctatgtagctttccccagcaacacgaagccagcattggtttcttaagttcccttcttgtctttatcatgtatgtacttagtatctgtattgtgctttgggctatttatttatatcagcatagcactttattgcatctttattgtaaataaccttcctgaa

SEQ ID NO: 103481 - DNA, 1050 bp, Homo sapiens
gtaggctgcttggatccggtttggccctctcctcttgaatgaggagggaattgggcaagccgcaggtagaccaggtggccccgatagatagtgaccgaactggtacttgagctgcatctcctcttcttgtctagccatcttggtgttctaggtaggacatgagctaggtcctaccaaagacttgggcactttatttaagttctctcatgtaatcctactaacaacgttgtgaagcatgcactatttttacttactaaacaaaaaaggagcgatcgggactagaggacttgaaataactttctgaggcccagcctgctggtgcgaagtagatccagtgattcaacgtggctccatcccatgacatttagctgtcagggagctgcaaacctatgaaacagagctttcagattttggaaatagaaacgcaggcagcatagtgccacttgctgcctcctgggaaagccccttgtcgtgaataatagaaccagcgctagaaggcacgttgctcaggccggcaggtgagtccgagggctggggaggggttttctgggcagtgggacacctccctcttagggggtttcatttgtccagggccagtgaaaggctgtttggtccctctgctgagtgaacagtcccagcccacaggatgagtcagagcagagtccagaacagaaggcagagggcatgtgtgcaaaggccatgtttatcccaggcatttggatcttaagattcctgttcatgatgattaaggttttatacataacactgtttacagactgctttatgatcatttatgagtgtcacctggcaacagctgagttagccacatccatccaccgtggggtaattaactctgggcccacccagagcccagttcattgcttgtgcattattgagcctcctccccacaccctcattcattcatctatccatccatccattcattcattagagccctttttgtcagatgccacctttgtgggtagctttgtggttggcatttctttttcattgctgagaatacgtaatatgctggacatgttggtgttc

SEQ ID NO: 103482 - DNA, 1076 bp, Homo sapiens
tatatatatataaattcaaatgttacattctttatttcatactgtctggactgtggtatgtattttattattattattattatttttttgagacagagtctcgctctgttgctcaggctggagtggagtggcatgatctcggctcactgcagcctctgcctcccaggttcaagcgattcttgtgcctcagcctcccgagtagctgagactagaggtgtgcaccatcacgcccggctaatttttgtatttttgtagagacacggtttcaccatgttggccaggctggtctcgaactcgtgacctcaagtgatccccccacctcagcctcccaaattgctgggattacaggtgtgagccaccgtgcccagcctgtattttaatttatagcacagctcacttcagagcagccacatttcaagtgttctgtagtattttcctgtatcatcgtattacatccttccagaattctaagaagtaatcatttctcccattttgaaaatgggaaaactgaggcatagagagattaagaaacttgcccaaagtcattcaatgaaggtttgaacccagataatctgtcctcagagccctgctgtgctagtttcttacaaaatcttgggaaaaaaaatttttttggaggatacttggggctttcatttggcgtagactgggtagtttatacctcaaatggagggataatcttgactagactgaacctcgcaacagggttaacaataaaattacatggcagatgcacccccagggcaccattattatacatagcagggcctcagtaaatggtattctttcccttctcttcagacccataaaatcagctttttttaaaaagggactttcttagttttgtttacctctggatccattcctggtacatagaagacgctcagtaaatacttgcggaaggcagagaggatgctttggggtcactggatgtgatgatcactcacagttgttggggcatctgcaaatacagtggtaccattagatggtgggttttataaatacagccctgggtgaagggggcttatgtggagagatgaccagagtgttcagatctg

SEQ ID NO: 103483 - DNA, 1051 bp, Homo sapiens
gggatggtggcatctggcctttcagggcctccccaatctggtcttgcccggtctcccacagattccctgcatagttgtgacactccagccaaactgacagtcacttggatgtggcacatgccttcccatagtcaggccctttgcgtgggctggcacaatatgggggcctcagaagagaagtggggtttgataagtgggctgcttctcccacactgactcaccctgaatgatagcagtgtgtgaagagcacactcgttaatgccatcagaggaaagagggtcaacgtacagtgacccaggataatgttccctgcaagcgcatgatcgctttaaagtgctgtgttcccagcagtgtggacggacagctgcagtaatgattcgtacacagaggaagctggcattgaccgaggccaaccgcatggccttggtttctgccctgaatgagctgacattcttgttgaaggtgagacaggtggtgtggttggtgggcagagaccacctgacttagataggttcaagtctttatttttctcattgattcatcacacaactatttactgtgcactactgtatatgaggcactgttctaagtactgtgggactgttagtaaaccaagggacacgagtccctgccttcatagagtttgtgttctggcagagggagatagactaacacacaaaacaaggaaaacatactgtgtctcctgtggtggtaaatactcggagagaagaaaatacagaagggagagagagggagggtggagtgtgtgtgttggcaggagtgggttagggtttgcggttttaaggaggttggtccgggagggtttgcagaggtaattggaggagatgcctgaaggtggtgaaggaatgagtcatggggctttctggggaaagagccgaggcccatgccagtgcaaaggccttcaggccatttcttaattgctaatagagagaccacagaggggtcgtgtgcctggaagggcgcaagcccctaggaaagtattgggagaggatgacagagaggaacccaattgttctgggtctcctgggca

SEQ ID NO: 103484 - DNA, 2428 bp, Homo sapiens
agccagtaaggaaatgaatttctggactaattcatataaaacaaaggggcaagtttagtggtggagatattggaaatttttataggcatttggtagagcacagaggagagcctcttgattcagccttgaaagataacatttctggagctggtgaactctgaaatgactctcaaatgaggggtctgaatgaggcaagggggaagcaaggggcctgcctgttgaggagacgagagttcacagaaccgtatgcagcttcccatatgcacagaaccgtatgcagcttcccatatgcacagaaccatatggagcccagggtagcttcggggacaggtagctgctcagttgtaaatgtttgtttttctgagctgttgcatgccttggcgctagggcagtaaatctctgagcagctatgcccagtaaagtcatgaaaacttgagtctctgtagtctcataaccccttatttccacctgcctaatgcttgttgctttagggaaactgaggcagcacccccccgcccccaccccaaaattatgacctcctctgtcctgaacaacctgaggaattgttgcctatgagggctggcttatcacgaagctcatggtccttttgaatagatctgagaattttgcagatataaaataaatttgaaatagcttgttgtagtttaaaccttgacagcattatgtgcagtgattcttggtttttgaaacaatttcttgatgattctcaacttgactcagactccagcatgtacctgtgagattttggtgaagttctgttgcagagttttgagcctcagttttttcatttcttgcagctttttgagcctcagttttttcatttgtgaaacagagataaaatatgcctcctagaattgctgtgcgggttaatttgaaaaaaatatgaagaaaagctcattttttttttaagcaccaactactgtgccaagcactctttttagcctctatatgaatgaattcatttgacattttaaatcctcacataaaaccctaagatggaataaacaggagtgtgagccccgccttgcatctgaggcattgtggagtttggtaacttgcttagggctacagggctgggtaggggagaaactaggatttgaacaccagaattatgcgcttaaccctgaagctgtagtagctctgttcctagaatgtggcaggtgcacatgggtcgctagttcccctctatcttcagaccactgtcgttgttctctcccaggcctgaggagccagtgggccagctgggctgggagggcttggcagggccctggcctggctccccacttatggggggcagaaacctggggcctccctttcagcactgacatggctggtggtttgcatttgcctgtgtgttcctcatctgtctatcccatgaggtttcacactacacaagggcgggggccatttccgttttcctggttcacactgtgtttctggcaccgagcttcacatccttccctcattgaacactcagaaagttatgaatgaatgaatacatttttatttagttctcccctcctctatcttctggtcactccagaccactctccctttaagacccagttcaaatgaccccatccccttgtaggtgcctccgtgagtattgcttgcatctcctttgtttcctgtccatgagcccctccgggaccccctgcaaacaccagacccagagcctgcctccccatgttggatgttcccaatcaatggtcttggcgtgagttgattgaacagagtccctatttgagaagagcctgacttatgtctctgctagactttagaggggaccaagaataaagggtctatttaaggaaaccattacacaaaatttccagatacgtattattccagctccagaatctcaaacttctgaatggatgggctccaaaaaatacactttcttttctctcattgaaaaagatgtcataaatggcgctaagaaatgctgccggtgtgcagaagtctgcctagcccaggagggagcttcctggacctttgccacgaaaattgtcagacatacacttgcaaacctgacaattaaaacggaagacaatacaatagaataagaatcttttccatttctgttgaatgagggggcttgagaaaaagctcacgaaattaaaaggagaatgaagacgcttctgaagggagctcggtaagaattttaggggcaggtggcatctgttatttattgtgccagttttgatttcagattacagtatatgctttcttttggggaagtgaggtgatatcctggttgaaagctcaggctttagggtcaggcagatgctgatttacatcaggaacttaaatgtgtaactgactttaagtaagctactcaaaaaccaccagtctcttcatctctaaagggagtgaagtatgttacaaaactcgtgagtgttgtatg

SEQ ID NO: 103485 - DNA, 2085 bp, Homo sapiens
cactgtatttaaaattgtggctctccgataactccacacttgccttctttaccctgctctgttttttcctatagcatcaccgtttgttaatatgctgtgcgtttatctgaatgtgagctgatgacggcagggtttctgtctttttgtgtcttaggcatagagaactctcaataaatatttgttgagtgaatggagtaaatggtggcctctactagtgttagtggatccagaaaggacatggaatagtttaagatttattccttggttgagttccaggaggaactgcaggatttactggggtggtgggaagaggaagggggacagtgctgtggatacattttgttttacctacccttttggagctggtgttttctttctcaattaaaatgtattttctttagcggttactttgtaatggaaaatgacacttctgccagttttagtcttttatgtgttctaaaccgagtcctttcctcctgctgtggcttcaataatgcatcgtttcataagttcacagaatttaatgtgcttctgctgaacccctagtctcagccagatagttaaatgaaaattaaccactgtaggttggattcaaagtcacctattcaccttctccctttttaatccccttccctcactccacgtttgcaaagcagtgttgcatttttcttttttgagaaatagggcatgatgtgtgcctgcacacgggctcttgtgtgtgaatgggaatattgatttatttcacaatcagagatccatgaaaaaataacactgtgaacatacacatttttgaaatgctgcctcttccgctgaagtacagtggagtgtagggacctgtagcaaactaatatttaacgagggtgccactgttgtaccacctttagaattcacagtggctgctagtgaaactggcatgtgtcttgacaaggctgtgaaatgtagtcagtcttctttcattcattcatttgttcatttattcagagccagatgatcattttgtatgcatgaagcacctgagtggtggatgtgataggctgattgcatttgtggcctcaaatcttcacacgtttctgatttcctacccaactcctttgacttttgactttaagtttcaccatgtgactagctttggcctgaagtatgaggtggaggggatggtatgccagttttaagcctatgccttaaaagatcttgagcatttctgcttttttgtgtccctgcctttgccacaaagagtgtgccctgccagctgctggtcagaagaagagtaggagaggggagcagagccacgcagccaattcatgggccctcagtgagaaaccaagcccagtctagatcagccaagtcccagctgacctgcaggtgcatgactagaaataagtgatcgttgcctcaagacactggttttgggatggctcattaggtagcattattatgcaacaaatgactgatgtggtgggttgctaacatgattcagacgtgaatcctgtttgaaagaagctttgtagttttgtgagggtggtgagaaggccaggacaagattgtgaactctcgtacgtggtagagaaggtacgaaacgtcttaagaaaggactcatggtgagagtggcttttgagaaggcatttttaggtgatgttgtcaaagtcgagaatagaagaactattagactaggatcctatcagactaggattttgagttaaaaatatgtgatatttcaaagttgatttcatcacagccaatgcatcgatgccaattttccgttaaatttctaatgactttgcttttgatgaaccaaaaccagctcttacaacttaaagctacgctgctgtcagagaacatctccgtttgataatagccaacatttacagtgcttatcacaaagaattttacccagcatgtatttggtctatgtactgtgtgccagggatgtgtttgctaagcattttataggtatgatctcatgtaatcctcctcatgatctgaagagttgtaggtactaatgttgggtcaattttccaggtaaattaaccaagccagagaagggtaagttacttgctaaagtcatgcagtaacatcgtattctca

SEQ ID NO: 103486 - DNA, 1547 bp, Homo sapiens
gttagagccaatttgtcctccttgtgccttcctgctctctctggtttccggtttgtgtgtcccatccagagaccgagggtgccaactctgcccacctctgtagaggtgtactctcctccccatcccccacagcacccccacttgcctctccaatataaggctcatgacacaaaatacaggtgatcggtgatcagattttctagggtggctctaattgcaaatattctgccccatttgttatcccattaaaccattaaactgtcccaggcattccactttggtatataagctcttccgggactggctcccatgtgacaaattgagaagtgccactgccattttttgagcacctcctgaatgtcaaatgcttgattcatgattctcattgtgttttcccaacagcctgatgaggtggctgtcatggtgcctgacttacagaggagcacactgagaccaaatgaggttcatttccttgtatgaggtcacacacatgtgtgtgaccttggaccagatatgggtccagacaaggatgagaactccaaagccctgtcctaacttgcctggggccactgccttggaagagcacagtagtttttctgccagctcccatgtcccagttttgtttgaaaaataagagttgctgcacacagaggctacttcgaggtttctgataattcattctgatggacagcagtgggacagtgtcgggtaggggacacagctaaagcctcaaattgaaataagaagaggagacaagggggtcaggaataaggttgcaactggggtagccaccctagtgagtagagtaggggtccacagtgtttctcacctaggatgtgtactagaatcctctggaaagctttaactgatgctgatgtctgggatccacccctagaaatagtgattttaatggtttgtgatgcatcttggggaccaggatcaaaaactccacaggtgatctgcataggcagccaagatttagaacactgggaaggaggcctccatatggtacaggttgaacaggaagtagagaagacacagccttaggataagggcagggcctggaccaacagcacaacctctctccccatctagagggtgaccctgagtgctcatagggtcagcctctagatggggaggggagttgacccttagacttagagcatccaggtctgcagggccgggagcccagtttggggacccagtgaggcctgctcatgcttttcctgtggaatcgatagatttcctgcatcttcagtgccttcaatgcacttctactcaacatgtagtgaaaggggcggaggtgccctgtgagacttgtgacgttcagcgggccttaataataggcctgcatggactgccttttgtctttgcttagagttcatggttaaacgtggggtttgtggtgttcccatgatacctgaataccgcttgatgagagggattagattgcaaacaccttgtgagtggggaacccaatatttgtgtctgctagaatgagtgatatgatggcttacctgtaccacttaagttaatgattgatttca

SEQ ID NO: 103487 - DNA, 1084 bp, Homo sapiens
caaaaacaaccctccaaacccacacactgacatttaaaggatttgtgccttttacttgcatttacttacagcattgtacagattgctgtctgaatatatacatctggatgtattctttgagatgcccaaagcactgcagaagtctcacttctttgttaaatagattttcatgttattcccatcaattggatcagaatttctgagggctgctggtcatcgatgttgctttgctcagattcattccttcatttgctgattcactgaacacacagttgttgaccctctgttatatgccaagcactgtactgggcacagtgagggggcgggtgaggaggagaacaagacaaagtcccagtccctgcttgcttggaactctcattctgtgtggcttggttcattgtgagcagattaggttggcccttggctgtcatgcttccaggcaaagctatcccttttgtcacttgccacctgcagttctgggctaaaaactaccatatgtataactcctcttggtatttattggtttgttacatccaattttgcaaagcctgatgcattgtttggttagaaggaatcctctattctactcccaagaggccgctcaacaggctttgatgatccgttaaacccagttccatttttgacatgggagagcctgtaacttttttgcctgttttgattttgagtcctttatagggtattttgagagttgggcaccatcaggcgggtttgatgtcagtgcctcacaggtgggcgatgaagttctgggatcaattttgttatatggccgccttgtacagtgccacactggaagcttacattgcaagacatgttcttttcatggcgagattgagatgtggtaattgaaatgggaatggctgaaaggaatactgatgtctccatactgcagggaggggtccaaagccatcttgctgaagagcagcaggggtttgtggtcctgttcacttctgatagggagcagcataaatagcacatcctgtcacttcccgatggatacagttgcgtgaggacttgtttataatgaatggtcctggaaaacaacatctcagggaatgaggaggca

SEQ ID NO: 103488 - DNA, 1663 bp, Homo sapiens
ctgtctcagcctcctgagtagctgggactacaggcgcctgccaccacgtctggctaatttttgtatttttagtagagatggggtttcaccttgttggtcacgctggtctcgaactcctgacctcaggtgatacaccctcctcagcctcccaaactgctgggattacaggtatgagccactgcaccaggccctgtcctccctcattttataaaggcacatctcttagccagaactagtcttattctggcatgttgctctgggtatgaaaatctcaagggtcacctaacaaagggactatttgaaattggtatgttgaggtccttctaatcacagcaatgccacatggttgcctctttcccttttgtcttttacgtgttgaaacttggtgccagaaacagggcatttaagcccctttctcatgtgagagaataatataacattttcagttcttaaaaaataacttgctgttggatttttaaaatgaatgatggctatcagattgctagattccatttaaaactgtgatgtgaaagttttattttaaaatgttaatgtttacaatatgctgaaaattgtatccttagaaattgtgtagttgaggatgaaaactttatgtcagcctaaaaataggcacggcagtacaagtttttcaaatttcagaattcaagggcccaggcatggtggctcatgcctattatctcagcacactgagaggccaaggtgggaggatcgcttgagcctaagagttcgagaccagccctggcaacgtagtgaaaccccatctgtataaaaaacagttaaaaaaaatcagctgggcatcctggtgcatgcctgtggtcccatctactcaggagactgggaggtggattccttgtgcccaggaagttgagggtacagtgagccctggtcacgccattgcactccagtctgggtgacagagcaagatgctgtctcaaaaaaaaaaaaaaaaaaaaaggaattaaaaaaaaaaaacttaaatacctctgtactattctgtctcagatactgaagtttggagtgggtaatttttaagttgatttctgccatagacccttatacacctgaatatttttttccataaaatttaaaggacatcagtatttcctaaagctcatacattgccctcctgattaagcacacttgaaattctgttgggtttcaggataatgtaaacatcctttaaatgttgatgaaacttttacacatgtagctagtcatgtgatcgtgtatgccagagtgcctcaatggctcactgaggactgtttcaggtacaaattatagaaacctaactcatagtgatgttaaataaccattccactttatcttcttaagtgactgaagacccgagggcagcgtcaggcagggctggatctaagtcctcgaacagcgtcaccgactctactgccccacgcctggctctgccttcttctgtattggcttggttctcaggcagcctgtccccatgggatgccaggagccctgggtgcacatctgacttgccccaccatcgtagctgagggaaagcatctttttcccagtacatctggcaaaagtcctggttgtggccaggcgcggtggctcatacctgtaatcctagcactttgggaggccgaggcggggggaccacgaggtcaggagattg

SEQ ID NO: 103489 - DNA, 1805 bp, Homo sapiens
tatctcttatgaggctttccaaaaaagattttgttctaggaatggaataaactgtagggcgtttaaggcttcagaggtaattttgggcaacctggagttgcaggtaatcacaggctggggctggaattgaaaatgcagtctcacccataatttgagcctcttttgtcgcattatggggctgtgccttggacaggcagcagacgcagatggagatggaaccctgactactgagagagctttgcttttaacatagtccttttctgaattaccaaggccaattgggaagaaaggacttgccgatctttccagctctccatggtagccatagaatttaggaagatttacagcagaacgtgggcatctagggatttctttcttccttttcttttttttaaattttaaattcagaagggaatcttgggctcttgagtgttattctgtggttagggattgctgcggcttccttggatacattaaatgcatatttgttattattgagtaaggttaaccttgctgcggctaactcgaagccatcccctccccttttgtttttagaacagttgcgtagatccttcatgtgccaacactgtttgtttaagagccttcttgactgatgtcagctctcatctggaaatggcattttgtggttgtttcagaagccaagggaggcatagaggcaagcccataggccggtggggctttacctttcttcaggagtggtgctggtgcttagtaggtctgcagttagtaagtagttgtgtccacactgaatgatttgttttgtgaatgaatggtcatgttttcattactggggtggaggtgatgcgggagggagaggtgggtgagtaacagtagacttaaatggtgatgagatagacttgagctcctcaaggcgtctcctagcagcttttgttttaaaaatgtgaaggatatttcagatcagcagaatgaattctctgaaggatcattgttgtggttcaaacattgatggctttgtaaaaaggcaaggagagtacaataccgaaatgcgtgctttctttcctccgagtttgtagggattttaacttatctggaatgagaagaatggacatgctgtaaagcttgttcacatttacatgacaagttgccttgaaaatgcctggaaagacattttcaatatgagaaactttaggatggttgttgtccagcatggatgacgatgattatgaaatgacttaggtgtagaccggcgctcccatgtcaggaggatgaagtggacgtgggagaatggagggagggactcagtacttggtccccagcaggaagaactctcctcgaccatattggtgtctttacccatttcccaatatgactccctctctgctgggtttctcagttacaagagcactctctgatgccttccgtctgtaaggcagagctactgtattgagagactaccaaggctggaagagaccttggagccccactagaccaacaccttcattttacatccgtagaaactaaggccagacctaagggaggtcaagatgattattcagaggggaggtggaaccagaacctaggctccctggtcctcagctctcccttctctgcagcatgctctgcttccatccaatctgcacccaaagcacgttcttccagtgtttcttttgtgccaggcactctctcattcggtcatttttgttatttcattctcacagcaaccctgggagggggatgtgctcactctcccacttcacagatgtggaaactgacgcttgtgcaaggcccacagccatgaagaaggagccaggactcaactcgca

SEQ ID NO: 103490 - DNA, 2434 bp, Homo sapiens
gctctggagtgagcagtagctgctgacaagtgtgggccctcctgcttcacttaatgaagtgtgctggggtgtggattaactttttgatgtgagccaatgcagattcctttggcttttaaaccatacctggaagggccttagaaatgaaatgaaaggtttttttcatctcatcataggtctcggaagtgcttccatctcttgggaaggttgtgacgaaggtttcctttgtttctgggttcctgagctgcgctttaaagttgatgcacagtgcagggagggtgcgtcctgtagtgtcgccatccttcagccacctacagtagcaggacactaggggggactagttatcttttccaccatcgaagaagaaaacaccagggcccatgttactgtggtttatcttgagggttcatgagcctgtggtttatgttgagggttcgtgagactgtggtttatcttgagggttcctgagatgaactttttgggatctagtacatgcttgcactagtgagtggattctgagtgcctaagggatgggcctgctcacatctaaattgtcatttggacaactcagaaccagttaactgcaaaatgttatgtgacattctgaaaagactcagttataatctctaagtatttaaggactacaaaaaggctctatcctttgaatattagaccatcctaactttaagttccctaacagtttgtaatcaacacttttggtgtttggtttttgactgcatattccctgcagtcatcataaaatcacatggcttcaaaatgtctctgcagtggactccatcaaacttaaaattccccttaaaaatacattccgtatacttagagatgttaacataacatttgacggtgtagttgcacttccacctcagacgctgtctgcacttttaatagtatgaaatcattaatgtccacagcccttccagcagaattggaagataattctacttccctgaagaacactgactgccccattgcctaggtttacccaagtagctaagtcttatcaaagctgatcccagaggtgggagtagcggggagacaggaaagatgcaaggtagaggccaagaagagcctgcttagtttagaatactgtcacaaaaacaggcagatatcaccaagatgttggtcacactggattctaaaaggcccagttcagcatgtagagttagactctgtttgaaacctgtgaacccacctgagttattacttttcccttgaactctggggtctggtagacggcatttgtgaccctttacccatacgtgtagtgcacatttaggtagttgaaggggagctattgttgtggtctaggaaaaatggtcagcagacagctttatttctaacattaagactttatagattgattctcttgggcacagtacagccaaggggtaagagattggaacaggaaaataccatcgcatttgccattgagcaccaacgattgaagaccgatcctgtggagaatatatgctgtcatcctgagacatgaatgaagtcttatgaatttgatggaagccaggtggcagaagtagaggcaggaggctggccttccttacggtccgtgaacaagatgaaggtgtctttttggctagagattctcagaaaggaggagcatactgcattgggggtgggggatataagacccaaaaggctgagagctctagacaccctgccactgacacacctcggggatacagccaccttggaaaatctgcttagtgttggtgaggtcgctctacatggagtatttgccattgagaggtgttcagcatttctctgtcacattggcgtatggagagtagcaggcagcaacgagtgaaaggcttcgttaaatgtattttataagacttttcatcttttcgtttaacaaataataatagaccatctaccctgtggcaggtgccatgctctgtgtggaggttacagagtcaggttacatttagcttctagtcttttatgggaggcagacattcagctatttgtttgtttgtttgttttttcttttttttttgagatggagtcttgctctgtcagccaggctagagtgcagtggcatgatcttagctcactgcaacctccgcctcccgggttcaagcaattctcctgcctcagcctcccgagtagctgggattacaggcgcccgcccccacgcccggctaatttttgtatttttagtagaggcggggtttcaccatcttcgccaggctggtctagaactcctgaccttgtgatccacctgtctcggcctcccaaagtgctgggattacaggtgtgagccaccgtgcccgggccagacattcaactattattaccaggtaagtactatcctgcagacttgttcaagggatgagtttgaacttcccaggagagtagggaggaaggggatcacaggcagaaagaacagcatggaaac

SEQ ID NO: 103491 - DNA, 1917 bp, Homo sapiens
aggccggggcgaggccttttccggcgcttctttcccgcggagccgcgggcgggcggcgcaggccctgggggagagcgcgccgcggccggttgcagccccccccgcgccgccgcgttcggcgcccggcccggccagtctgctcctgccccgccgccgcgccggagcccgggcgcccgaagctgggggcgcggccgcgctcgtctcgccgggctgttcgcgggcaggccctgccctgaagggacgaatcggcttggagcgcgggaggtggagtcggccccggcggtcgctccctggacccaacccgaggctgacccaggcccctgcccatgcggggcgcccctggctcggaagagtcccccgggccgggagcagctccaggcagcggccccggaggaagaggaagaagggacagtgctcagcttgggggacccggaccctcgccgcggcatttggagccgggggcagtcccgaactctgtgcttggcaccgccgctccgagtagggcagcgcctgccgggaccctgacccggaccccctgcgcctcgtaggcggcggcgccgccgcgccaccctgttcttccgtgtctccctctgcctggcggcagtcacggccaaggtaagagccccggagcgcgagagtcgccgcgggggcgccgtggtgtgtagcgccggacaagttctccgaacctgtggctggtaccccctgtactcgggatgccggcggggaggccgggcacaccctctgctgccccggccgggagccctggagaggctggaggtggaagcccccagtctccgaagtccccaggaccccctcagggcctgctcggcttctgggcacacaggctgctggcagggagcgagccaggaggagtttctggttaacaccacgagggcatgtgaccgatacccgcacccccggccctcttgttagcggtgagcacctgtggttcgcggagcctgccgtgtttggagagggccctgttgggcggtacgcaactacctttcgtggtgtgatgctgtgaataacttttcttgttccttcttgcagacagtcctgcgcaatttgggggcgagcagccacagcttgcgagtccctctttaggacagagtggttggttggcattgctatctgtaggggggaagcccagccagcatgtccttcctgttagtcaaagctgcttgtgaggagtgatcagtgtatagctatccagacattcttgtaaatgtcactgcttttgaagttttggagtgaggactccaaagtttgtgtatcctcaagttattttgttcattgccttatcctcttttaaatgttcctcttaaggaacctcagttgtacaagcctgtccttgcctgtttgaaatttattaaacctgtgagcttcccccagaacaatctgattttaaatgggtcacttcggagggaacagattgtctcttgcacactgaatccatcccttgggtgaccctgtttaatggggttggactctttttttttttttttttcgtctctgtgctgatgtgcctcggttgagcaggtttctgctgaattcagaatccgtgaattttgtcactcagtccattaaaatgatctcctgagggagcaaaatagcagcttacatttttcgtgaatgtcactggaagttttacagggtcttatgtaagtgcccagagagagagagagaggagggagtggggggagatcaggctcctgcttccttcaaggggagaaacggagggggtggcaggtgggggcgtccgcctccctgacatgcagatgcctttcttctctgacacaggtgtggagacctgaagtgcttatcattccgtggaggcagtcacctcgggttaatttttcttctcacttctcctgtcttcccacctcaggagtcagctttgatagacttaagataagg

SEQ ID NO: 103492 - DNA, 1118 bp, Homo sapiens
tcaagttacctcaaaaaaagtctgaaacctgttttttaactgtaatttgaagtttcaaaatgacaaagtgctatatctgaggactttttcctcctgattactttggtcatcccaaaggcctatgcctgaacataacttgtatgcttatctaccagggaaagagcaactctgccccctcctttttcatatcctgaagaaaagtccccgaagagctatttaacaatttgtgcatttcataagtatacatttttatggtaccagttttttacttgtatcaacagtatgaaatagtgaacttttacttatgttgtcatatcttagcacactgagacaaacaaaattattcttgcctcttggagttgacaacattgaattttataaactcccaaattattgaattgagactgggttttaacacctgtttcacatttgccaacatttaatgtaattatgacctcccttttctaatgtgaaaatcaaacctaatattcattttcattaatcctcacaatctactctctacccctgaactctgaattttcacagattgtattcaagacctggaaggaatatcaggggttcatctgatcttatataaatgttgcctgaactctgcctttctttcacactgttgcttgagatttatctggtatctttccaaaactaaaccctgagctgcaataatatcctgattttaaagaacgtagaaattcagggcccatcggtctgcccaagctgtggctgatacagtccgttgtgtttaattttagtttttcaagctcttggctgccccagttcttcagtgaattggacgtgtcttcaggcctcattccttcttttttcttcaggttatttaatccagtaatttataaaatgctcttcagtgtttttaagaaaatttaaacagtggtagacctaatatatgtaatgccaacaccacattttcttggttggcctgtgcctctgagaagcagttcctaattttctattccctctcacaactttttaatccactagttttttaaagcagccagtaacgagaccacgatacagtcatctttctttctttctgtcttcagaggtacttatttctattctgttaggttgcccaactctgt

SEQ ID NO: 103493 - DNA, 1331 bp, Homo sapiens
catcatattgacagtacttctcttgattatttctagatatttcgtctttggaatcgtcacagaagaaaaagaaaaagtccagcccacagtctactgatacagctatggacctgttgaaagctatcacttccccactggcagcaggctccaagccctccaaaaagactggggagaaatcctctggctcttcaagccattcggagagtaaaaaggagcaccacaggaagaaagtcagtggaagcagtggggaactacccctagaggatggtggctcccacaaatcgaaaaaaatgaaacctctctatgtgaacacagagacactgacccttcgggagcctgatggtttaaaaatgaaacttattctgtcaccaaaggagaagggaagcagctctgttgatgaggagtcttttcaatatccctcccaacaagcgactgtgaaaaaatcctcaaagaaatcagctcgggatgagcagggtgctttactcctaggacatgagttacagagctttctgaaaacagcccggaaaaagcacaagtcatcctcagacgcacattcatctcctggccctgaaggctgtgggtctgacgcctcccagttcgcagagtcccacagtgctaaccttgatctttcagggcttgaacctattctggtagaatcagactcatcctctggtggggaactagaggctggggagttagtgatagatgattcttaccgagaaatcaagaagaaaaagaagtcaaagaagagcaaaaagaagaaagacaaggagaagcataaagagaagcgacactccaagtccaagagaagtttaggactttctgccgtgccagtgggagaggtcacagtgacatctggccctcctcccagcatcccatacgctggagcagcagcacctcccctgccacttcctggcctccacacagatgggcatagtgaaaaaaaaaagaaaaaagaagagaaggacaaagagagagagagaggagaaaaggtaaagcatcttttaagtgtggtgggggtaagagattaagcaggttcttcctgggtagtcagtggacttttaagttaagcagttgaggtaaaccactgggaattaagcatgtttgggggatatgttggaatgatataaagtataaaatattaccagtagcccagtctgtctgatatagaagcaatctttttttttttttttgagatggagtctcgctctgtcgcccaggctggagtgcagtggtgcagtctgggctcactgcaacctcctcctcccaggttcaagcctcaccctcccaagtagctgaaattacaggcacccgccaccacacccgactaa

SEQ ID NO: 103494 - DNA, 2908 bp, Homo sapiens
tccctggatttttagagtcagatccattgggcgtcagagatgccctgccttaatgagcactgtcagacacacataaggctttgtgacacacagtgcttccttcatctgttggcccatggaacatgatgctatattatcaaatgcatgctgtactttcactgaaactagaaaacaagccatttaccaaaacagtacttaagaaagcagcattctagcccttgaggtactacaattcctgtgtttcctgtttgctattctgcacccaaagacagtacaggaattgtttccctcttttttacgaggattaatgggagaagtcagcagaaaagttcctagcataacaaacagcaggatgccgtcttcattctcacctgtttttctaactccatttgatttttcttatctctctccttgaacaaagaaacatctctcaggaaaccaaggtacagtactcttcagttgaacatttttctttgttttgcagtcaaacacattagacaacattgcttacatcatgccgggactgtgacagcaaagaatcctgggacagaaaccttatcctacaccattgctggtttgtgtatatatgactgttgcagattccttcagtggcctctggctgtaggttttaaatttttatatctatacatacatatatacatatatatataatgtacaatatatacatagactgtaactactttgcttttaataattttatgaaatggcaaaggtttagccaagaggaaattttggcatgaatacaggcttgggattcttttttctcctgtggtggataaatctgccttaaaaatcaatgtaacttgggggctgggggcttgttctgggtgccaagcgcatctctttatggacagctaaaatgtgattattttccaagctcagttggacctccagacccatcactgaccatttgccttacctgtcttagtctgaaatgtaataggaaagataacgggaagatgccagttgactgaaaattcaaagcctttcaatttgaagtgacctaggtgggaggtgataaaatttgttccctttatagttatggaagtggcttaggtgaattgagtagagggttcattccaattcctactgtataggtgtctgtgtctcaaaatttattgtaatcattggtaccattggtggcctcaacagaggccaaggagttctgtgagccctggcagcaaaaaacaccttggggggtgaagctgtcaatgccaccagttggacctccatacattctgagctaacccagaatctttagtcggcagaattaagtgctggtgtctttcactggcagcatgaagttagccaccaagtcctcacaagccgtgctgcttagttgctcggtggttatggataaactttgcccagcatgatttttgggttcatcttatcagttcccctggtgggcagatacacagtgttctgcattccacatgtaagtgaattgcaaaaacaaaacaaaactcactctcttgtaggtttatttatgtgtgtgtgaatgtgtattttaattatgtgtatttaactctttaaaatctcttagattttaatttatcctgtaaatttctgtatatataatttaataacagaagcctccaccagcaacagcatgtggaagatacagatttgtcatttctcccttccgccctcccttctttccttccttccttccctgtttccttccctctttccttccttcctcctggtctgttccaaaaactctgaatcatctacattttaaggtattttacctcaaaaatgaatcattgtgttaggattctaattctttataaagaacttcatgggcttcaataatgtctagaaagtaaaataaagaggaatgttaccatccccagctgcccttatttccagagaaccagacgtttgtttcccagttggaaagaagacagttgagcacttcaggatggtttttaaatttggtatgagattctctgccaacaccaagctctgagttaactgtgctttcttctcctggccctgacagagcactacagcatcaaagtaaatctttggggacagtgtagcccatctgcatcctatttaatttcttcccttctccccaccagtgttgtcacagggctatgttgcttaaaggtagtctggctgctgaatccctttctcagctcagagcagttttaagatttaattgggaatacagagaaacaggattgtttgagaaccaaaatcaagaggaacagaaatcttaacttgatttcatgtgttagaacattgtaccatgcctcttctgtatctgtggaagtttcctgtttgacacagggtatctaggaggggcggggaagacatggatagtataggaagacattaatcctagcattgtcatttatatacattaatgaaatcctgatgaggacctgctttttgtttgttttcctttgaaacccagccctattgtatttgtatttaaaatttgtacacatttgtataataatctgtaccttgtggtatttggtactattagaggaaaaactttggattcagaccttcttgcagtttttatatcattgttttattttgttttttaaataaattctagtggtttgatccaaatcccattacagttgtataaagaaataaaattttgtacttatattattaaaaatcacatttttaatatttgtagtccagtctcagctgtcttttccctaatcatgatcatcatagttgctatgaaattataaaacctgtttttcactctattctaccataattttcttaagaaaaaaatcaacccacaatggagattaaatttctaatcttagccattttcttaatatactccttactctgcttctattaacttttacattgtagaggttctcattttctcttttgcaaattgcaa

SEQ ID NO: 103495 - DNA, 1158 bp, Homo sapiens
cgagaccagcctgggcaacatggcgagaccccgtctctacaaaaaaaaaaaaaaaaaaaaatacagaaattagccgggcgtggtggtgcgtgcctgtgcacccagccactcggtaggcagagctgggaggatttattggatctgggaggtcagggctgcagtgagccctgatggcgccactgtactccagcctggacgacgcagggagagcccatctcttgaaacacatacacatacacacacacacacgcacacatatatataaaaatatacacatacaaacatacatatacatacacatacatatatattatatgtatttacacacacacgttgttcctgagatcaccaagtgaaggttaggaatccctggaaatcgcttggcagtagatctcataggtgctcattcttgggcaccaacaccatgagaaccgacatgccttcacccaaacagccacacttctccggaggatggtttgggtgttccgcattcttgcatgaagaaaccatcgcattaccgtgaaattactcttcatcttttttgatgacgacttttcgtcttaagtccagactgggaaaactttaagatgagacatattttccattcttagtgtcttgcgaaacctcacgaaagcttgtcgacccggctctgtgttgtaatcgccaccgtggctgtcggtggctcttccgaggttttgtaatcaatgctctccaagggggaggtggcagtccaggatttacacaccaggaagctcctgaaccagggagaggaactgccctctcaaaggacccctgccctccccggacacacacccaccccacagtgagtcatggttttttggagctgaaaagagaaggcagctctcctctcatctatatttctctgactacagaaaccactgcttttatcacatgccaagtttaagacttactacttaaaaataaacaagtaaataaaagacctggcttcaaagtcagccacatactcttaaggctttctggaaaagctcacctgggttctggatttcagctaatcaaagcaaacttctcttcttaccttgaagcgttgcctttcttgggcaagaaatacttctgtgcaaagagaatgctactaaatcataataccttaaagcacaaatggaattttgcaggtaaaag

SEQ ID NO: 103496 - DNA, 1044 bp, Homo sapiens
ggccaggcacggtggctcacgcctgtaatcccagcacgttgggaggccgaggcgggtggatcacgaggtcaagaaattgagaccatcctggccaacatggtgaaaccctgtctctactaaaaatacaaaaattagctggacgtggtggcacacgcctgtagtcccagcaacttgggaggctgaggcaggaaaattacttgaacctgggaggcgaaggttgcagtgagccaagatcacgccgctgcactctagcctggtgacagagtgagactcaatctcaaaaaaaaaaaaaaaactgatgggtgctggggaggactgatagaactgaatgtgcagggctccaagggcatggtgtgtggttacaggaataagcagttcggtttcagtataaatagctatccccagagccttgcaaagatggaactggctgccttgttcagtagtgagctccccaccactggagctgtgaaggcagaagccggggtggggagggcgactataaagaggattcctgtgttggttagcagactagaccagggtcagtgagctttttctataaagggccagatagtaaatacttgtggcttcgtgaaccagatggtctctgctgcaactacccagttctgccattatagcacaaaagcagctacataggccataggtaaatgaatgagaatgactgtgcataaataaaaatatttatgggcaatgaaatttgaatttcacgtaattttcacatatcatgaaatattattcttcttcagcttttttttttcccaactatttaaaaatataaagaccatctgtagctcgagtaccatacaaaacagactgaatttggcatatgggttcatagtttgctgacttctgaatcggagcagctggccagaggcagaatgatggagcacactgttcctcaaagtggggtaccagagcacccacactggggatgcttgagggtgcttatccccacagtgtgcccatgtgagccctaatatcttgaagcttctgtttcctgatccgtaagtacaggacccacattag

SEQ ID NO: 103497 - DNA, 1060 bp, Homo sapiens
ctcctctgtcctccggcagactgggtttagcaggcactgtggcttcttttgggcaccttaaagcagggaccatgcccaccgagtccaccatggtatcccagtgcctggaaccggcttggcttacaaatagccgtgtagcaagcgaagagtcacccaccctccccgagccggggcacagccgtgaggagagagcctcccttgcaggacagcgtgacatcacgtggaataacaagttctacatgcctactctggcacacactcctgacagataatagacagccggcagcactgtgctcaagtgcctggcccatcagccagcaggtgtgccaaggccggcagggtggctgcagcaggcggatgagtactttgcatgtgacacttgcaggggagggaaccttgggtagtgccctgtgtcagaacagggtctcacccttaaaaggcggagcaaagcctgtcttatcacacagtcctccatgtagtcacaatacataccagccagagtgatgtgtgtaatggaacgttacctgcaagaaacagggcacaaaatttcctgtgtgcacgtggttgacgcgtgaagatagcatctaggaaggcgcagagaacagaaaacaggccatgcggcacctccctttcctaaagaccgtttacaaaggtgctggcattgcgagttcctgcgttcatcattcatgtaataccaattagtgcctcccacactacagttcacaaaaggctgccaagcccggtgcttgctaccatgcagacctgcagccagtggtcccggccatggccctgacaggcttccagaactctgcagccgactcccggcctggaaatcttaccctaggaactgccacaaagtgaaaatttcgtggaactgaatagaggtggtggtggttgtattcagtattacaggtgtaccaaatgccactgaattatacatggtaaaatggttagttttattttatgtgactttcgcctcaactttttttaaaaagaaccaccaccacttgctgagtgtttattttgggcccgtaccgtgctgataccttgccgtgctgat

SEQ ID NO: 103498 - DNA, 1726 bp, Homo sapiens
cctctgagctcctcatttgagagctggaaaggtctgtaggcaacgcactgtcctgtctacactgcaggcggatgcagaatggcaagaggccatttggaaaggttctccccaatcccccagcatgggaacagacgcttacatcactccagaaccactggcagggagagcctgggccaaaggacctgtgggtgacattgaagctcagtaaacccaggcctccgcgggggcagggaggccggctgactgagttgggtgctgctcggcactttggtgctctggcaaatgaatgtaaaataaataccagtggctgagaacagtcttgcccacaccactgaaccagcccagatctcagggcggccagacacacgtgggcctcctagccgtcagcatgggtttggctggggaagatataaatgctgtcccaccctcctccacaagcagcatttatatccaggtgaattggcttaagcaaaaagcaaaggcaattcctgcagtgggaagtggagagtggggagggaagttcagtgccttttccctgggccacaggctcaccagtcgattgacatctcagatgctccttgatttcctcttggagagccccttctctctagaccatgtttagctcagagacagcattgggattctgcgtgcactgacgccagtcagggaaggaagtccagcccacacaccatacctctgcccaccctaggccgtgccctccagtaaacaagtcccccagtcctggcattgtcccagtcctccacattcaagggtctcactccaggaagtcccatctcctctcccgggcctcctctctgggacacaggaggagccacgagggtgggggttctgagcacctcctctcctctgaccaaggtgctcgacggcacctctcggccctccaggtcttagaaacctgtgtcaagaactgcgggcaccgcttccacgtgctggtggccagccaggacttcgtggagagtgtgctggtgaggaccatcctgcccaagaacaacccacccaccatcgtgcatgacaaagtgctcaacctcatccaggtgagtgccaggacagggcagggcacggccaggaagagctgtcagtgcaggagcttcctgcccagtggagagtcgaggccatcgtgtttgtcccaggctccgcttctcatttcggggcgtctcggttgtcggctggtgggatgttctgtggggagggaggcttgccaactgcgtgctttgctgtggagtgggcagggcagatgtagttaaaaaaaaaaaaaaagcagggaaagaatgtctgttctctgtctgagtgccaggtgggcaggctcacaggtgagctgtggttaccggctgtgtccccttgtcccctctcagtcctgggctgacgcgttccgcagctcgcccgatctgacaggtgtggtcaccatctatgaggacctgcggaggaaaggcctggagttccccatgactgacctggacatgctgtcacccatccacacaccccagagggtgagagaactgccgtaccgggaaccaagggaagggaggcaggactcatccccagagacatcaccaggctggcccctgacttcctgggctcttgatgttcccaggagccctcactgatcctgttttcctcccactagaccgtgttcaactcagagacacaatcaggacaggattctgtgggcactgactccagccagcaagaggactctggccagcat

SEQ ID NO: 103499 - DNA, 1022 bp, Homo sapiens
cccagcacttcgggaggctgaggcgggtggatcacctgaggtcaggagttcaagaccagcctggccaacatggtgaaaccccgtatctactaaaaatacaaaaattagctgggcgtggtggcacatgcctgtaatcccagctactcgggaggctaaagcaggagaatcgcttgaacccagatggtggaagttgcagggagcagagattgtgctactgcactccagcctaggtgacagagcaagactccatctcaaaaaaaaaagaaagaaactggagaccagtggcccgggcttcacattccagctctaccagttaccagctatgtgtccttaagcaaatgactggcctttctgaccctcagtctctttatctgtacattggggcttatcctagcacctatacttgtttataatagaagtgtgagaggatatatttagggagctttacatggagttagagcccgttcaatagtattcctctctgcctctctagagacttttaatctgcaggagtgtgggcagagaggaataaaagagcggaccctggccaggcgcagtggctcacgcctgtaatcccagcactttgggaggccgaggcgggcggatcacgaggtcaggagatcgagaccatcccggctaaaacggtgaaaccccgtctctactaaaaatacaaaaaattagccgggcgtggtggcgggcgcctgtagtcccagctacttgggaggctgaggcaggagaatggcgtgaacccaggaggcggagcttgcagtgagccgagatcccgccactgcactccaacctgggcgacagagcgagactccgtctcaaaaaaaaaaaaaagagcggaccctaaagcagcggggagaaatgcgagggtgctctttgaattccgtttagttccttgactgtgtgttgagtgacagccacttgtccagcaccgagcacattttgtgggtgacccccacacgctttggcaagacctccaagcaccattctctcatgcatgtcaacgtgtatctgga

SEQ ID NO: 103500 - DNA, 1051 bp, Homo sapiens
tttgtatttttagtagagacggggtttcaccatgtttgccaggctggtctcgaactcctgacctcaggtgatccacctgccttggcctcccaaagcgctgggattacaggcgtgagccaccgtgcccagccacaaggctgcatcttaaagcgattgagaacgtggcctgaatgaggatgggagtctcttgaaggcctgcccacaggtgggaggctcagcagttgggaaggaccccacccccagccagctttgtgttcacctttcccatttcctcctcagcatgccccaggatttgtcagaggccctgaaggaggccaccaaggaggtgcacacccaggcagagaatgctgagttcatgaggaactttcagaagggccaggtgacccgagacggcttcaaggtatgtggcttggtgggactagccctggtggagggtgtggcaggtgtgggtggacccaaggctcagaccagtggtttaagtggggatgctgagggaccagatgggcatgtccaatagaatcatcttaaaaatgatgacactgaggctcagagagggaaggtgagttacccaaggtcacacagcaagttcagcctgctctgtaatgttgtggaggggctggggcagcagtgccgttgactgagcaccggttccatgttgggcattttgtacacgtggtttctaatctgtgcttcaaccctgacgagaaagatgaggactggaaggctcagagaggttcagtgactaacagaaggtcacacagccagtaagtggaaaaggctgaaatcaaccaagaccgatttcagccttgtactccttgtatttcagagcttgtactcctgatctaactcgaatttgcctctgaagataaggaataatataggttggagtcttaacagaacccttttctaacagtgagactgagggtgcctcatctaatctccctaagccacgttttccccatctgtaaaagagtatttcaacagcagggttttcttaagcacccactatatgccaggtactgattttgctgtttcccagcactgttgtgaa

SEQ ID NO: 103501 - DNA, 1059 bp, Homo sapiens
gagaggaagatttacagctcagacctaattgctggcaaagtttaaggagaggacagggagcaggcagaagtctgaaaaccacgcctgggcccaagaatgttttcacaatgtggcctggctgcacagggaagaacagacagcttgaagaagtagtgagctgcccgtctttgaaggtattcaagcagtggctagagggacacctgtctgtggtcttgcagaatcctggcgttgggcagtgactgtaccacagaccctgaggccgctctgctttgctttcctatgacatcagacaccctgatgcacgcccacctgttaatgaccttgccccattttctctttcagattctgcccccgtggagactcccagagggaagcccccactcaacacccgctcccaggctccgcttctccgatgggtccttacactcagctttctggtggcgacagttgctgtagggctttatgccatgtgaatgcaggcatgctggctcccagggccatgaactttgtccggtggaaggccttctttctagagagggaattctcttggctggcttccttaccgtgggcactgaaggctttcagggcctccagccctctcactgtgtccctctctctggaaaggaggaaggagcctatggcatcttccccaacgaaaagcacatccaggcaatggcctaaacttcagagggggcgaagggatcagccctgcccttcagcatcctcagttcctgcagcagagcctggaagacaccctaatgtggcagctgtctcaaacctccaaaagccctgagtttcaagtatccttgttgacacggccatgaccactttccccgtgggccatggcaatttttacacaaacctgaaaagatgttgtgtcttgtgtttttgtcttatttttgttggagccactctgttcctggctcagcctcaaatgcagtatttttgttgtgttctgttgtttttatagcagggttggggtggtttttgagccatgcgtgggtggggagggaggtgtttaacggcactgtggccttggtctaacttttgtgtgaaata

SEQ ID NO: 103502 - DNA, 1047 bp, Homo sapiens
ggtgtgggcagattcaggggtgcaggcacacctcagccagtgttggtttcctcttctttgcacccttcctgccccaccctgctatgtgcccactccagggatgaactcaagcggcattacaacctgggggagtactggattgaggtggagatggaggatctggccagctttgatgaggacctggccgactacttgtacaagcagccagccgagcacctgcagctggtgagtgggaccccatccctgagcttcccagggctgctctgccccagttactaatagcctgtgcccttccctttctccagctggaggaagctgccaaggaggtagctgatgaggtgacccggccccggccttctggggaggaggtgctccaggacatccaggtcatgctcaagtcggacgccagcccttccagcattcgtagcctgaaggtgggtcggagggcagtggctgctgcatggtgcagagggctttggatgcagccagacctgagtgctagctgtgtggccttgagtgaggcacttgacctttctgaacctgtctcctcctggagacaaaaggatcgtttgttgttttttgctttttgttatgaaaaattacacacccaaaagcagagagtagtataatgaatcccataaagcttcacccagatttaataattaacattttgtgttgtttcctattttgtcctttttcttttttgctaaagaattttaaagtaaattcatgcacagtggctcatgcctctaatcttagcactttgggaggccgagggaggaagattgcttgataccgggagtttgagaccctggctctccaaaaaacaaaacaaaaaaaaaacaaaaaaaacaaagctaggtatgctggcatatgcctatagtccaggctacttggaaggctgaagtgggaggatcaaggggcctaggaatttgaggttacagtgagctctgattgtgcctctcagcactttagcctgggtgacagagcaagaccctgtctctaaaaataaaaaataaattacagacatgacactttatcccgaaa

SEQ ID NO: 103503 - DNA, 1699 bp, Homo sapiens
tattgtccggtgtgggaatagtcattaagatggggaaactgaggctcaaagagaagtgacccagacagaagaccacacagcaggttttgacagaacttgaactagaatgtgggcccctgcctcccaggtttgttctgtgttgtactctacaggtccaaggatgtcgccatcagagctggggtcaggtctctctcctggcacctgccactttgtagtgaaatgtgcttagtgtatctcttgccctgccacctccccccccaattgtgctgcgaggtctttaaaagcaggagctgtgcctgaggctcctctgaaccccagggtccagatagcctggcactgggtggatgctctggaagcattttttgagcggaacagaagagctgtggccctccctgcagctctgtgcccacctcctccaggctcctgcccaggatatttactggcatatctcagatgcgtcctggctccccttaaccaacaagcttcccgatggctctattacagtcggacatgatgtcacacctggtgaagatccctggcatcatcatcgcggcctctgcggtccgtgccaaggccacccgcatctctatccagtgccgcagctgccgcaacaccctcaccaacattgccatgcgccctggcctcgagggctatgccctgcccaggaagtgcaacacgtgagtctgtggcccagagggactgtgggaggtgacctgagtgaagatcagaaaggatgagaacaagtagcaagcactgcctgcagctgcttctagagatccactgggatgggctgggcaggggtgtgcccttaggattggcacagatctgatgccctgtggctctgagacaccatgaacagggtccctctacattggtgacttctgtctcaccaggatacccagacagcgttgtagggaacccagggttgggagggaaaagcagtccagggtaatgagtctacttggaatcttctgaagcaaactatggtttgctcactaggccagatctagcctgctgaccctatggcccaggaacacgttcgttcatttaagtattgcccacagctggtttcgcactacaaaggcagggtatgtggcctcttggctggcagaacctggaatgcacatcctccggccctttctagaaaatgtttgctgcccccagtctgaaggaaccccaccctcttcactggctgctctttcttggctccttcgctggtgcctcctcagcttcccatccacctgtggcacagctgcctcattccatgctgttgacatctctcacttggagaggcacgctacctcctccctgatcccccgcgtccaccctccaccccctcagtctgttttccacccagcagccaggtgtcccttgacactcaggtggtccagtcatttacttcttagtcaagtcctgcacagcccaccacgatctgctcctggcttccccaggcctcgctgcccctcctctctccaggcccggcctcactgcctccttcctgtttctggaatacactgactacccccagtctcactgcctttgaccttgctgtttcctctactgggagtgctgttcctcaagctaccatagtctgtgtcctcacttcttcaggcttctcttcacatgtccccttaccaggggcatcttgcccaacccttcatcttcagtttggtgtgcacgtacctcgtctctcccacac

SEQ ID NO: 103504 - DNA, 1038 bp, Homo sapiens
attctccaggtagctttggtgactcttttcccttaccttgtacagagatcaggctgggcgccccaaatgcccattggacccgtacttcatcatgcccgacaaatgcaaatgcgtggacttccagaccctgaagctgcaggagctgcctgatgcagtcccccacggggagatgcccagacacatgcagctctactgcgacaggtgaggcagacgggctgggaggtgggcatctacgacggtggatgtcccagctgtggccctaacccgagtgttgggagtgggtcatctggagcagggtgagtagggtggagaaggtggccagttgcagagcacctgctctgtgcctaatgcttccataagttcctctcatctcgtctttccataatctgcaggggcatgtcagccccattttgcagatgaggaaatgtaacttggagagattaaatgacttcctgtgtggaggagagccgggctttcagcctatgtgcattgctttccaaagtctgtgttcttcttaggataagaggcccaggatgcacagctagataaccaatagctggcaaagcctcttcccagcctgacaccccacctcctaccccaggctttctttttttttttgagacggagtctggctctgtagcccaggctggagtgcagtggcgcgatctcggctcactgcaagctccacctcctgggttaatgccattctccggcctcagcctcccgagtagctgggactacaggcgccctccaccatgcccagctaattttttgtattttttagtagagatgaggtttcaccttgttagccaggatggtctcgatctcctgacctcatgatccgcccgccttggcctcccagagtgcgtggattacaggcgtgagctactgcgcccagcgtaccccaggctttctgttaagatcctgctgaacagccacggtggctcatgcctgtaatcccagcacttggagcggctgagacaggaggattgcttgaggccaggagttcaagaccagcctgggcaacatactgagacc

SEQ ID NO: 103505 - DNA, 2722 bp, Homo sapiens
ttgaaaatgcatgtggtgtttagcacaattccttcatgcagattacgtaatcaggatgtatgattttccaagcagttcatgaatcctgaaaacttacgaagtgggtatgggaagaggggagttggaggctcatggagtgacggtgatggtcttttctggagctgtgatgcctgatggtataaagcacttctatgtctgctgcctcacctgactccacaacatgagaggcaggccacttcgtcatccccctaggctcagaggtgcaatgacttcgttgaggtcacacagcgactaagtgtccctccacaccaccctgtctctgactgggggacttggagacttccctgtttcaacatctcattttgaaaacaggaaatgaaaacccagaggcaaaatgagctcacagagccatgaagaggcaaaaagggcgagtggcccctcaaggaggctggggggcgtgaagaggaagtcttgccctgagaggctaaagggcaccacacagtgagctgacagcagacacgtggagatggggcttttggagggctctgtgggctggcactaagcctcctaaaccagcgtacaaatgagttagcgagttcagcgagagtcaggccaccacctgcctttctgtttggctgtcactgtgggcaacaccatcctccaagcagctgagcatgggctgagtgacgtggggagagaggccgttctctgggctccgtggggctggagccagctcagcatgtggtgcctgtggcaaaaatgctgcagtggaccctgcgtgtcctgggcatgggtggaatcagagacttgctgtccaagtcagaatctcagcttttctcctttctcctctaccctcctctcaggtacctgtgtgacaaggtcgtccctgggaacagggttaccatcatgggcatctactccatcaagaagtttggcctgactaccagcaggggccgtgacagggtgggcgtgggcatccgaagctcctacatccgtgtcctgggcatccaggtggacacagatggctctggtgagttggctttggggtcctggcttagccctgctaaaaggctgtgcttgcatacttctggtaacaggcagctcgttacttcatgaggtagcccaggatgtccttgtgttgctcatatcattagaacgttcatttttatattaagtgatccctggaacttccacacattggtcctagctgtggctcctgggctgagggtgtttgcctaagtgcaggattaaggcagaaggactgaggtcaaatcactggggaattactgaaagccaagtcttcacttctgtgacaggaaatacaagagaagtgaaacgcagggttccaggcaggcagccgcctagtgtctagttggagaaataagaaaactgtgagaccgctggggacatgtgggtaaagtggtggctgttgtgggtcacgcagttccaaggaggtgctaaaggaggtctgagaaggaggaggtcggggctgggccttggggaaggttttctgggaggaggttaatctgagctgggctttgaagagtggtggatgtggaagaacttccaggcgggaggggatggcaggagcaggtgaaaaccccggcctgggcaaggtactgagtggctggagggccgagtgggagtctaggggatgaggggccaggtggtgtaagaggccttgagtgccgagatggggagctcctgcttacacctgagggcagcaggggccactgagggttttcaggtttgtttcagccctctggctgcagtgaattgattcagaggggtggcttccccagggctcagtccatggcccaccccacatttacacaaactacctagattattacaactttaaaaccactgacaggtaagtagctctcacatttccatttctagcctgggcttctccccacgttccagactttaataaccaactgctgatttgacatgttcacttacatatctgaaaggcatctcgaactttacatggctgaagctaagctcccctttccccaccctcagactggctcctctcagtcttcccatcttcaccctttcagttgctcagacaaaaacccccaagtcacccttggtgctcttttctctcatcccccacatctaatcactcaggaactctggccagctccacctttaaaacgtgtccaggatctgaccacttctcatcctccccacctgctctgagcccttgtcagccctccctggatcaccgttgatcctccccagtgttcgtctccaccttgccctaccttctctgttctgcagcagccagtgagcgatgctgtcatgaccaagacactatatcactcctcggctgaaaggggagaccttccagtggtttccaaggtcctatgccatctggccctctgtttgctcagaacccttctccccacttcccctcaccctttggaccctggaacacaccaggcccattcctgagggcttgagagctgggatctctgtttactcagataggttgtgctgtcctggccctaagggccctaagggctctgccttctgggaggtccctgagctggtgccaggatgggcagtgggctggaagagctcccttgtactcactcatgcgcctgctttgcctaccaaggccgcagctttgctggggccgtgagcccccaggaggaggaggagttccgtcgcctggctgccctcccaaatgtctatgaggtcatctccaaga

SEQ ID NO: 103506 - DNA, 1048 bp, Homo sapiens
cgatgccctgaccctggcaagggggagactgggggcctggcaagtgcagtgggagagcactgagcttagggtcgtgtaggtaccaggacttaaatctcagcactgagcttggggtcagtagcagggatattattagcagctgccatttactgtgttcttcctatgcacagccattctttgttttttttttttgagacagtctcactctgttgcccaggctggagtgcagtggtgtgatctcggctcactgcaagctccgcctcttgggttcacaccattctcctgcctcagcctcccgagtagctgggactacaggcgcctgccaccatgcccagctaattttttttgtatttttagtagagacagggtttcaccgtgttagccaggatggtctcgatctcctgacctcgtgatccgcccgcctcggcctcccaaagtgctgggattacaggcgtgagccaccgcacccggccgcacaggcattcttctaagtgctttatgtgtctgaagcccagtcattcctcacagtaacctgttaacgcagctgttgtgcccattttatagatgagggaattgaggcatagagagttaaagggacttgctccccagcacatgcaggggagccaggagcctgctgtcatggtgcttgttctgccgcaccgtgcacagcccacaggcagctctctgtccttttctttcaagctgggaggaacgttgctcagatgctgggtgtacccgagcacagccataagagccatttcctttaaccctcctcttctgggaggcaagctctgtcctcattgctaggcaagacctaccatggtttgggaactacagagctgggtaggaacatgggtctcaggccacagccactaccttcttaccaactctgaggcccatgatagttgggggagtcaactgccagcccaccaatctggtgactggatgtcacatgcgatgccctcatggattctcaccttgtccatctacccttcgtcccccaggctccctgatggacttactcgccgaggagacatcaacctgctga

SEQ ID NO: 103507 - DNA, 3270 bp, Homo sapiens
aaagtagctgggtgcggttgtgtgcatacctgtagtcccagctacttgggaggctgaggtgggaggatcacttgagcccaggagtttgagaccagcttgggcaacatagcaagaccccgtttcaatttaaaaggaagaaggggaaagaaaaaaggaaaaacaggtgaagttacttctgtttaactcgctatatctaaaatctcatttcaacatgttgtttgatatgtagattattgagatactttacattcttaggagctctgagtctttgaaatcgtgcgtattttgcacgattaaggacatctcagttaggactttcccaatttcaggggctctatggcagtatgtggcgtgtaggtctatatagagacgacaagggactcacgatgggggcaggctttccctgggagtcaggagtcctcatcctagccctgaggctaactcctcttctctgggcctcagtttgctcatctgtgagttgggcctcacaagactgtgtcacagggctgtggtgaggcttaggtgagccatggatgtgatgccctcagcggggagaacatctgggcacaccgaggcccagggcagcatccccttccagagggagacgcactgagttggagccttgagtcctattctgtaccctgcagccagctttgatgtgtgaccttgggcaaatcacaacctcagtgggtctttttgtcttatgggggtcaaagcatggagttgttattgggccctgacaccaccccactgccccaggtatacacgtctgggaaaggcagcagcgcagctggactgacagcctcggtgatgagggacccttcgtcccggaatttcatcatggagggcggagccatggtcctggccgatggtggggtcgtctgtattgacgagtttgacaaggtgagtctgatgaggtgggtagtagccaaaaggtgggtggcaccagggtatgtgacttcctgtgctcagccagcagaaatcacctctgacttgggagacatgttttcaatccctgggccggtcactctagtaactgtgggaagctgcttaacctcttcaagcctcagttcccatatctgaagagtggggagaagaaaggcaagcccacacagttgttcccatgattagaggtgacctggttgctgccattggccttgcgtggagctggtattcaggagtgagggctgctgttagttttcctgtttctactgctccctgctccctcacttcagtaggtctgatgatatttctctcttccccacttagatgcgagaagatgaccgtgtggcaatccacgaagccatggagcagcagaccatctctatcgccaaggtgagtggccctccatggagagcccagcctgcagcagcccagcgtggcccaaccgtcctcaggctgccctgattgggaccaagttctctttgcccaggcctagaatctgtgtgtgtgtgtgtgtgtgtgtgtgtgtgtgtgtgtgtgtgtgtgtgtgtgtgtgtgtgtaaacgtgtatataagaaggcatctttgccatctcctcccccttttcgtcgtctgtcgcctgttaggctgggatcaccaccaccctgaactcccgctgctccgtcctggctgctgccaactcagtgttcggccgctgggatgagacgaagggggaggacaacattgacttcatgcccaccatcttgtcgcgcttcgacatgatcttcatcgtcaaggatgagcacaatgaggagagggatgtggtacgtccaggggcagggctggtggccatgggacctgcctccaggcaggcttgtgattgtgtgggaaggagaatggagaacaagggccttggctggcaaagtcctgactgtcaggctgtgaaattggggagcacgtgagagggcggttgttgtggactgcagaggattgaagcagggtctggagtcctgtggcctgctctgcctctgccgtgagtgataagctgtgtgatttgggctaaatcagtttctccctgggcctcagtcccttatatatgaaacagaggagttgacattgggttatgagtaatagaacctcagttctggttagtaaatttttcaaagaaaaaaacatagtggtttatagaattggtaagtccggcggcttaaggcccaggtagatctggattctcaaacaactgtctctgcctttctgttctgcttcccttggtggaatctttgtacttgggcagctgttcctcttgtggtggcaaagacaaaataagattttgtcctgttagcttgtagcttaacagcccccaggaaagaggaggccccgtcttttccagtacttctatcaaaagtcccaggatagactcctattggcttgggtagatcctatgtccatgcccaagttggggtggacaagatacatgccccaagtcggggtggacaagctgaacccacccctttatggaccagggcagaggagcaaggagcattaagttctctctaaaggagaatccagatgctcccatcagaacgagggcctggtgctgagcaaacaggctgagcacgcctgagatctcagcaccctttccggctccttgatgccagggccccatcagctctttctggctgttccacctcagtgctgggactcaggcttgggacggcctgtgggatgacccattatcccctctgctctccagatgctggccaagcatgtcatcactctgcacgtgagcgcactgacacagacacaggctgtggagggcgagattgacctggccaagctgaagaagtttattgcctactgccgagtgtgagtcctggacgcaggcccacgggggtgaggttgcccagcttccctgggtgggagagaacccagtcccctggtcctgctcctcctcatgaagaacagcccagatgttgctgttctgaggttctcagctctactgaatctgctctgctcccttctaaccttgcgtagctcactggctcttggcttcagttttcccacctccacaccaaggaggtgggatttagatggtcttgaagacctcctcgagtctgacatgcagggaggcagtgaagtgtagacatggtagacatgggctctgggtcatacctgccttcactctatgactttgggcaagttggttggcctctctgagccttgatttccccaggcctatcgatgtttgctaggatttttgtaaggattgcacaagatgatgagtaagtgcttggcatagccctgccctgggtaaatactcagtgagtcgcagctgcaatttgattgttc

SEQ ID NO: 103508 - DNA, 3922 bp, Homo sapiens
ttgttgtcccccagcccatatgagtgggcagctgtggtgtggtgggaaagtgcatgtctgtaagctggcagggggctgggggaaagggtaggtgccctaagagtccctcctggcctcacaccagcctctccccactgtcctgcaggaagtgtggcccccggctgtcagcagaggctgcagagaaactgaagaaccgctacatcatcatgcggagcggggcccgtcagcacgagagggacagtgaccgccgctccagcatccccatcactgtgcggtgagcaggcgggcagggctgggccatggcagatggggcttgctttacacagcagggtgtgcttggcaaccaggggcagtggtccaggcttttcacttggcacaggcccatagtagctctgggcaggaagagtccctttggagcataaactatggcctccttgatctcaatgatgatccatgtttcttgatttaaggccgggcaaacctagacccctcttgtctgaatttggcctggcttctcccattgtaggaagcccgaagggagggaaggacccaggcctgggagtcaagagtcttgggtcccagcctctagcccactgtgtgactgtagggaaattacattccttctctggccctcagtgcttttagctcctaactctgttcattcttgtgactttgtagacaatacagtgggtaagagttgggatttacctggtttgaatcctgtctccagcactgactggttggaaatggatttggctataagtaatggtaaatccagataaagtagcttaaagaaataggaagttcatttctcttttctgtagcactgtctggaggaagatggtatggggactggtgtgaggactcctcaagctcccccttactcttagtccgagatggccgctagaacttcagccatcacctccaggcagcaggacaggaaggaaagagagcttcccttttaaaggacacttcatgaagtcccacacaatgcttggacttacaacttactgccatagattggtcacacaaatacaacctggtacaaaagatgtctgggatgtgttttagtggatcgctgtgtgccagactaaaaactggggttccaagctaggtgcagtggcctacattgtgatcctagcactttgggaggctgaggcaggaggattacttgaggccaggagtttgagaccagcctgggcaacatagcaagactcccatttctacaaaaaataaaaaattagccaggcattgtggtgcatgcctgtagacccagctcctcaggtggctgaggtggaaggatcactggagcccaggagttcgaggctgcagtgagctatgatcatgccactacattccagcctggtccacagagcgagactttgtctcaaaaaaaaaaaaaaaaaaaaaaaattgcagttctatgactaagatcaaaagggagatggattatggggacacctagcagtctccaccacagtcttaccactttgggcaagcacctccctggtaacgggctggctggggaggaagggaatagcggaccgaggctaccctgagcacgctgttgcccccacaggcagctggaggccattgtgcgcatcgcggaagccctcagcaagatgaagctgcagcccttcgccacagaggcagatgtggaggaggccctgcggctcttccaagtgtccacgttggatgctgccttgtccggtaccctgtcaggtgagcagatgcaggggccatggtctcaattgatctgggttccctggctcggagctctgtgggcagggctctggcctgctgggggcctgcagtgtgtgtcttgcttctctgagtttgctgagcttctctgagtttctttttgccataagacccctctcctcctttctccccaccgctgtttcctccaagatgggaagaagcagcttctctccagacccttgaacacaatcctcttgacccaggtcattgatgataacccttctcactggctaggaacaacagttgatgctctgcttcctagagcttgtcagcattttcagtgcttccagagttatttcttgcattttgccttacagctgccccctggaagccaggtgagcagtcagtcctgcccatgttagaaatgagacagctgacactcgaaggggcctttccctggtgcccaagatcacagtcgcttggctggaatgcaagtctcctggcccctaggccagcgttttccacaccataagccatactgtctggtttcggtcagcctttcaacagactgtcccaggcaccgatcatgagccaggctacctacgctggggaaaatctgttccttcacccagcagatacttcattagtgttactgtttgccaggcactgttctaggtgctgggagtataagagcaatcaatcacagggtcccggccctcctgggttctcattctcgttctagttggggagagatagacagtagagaaacaaatgcaggtagtgtaggtagtgaaaaaggcagtgagggagatgatggcagggccaggtgtgttggaaaaggaggacgtgctctttcccatggagtgagtgggcatggcctctgcaaggaggtgatgccaagcagggagctgcatgaaggggacagtgtggctccttgggggaagagctgctcaggtggaggcagcgctaagtgtcagtttccccaggagggagcaggtttggtgcatttgaatggggaggcacttgggtgaggaatggggtgggtggggcctgttcctcctgtcccccttggtgaagactcagcctctaccctggagacacttgctgtcacatgagacattgcaggtggaggcctctgggatgctgcaggcacagagggcaggggtgatatggagtggtgataatttgagttgggtcttatgggctatgtaggagtttgcctcacagactcccctctcaatgacttcttgaccatgagcccaccatctccttagctgaaacaccaaggcctctgtggcagtaattggaagtcacgagcctcctggttgccgagggctcctcagggcacctcgtagatgtgtccagggcaggctggcttccctcctgggtcactgatgggccccttccaactctctctctaatctatctgctccagcaacaaaaggagtcctgctgtggcctccaagggcccgcaggacttggtccctagtgacactctggccatgtctctgctgcgctgggccccgggctgctttttgaatgagacaggtgtgttcctgcctctgtgactttgtgcttggcctggagtgtccccacatgtgccatatcctgtctcctcaatcaggcctgcaccaccctggcacactcggtgcccttttctgacttactcttcggggcctggctcaggctgttcttccttgggctagaggctgtctctgtccaagaactcccattgtcccagctccccggctgcctcacttctccatgcccacaggggtggagggcttcaccagccaggaggaccaggagatgctgagccgcatcgagaagcagctcaagcgccgctttgccattggctcccaggtgtctgagcacagcatcatcaaggacttcaccaagcaggtgagcctgccttggagtgggggtgtgagccggcacggggtgcaggtcttctgctggttcccacccactcagcactggcatcttactcagcagacaggccctgaacgggggtaggatggacaactgtccctttctcagaccttttctagccatcattccttccctagggacatcttcatcaggagcagggatgggggtattttttctgtcccacgaaggggaggggagagcagaggtggttggattctggtgaaaccccatacaagttccccgcagcccttcccgtctgtgcctttccccgttggcgggcgtttcatgg

SEQ ID NO: 103509 - DNA, 1491 bp, Homo sapiens
gacttaagtcccagctctacctcttaattgctgtgaccttgagcaagtggcttagcctccgtgtgcctcagtgtctggtacacagtgggcactcaggaagtgtgggccctttaggtcaaaggagcctgagtacaaagttccccgtgagcctggggatgtctgggctctgtcggagtcccctcgggcagcacgtgccgttagccagccatgtgctcccacagaaatacccggagcacgccatccacaaggtgctgcagctcatgctgcggcgcggcgagatccagcatcgcatgcagcgcaaggttctctaccgcctcaagtgagtcgcgccgcctcactggactcatggactcgcccacgcctcgcccctcctgccgctgcctgccattgacaatgttgctgggacctctgcctccccactgcagccctcgaacttcccaggcaccctcctttctgccccagaggaaggagctgtagtgtcctgctgcctctgggcgcccgcctctagcgcggttctgggaagtgtgcttttggcatccgttaataataaagccacggtgtgttcaggtatctgtgggtttgtgcactcggtgacctgtcacctccatcgtgccctcatggcagggtaagtgtgagggaacagggtctggaggcagactggccagggtttctgacttggatctgccactcagacttctgggtaagtcacgtgacttgagtgctccggtttcttcatctgtttagcggggctcataaagccactcccttgatgctgggaatccagtgagaccagggagtggggaagcgcttctcaaagtgtgtgattttgatccgcctcacctgttccccagtaacttattggggggctgcgagccgtggtgcggcggtcagactgcctggattcatggaccctctccatgccttagtttccttatctgtaagcaggctgatactagaacctgcttcacagggttgtgcttagggtcagtgagcagctgttagtgaggggaatgtagtggccaccaggcaggaactaggactccagccagttctttcctggtgggccacgtgtaactgtgtggccttgggcgagacatttcacttttctgtgcctgagtttatcagtaaactggagatggggggattcctcaccctgagttgtgaggattgaatgacagaaggcactagtgacagtgatgctggaggaaggagtgttgccaagtgcctcggtcactttgcctaatttcagaaagtcactctgagttggtatgttttgtgtttttaaaaaagctaggattcataaaattaaatagaaatcagtgaaataaaatatttgatatttaaaatacatttagaaatacaaagtgtcaagcaaaacgtgaatttggaaatctatggaacattagataaggtatttaaaagtaattgccatgtaaaaatgacacgaacttgaagtaagattatttgatttttctaaaaatacaagaaagc

SEQ ID NO: 103510 - DNA, 1012 bp, Homo sapiens
acaaaatctctcaggacccttgttaactctgactgtctataattctaaaattcttcctggtggactctgagcatcctaggtttgattctcatgcttcctccagctgctgacatcagcctgaaatggctcctttccctctcctgagtccaatccctgacacttaaaagcaaagaaaaagcaagtgaccgttctaacacccttaactaatgcagccaactgacctaccccacgtgcaaactttccaccttgcagctgaacacccttgatcttagggtgtgggtggcaggggcaatggaatctcttccttttacctgatgaggacttcctgcccatggcctgggatgtcagcctccaccttcccccagacgttcagcaccaactgccattccccgtcgctgagccccatggcgcagtctgaagaagacaaaaagagcaagtatgggctcactgggtgtcctggccccaacagctggggtttgaggctgcctggtcccaagggcgtttttataccttctgggatgcttgacaaagatcgctcaatggctcgctgtccccctcccctgccctccttcactttctctctctcatccagggagggtctaatcttttcctttctctagccctcacatgggaagctattttagggcaggtgccattgtggcgaggcaggacagctcaggccacagggggtggggtggttgtgcgtgtggaaagaaggggaggaggttgggcactgtctggactctcatagccgacagaaagggcaccacagaagccgacgccagcagcctgaaacccaacgctccctgcggtcagccctcccaagaggacctgtcatgtttctaagcttggccaccaggtgccccggctggccccaggacagtcctggccattcgcaacctctcacgcaccttctgcccctttgccagagacccctcacccagccagaagtgacagaaaggaaccggatggttttgtgcttatagccaggtggtcccaggcaagtccacaa

SEQ ID NO: 103511 - DNA, 1106 bp, Homo sapiens
ctggttggcagggattggtaacggagagaactgctcatcagccaaaactcaagccttgccttttaggaggccaccagcagagggacttggtcctccttgtctggtacttgtgtacatgccggtgacctgaggactccactcacactggcgagcaaaaagggagcagtgattctcttttctctccccaccccctgccctttgttaccaacaccagtttcccagggggtacatgagtttctgaatttttaaaaaatgtttttggtttggtttttctggggactgataagtgctttaagcaatgtccataccccgtcaagactcccagcttagtcattttcttgtatttttctgttcacagtatttgtgtgtgtgcttgttttggcagctcattttggctgtattatatattgagtgatgaattgatcctcttttttccctaagggatatgaattgtttttcttgtgttatattctgcttgtgaatagctggagcaaacctggggctgacacgcgtaagctagggctgcaaagcgagaagagagccggtggagtgtacttgtccctgacaggctgacctacctgagtctctgagcttttcagtccaaatctttgcaaggctcaaaatgccacagaacctctcctcttctccccactccccatggcagggaccggaccatccctacatgcaacatgctgttcctccagcccctcccattgccatggcaaaacaggtacctttggggcatgggggcattacatgggatgcttgtgtaatcgaccacctagccttctctctcccctcccgtcctcccccagaatcacttcctaggacacccgagctgcttgcccagggtcctgtttccctgctaactccagagaagcatcccagggctttgtgacagtctctaattcccttcccttctcgttaagaatcatattgtatagtagctttcagaccatacagtattcattgggttactcctattattatcaagtagctggaattgtgaaggtcggagtagttagatctttagcttttattccttatttttttgtattactctccatgtgtataaattattgatcatgttgctggcttttataaac

SEQ ID NO: 103512 - DNA, 1943 bp, Homo sapiens
ataaaagcaagtgtcctacagcatttcccaaatgaaggcattaggaaatagaaaagcacggtctttttggctccctggtctagtcacattggtactagggtgacctttcacccaagggacagctgctaaagggagtaattcagagacatggagcttctggttatgggtttgttttgggtttgtttttaactcctgcctccacacatgttcttgactgataactgactcatgtccctgaattaaaatgactgacctatgacagcatcaagcattctttgtaagcagagtgatatatctgagagggcgttgacctgttgtgtagaatacatatcctttcccccttcagaatcctgtctcgcctcgtaactgggagagaggctgtgcctgaaactaggggcgatgtcaaggaagctagaggcctcgatgcaattattactgactctggggaggaagacagagaataaggggacaccaactgcccagtccactggccatttttaagggtccccccaccccaagccaaagtttggtttgttgctgttaagacaatttttgttgtatgtatataaatattttagttagaggagcggggaatgggatgcgggctttcacagttctagggaatgggggcagggaggattttgcttttgcttttgctttgagggagaactttagctgactaaaaaaacagaagtttggggtcatgatcacaaaggggccattcccaaaagatggcaagccacgtattcagtggagactaggccaaattctaaatggttttatccatagcaggggagaataggagaatgagtttaagagtttttctcttcttttttcctagaaagaggtaaggataatgggaaaggtagagaaggcggctcccacagaccttttaagagaggcagaatcttgagcttgaggcaccttgagtgcatctcagttcagctggttctggctgaggcctccaaaggcaagctctgtgctttccagtggtttctgctgcatttccagggatggtgtttaacaccgcttcctccagctcccttttctaagaaagaataaatggagttctgctttttatgaaagggtctttggttttcagtgtcaacactgagaattggggctcttgcaagcatctggatttcacagtatcaacctccccgtcaccttttgaactttgagactccgtacggtcaacttcaccagaggcaggttgctcgaagcagcactgcttgtctgttcctgactctggttctcactgtattaaaaaagagagtcagaggagtctggcatttcgtgagtttgttagaggatgctggctgataattccagaaaacttactgatgctaaatcacagtacatgcatgattctttttcagctttactatagttcatgacctggactttctgtactcttggaagctgggctccttaaaggaggcctctagtgaacacctttatctccatgtccctcttagagcccagagagctgcccataggcattttccagaattcctcatgtcacctagttcaatttccattaactcagatcagccattgtgattcaccatttgtcaggctctcaggtttaacaaaacctactatcaccatcatccttcaacagccacagtctgaattgagccaacatttttttttctttgagaaagaagtggactggggcacaacttttagtctgaggggagctagtggaaatctagacaatagaagtcatcgatagcagcttttcctcaaatgtgtgactcctcaggggctaaactgctcttagcttagaattatgctttactagagatctagcagataagtgggttaatcactaccatcctgtaactagttatatagcttccagacatgagggagacatcaaacagggatggaagcaaccccaaggatatgcaagaagggcatgatgaacccccttccct

SEQ ID NO: 103513 - DNA, 1033 bp, Homo sapiens
tgagcaccttagaagcagaagttggtttcctgacttcactgcacaaggcaatgcttgatcagttgctttgaggcttcgaagcaggctgtttctagatccctctctggacatttttcttcactgttaatgcttctctcatcaaccttttaattatttttatctctttaattactgcaggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaaaaataatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctcttccctcctgtcttctccgttctttttacaatcatcttacacgcacagcctgagacagctggcatagtttttggaattatagtattgatatttccaaacgtgctctcagacagtggataataaacacctcattaggaaaccgatctcagaatgaactctggagtatgaaaaagatcatttctttttgttcctgtaacctagcattcct

SEQ ID NO: 103514 - DNA, 1457 bp, Homo sapiens
aattacccttgtttgcaaagaagttttactaaatagccctgctgtaactttacactagcaaacaaattctaaactaatggaaccatctctagttataatgaaaaattactagggttcattttagtgttaaaattccaactgtaattaacatttgctttgtttaacaaatgcttaaaaaaaaaaaaggtaaagaaatactttagttagtttaattatgttgtggccaggatttacagctttgcccagatcctggctagaattccaaggaaccatgttgatcagaaacggcccccaagggtgcttcctgccatgttcccattcattaccatttcattgtcagtgtttggtaatattaattagagtcttcatatatctctggaagaattcgtaattaagaaggaaatgtttactttctaagtcactcatttgaaaaacaaaggaggaataatgtataaccactgaaagccagtcagggatttttttaagtacatttgaaactaccctgacttcaagcagcataaacttgaagagcaggaataaatttccctcacaatgcagtttcttcatttagagaaagcataaattatataaggaagaagcaaaaggctttagaagctcataagaaattataggtatttctaaaataaggggtaacaaataaaagaagcaagctaggacttgccatgcaagatggttaagaagaacaggggtccccttagaaaatagttgttctcaatcccaagaaatgatacagaagtaaatttgaaatttcttttgtagatttagaaaaatcgaacatttgaaaaaataggaagtagaaagcacagggcagaaaccttcagatatccatgagaaatgagcacattttatccacagaaataaaatgtttatgctattgttcactactgaaatgatgttcagttgggccagttgaacatagttgtttttgatagtgaaaggccaataataaaaatttgcatctgaattacgtttaggtaaaatagatgaattctatttcataaataataaaaagtagagtttgccacttttaaaaatatcctgtctcatgtggcaagcatttgttgttgtgattgtctcttgaaatgctttctgaaagagtgcatgattcaccctgatagtgaaaaccttttgtatatttgagttatctaaactgagttgaaatagaaggatgtgatggtttgaaattctttaggactgagaggatatttggactattggaagaaaagctcagagtctactgtaagattaatatgtaagaatctcaaaaccttttagggaaggaaaatgcagttaagtgctagaagcagggttcctgatctatttgaatccagccaaagaatcctcagaaatttgtaattgatttgctcaagtatgaaatgtagatctgagttggcaaactttccgtaaagggccaagtggtaaatatttttggcttt

SEQ ID NO: 103515 - DNA, 1112 bp, Homo sapiens
gtgattttgctggttgtttagctccagatgttggcatgcttagtttttaatgtgattaataaatgtggcgccatatccctccccacgcctgaaccctgtctcttctacctccttcccacccttgttctttttgaaaaacttaagaaacagtaatgaaaaccttggtgtttcaaactgcactttgttctcatgttttataaaagcctttagatttgctagtaagagtgaaagctgaaaaaacggtttctcagcctgaaatttctatgcactttgaaatctggaatagaaataaatatatctgaattttctttttctcacattttgtgatatgttttgttgaataaagcagcaaaaatactttcgagtaagtgtatgtgtgtgtgtgcgtgtgtgtgtgtaagagagagagagaggaatacatccatgatacacaattaatttttctacttttggagtagtcattagtgaattaccaagttagtttagtaggatattgcctatctatcctaaaatagttcatcttttaaaggtttctctgtaatgccattattataaagtaatcaggagaataatcatgttaaagtcatctgctttaaaaaaaactcttcatgtgttttttcttagtgctgatattcttgagccttttgttttcagtaaagtatttgccaaccctgttctgttttcttccacttgaaaagcagagaacttcatcatgtttaaacttcaaagtcagacttgacttatcaaagaaggaaaccgctacagatagattctctccatctccttctggattggaaggaagattcttttccatagtctgatccatttgaattgttttgattagcagtaacattactcctaaaccaccaaggttcctatggcttcctgtaggcctaggaaaatgaggggaaattggttctgtcagcaacctcacttagaacctgttttttaagaatacagcttaaagccatgatttgatagaatactcagagatcgtacctccagtacctcactcagtcttcctgagagtcaggtgtgaaacctacccttggttgagtacttttgaacctcagtatccctttgcaagaatttatacctctgccgtatggcat

SEQ ID NO: 103516 - DNA, 1056 bp, Homo sapiens
tctcaaaaaaaaaaaaaaaaaaaaaaaaaaaaagacttgtctacttcaaacttgttaagtcaaccaacccaattttttaatagttatcttacttccttactttacaatgtaagattttattgagacagatgatttttctgttcctgttaataaaatactcttggttttttttttttaatctactaactggattaccttgctgagctaaacacaagtaattcagtgatcttgctgaaataattttttttgaccagtggccccttgttaatgaaagtaattaatagtaatgttattatttcttagttcttatcttaaagcagagttacttagagaaaaaaaggttggtcactagtgctgaaataatatccatgcccctacatgaaaagcaagaatactttatgaggtaactactgagttaggcctaatacaactgttgcttttaaaactgtgtgttctgtattccacatgtgagggagcaaaggatacttcttcaaaaacacacagacaacaaaacactatcatttttgccttgagtttgttctgcttctctccatacatttcccatctgtggaaatctgtcagcatacatttagttcttatttcctccgaaaggcatattagaaatagaaggaatagagagtttagtatgaaaagtgcaccgaatcggagcttgaagagaagacacaagggaaaagattttaaattgctggttatgcttaagttaaatgaatttaggctattaattgtgcaaggtttttgtaatccctttcacagtcccattcttagacagtgattcctgctagccatttactttctgtttcttttatggcacattcctctctggagaactgatctagcaattctgttcctagtttgtaaaaagacctaccgtgataggatttgggagtgtggcagctagattatgtatccagccctccctcttcttttttggccagtagaaaaggcatagttcgccctaattcactttttaaatgggttaacaaactgctcctaaatcacctcctgtgaaaagcatgcttgcatccaaaggaaaga

SEQ ID NO: 103517 - DNA, 2134 bp, Homo sapiens
acatttctctgtttactttggtcagaattgattgacttgtttttctgaggtgttgcattggttcttaaaatgctgaataataatactttgcatgcttgtgtgatcagccaaatcttatcgcatgtctaatgtgcagggtaaaaagcaggtgatgtatggatatcagaaaaacatttacatattattacaatactgaaaacaaaatacttaaacgtaatgtaaaaacatactttgcatacaggccctgccctagtggaattctttgggttcagtttttcatgttaaactcctcttcacccctaccctactttgtaagctctttaaaaagaaacttcctcctagggcaagcttatttttaaaaatactccatatacaaaaagttatttccaagccagcagattttggatagatataataggctcttctaggagtgctttttattgtgtgaatcctactttaattaccaaatatccaggttgcgcattctagttttgcacacctttccctctcctcgcatgtcctggagctgtgtaaccttcgtgtgcactttcacattttctcaccaacttgccgaggccccaagcccaggttatgtattcatacatcacctgcctgtgtagagcgcatgtgcatgctgccgtcctcaataaccggaatgtgtttctgttcttttgttttttttgtttttgtttttgtgtggattttctgcagtgtggtttaccaggacggattttacggtgctgacctctatgtaagtacacacactggggccttctcgaccccatcccctgacaagccagcctttttttttctgtttctttggtttggtttggtttttttccttttaatttatttaatttttattttctttttccttgtggatatatatatatatatatttatatatttaagaatgcaagcatgcttctctgccactgcgcttgcccctgggtgcaaaaactaagcctttgggtttcctgatcattgcaagggtcagtctactggacatattcttttcccttccctatacccacagatgttctgtggatcattaatttacttgtgagatgatcagcaggtttaaagtcttttattattgtcgtgtcatttgcatacataaataacaggactagcttaaccttaaaccagctctttcccttttctgcttttcttctcatttcacatccctctttagatcattagagctgtgatttagaggttaataagctttctgaactgtacattttcctattttacctactttgagagaacatgaccttgtgatagccaaataaggaaccgatgccagcaaagagtgtgtagtaatgagaaaacgccagatatttagttcttaaaagccattggaggaaatgagtagcataatcagcaacccagactcttcttacagctatttgactatcatagatttgctgactctactagccatagtaatatggactccattatttaaactgtctagctatcactaaagttccatgattggtttgtcacatattatttaaaatgtggacaaagtgatataattgacaaagtacaagtttttgagttttgaagtcttttatcatgacctctccagatggactttttctgaatgcaagcttgatttagtcgctcaagtcatcaagggaaaatttttataagaaaaacttgtcagcatgaaatgattctgtggggataggttaaaattgtctagaaatactttctccacccttactttccaaaatcaataagaggtcctttttagtgaactgtttccacagtctaccagagattcacaagcaacctaaaaaagttaatgcactttcagaatgcactcagaggttttgcgttttgcaggaagtagagatgggatgatacagttcttcgaaatacaggtgactcacctgtactacttagcataggcctgtaaggtatgccttaatttaataactacttgaaggaacctcagctatgatttggtccaacctcctaacttacagatatatttctcagagacttacccagaactacataaattattaatagtcaggcataaaacccaaccaatccatatttcattacctctctttgtactttaattaaaatccacctctttcctcaaaatattttcaac

SEQ ID NO: 103518 - DNA, 1618 bp, Homo sapiens
tggtctttcatgagtcagttgtaccaaggacttcctcatcaaagatgtgacatttctcttcaccttttctctgccagataatgtcaatatgacatatttttttttgtattcttacggaggaataagtagcagcagagaagcttgttggctgctacttagttaaaatataaagggaaggaacctcctttgtatgtccttttctgacagcaaaattggcttagccttgaggtgtactaatttagcattcattcattcattcattcatagaccaaatggatgtaccattagaagttctccattccacagagttaaaacatttttattagacaaggtatgttgaagtgggcaggctccaaaagacactggaagggaactgcttcagaaattaacttttgtttggagtttgtagacatttaaatcacatgcattccatcatctccatcttatgccattacttacttttattttaatccttttttctctcaacttgacctttgaccttcaacctctgacatctctttaaagaagtgaatatgcagtattatttcatcaagaaatactcaaatgaaacattaaaaggaaccttttggaagttttacacactaggaaaattgtttgtgaaatgtcttccgttgtaatccaagagaatttactgtcatatttgcaaagagagactactcaccagaaacatgggacttccttattttgtaacattgctgaattactttataaagtggttgaatttagtcctgttcaatgtagtcgtttcagtatattgaccaaacttgagaacccattctctaccaagtctgtgtcaggtatatatttgctcaaagatattttatctttatgtctaatcatatcaatttctgtgcattacattgaacactgatttcccatgttttctttttattaactaaaccacctgtttacatggaagatggcaaggaataagtccagtatttcatgggaatggcctagaattgcttttcagcttagtaaactaatttcatcattaatcattacgtttctagcctccttgtggcatttgatacagggaatattgggattcttctagaacgtagatgaatattcccaataagttatttgacttagggtaaaatgtattcgtgtttttaatgccaacccttctttatagaaggcttatttgtaaatctttgcctatatccccttactaagatctttgaagtttaattaatcaccacttggtctcagtgctttccattttatcagccttctcattttgaacaagttgtttttttccttaaaatgcagctgagaggcagattactttctaatatcagactttaactgcaactggagactatgaaaatgaatgggacttagctaaatgaacatcagagatgagtttgatttgccttttgtgtgatacaagggcatagcatatttggggcattccaaaatgtgaccatgctatcctgtaaatacaaccaaatgtcattggaaatagaattaagaaacattccacctacctataagaaataagttatttcatattcaagttaaaaatatgatttgatgactttacttgtcagcttgtttattgtaacagagaaggtagtggtgaaaatttcca

SEQ ID NO: 103519 - DNA, 2178 bp, Homo sapiens
agccccccagccccagcccctcattatctcttcactgtgtcctagttctactactgttactctctcatataaaccccaagctggaattccaaagagaagttgataataggcaaaaatagccccagagatggctgaagccaacttgacatgcactgatcatccctttcctcaaacagtcttaaatgcttaccttccattttgtgtgtttcaggttggaaattaagcccagtagttggagctgtatatggtccggagttatatgcaggtagtatttaagtaaatgtttccacttgtgctatttaattgtaatagcatctgctgtttttcaatttgtgactcctttttaatcttcttgcatttttaaattttttaaaaatccaatcagcatccagctttcaagcagatgtgtccctaggcaatgatgcagcagtgcccctatcaggaagagggggtatcaacacttacattcctttaatcagtaagtagcctatgttggcctggcatggattttgactgttgtgagtgaactatcatgtactgtttttttttttcctagtacagtacataactgaaatggaaatttcttgagagggatattaaatactatcccagtgccctgtcctgcttaacctgtgctagaattttcctgaccaaatattaagattgcacaaagcagaaatagttggaaaaggtagagggggtaagggcatatgaagaatattttagtctgtacttgacgataaagaaaacaaaagaagcaagtatgtgtagagcatattatacatttcctctgcgagtcagccacaggttctccagcagaggatcacttagaagtacttccagtattattgattattcccagctctcttgatctctctaagtcattttgacctgagccattttactccagcaagaggtataattaaacaggattcagtggacatggaatcaatgtctctgcatgctttccagaggacagcacacttaaaataggctcttagaaattgtctgcctctttaaaggatatgaggcccctagaaattgtctgcctctttaaaggacagggtaggagttgtttccctcaccttacatttgtggattaaaatgttttaaataaaagaatgaaattgactaatgaaatgaaatgtctaaagactattatgtgccttagaggttggtaccatgtaaaaatataaaaagaatgttcttttgagtaataattattatgtggacatagtaacattgggaagcaaggttaataactgaccggttgaagagtttgtgtcaatctgatttagactgcccacagtaattaaaagtctgtctcttattatggcagtcattctcagagcttcttgacctgtttctcagcagcttgcattgtaaagctgaaattgagaaggaacagagaagctcactcaagatttgtgatgaatgaggcatggaatcttttgcttttgcatgttgggtctctctttccatttcttccccactgagagacccagggtagaacgtttattgaatgcatgccaccttttccaaaaaggtgtggttcgtatctttccatcttttctataattggttcatagcaagttgtgactgtgcaccttctattgaatgcaagttgaaatttctgtcatattttgggtctccctttagttcctggcttcccttaccctactgcagccaccacggcagccgctttcagaggagcccatttgaggggcagagggcggacagtatatggtgcagtccgagcggtacctccaacagccatccccgcctatccagggtaagcgttagattccaaaatcagtatgtttctaaaataagcagttggaccaaaaaagaataccatggccctttcataacttctgggatgttgccgtgtcacagagtaggcattcagtgaatatttgcaaattaacagattagatgacaaaaaacaaaatataccatcatcagaatgtgacaaactgtcaattcattataagtcttcattttggccaccttaagccctcatggtaatggcttaagacagtagccagaaccgtcttgtgtttactagcagtgtgttggcatgaagttcactcagaagcgcacgaatatggattaacattactgcagagaaccaaaagaggagctcaagattgtagtacaagcctgcatctgctgtgt

SEQ ID NO: 103520 - DNA, 1028 bp, Homo sapiens
ggtatgatggctggctggcgaatgtactgtgattatgaccaagtctaccgcctggtattcaccagccctttttgataacacatcgaaggttaactggctcctttcccctttcccaattttttaaagtattaaatgtaaaagccaccattttgagtaagatgtctgcatattttgctttttttcccctcctttccaatggtttagcatttagggcccttcacttgactcactctttccatggtaactatacacaatgctggcgatggtgcccgttggcggtaagtgaacaaaagcactagagaagaagcttttaaaaatgtaattacaaaacaattaaataagaaagaaaaagtccatctgccatctcacattaacactacaaaatgtgatttgacttgttgttcctcttccttttcctttcccccttttattttcaatgctgttgagtaatgccgcctggattttggatgtacatattgttttgtagcggtctgagctgtttgattactgacttcatggtgatttttttccccttgcacatcttactcagagttactgaactccagtttggctggttttattaatgcacttcctgcccctacatccttccctacttttcctgtttcccaaacccccgtttgtagctctgactgttctttctttgcccgttacacccttcctgactttctcttttctttttccctaccttactctctttttccggatccttgttcctgtccctttccctattcttcctttcccatcccttcagttacacgcagctgttggtctcttttgctgactggtggtttctgattggttctggccatttttccttttaagtgcttggttgctttctgctccagcagctggtttcagctcttgctccattctaatccttgtctgtgagaaccttgcttttcagtttctcccctctttccaaaattgattgttttttctttcttttatttgtgtgtgtgtgttttttaactgcatgctctcagtctcatcattgttgtatcccattc

SEQ ID NO: 103521 - DNA, 1373 bp, Homo sapiens
ataagtatatagtaaatgctcctggtgttaaaattggtagtacgtgaacatcggagtgaaggtagtcaactccctggtctcctgatttgtctacttaatgagttaaagctccactccatttttatagtatcttgcaaggaacaaacaaattaatcctaagtcattataccagctgcattgctgttttctgatatcctttttctactgaatagtgtacaactgatgtcactaatgtagatctcattcccattgcctgttgactgttccttttttctctatatatagaaagttactactacctttaatagcaggtataaacatcaataaatgaataatttaggcaaatttgggttagcagttttctgaaattcagttgaacatatttttactctaagtgtcaatctggtcatttaaaaagggcattgaagaaaagttataattgaccactgcttagtgatatttttatttgcttagaagagcatgaatgctctcctctcccacacccagtacatagaaaattgtacaccgactatgccctaagttatcctgttcccaaaggaattaatagtgataaaagcaacaggcaacgtggggctaaaatgattagacctactttaaaaaaaatctcattatgcaatgttgaacctgaatgtcagatttcatgtagcagttactggaaaataatagatttgggatgtcagagagtcaatttaattaagtcttttttagtattacataaaggggcatgtatattaaattaataacatgaattgagagagaaaggtagggcattaaaaaatcttcagatttttggttgaatagtttgacccgagtaactctgtaccttaattttggtctggcctcatatgctttatgttttattttattattgttacattgctgttaattattattattattacagttctttattcttttattggatttaatttccctttacaaatatgcatggaccaaaaatgtgactttgggagattattgctgagttgttgctgatgtcagtttcatactatgatattttttctctatttaccaagagatcagtatttcaatataacgatgtgcatgttttccccccttctcccgctgcatgcagggattcgggttcgtaactttcgagaatagtgctgatgcagacagggccagggagaaattacacggcaccgtggtagagggccgtaaaatcgaggtgcatgtctttaataattcaatttctggtttatatttttatttctcttttttcgtgttgcctcacttagttcacatttggaaccctgtcttatgtgtgcgtgtgcacatgtatgtgtgtttgtatctctgtcttcttcaccttcttgcactaaaatgtataa

SEQ ID NO: 103522 - DNA, 1046 bp, Homo sapiens
ctcgctctgttgcccaggctaaagttgcattggcacagtcttgactcactgcaacctccgcctcctgggttcaagcaattcttgtgcctcagcttcccgagtagctgggataacaggcgcacactaccacccctagctaatttttggtatttttagtacagacagagtttcaccatgttggccaggctggtctcaaactcctggtctcaagtgatctgcctgccttggcttcccacagtgctgggattacaggtgtgagccactgcatcctggccccacatttttttaaatttacctgatccaattacttctctcatgtaactcatttgaaagtaatgacatgagctttctctttgagaaatctaaaagcataggctgcttctgtcagcttgatgctgtgtcctcactgccccatttttctttgggctgctaaagggtgcacagactgtgtactaattggtaaatgttttaaaaacaaagcatagaattcagaattgccctgaatctgccttcaaggactgatacaaaaccttgtttttgtcctttgaagctttcttaactgctacctaaagttatttgctggaatgggtgcccttggaactgttctgaggctcctaatagagatttattttggaatcaaacccatggatgcctcctctgggatccacctaagagaaattaatgagcactttttgttttgtgaattaagtttagtttcttaatccttttatatgtttggggttgactgtaaaattacagcgtattttgaaaataaccagagaaaaggaggctttatatagtcctattgtttagctaagagttcctctaacttttaaacagagtgcttttctgtacagaaattagctttattgaatttttttagagcagtaatggaaaaactagtcacaaaataactctaagatagcaatacttaatgtaaaacagggtttaatcaaattgttccaaagcaaaaagcaactccataccatatcttattttgtataataagaccatcacccagggttttaggatatacccatttgaaa

SEQ ID NO: 103523 - DNA, 1035 bp, Homo sapiens
gaaatataaaaatatttccttatttcatttccttgagagagcctgagatcatagaccaaaaaatgaagtgacctccataactaagtacaacagactctattttcaaaatagaaatatcttaaaaatagaaagttctaagagtctaagaatgaaggaactatttttgtatcttcagatcctaatgtatctccatgtgatcttgggcaagtcacttagtacttccgtgttcgttagctcccattttgttagcatactataaatactcaaaacaccaacattttgtttgtagacggtagcatttagaacattaatagcatctttgtgttttgttgttgctgctgttgttgttgcttttgtctttgaagggactactgtgatttttgcttaaacataccctgtttggggatgattgctgtggggggataactttaattattttaaagtaattgtgtatatttttcattctttatttctttgcttagcagacagaaggtggagcacagacagacggccagcagtcacagacacaaagtagtgaaaattcagagagtaaatctaccccgaaacggctgcatgtctctaatattcctttccgcttccgggaccctgacctccggcagatgtttggggtaagtctctgaagtctttttatggattttacaattaaagtagattttaatcccccagatgtgttattagtcattattactttaggattaaactacaaatagattgaaagaacctgaggtaaatcagtcttttcatcagtctttagaagcctttttctgtcatccagtctgctctagacatagtcttgcaggtggctgcacacataaggtggcgatatgacccagcttgctgtgactgaggggtttcttgtgatgtgagactttcagtgctgaaaccaggatggtcaccctactcacctaccaaactcagtaaacataccaataatatgcttagtttcatctgcaagaacaaacatgcacattcttttagagcaatgattcctaaacttgtttgcacactggaaat

SEQ ID NO: 103524 - DNA, 1050 bp, Homo sapiens
atttttgcccctttggcatctagtccacttaaatatggttgtgggcctgtctagtaactacacattaacaaaagtgagtgtgtgtgtgtgtgtgtgtgtgtgtgtgtgtgtgtctgtccacatacatatatctatgtgtgtatgtgtaataatattttctccaatcctggagcaataagcattccattttacctatgcagtgagagaatattcagagaattccatatactcactttaaaaatagttacgtaacaaggattcaaagtcactttttctttctcttgttgtttgttttagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacggtacgtggaccatgaggtgaaaaatggaaggatgcatggcaatcatatagaaattgtcgccttaattatacaattagaagactctcggaattaatttagcatttacacctgttctcatttacaccttctctcaacagcattgtatacattgtcctccctcctcctagaaatacttagtctcttggcttttcgagctctcccaattttcctgccaagcactgggtgttctgctcctgcctccttctctgttcaacttttaaatggtgcagtactccatatgtaggtcctggaaccccttttctttttattttatatcctttctctgcataattatactaccaaactcaagcaaaacctaggaatattctttctttctttctttcatctgtacatctaattgattagcaagtcttgacaaccataactctaaaactacttcgtcttcttctctacatcttattactcttccaccaaattgcttgtgtttgaatctcaatatggcccctactaaactgtgtgaccttggac

SEQ ID NO: 103525 - DNA, 1030 bp, Homo sapiens
tatctcatagtttgctgaaggctgttgtacttctcttctgagcatagaactttggaatatggcctggaaatttaatacaaatctgaaaccatttgacatttttaataatgtatacttggggaaatattcagacattgcatgctatatgagagaaaatgttaaatcactcctatcccaatttcattcccttaatatataaacaattgttgttacatttttaacaaaaattttaaaagaaatttctgtaagtaacaaaataatccactaagaatttcttcttgacctcttaagggaggtacataacccctctaggaaaacagagcctctgcctggcttgcatttctgtaaaacgcctagtgcctaggctacaagtggattgcaggaaatgtttttacctttctccccatctcccactgctaattgatgtgtttattcagttatctgagtcagccctgttgagaataacgctgtgagagaattcatactgtgtacttgtgtgccagagtctcattcccagcaggctggggtggagaatggaggctggagtaaaacgaggaggctgaaaggagcagtgtcagagcaggagaaagtcgccttggccttgttaatcctaacttgaaaactctatcttttagcttttaccaattatttagtagaactttcttatggattcctgtgagattatatttatgcctgatgtgggcataagacctttggtgctcttattgtgtttcattcaccagtccacctgaattccaattcaattctttttcatgtctgtcttcaggccagtagattcagcgagggcttctgaagcagtatgtttcatatggctagagagagacagagagatagagcattgaataatttgaaggggaagggagataactattttatatctctcgtcagatgcccagaatagctataaagacatcataaaaactatcctaacctagaaataacgtaaagaagttatatggtgatgggtgacgaagatagactttttccaaaaaaatttaaagttttcata

SEQ ID NO: 103526 - DNA, 1124 bp, Homo sapiens
tatctaagtaaagtaatccccccatccacagtgtcccttttcatggtttcaattacccatgatcaaccatagtctgaaaatactaaggtatggtattttgagagagagcgagaaggaggccacattcacgtaacttttattacactatattgttataattgttctgttactattagtattgttgttaatctcttactgtgcctgatttgttaagttaaactttctcacagttatatatgtataggaaaaaaaacagtatatgagggttcagtgctatctgcagtgttaggaatctactgagagtcttggagcatatgccctgtggataaaagaggctactatatatgctttaaagttttccctcctgaggaaccagggggcatttttgaaaaacaggagatgcagggggggaggtttgtttacttttacttagcctatctcttatatgcaatctttaggaagaagaatgtgatttttcccctcatatttgtattgatgtgactgttcatatgaaaaagaacatggagaactttaagattataactcagctgttagcatttatattttggactatgtatgctttctattttttcttattctttcacaataatagtggtaattattatctctatttttttttttttttttttttgagatggagtttcgctcttgttgcccaggctggactgcgatggcgcgatctcggctcactgcaacctccgcctcccaggttcaagcagttctcctgcttcagcctcccgagtagctgagattacagacatgcgccaccaagcccagctaattttttctatttttactagagatgaggtttctccatgttggtcaggctggtctcgaactcctgacctcagtgatccatctgcctcagcttcccaaagtgctgggattataggcgtgagccgctgcacccggcttttttttttttttgccaaaagcaaagaattttttatatatgatcttagttaattccttttttttttttttttttttttgaagcggagtctcactgtcttgcccaggctggagtgcaatggtgagatcgtggctcactgcaacctccacctcccgggttcaagtgattctcctgcctcaacctcctttgg

SEQ ID NO: 103527 - DNA, 1408 bp, Homo sapiens
caggtatgttttgctttgtttcattttctcttttcctgtttttgtttgtctggtttttgaaaggagttggagtagagaatctattctgtgattttgctaagcatatcccattttctttgaattctggaggtcctctcagcatttagtctccattttgtggcactgctttaaagtgattccattcggttgcctgccagtcatgctcccttgccactcgaaccttatcccacccttcatccacggagctgcagccacactgtttgttttggcacactttccactttctatgggctttgcaggatttggggagttggaggataggcggggattgtgggttggagactgaatttatgttcctttacaatgaaaaaaaaaagcctcactttttccagagatttggtttctttctgaattcttctacattgctccatatcttcagttataatcatttcttcgctgaggccaagattgtctcttgaaaagtattgcttttctaaaaattacttagctttcttgaaaagataaacagaatttcataaatgaagctatgatgaaatccgagcaatcttgactcattaaattgttttttccgtcttagtcaccccctaatcacacacacttttctctttcttttttggcccccttctctattttttcctttatctttctccttagctttgcaattgagtctaggtaagcttaatatttgacaacctattacttaaatttgtattgctacaggagacatcttcatattgaacagtaatgacattcctcattcctctcagtgataaggcataagctcaaattcctggttttgttcctccagttttctgttctcccctgagaaattccaaactctgatctacacagattgccatatgtaaacaattttatctctctcaaatttgaacttttcatcatgtaattccttacctaggggttgtttcttggacatctgtttatggtagacagatagtttctgggaaccagtcatactaggtgatacagcccccccttacccaccctggtctccttctggtataccattcctctccgggatctgacattattggtatcccacatgttcccttccgaagtcataattcctcactcttttttttcaacatttccaaaccactgtcaaatcttttttgaacatttcctcccaacattttgtatgtgaaatttgccaggcacaaatacaaggctcccctgcagtaaatactttgctcttttgattgtagcacctttcttagtgggctccagtgttcaacctcttctaggcagtgagaaatgctgcattctgccatcacaatgtattgtgtctattccccagactcttaaatgtttctctattactattagaatgattaaattcaggaaactaattcattagaggtcattg

SEQ ID NO: 103528 - DNA, 1051 bp, Homo sapiens
tctcttctcttcctctcccagtaaccaccggagggcgagagagccagctagttatcaggatggaggcatcattttaggagctggaatcctgtttagttatataatgccctgcagtgctgtttggaaggagggaaacctgtagggatattttcccattgggacccagaggaaagaagtttcaaatatatcttttcaaagtaatttttcaccaaatctgagtttagaaaatttcaacaaactccttcctcttttggaaaagcggagaagcttttgaaatgtttctcttccatgtgttatcccctcatcatcagtctaattacctcttttgaaatactgctttatgctctcggccttagcgccatttttttggaaacctctgtgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagaacttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaaaaaaaaaaaagaaaagaaatactgctttattttttaaaaaaaatttacataaaagataaatcctgtttctggattctctttttgcttgggagatgatacttgcttaaccttagagccctcattcaatttttattaactggcaatattagagggtaacagctctcttcttgcttagcaattactgaaggcttttcaatgacttgacttttcattatttattttttaaactagtgaaagaatgatctaaaatggaaatttttatgatgagttttctattgcctcttg

SEQ ID NO: 103529 - DNA, 1478 bp, Homo sapiens
aacaaaaaaactccttggggccttgtctctttccatgatgtatggaggctgcagtcacacctaagtgtcaaggtagctgctgcttttctaaggatgggggcgggggacattgtgggggagatgctatcttcttagtgccccaggctttttgtcaagaatagtgtaataaaccagaggattcagagaatgatacacagtgattctgaggtttatttcaattattagaactgaaaacacagttatcccattagtatgattcaagattttttccaaaaatacactgggttgctcttgcttccagtgaaactcacctgcccattttctgcttactcactttgtctttagaaaatttgactgctttttatctccttctgattggcttttcagttgcaaattcagagagtactatatattctgtgttccaggtcacttctaaaaagtgttaaataagaacaggcctagtacttatctatattactttactcagcgtttttcctaatatttgaagatctcattctttttaaaattattactatggattatgccacaagtatacagatatctgtaaaatgcacagaatagagcctgatatactatgttacatcagtttctccaggttccacagatggtcctgtatttcctgtgttcctttcagaattgttaaaatgattattaatttaggagcgggtgtaatgatgttgtattggcagtgtgccagccaatggtgttatacaacacatttttttaattttaaaattttaaaaattgaattcacaatagagatagggatttgccatgttgccttggctggtcttgagcttctgggcccaagaaatccaccagccttaacctcccaaagtgctgggattacaggtatgagacactgcgcctggccaatacagaacatttttaaaagcctggtactgcatgttgccaaacagtccttatggagacagcaaaaaactatgtattctcagtgtgatttgttattttgaatttagatttctgtagatgtttattttttaaatggagagctcgtgttgttagccgtgggcttgtaaaaaataaaaatagataaaaattaaaaatgggaagcttaattttggaattaatctttttaacctttgggtagtcttttagaaagtatatcctaaaaatacatagcataactaaaatatctcataaatccttcagaatgagctatttattagaatgctgtaaaaaattagaaaatcttaattttatgagacaactgataaactcatcattttataaattgttttatttgaatgtgtgataatataaaatagggaaattatgaagtttatattcagaggttaaagatttttccaagatcactagtaaagggcagaattagaccaacttctggactgaaccacatctttgatgcattttttaattatattattttaataagagaactttaaagaaactcttattgtcagtattctcctaaa

SEQ ID NO: 103530 - DNA, 1052 bp, Homo sapiens
tgcgtgcacacgggtacatgctccccgcccaagaaagaatagagtagtaataccagtcccatctgcctttctgtgtcctggattgggagtattctctgacgcacttaaagcctggaacatatatattattttggctcctggataccttagacttcctaccgtgtttgtgtgccagtgtgaggagcctgtgttcccttccctggctgtcattctctgcctcttgagtttctggttgagttgtcaatttaaaaaccaacagtaacagcaaatctccagtgtagttttcagtctgtaactagtaactcaaagctttttgcttttttctgaacatctcttctgtgtattgtcaaatcctgttggggtggaggcctggtctcaaccaagctccgacttcatcagctgagccagcatacctatctgcgtagactggaggtcagcgaaggatttttttggtgctacctagttcctttggacaggacagccagcgcaaacaaggcaaaaacttagacactttttgtactgtccttatctgaagattttttcccttttgctatgtatggtgtatattgtatggattatcaatatcctgttgtccaggtaagctaagggttataatttctagatactgtttgatttatgtgaagctttatggtggaatgaaatgcctacaaggctttctgtcttttgacccggtaccattcagagcctagctttcccagtgctttttgctaatttactgtaataagaggatttaatttatagtattggcggccagacaaaggtggttggcattcacccctagaagttctgaaactttggagagattctgtgtgtctgtgtgtgtgtgtgtgtgtgtgtgtgtgtgtgtgtttgtgtgtgtatgtgtgtgtgtgtgttttgaaccaggtgggctggacaatataaatgtaatgtaaaaaacccatcatattatgataaactttaggctttgttttgagcagatgagaggcacagttggcagtttccaaatgttgtattttccagaaaggtaatatataaagtagagggcatct

SEQ ID NO: 103531 - DNA, 1016 bp, Homo sapiens
tagttttgtgctgtagcattgttttgctttttggctttgcctgtgtccttatctatttctcccataaactgtgaattcattgacaacagaactgtgttcatttctccagggcttagtacaatattttgtctgcaatagatgttcaataaatgttttattaattatactgaatagatttattcttgttcttcatgtgtaatgcacatagaatcagtaccagcaaattgaagataatcgagtatagtggtcctcctaatctgttagaactgagttcaggtaaatgtttaaccaagaataccatcaaaatatgctatagccattttgactcttaaaaatctgtttcttctgaacaatcctaaaataaattacagtgaccgtaaaaggagaagaattacactgatgggggcggggcatggagggcatggtaatacttaaattctcacagatgccctcacagttgcatttaatcctcatggtttaatcatccaaaagcatgttacaatattactggctctccacgattagggacgtcatagcccctgaaacttatttagaattatttaccattttgaaattttgaatgcttgttccaaatagaagatttcgtaggatcaatagttacaactggtttgtcttttaataaacattaattttcactttctgctcactctgtgtcctttttctaaggattacttagcagttttctgatttttgatgggccatttaggctctgaaagccaactcttgaacctattgtgctttgtcagacaaacctaacacctgtccatgtttgttactgcttttaatatctgttatagaaatatgtgtgcacatgtgtatttgtatataatggcagggtgggtatagcagctccctaaaaggagaaaagcaactggcttttctgaaaagacctttccacccccacctttttgcagacagccggagttaatccttccaagtttgactggaacagctgagcaagtgtaccctgcatatctggaggcctccagtggact

SEQ ID NO: 103532 - DNA, 1008 bp, Homo sapiens
gatggagtttcgtcatgttggccaggctggtctcaaactcctgaccttaggtgatccgctcgccttggccttccaaagtgctgggattacaggcatgagccactgtgcctggcaatttttttcatttaataatgcatcagtcgtatcttttcaccttgtatgtatagtctagaagaatttaatctttctctggaaattgactaggccttcaataacatttggggatcactttcatgcttaaattatgtcagttgttttaggatttgaattacagtctttcatcttaaatacaacagcatctgggaatttcctctataattaagtcaccaaatattgaactgggttaactcttgaagtttaagttagtcagtcatagttcattattacagccttttatgatgtataagacatatcatcattttccagtcttcatatcaagaagaatcttaggagatttaatagtgatttaagatactagcttataagtgtatatgtggcccatcctgctgtactgctatgtatgaaatgacagaagtgtacagggaggaagaaggattaataattatttgatttgattagaagaggaaatttagcataaggttttattgcagaaacattctttttttttttttttttttaaaaagaaaggtgtcactatgttgcccaggctagacttgaactcctggcccaaatgatcctccctagtagctgggactacaggcacatgctgctgtacccagtcttttgttatttcttaattaccattttaatacctatacaggagactgttagaatatatagtcctctcatatctgtgggagattggtaccaggatacaccctctcacacccctgcagataccaaaattggcagatgctcaagtttcttatataaaatggtgtagtatttgcatataacctatgttcatcctcttgtagactttaaattatctctaaattataatttccaaaacaatgtaaatgctatgtaaataattattataactat

SEQ ID NO: 103533 - DNA, 1034 bp, Homo sapiens
ggccaaaaccaaacaaaataaagtaaaaattctccttgatagaggcaactgtgggtagttgaatgtatcaataattggttttgtactttattgccacttggaaatcaagtatcccaatagaaagtttgttaaaatttatatgcaggcattttgtctatttttcattctgaccatgagtttatcaggtttgctaccattctttttactcatattactaaaacagtgctctgaaaactctttaactcttgtttgctaaattcagtcatttatttctaaattctcattttctttaacctttctagatttctacttggcattgttatatattcacctctgatatcaatttatgaaataccttccctagtataaaggatgtgagatcgaagaaaagaaacagatgtcctctgtattcctggcttttgtgaatagtacacgattatgcttaatctttttatcctctgtttctatttctgccttcttgaagcaaggattcctcaaggttctattttcagcctttgccttctatctgtctgtgtctcccctccacctcccatttttcttttgtctctacttttctttttttggagtacatggttgatgtataataaatgttacagactgcatcagtgtgggagaggaatctcaaccccattatggccatggctatttctccttttctctttgatcttcgtgtctaaccctgacctctcctctagctgtaccttcaaccccgagtacctgttataccttctctaccattacttcaaaccagtttatgcttcagatttgtctgtattagcagtgttattcttatttggctagttagctagaattagaacctttctcttataccctacatgtggacagtcttcaattactgtggatgttgtcttcgtcatctcttatatatctataccttctttattcctactgctaatatgtattttttgcattagtcatctgtaacctcttgtaatggtagctgctaattggtttccccacctttaggttgttccctttttcattcttacctg

SEQ ID NO: 103534 - DNA, 1066 bp, Homo sapiens
gctaggcacagtggctcatgcctgtaatgccagcactttgggaggctgaggtgggtagatcacttgaggtcaggagtgtgagaccagcctggccaacatggtgaaaaccctgcctctaacttaaaaacaaaaagtgaataactattgtcctatccatttactgatttatgaatgacacttttaacaaaactgctaattccttgcctcacagtttgtatgccatgtctctcattccaaaacagaaatgcatatcagccattccatggtttactctgttattacccatacttcctttctgtaccatgtgtcatgcaaaggagtgtttccatacttaactatgatttgctattttctggtaggtataatttaaagatttccattggtgtagaaagccttacaattttctcagtaccttagaatcaatagaactcttccatggatatttttaaataggcttttgactttttttgggtatgctgacctgcctgcctttctgtaggtatggcttcatgtatgctatgctgttttatgcacttgaaaagttgttccactgcctcaaagcttcccaccaccaccctaatccatctagaaaactcccgctagtttttttaaagtacattttaagcattaattgcttgtgaaatatttctgggttttcttcaccctgagaaattagatggtggtggtggtggctatagtagcaattgctgctttattttctcccaagccatattggaataagcgtggcatttatcgaatggtattttggtgtgtattattttctactttttctcccctgtattttcagctcttgaatagtttttgctgtttgtaggccttcatgcaatgttgaagatatcatgattgaatgaatattgactgactaacaaattagggatggtctgtatgtggtgattcattcagttacctctgatttgtagtttgaatttattgcagaccttctcttttcatatactgatgagcatatactgtataaactgttttagcttaattcttttttttttttttttttttgagacagagtctcactcttgttgcccaggct

SEQ ID NO: 103535 - DNA, 1046 bp, Homo sapiens
cctaaatccctctttaatcttattaatcatgccaggctttttttccaagggccgagatatacatccatccatccatccatccatgtatgtagtatatattcatacagttatttttccaaagttatctatctttctatgaaagagaagatcagttttctcaaagagagccaaagacccatgaatacttctgcagagtagcattagtattgcaaggatgacatcagttctgtattcttaaacctaagattaaagtaggtcttggcagggcctcctgagagggaatctagtcttagccttggatttcctgagaaggcatatggcactcttctgaaagtgggatgttatttcagtttagaagctcttagtcaaaaaatattggatgaattaattgcaatggagacactgctttctaatagtggaacaaaaagtcatttcttagcttttgacctttgccctgaactggtgctgtgtgcattaggaaaagaaaatacacatttggtcttaagtcactgtttctactttgcacaatataactgattcagaccttgtgctctgtttctttcatttctcaaaggataattgtcagtgaccatcctctccaagcaatcaaagtaatagatcctaagtataagttattatttttcttatttctacttttgggggtgggaagtttgagaattagatcaaaacttttattgattgattcagcaaccagtaaacctgtaccaaatgttcacctttggggcctcacatgattatgttccctctagttattgggtggtggttgtcatcattgttttcaactgatttgcccacattatacagttttgacctggactgagtaacttatgtaaattccttaaattgctatattatagtggtttcaggtcatggggaaaaaaccctggtaggtactatgaacccttctatgtttatttcacttatgacttaattactcagattcctagatataaaaagtgtagcaaaacattgtattatgagttaaaataaaactggctttattttttgatattttatgttcagct

SEQ ID NO: 103536 - DNA, 1445 bp, Homo sapiens
cagtagtcagctggtttttcaaataattcgatacctcattacccatgtaccaggggttaaacattacccttattaaattggctagtctactcacctggtcttcttgccttggtgcatggtggcactctagtttctcttggaacctgagccaactctgaaccctcagccattttttgtcagtgcctcttttgagcttactggatcccaattccttttttgctttgagtttgatggtattcctttccatgtggctaggaaaagtgagaccatgccttgtcatcttacaccaaagcccttgaataagaacagctcagattaagctagtctgatatattcttaagacctgaccatttggatcttgacctccatctgcagcacataataagtcttttcccagtttctaccttgaacagcctttattttagtttcataatttctgtacccaggacttcaccatttccctgtatttccattgttgcatattgaggttatgcagtctgaagctcctctgaactgtttttcagaatgcctttccttctgcttcggaccatcagagcttcctagtttcctctattcccttctctcaccttcacatttcttttgttcccctttcctccaaccatagagtacacattacttgggaaaacccgattatataatattttagagcataggtcttggaaacatgtttatgcactgtcaaagttgcgtttccattcatctgtctctccccaggtaattagcataaatgaaaatagtgaccttttagaatatctttcaagggtggtagccaacataccaacccaggatactgctgagtaggagccagctggcatgaagaagcaaggacaagagtaaaccttttaagtgggcagtttcaaaagtatagaactaaatggaagcaagaaaaatgaggggagtgtggatatggtgctaattctaatgtggcaaagattttaaaataatacagaggcaatccagaatacattgagagccccagtgaattgttttctttaaatttcatgtcatgtgtagtcatgtttctcaatggacaaatggttagtggaccaaatgacattttttactcatccctgagtaaaaagtccaacgaatatagttcattagactgctgcttgttgtctccaaacagatcctgaaagttcaaatgactgggagtcagaacctaaaaatataatataccccactgttttggcaggaaattgagacctgcttttatcagccacttatccagaaagcatatgttctatataaatcaagccaaatctatattgtctgcaagtattcctgcaatatagttgatgttcataatgtgatccagatattttcagtatacttctgtgtattttgattatcacatgactttttatttatttgtttgtttgtttatttatgttttgagatggagtctagctctgtcacccagg

SEQ ID NO: 103537 - DNA, 1058 bp, Homo sapiens
cgctcagaagaaaagctagagtccccacaaggctccagtcaagcctgctcctaggtacttgtttgactttcatctcctcctgttctcatttctcacagctacttaggccttttggccattcctcaaatttgccaggcactttgtacagctgttccatggtattcatgagggggttggttccagagcctcttaaagatacccaaatccgcagatgctcaagtccctgatataaaatagtgtggcatttgcatataacctacacatattcttctgtatactttaaataatctctggagtgtttatagtacctaatgaagtgtaaattttatgtaaatagctgttatattgtttctggaacacgatttacggtgacaaggaaaaaaagactgtacatatccagtacgaattatttctcctgccccaaatatttcccattcatggttggttgaatccagggatgcagaacccacaaatatggagggcttactgtacttgtttcttctgcctgtaatgcttctctccagatatactcatgtcttcctcctggccttcaaatttttgctcaaatgtttcctattcaataaggccttttgaaagccattttactttaaatttttcatagcatttatcttctaaatattataaaaacaggccatacggccaggcacagtggctcatgcctgtaatcccagcactttgggaggccaaggcgggtggatcacgaggtcaggagattgagaccatcctggctaacatggtgaaaccccatctctactaaaaatacaaaaaattagccgggtgtggtggcgggcgcctgtagtcccagccactctggaggctgaggcaggagaatgatgtgaacctgggaggcggagcttgcagtgagctgagatcgtgcctctgcactccagcctgggtgacaatataaataaaaaataaaaaaacaggccatgcatggtggtttatccctataatcccaagactttgggaggccaaggtgggaggaactccttgaggccaggagttcaagaccagcatgggcaacatagtggtaccct

SEQ ID NO: 103538 - DNA, 1391 bp, Homo sapiens
gagggacactacctgtactagcattcagcatggtacaaggctagagtagagaaatgaaaataaggaaacctgaattctgttttcatcacccttcgttacttgagacaattacttaactgtgtataccttgatttttcaggttacgaaaaagatatattcttaggaacattcatggaataatcttagaaaaatgcatatcagtcattttagaaatgaagtagcaagtaactgatggctttatcataaaacttgaaagtcacagactgtgagtcaaaagatacagtttcgggtcttggttgtgccatttgtcagtgtatcatctttctgagcatgtttcctaatctttaaaatgggaccaagagattatagagataatctgtgaaagtttctggaagttcttttgtgtgaggcaaaaataagctaataacaacaccttattcaggtttcacgttagtcatttagtgctttttatcactattttgccactctaattgctctacacaattagagaactagacttaatagtaaattgaattatcacaaaatgtagacaatggctcagttcagataacatttaaggtcagatgccgtgataggtaccgtacttgacagtgaaaagccattaaaagattctaagtaggattgggagtagggtgaagtgaagtttataattagattttttaaaaagatacctacatagattagaggagagtaaaagtgcagagagaagttaggtgattgttgtgtaagagtctgagtgacagggaaggtcatgatagaatgggctggagggaagcggaactgtattgagagattcagaaggtaaaattgacaggatgttataatttagaagaggaccaggtttttgtaggagggaagatgaaagggatcatgggtttggttttggatttagtacttgggtaactttgagatgttcaagaggaaatattgcttacatggccacctaggtctggaaacagaaggaaagacagaggctttcctctattgtgagaaacctgcatgccccgagcgggtctcataatggcttaaaatgataacggtctagggaggaatgtagagcaagaagagaagttaatgcctggagaagaatgaattttcttttcttttcttttcctttttgagatggagtcttgctttgtcacccaccctggagcacagtggcatgatcttggctcactgcacccttcgcctcctgcattcaagcgattctcctgcctcaagcctcccaggtagctgggattacaggcacccacaccacgccgagctaatttttgtatttttaatagatatggagtttcaccatgttggccaggctggtcttgaactcctgacctgaagagatctgcccaccttggcctcccagagtgctg

SEQ ID NO: 103539 - DNA, 2669 bp, Homo sapiens
actaaccagctttttgaaagtttccctttgccctttgcccttcagcccagatgtctggaattgcaggaacctacttggctaacacaggctaaatttataaattatcagaaagcaaatgttaactgcgtttgcagagatggagcttgttcacagaagatgtatatgtatgtgtgtatgttcggaggggctgcttttcgtgcttctcccttcatgtttaaatatgaccttgaaatattattttctcttctctattgattttttttgtagtatttgtaagagctcagaacttttctgacacactaatgtgcattaagtagttttcgcctccctgtaaactagtcatctgtgcaggctctttgcagccttgtgggtgggattgatcagccctgttgacctgaaggatgggctgttctgtcttttgatttgtttggaagaggagttatgaaaggaagcaagttgaattaatctcattttcactcacttatgtttgatgaaagcagacagtgacagtctccttagttatttcctttgtgcttatgttacagttacttgtgtatttatctcaatttttttttttacttattaaccctggaacagagcttccctaccaatgctacatgccagattgagatagaaatatgccaagattactataccccacaacccttggagcagccagctggggcttgggagtcccctggtcactttgatcatgtgcaccctaatttgtttaccactttgtgctataaaaatatttcctatgtatgccatgacacctgaaggcttgggtagcactgcctagagggcaaaaagcaggtcagctctatctcttttattatttgtgtcatctagcccaatgcctttgtttacttcattgaggacgtgcagaaggagctatagcgaataatgcccagatacatagaaggaagccttggtggtcacgcattcagtgggaggcacagaggagctgctgtggactaggaataggagatgagagttttagtgtaggtttagccagtaccaagccatgtgactttcggcagtcatataactattctgagactcagtttccacatgcgtaagataattgaactgaacctcttctgattctgaaattccatgaagtgaattttatgtaacagtagatatgcctgaaaaatgcccagttctgcaaggatgtttaggtctaggtgatcagagaaaactgtcaaacatactgtatcacctcccttgcatgcttggtttggtaccagtaatgggtcaaaggcactctttctgagtattctagaaaaattactggactatgttcagttgtcagtacctctgaattggtgcagatgggcatttttagaacctgtagaattgaagagtaaaagttacagcttatccaagcattttcatttgtgtagttagatgcagctcattaatttgctcctgtgtgtctagaactctgagatagaatgctatcttgtgcgctctctatgctgctttgccagattttctccccgctttcctgttgagtcatcctcttttttagtgaatttggtagcgtcagttggcagcatgaggtggtgaaaagaatacgggtttcagaaacctcactaggtctaaatcccacccctgccatttccaagtgtatgactgttaagttacttaacctctctgagcctcagtttcatttgtcatatagggaaaatagtggcactcaggattgttgtgaagatttgagataatctatgaatatacttaacatagtgaatggcacacaatagatgctcagtaaataactagtacaagccaactttttgctttgaacatttgcataggcagactactcaccactccgaagtgttttctgtatcacgttgagggtatctttgaattcatctagggagaactttgataaacacaaactagttttttgtgaaatatttttcctcttagtttgtatgttaagtactcgtggctcgggagcccttgttaaggttgcctcctgatggagaaaaatccccattatttgttgtaaactttttttttttttttgcgttgcacagtactattaagcattcattatgtcatttattttccctctctcgccatcatcaaaaacagggaaagagacagacagatatgattcctgtactgaggcaacttacttgtttgatgattatgtaatttatatccaataaacataattatagaccacttacttaaattaccagaaaacaggatatgttctccctgtctgtgcagtcttagctggacaggcaccaggccctctcttattcatgctctatatggatgaacttctggattttattttgaactgttgttttttcatagttcaattctgtcttcttaataaatcagttcagccaacatttaatgaatgcccataatgggtagagccagctgttgcaaatacaaagatgattaaagattaaagacatagtgtgccctggccggccttagtggctcacgcctgtaatcctagcactttggaaggccgaggatggcggatcatgaggtcaggagatcgagaccattctggctaacatggtgaaacaccgtctctactaaaaatacaaacaattagctgggcatggtggcacgcacctgtagtctcagctactcaggaggctgaggcagaagaattgcttgaacccggg

SEQ ID NO: 103540 - DNA, 1159 bp, Homo sapiens
cttttggtaactagggtgaaattagtagcactctaactttatttataggacttggttagacagttgcctgagtgccagaaactcctgcaaataactttgaccttccctaacaaaaagtcaaaggataaagcgtttcatagtagaagatttcagttgtatctgacatacacaaaacattactttctaatggagaaatctgtaaccaaaaaaagcataaataattaaagattttggtaactgctaggaagaacataaacagggcacagtaacagagagtacgggcttgtggggaaagacctccaactagatagaggagtctggagagttttatttgaggaagtgatatttaagctgagttctaaaagataagaaggagcctggcttgcaaagaatgaaggtggaacgaggagggatttcagaaagagggaattaaggggtatgggggagaggaattgacacaaaatcagtgtctttagaatagtgattgagaggagatatggtatgaagtgaggttggagaagtgggcacatagcaggtcatataggaccttaaagaccatcataaggagtttggaaagaaaaatgtaatgtgatgccgtggaagtaggagagtgataagatctggtgtttgttttacagagtttctctggctgctgtgtgatggtgttttggaagggagcaacaatggaaatggggaaactagtgtgatattcaggaaagagatgatggtggcttgggttaaggtggtttaaggcagtggaggtcaagtgaagtcacacacacagaagttgctgtaggttggatgtgagggatgaggggtgaaggaagggtttctggctttcataattgtcaggtagtaccaggggacttcaagggtggtgatggtggagaattaaggacccaattttgggcatgttgagtttgacatgcttgtgtgacagctaagtagtcatattggagcatggggagaggtctctgctaggggtgtaacttggtagttattaacatgttgatggtatttgaagtgatgggaatggatgagacaacttagagaagatgactcaggattgaaccccaaggaacacttgccttttagaggtctgtcgagggagaagccataaaaagatactgaaacagtaaccagtgatgcatgaaaaaac

SEQ ID NO: 103541 - DNA, 1043 bp, Homo sapiens
aggcacagtaaaaacatggcattatcatcttacgggaccaccatgacatatgtgttccatcattgactgaaacattgctatgcagtgcatgactctattagagtatttcataatggtattttaagagcttcctcatccccctcccccaaggctatactgttcagtgtttcactgtatggataagccataattcattaaacaggagagtcatgtcttacttacatatctatacctgctctgtaaacgcattcattcatattcaagggactgaactcttgaatttgtgcagaatatttctcttcttcatggctgagtatcctaaccagctgagaggattttcccttctttaaagaccaaggtatttaagattcagtcatttcagaaataaatccttctaaattgtgttgtataactataaaatttatttcttcttaacagtaaaatagtgggcatttttaaatggttttaacacaggtatcagcatcagtattgtttaggaatataaaagagtaatatttcaggagcttttgctggttttgccttactaagtggcaccattttgacatatatcatctatctattttacctgctttttagattttttttctcttcatctttcttgtttcctatgttggctgcctctaacataatattcctttttcctctggtacttattccccactgcttcccagttccttttcttaatttgctttgtaaatttttggtggacaattagccagataaccaggacagaaatattcctaaaataaaaataaatagattcagagagaaggtctgatggagttttcctgccgatgaaaattttggaatgaatgttttggaattctggatacctagagggcctttttgcttcctggttattaccgtgttctaggacagctctgtctaatagacctttctgtgatgatagaaatgttttatgtctgccctatccattatgatagccactatcctcacgtggctcttgagcacttgacatgtggctagtattaagtaactgaaattttaattttaattaagtt

SEQ ID NO: 103542 - DNA, 1014 bp, Homo sapiens
ttcagtagaaaccaatgttcattcagtagaaaccatctgagtacccattttttcacttttattataatattcagtaaattacatgagatattcaacactttattataaaataggcattgtgttaaatgattttacccaactgtaacctaatgtaagtgttctgagcatgtttaagataggctaggctaagctatgatgtttggtaggttaggtgtgttaaatgcatttttgacttactatattttcaacttatgatgagtttatagggacaaaatcccattgtaagttgaagaacatttgttctctatttgggtttgacaacatccctgtaatgtaggcattattaactccattttgcaggtgaagaaactgagtgtatccatatttgactgtttctcattatacgaattcaagaatggttaagttaaaattttatttctatcattttggtgtggaatagttatggatagtagatcagagtgatacaccagttgacttcttggcctaaacatttgaaatagacatttcaagattctttgacagtctctgttttggtcatcaaatgtgcacactgttgatgtgcataaagctttctgttgtttcaagtgaaattgaattttgggtagagcacagtggctcacacctgtaattccagcactttgggaggtcgaggcaggtagatctcttaaggtcagaagttcgagatcagtctggccgatgtgacaaaaacccgtctccactaaaaatacaaaaattagctgggcatggtggtgggtacctgtaatcccagctacttgggaggctgagcacaagaatctcttgaatccgggaggtgaaggttgcagtgagctggagtcacgccactgcattccagcctgcgcgacggagcgacactctgtttcaaaaaaaaaaatcgagttttgatttgtaagttaaagtaaataatttattattgaaaacatttaggattaagttcagctgcatataacaatctcctcttccccacacagaatc

SEQ ID NO: 103543 - DNA, 1582 bp, Homo sapiens
agaccagcaaatgttgttgaggtttagagatgaaaggggttaggatttgctggagcagtaaaaacagggttcattaaaaattttatccagagtatggagtggggaagggctggggtgagatgggatatgggtcatgccactgctagtgaaaggaaattgaaaatggctcattggattagaataaggtacttataccttctaaaattgttgatggagtcataggcagagattgggaaggggagattccaccaattagcattttaagtgaggagtgtaacgataccagcagctaatgtaaacaacaccaataataacaacttaatccctgagatcacaatttttaggaaaaatttcttacatttatttatattttggctcccttgattagctttcctctgattagagaatgtggtatcctgtatattaaaatacctttactcttgttggatttttaaaagatgcaaaactttaagataaatcagaggtcgattaagacaccagtaggccttgttgccatttccatttcccatatgcattgattactgtgtagcagtattcctgatgattgttgaatatttatgaggttctctcccaaaaaagcccaccaagtgaagaactatctttcattttttaagttcctgaaaattacctaaaactcttctgtaggagatggcttttacaaagaagattctttccttctcccttcccccaacccatagtagcttaacttaagtacctgggggagataaagataaatgtgggaaacttcaggatgaaagggacattattagagaccagagaagtcccgggaggtcatatcaggcttaaagtggaaactatgttacaacctaagcaaggagcaactgataggtctataaatagggttttatctcctcctagaaaatttttgtcatggttatagctttccatgtgggggactattatatttactaaaaataaaccgtttcagaaataattaaaataagtcccactgaactcatttatgttattaaaagtaaagtcatagcctgaaaataagtttatagagtttggcatgtactaattttaaggaacattttgatgctgcagccattgcttatatatgggatagaatggtaaagcccaaatggatttgtatggattaaaatagattaccttctcagaaaataatgttatttcagtttttttccgctagttcagaagaccctcaacctcctttgcatgcattcagacacataagttggcattacaaatgaatcatctagggaagtgggagtacttctaattctccaggaatctcacacagtaaagctgcttggatatggctattcagaacagaaaggtatagaaatggacaatggtatcccttccattggtattccttctgggcaacaaaaacccttaagctgtctgagtctgtttctcacacttctgttatcctgattgtagccctttaaattgtggagcaaattcttggcatctgtctgcctgtcagctacctatctctgacacccctggatagcttgttttcttcctatgagtatatgtgaaatttgtaaaaaagcatctattaatttaagta

SEQ ID NO: 103544 - DNA, 1832 bp, Homo sapiens
aaatttcattgtggctgtaagaacaaagggaatgcacttttcagcagctccttactgaccagtcgtgtggagtccctgtagtgtactcagggagagcggctgcctctctgattctctgcataaaacaaaagtattttgtacatagctttgaaatgggagagagaaacttctgaagaaaaaaagagttgtttggggtaataagattttgaggaggcagacacttcctgcattctcccctggggaaagaatctagctacaattgaagggcattgcctcaactaatttagttaagtggccccgtcctggattaataacttgggcagacttcccaatggatttggcagggtattgggtttctctctccccaaaccctcccttctctctgccctgcacatgtgtgctaacataattacagaaagttacaaggggatggggctgctcttaaaggaggtggctcagaggagagaatgtgattgtgtagtcctgtcatatttccgaaatggcagagttcgagtaaaatggtagggtggaagcaagcaggctggtttctctctgtaatggcaaagggggaggagggttggtggcagtgtcgatttcaagcacctagagcacacgagcactgggtactaattttgtgctagagaaatattaaactgtctttttgcatttgtttgtccagattgcattactaaggatctggtcattacagaacaacctttttgattaaggtcagaagttaacagtttttcaagtttggtggtcaagtgttcagaaatatttcacagatttagttgaaaacctgagcagatgcttttgctgttgtttacccccggggatcgggtgacattcttctcccttttcctcttccccacccctttgggaaccaaccaatcacgtagaggaatggatttcagtgcctaaggagtcagccaactccggagctgtagctgagactgaatgtttaactcttaggtatctgaatcacagggaatggcagacattgcagttagcttgttttcttgttggcatctactctcagagcccatccctaagggattgttcctaatgaggcgaggtacattgcattgaacttgaaggaactggcttttagccccaattctgccagtaactagtattgcaaccttggaaaagttattttctctttttagacttgcttctctttatgcacaatgagaggaaaaggagaaaatgggcatgtatggtatatcactatatattccagtggcgttttatcgctagccttgaggtttaggggaaaagcatttaacctgtattgagtgcctattctgaagcagtttgtttttatttgttaccttattaaattcttatgactctgcagggcaaatgctgttaacccaattttacagatgagaaaagtgtaggctagagaggctgtccagcttgcccaaggtcacttaaggaaggcccatctggctctaatgcccagactcttccattccactaggctggctaaaaaggccctagaagtcctgccagcattttcactctgatattctttaactccttcacagcttttaatcctgccctgtaggaggaccaaacattactgtctcctctttcacagccccgctactagagcaagtaaatgacttagggattcctccatcacctgaaagcagcaaaagaagatggtacagcattcaattttctccttcctccataaagaaattcccgtcctttatagccagctctgcccaccccttcctcattccccttttcttagacaggcagatattttcttttctctttccctttggcttgtgattatcaggtaaatatccctggtttga

SEQ ID NO: 103545 - DNA, 1463 bp, Homo sapiens
ctcctgacctcaagtgatccacgcgcctcagcctctgaatctgctggaattacaggcgtgagccactgctcctggccaatcatcacttcttaattcctctatgcccactacttccccagccctatgcaacaagtggtctccacttttctacagattttgcctattctgtatacagtttatataaatagactcaatagaatatgtggtcccttgtgtctggcttctttcacttagcataatgttttcacttagcacaatccatgttatagcagtacttcattttttaattgctaaataatacttcattatgtggatataccacatcttatttaatattttttttttatggtgggaaaacatgtttttatgttgggaaaagaaaggtgaagagactgagacaataaataggattattttccttaatttaaaatgggaggaataggtgactactatgaaaaccaaggctatcaggctttcttgaggaattgcagctaaaggcctaggtgacaggacagttggcatctgctgcttcatgaattgtttgtagcagagtggcagctcttttgacccgaacacgtgcagtattcagggagctcattgtgtaaatcttgtgtgttggccagcaccattgccccctacaatacctcatggggaactggagaggcctttgctgatctaatctggatacatttccctcagttactgcagctctgggtccccagagagtcctctctaaagagctgccagtttgttgagtgctggcatttgtaagattatttcttactatatgattcgtccagtgaagatgacacccatttatgaggtcctgatctattaagcagaaatagcaaccatcattcctgtgtttttggaatgaatgctgactctagggcccctgtatgctttctcagctgtagagtttggagggctcctttagcaagcaaacaatgtgcccttctgggtgccaggtgactttactgttgttctgttgattcctgttaattactttcttgatttaatctccaaggaatagagataccttcataaaatgagtggtatggctcaggatgtaagtctttttaatttgtacaccagaaatgttgtggatggctttctactttgccagaactttcagtttagtttagagagtgaattgtaatcatttgtcttgataccctggccctttggcatgtcagccctaacactgaaacaagaactctgggtagaggacatcagcttggccctcagttcctgagccattgaatgtcagcgctacatttaatcatatcacccccgttttacatttggggaaactgagttccagagaagttagatgacttaccaaatccatagtcttattttcttatagctcttgctagtggcaaagctgagtctgtgatattgagccttcattctcagtggagtgcttttttcccagtgcagagctgtttcctgaagaacat

SEQ ID NO: 103546 - DNA, 1386 bp, Homo sapiens
acaaaagtaatttgcattcattgaagaaaatttagaatatacagcagatcaaaagaatagaataaaatctgccttaatatatttaactttatcttaacgttttgttgttgattatcttgtttcagcgtaactctgtttgcatatatacacattttaaaattccttaccagatgtcaatcatattgtgtaaacttttgtaaaatgcctccagctcaggcctactttattataaacatcgtttcatgccattagctatgtctgctgcatcatttcatggctgccaagtagtcccttgtaaggttgtaagcttttttatcataattcttgctaaagtccgtcttgttttgatttcatgatatgcttttaggaagaataggatactgagtgctttggtactatgggtaaacaatttgtccagagtggcttaaagtataaaattaaggcagtaagcagattttggttgagaaggggacatggaactggaaaggcaatactaaacatgtttgaggttaaagtgagcccagaaataagaaaacaaattgaagtaaaaaagccaaagtatcaggaatagactgggatctgtgagttagatgggttagaacaaataggaatactgatggtgaacaatttgatggcaccaacagcctgcttttattgttggctttttgacatagaggctgagctgccgaatgacagcatgagaaaaactgggcataagacttccataaatagcagttattatttattgaggaccttcatgaccaggcatcatattaatcatttaatttttataataaccacatgcaattagatacattagttttccccattttacagcagtggaaactgacagtgacatttaaagtaacttggccaaatgctttgattggaaccaaattagttaaaactcccaaacctgtgcttttatgctgtcgtttatcctcattctttttttcatggtgtggcaggtgtttagccactattctgtgtatatgtattgttttactatgtgagctgggacagaaggagactaggtgtgtaagaaaggacactaaagtccactagagtggaggtggacttgaagaacaaaacaaaactaatagcccagtcgttttcgtaggaaaggtgtaaacctgagctagatagtgcagtgagcagaggatgggaatagcaaagtgaatcattgataggaaggagcaggcaggcatttggaaacaagggatggctagaagaatcaaagttccctcattaaaatttccttcccaaaggaggtgatatactctccaagggcactttaaaacagctttattgagatataattcacatactgtacagttcacccatttaaagtgtgtggcttttagcatgtttacaatcattcagcca

SEQ ID NO: 103547 - DNA, 1026 bp, Homo sapiens
cccaggctggaatgaagtggcgcaatcttggctcactgcaacatttgcctcccgggttcaagtgattcttctgcctcagcctcctgagtagctgggattacagacatgcgacactaagcctggctaatttttgtatttttagtagagacagtgttttgccatgttggccaggctgatctcaaacttctgacctcaggtgatctgctcacctcagcctcccaaagtgctggaattacagatgtgaaccaccacgcggggcccattctttgatgtttaaaatgcttgtcaatgacttctcaaaactatatttttttcttcaattttctaaaattctgttgaaagacacaatgtcccattgattagcagaaacaagtgggaacatcaaaggagatgcttaagttgacaaatataacatagacaattatagatttaaattcagagtggcagccttacttttaataagagggtaaatttaaaatgacctaagggtttcttttcttaacaagtattttctttcctcaagattttttttttcttttttctaaccagttttttcatgggtagaaaatgaactttattttagtcaaatttttgcaatgaactttcaaggctttttttttattgggagctgtggacaacagcaaatatatcttctgtagtgctcatttggcttgattgaagaaatgatgactacttttcttccctcggggatagttggtggaatggaggacatggtaagtgtgttcaggttctagcttagtgcttttgagcttaaaaaaagactgaccccaaggaggcagttgcttttatgtcatgacccagtatacacacatacatatatgttgactataacttagaattagtcttaccaaatgctgcctatcttaaccatgttctaagtactgtgatattttctgtccccttcaaaaaattgtcgattgtgactaacgattgaccaaaattgatttctgctggatttttcctggacccactaatggattgcaacctgtttgaaaaacattgttc

SEQ ID NO: 103548 - DNA, 1192 bp, Homo sapiens
ttgagctcaggagttggagaccagcctgggcaacatagcaagaccttgtctctactaaaaataaaaaaaatcagccgggtgtagtggtgtgtgcctgtagtcccagctactcgggaggctgaggtgggaggattgctggaacctgggagattgaggctgtggtgagctatgattgtgccactgcgctccagcctgggtgacagaacaagaccctgtctcaaaaataaatgaataaataaacccaggcaggattttagattgatgatacaatgtagtggtttagattcctagttgactgtttgtgatttgtgcatgtgcttaggcgtgttcccaggccttgattaaggctagaatgttttatggatttgcagtatttttaaagtgggagaatacttatgtgcatcagctctagggtttttatataagaagagcttaagagcagcaatctgattagaagagggccttgttctgcacagcagccttactgtttttgcgaagattatttatatgggatggctcttaggggtttcctagaaagtgatgggggtcctaaggctcctaaggctggcccctcgctcgcttttggtgcaacaactttatgtctgttataaataaggtgaccatataaactttagcattcaagttggggcacttttgagaataaaaagtgatgccaataattagtttcaaacagtcccaggtaaactgggatgtatggccatccttctctaattgaagaaatacagtcagtgttttcttaaccaaagtgatcagaactagtaggccgtgggttaatctaaacaattggttgaagtggggaaatattttaaacttttattttaatatagagcatttttaatttaaacaaatatatgcttactctttagtttcctgatatgaggtcaagatccttatatatagatgtgattgaaatactacttgaattttttgcataaactgtgctcccagagcatcatctgtgagttctaatttgtttttttttttaaagaggaacacggtcttgatgacattcagagcaatttgggtgaaactgtctatctagatttgtatggttttcccttcttgcccggtcttttacagttatcctgcccacatctaatttgagcctaagttttcagtgtcttgacttatttttcacaaagcattcacattagttattttcaaggaaatt

SEQ ID NO: 103549 - DNA, 1831 bp, Homo sapiens
gtcaggagtttgagaccagcctggccaacatagtgaaaccccggctctactaaaaatacaaaaattagctgggtgtgatggtatgcagttgtagtcctggctactcgggaggctgaggcaggagaattgcttgaactggggaggtagaggttgcagtgagctgagactacaccattgcattccagcctgagtgatagagcgagactttgtctcaaaaacaaaacataaaacaaacaaaaacaacaactacaaaaaaacaaaaactaggatggttgataatcaatagtcacctatttgcaggcctttcagatttgagagtatttgtccaattcttgcacttttggtgctgagttgatatcagagtggccccagataaggcatcgggagaagaagtgttgttagctctgtgttcatcccctactgagttcatcactgttgatattgaagatggaagcttttggtaaaagatagggccatttaccctaaatctaaagagaatgtaaagatttatttgtttttcattctggtttgtgtctgtcctagagcttctctaagctgggaaacttatgcctttgatagtacttttatatcttagtcatatatcagaaaaacattctcatacctggagatccaccccacggagtttctgattgggtaagtgtaagattgggcttacccattcaaatgtttaaaaatcccaaaggtgattctgctgtgtagtgcggttgagaactacagtcctatgggctgctttaaaagcagtgacagtttctgtttcatcctgtacttttcacttaggacatgtaataaaggggtcgtggttagtctcttaatctagtcttgcaaactaatgcagttactttattatttataaaatgttgcttattgtggatttaggaaggtaaagctaattgatgtaaagtatggaaatagacttactgagtttagaagactgaaagggtactgtattcttcttgtggggattatagatcaataaggagctaagcaaaaggagttaataggaatttattaaagcctaaaaaagtagtctctttgattgtacctactttttctttcttttgcagtaggggcccacttctgtaacctgcacattcattactcatgctgtctctgctgcaggcctgttacagaccctttgccatggtttaaagctgctgatttactttgaggcacattctgatggtgacaggtttattttagtttattttcttgggctttaatttgtactctggttggatctttgaattagagatcttagagtgtgcaaataggcaaatattgaatagctgcttgttgtatttgatgaatacagaatccaaatgagtactgctaattaatgcgcctaaccttgtgaactctcactttgcgttttgagatttgggaggcatttatcagcgtgaaacactggtcgctgaacagtctgagctggcggaaatggaacttgtgatctttacgtctcctcagcatggttttggctcagcaaatcgaggaactggggaatggggtgaaggtgaattttaattgtgcttttgtttgctttcccttttttttttttttttttttgttgttgttggtttggtttggtttttgagacagggtcttgctctgtcacccatactggagtgcagtggcatgaacatggctcactgcagccttgacccctggggtgcaagtgattctcccacctcagcctcctgagtagctgggaccacaggtgtgtgccaccacacccggcctgtttgctttccttattctttcactgttccttcctaaatagatgagaaccatctgcagacaagattcttatcag

SEQ ID NO: 103550 - DNA, 1529 bp, Homo sapiens
tagtggaaagtttactctattgttatattcaaaagtcctatcaatgaaaatttcttttacgctgttctgctagtaggaatgaaagtacagtgaatggaagaagaggatgaatatctaagtagcaatgttgagcactttgaaaattacaaaagcaatgtatgttctcatttactccttcgtgtgcacgtgcatcttccctcatttaaaagttcccttgaaagcaagggccttatttttaattcatctttttttactccatcagtcgactaacagtgcttggaaaatattaatattagtatatattaactgaatgattgaatgggtcaagtaagctggaaatgagtgttcatgttatatgaccttatactaaattagggtttgcatggcttttattagctatcatccttgccctcaaggatcttgacttagtggtttaaagtgaaaatgagacagatactcaacatgatatacctttaaaaaataaggttaattagaatcataagtaacataaaaagtaagctgcacaagtaagctaagtaaatattaaatattaggaggagtcacttgagtccataggatgatatagagtagtagaggaagtcttgaacagaggtcagatttcatccagatttcaaagaactgaggggataaaacaaaaaataaataaataaaaaagtaaaaactgaggggaaacaggctgatagagacgaagacctaaaacttttctgggttaagaggcagttctcagcagggttggtacttgtcccctttccatccaggggacatttggaaataaaccaacaagtttttggttatcctagtgtttaggggtgctaacggcttagtgtgagttggggctggggatgctgaagtcccacagtgtatgatgaagttaggaattaactctgaccccagtcgcagtagcaccctgcctaagatatactggaaaggaaacagatttagctgcataaggaagaaatagtttttatgaatagtgctcctaagcaaatactgttttttgtttttgccagtgtagaggcttaacgaggagatatatacacttaggtagggtggaatacagttaatggaacattttaggaaccagggcaggaatttatatttgatcagtttggatgattttgattatgcctaacattttctttcatctcatggtttgatatttttcttgtctttctcatagaacgagcctctgactccaggttatcatggattcccagcgcgggacagccaggttggtatctgctgtttgtaactcagatgatgtatgtgtgtggtgtgtttcatcaaagggttgctatgatagagagcatttcctgaaattacttactttgaaaggaaatgtggcttgtttcagcagtgaatttacttttacagatgtaaattaagcatatttttaaattctataagtattatgttattaaaattgtggatattagaagagaaaataatcactcaagcacagtcatgattggttttgtattttcttctccaggctacataataatttt

SEQ ID NO: 103551 - DNA, 1102 bp, Homo sapiens
tgtgttatatatgcctgaatatgaggaaaccatgaatataaggccttaatgctgtttttccattgaaaggaagggctaacctattaagcgtttagggaaataggcaaatatctacttaaaatatttatttatgtaatttagaaacattttatctttttgggaaaaaatgtgtatatgctctactgcatcagtatctgtattgttgcttagaaccactttgaatcttcagttttccagagtatatattgagatacagcacttttttgtgtctatatttattgtagtcactgatgattttatctcaagctgtaagtacttattcaaataacaacaggaagtttcttcatttgtactgtggtgtatactgcattgcttttaaaaaaaatgttaatggaggttaaattcatataacataaaattaaacttttaaaaaagtgaacaatttggtggcatttaatacgttcacagtgctgtacaaccactatctccatgtagcttacatttttacatcaccctcaatggatacatcacccgtatccattaagcaatcatcctgtctttccccttccctgctggcaaccaccaatctgctttctcttttgatgaatttacctgttctggagattttatataaatggagtcatataatatatggccttttatgtctggcttctttcacttagtactgtgtgttttcattgtttatccatgttgtagcatatatcagtacttctttcctttttataactgaatgatattcctttgtgtgtatatagcacaatttgtttatctgtttatcccttaatggacgtttgggtttccatcctttggcttttttttttttttttttttttttgagatggagtcccactctgtcgcccaggctggagcgcagtggtgtgatctctgctcactgcaagctctgcctcccaagttcatgccattctcctgcctcagcctcccaagcagctggaactacaggcacccgccaccaggcccagctaattttttgtatttttagtagagatgggatttcaccgtgttagccaggatggtctcaatctcctgacctcgtgatccgcccgccacagcctcccaaaat

SEQ ID NO: 103552 - DNA, 1628 bp, Homo sapiens
ctagtcccttagaaagggccaccagtggagtctcagtaccatctcatctctgtgggctcttcttgcccttctcccagctatcttgagtatttaattgtacttgcagaaaactaagctttacacaatatatatatatatatagttttctctatctgtttctgcaaaatgccttttacttaatggagactattatctaagagggctagaagatgaagaactaaaggatttgagtaattgagttgatacaggaatcaaagtataacgagatatgacaggcagctcttttatgaattcttaatagttgaccatttgtttaaaaaaatgtaattcctggtttttaaaacttggcatcaagaaaaaaaatcctcggtaggtttgaagttgtttgaagtcttttagattggttccaagcaagaattaacgtggtaattatcagaagatcactgaattggtaagtaatgagcattatcttctttctgaccagggaattaatacaataaaaggaagttcagggacttgctctgaggacactagtagtaggtggcagagagtctaggtcagagagttggcagttgtagccagtagggcattggaagcaacagcagcaggaggaaatagaaaagtccagttttacccagatcttaatggacttagggataggcaggattgtgaactcaaagcatataataaaaattgttacaataatagtttttctctatggggtaggtatactttcaggtgctttgtataccttgtgcctaaacttaacatccttgcaaggtgtagacatgatcacatatattttatagaccagaaaataaaattgaggcccagaaaggtgagtaacttgtcctaagttgttcctctaataaacaccagagctggtttaacatcatgttcaatagcaatgtgagtgaagagactgttataaaactcaattgaaataatgtctatcaattaaaataaaatttattattttgtctataatgactttttttggggtagaattgttaatttaaatttagactgtgatagtcaactcagcctgtcttaaagggacttttttgaatgttgcagaatgatcctttgaaatgtatttcttttatactctgaggctaattaagaggtatcttttgtttttttaaatgccaaagcttgtgaagtcttcagtttagtgaaacaccagtttaaattgaaatatcacaacacaaactgatttgttggtggttatcaattggcatatttagtcataatgagtattcacataattgtgtctgttagtctgttattccattcagatccagatgtagataattatcaatgattgcacagagtgaatcatgtatttagacagatttctaagttacggttggaagaactacaaatgagaggacttgggttccaggcctgtttttgtgaccttggacatgtcacttgaaactcaagggaatgaacctgagtttccattatcaatcaaaagagaataatgttatctatctaacagaattgttatgagtaggaggatgtgcttgacaccaatttctgcttcttagactagctctgtaaccttgagaaagacatttaaaaccttgtggtacattggttttcttatctgtaaggtcagtctg

SEQ ID NO: 103553 - DNA, 1038 bp, Homo sapiens
ggaagagagagtgatgtcatcagattccatggaccagcccaggaacccctgtgaggttggtggggagttgggtgtgtggggggtggtggagtgggagtttgtgcaggggaattgtggcttcagtaaggtgtggggagtccagttcaagcagagaggtcggtcgtgtggaattgtgctgagctgcattaatgcctgatttaaaaaaaaatctggaaaccattctgaatttgcagagtattttctttgttgaaagaagacatttatttaacaaaggagctcatctagatgtagcaatgtaatatctttttatagttgtatccctgaagtatttgtgtgtgcctttatcccttgtatgtgagggtatttgtgtgcatattttagtatatagttgcctttgtacaataccttttatggtgctgcatgcagttaaatgcttcattaatgcctgctgatggtattttttttatatggatgggtgtatataaataaaacacacttaaaaataatctgaaaagaatatcaaagcagttgctttttcagcagaaaggaaaactgcatgcttcaagacagttgttctgaacatatgcatgtttgtgctgatagtgaagggcaaatgtgtttcttttggtatgactaagaggctgctttttttttttaaacaaatataacagaacctgtgcatccaaatgaatattgcccttcaaaatagtcaccttggttggtgatacaaccattgcgcaaaacctgaggaactctcattcggaatcggctttagagatgagtgatgaggaaaacgttttcaatacctaacactgaatttttttatttaaaaaaatacctacctaggtttttgaaagacactaggtttcttcgaattggctcttcgtgattttgtggtgttgtcaaaaagtcaaatctgtgctcaaatggtgagcttttaccccatttgaagatacttaaagtcatgggtttaggctctgaaggcattttcattttcagatcaagggctctttaaatgtttagtttagcagtggccgt

SEQ ID NO: 103554 - DNA, 1393 bp, Homo sapiens
ttcatcctttgctgttttccacaacagttataaagctttttctagatgcctgtgtgttaactagaggcatcttgactcttttgacttctctaattgttctaaattgtttaagttttctgtggggtagatgactgttattatactaaattattcttctttcctgtcttttttttttttttttttttttttttttgctggagagttggtgccctggagttgagtctctgctttgcaaactgaaaatacaattttcctgtgtgtgccttatttttttcattccttttctccctttcctactacaaggctctgacctgcttggagcccttattacttggtcacaattgatactttgtccttcagagtcacataggacatagccactgcgttgattcagtgctcagctatcaaatatggctctgagaaggaattacttctctagaatgcaaagtgggcatctgagccagagaatgaagccctggtccatatttagtcattatttagggagagtgaggagtaacaatttcaaaattagagtttggattaagcaaagaaaatactagtcacaaattggctggtgtatgaggtgagtagagctggatttttaccagaagtagaaacctttgtaggaactgcctgtggttcaagaagttatgtatattttatggtatatctatgattatgaaaggataattttctaaaagtttatgttcttcctctggggattgttaacatctgttaatatccacaggaattttactaataataatgccaacttactcttgattcagtccctttgacacagggacccaaactaatttacattaattttgtcagtaattcttataatatccctgtgtgggagctgctttttagatgaggtatgtgagaatttgttaagtttacatagtgggtcagtcccttggatggaaagttggacccaggatttgtgcttccaggcttagtgtgtttgatcactgaagtgtgcagtctttttacctaattctcctccccatttattcttcctatgatggaggaaatcatatcaaggaaatagcaggagaattccatcttctaagaggttaaagacttttctgccttgaggcgtggagttcccaatccttggcttaggatggaaggaaacagcggaacactgtgatgttcagctgaaatgacccaactgtttttttgcatagttttttgttctctttttaaaaattctcctgttgggaggaggtgaatgtgagaattttctctctgccaatcttatatgtgaggcaggtggcttggttgtttttaatgctcagcagatatcactacttgcttttgggttggggaccagagaggaggaggtgaagcagccacttttgggtggggttgagaggagggtacaatg

SEQ ID NO: 103555 - DNA, 1059 bp, Homo sapiens
cctgtattcttagctacttgggagggaggctgaggcaggaggattgctttagaccaggagttaaagatcagcctgggcaacaacatagtaagacctcatctctacaattttttttttttttaaagttgactgcgcataatgccatgtgcctattgttccaactactccagagtctgaggaaggaggattgcttgagcttaggagttcaaggctgcagtgagctatgattgcaccactacactccagcctgggcaacagagcaagaccctgtcttttggagggggaaaaattatatgtatataaaagaaagtaaaaaggcaaactacaaagtaggagaaagtatttgtagtatagggatctggctagtctctagaatatctaaataacaactacaaacccatatataaaagaagttcttttaatgaatcttttgaacaacccagtagcaaaatgggcaaaatatttgagtagttacttcacaaaagatgatctccaaatgttccaaaaaatggtcaggatcgttaatcatcaggctaaagcaaataaccacgatgagatattatcacactacctccagaatgactaaaatgaaaaaggcagacattaccaagcattagtgaggacgttcagcatctggaaccctcatgtactggtggtaggaatgtaaattggtacaactttggaaaactggcagttggtagtatctaccaaagctcaacgtaagtgtaccctataaccagtcattccactcctaggcatacccaaccgaaatgtatacatgtgtgcactgaaagacatgtgcaaggatttttaggaatagcctcaagctggaaatggcacagaggcctttcaacattactgaaatatttttcagtaaattatgatatatttataagatggaatacactcaacagatggatcagttttacagatataatgtggagtgaaagaagccaacacaaaagaatgcataatgtgcaattccattaatacaaacttcaaaacaggcagagtgaatttatggtgttaaataaagtcattgtgggctggtgggagtga

SEQ ID NO: 103556 - DNA, 1236 bp, Homo sapiens
gtcaaacctttgtctgttgttttgcatcagaggagtgactttgaacattttcctgataaaagagttttaattccataagcttcttttcttcttgtttactaccttagctcaagatcttctcttaagcttactgacagagtcttgctttatttcagaaaatgtgcttaagacctggaagcccagtctgtgaagcatctggtttaccttgacctgtaaaattatcagactgcttcttttccctcccgttctgtgtgtttaagagaggcgcataattctattttgaggcttatgatagaataggagaataaagcaaactcgatgactctgtttactttaaaaacttgttgctcatctaaattggttgaatgactatcccttcccttaactaaccctttcaacttttcatcctggattgaccttccctaaatttatctttcataaaaagaggccatagatatatttgatctctaacccactgggactcttttttaagtttggcttttggctttttttttggtaacctttttctctaagatcaggaagaaagggataagaaattgtggacaagaaaattggaaaacacttaagaaaaagtttcgggttgtgtgggtgtgtgaaagcatatgtgtatacatatacatgtttttcctttcctgccccactgttctctagctagaatgacctagattttttttattctgggaaaaattgtattatttctggattctgctgtttcttttaagtagttggactggaagatgctggacttataacttacatttttaagttctttcttgtactcttaagaaaagtggtaaatggtacggattttagatgtgtgtactggaaacagtagcactaataaggaaatgcctttgtcctcctgttctttgttgaaatcagcttggatagctgaggatggtggagggttatttattatttttgggctccaatgtcaaaattctcagttttatttaaacactcaacacaattgatatttgagtgtcatgcaattattagctaaggttagtattcacttaggttaggaaacatctcttaccattttcatctcttgtagcacctaacacagccctgggtgcatacgaggcacttgataaaagcttgatgagtttaatttaatgtaatcttgcttaattcatagattgagttgtttgacctattaggtggaagaaaacatcattgtccttttttttttttggtagggtattttttttt

SEQ ID NO: 103557 - DNA, 1050 bp, Homo sapiens
acatgccagcatgcctggttaattgaagagtgtgtgtgttttttttttttttgagatgggtctcactgtattgcccaggctggtcttgagctcctgaccttgagcagtcctcctgcctcagcctcccaaagtgctgagatttcaggcataagtcactatgcccagccacattttttcttgagctaaatgtacaatatatcctctgatgaaaaattttagtgctgtttctaggtagcgaggatgtctgggagatagagtttggatgctgaaatatttgatttttttgggatatttttgatgctataggaataatgtgtcagggtatttggaattgggatagcataagacaagttacatggtcacccttcttgagtgagtcttagcaatatagcattgcaaccgacggagaattatgttctcaattcaccagtaggatctttctcactgtgattttttaaaatcccccatttgactaggtgtaaagaagagaaggtagctaagatgttgtttgtttttcgagtggctcttatttgccaggtaccagactcatgttatctcctacaatttatcagaactctaggataaatggcctcaagtccatttgcgggtgagaaaactgcacatgcacagtgtcacacagctagctttgtttcagagacagcctcaacccattgtgttctgggcctaaaggtgatacatattcttccacattctgagttatatataaattccaaacccttctcagaaagaaactcctttctaagggtaatgtggtagttaaaaagatttttaaaaaatcactttaaacttatttttattgtcatccttgtcccattttaagcatactaacttcctgcctctgatatataaagagccgatgctggagagaggaaggaggcaaaccattttgtcatgtttatggagagacctcaaggctctaaaagctgcttttatttttttgagacaaagtttccctctgttgcccaggctggagtgcagtggtgcgatctcggctcactgcaacctcgacctcctgagttcaagtgattc

SEQ ID NO: 103558 - DNA, 1491 bp, Homo sapiens
ttcatttaaatgcttaaaaaaagcaggccacttcaaatttctaaaaatagcatttaaaaaaccccaaaatgatctaaaaagggattttagttgcatgaagactatactgtttggggggtttctgggctctagggaggatgctagctctctgaatgctttatgttcttatatgactcatcttgttagtggtgaccccagaagggcagtgggagaaatatgttccgaagggtgatttggaaggaagggatgatctggaaggaagggatgagaaggttgcaggcaggaaaactgagctaagtggttttagagagtgttttttttttttttttttttttttttagggagaaaaagaaaaaaggaaaggctgctaggagcttggtcctaactgattccagatgggcctgctacagtacaaaggttttcagtgtgtttgggatggggctgaccaagaaggccccctcagcacttcctgtgcagctctgcaattgtatgcacctaatcagaaacagcccttactgctggagctcaagagcaaccgtctcatgttgtctttgtgcctcattctgtgaactgctccctttgcctgccctgtttacctccctctcctagtctcttttcctttctaatcttttctatatttgttttcagggaatgttaaaaggaggggagatatgtatatataaacataaacatatgtatatgtttcttgtgggttgggagcagagaagagagggaggaaggaatggccaaattaaacgcagatggtgaatatttaggaaaggaatttttttctggacctgggaggcatttgctagaaatggggattgggaacatgagaatgtgaatgagacttggaaaaacaagccactctttatttttcatttttttgaatcctgcacacttgtctgaatggttcaaaatataacattgcatggggatggtttatttacattgtaaactgagtatcactggccctgtgtagctgtgtgccaaagggtgagtgtgacagtgactttaaacttaaaggaagtaggaaggtgttttgcacccacatcccatgtagtattgttgccaggggagcatacctggtgtgctctgacgtgggcttgaatttggccgttttcccacctactgcagtatatcaggcactctgcacagcttaaaagaggatttttttggtgacactcagctgcaggcactatgaattgttcttttgtgccctcctgattccaccagggatatattttatatatatacttgattttctattttgcttctattttggttgcctggttagactgagggtatgcctggtattgactgttagttttttgggtctagctgatgattacagaaactctgccatcccaggggtccatttaggtctttgcaattttattctaatccactcagctgttgtactgatgttgttgcgtaaatgtgagcttattaggatagactatgtaaaaatatactgtgttggcataaagg

SEQ ID NO: 103559 - DNA, 1637 bp, Homo sapiens
ttgggagtcagccgagctgccaagttctctgtgcctaatttgaagtgtattaatgtttcaggagtgggccagatctcttataggcacctcctacagttcagctttccacgttccaggaggaaatgtgaccctgctgtttcgggaaccccacctcatgtagtcttaatttctctccgaatgtgtttgaagtcttgccagcgtagagaggggaagtttaacacactaagagaatacatttttagggagcctgcccacaaggtggtcggtcccctatgccgtggccaaggaaaaggaacccactcatccttcaggttacttaatatatgagattaaggcctcagcccatataggagtaattttctcttcttctggatgtgaaatggtaaaacaggccctttaagaactagaccatttttagttgagaggaaaacattgatcacattggctccagataagagcagatactgtgtgtacttcctggcaaaaactttgtatgtggttcacagcaattcctgccattctggttgtgtctgaggggctgacaacagacagttctaatctaatctcaaaccttttacttgctggactggttcttaatcccagaaaccagcctgaggtcaagaattggttcctaattgccataggtataaaggtggcgctcctattgagggagttttcagtgttcctgctctggttgtcaccagtgtggcttgggagatggtttatgttggtctgtcccccctctatggatataaactaattgttaaacagttactgactcctgtaagtttagacagtttatagcgccagcctttaaatttcattgtgaaatataatcttcagatttattagaacagtttaacggaagaaaataagagaaagagctctaaaaaggtgtagactgtcaaagaaggctcatggaggaagcatcagttagaggactctcacagtactttataattacctcatcattatcaagtattggactaacattgtctttgaacatctctctctgttgcctgtagattataaacttcttgaggatagggcagtttctgttctttttttgtatttgactctggccttcttgatcgatttggtaaatatttattgagatcaattaaaataagatgctttaaaactgagcacaaaggacaagttacatttcagtagcttagtagtgaatttaattctgcaggtcttggtgctgtacttctttggtgagtttgctgggcccagatggctaggcttgtactttccttagacattttaatggcctgtcttggttgtgatgtctctaagcactaggaggacagggaatatggctcatagaagagggtgccaactgagagcctctgtccattctctccacccccacacaactcctttctgtacagtctttggtaggtaataacatttctttaaagtgatgattcctaggtgaaaccggaggccagttttgtgtgtactcttatgttttattaggtgtgtgggatttgaggaagttgtggtgctggaaagaatctgccttgccccatattactggtgaaaaaatagagacctaggaaggataaataatttattccaagccatatggctacttagtggccatcaagactattgtccaggtctcctta

SEQ ID NO: 103560 - DNA, 1041 bp, Homo sapiens
tgcatattgctactagagtgtccttgcctctaggctgtctcagcaaacagctagaaattgtgtgtatgtgtacatacatatgtacataaacacatatataccacatatacatctatatttccatatctctttgtgctatatacgtatatatacatgcatgatgtttgtgtgtgtgttacatattttaaattataaaacaatgcattttatattataaaatcatgaattcacactgataactccattaaatgcagccaacctctttccatatttgtaaatatattctccagtagggaaaaacttggctccccttatccccaatatgtttacttatttgctcagtgtagccagttttccaaccgcgatggctgactccaccacctctgtaccctactcctcatgttctggaatcctcagtcaatgggctcctttggcccattcttccttgtggcttcctaatctccctagagtttcccagctttacctgtagtcttccagtgccccctgacccccaaccactcttatctttggcctctgggcctgctgtcctgtgcatccttgattcctcagctgctcacctacctgtgtccttggctgctgtgctaactcctctgtgacggaagggggacagggctttttttttttttgagggggattttatacgtatacacatatgtatatgtgtgtgtgtgcatgtatatatatatatatatatatatatatatatatatatatagttcattcaggtataatttacatgcagtaaaattcattcttttaaggctacatttctatgaattttgacaaatgtaatatagacatgtaaccactaccacaatcaagatataaaatgcgtccattaccgtagaaagtttcttcaggctctttcacagttagttctctcttcgcatccgcagccactggcatcactgatcagatttctgttcctatgattttgccatttctaaaatgttatataaatggaatcatgtattatgtagctttttgagtatggcttctttcacttagtgtaattctttt

SEQ ID NO: 103561 - DNA, 2541 bp, Homo sapiens
aatcttacagatggtgtcagagataaacagagtgtgcctggtcgttgaggaggaagagagcttggattccaaattattcatcgactctagctttctagtcacatgtaatgagaaaacattgtacttgaagtaaaatggtcatgggtcatagttctagattcccactaattagttgtgttcatttagttcagttaaccaaccatttatcaagtgccgaacactgttggacactggagacaaattagatacaggtcttgccatccaggatttgatgatctaggaaatttttttgtgtagccgtagttaagcagttattaacatctctgggtcattctccatttgcaaaatgtggtgatatgatgttatttctgagattgcttttagctctaacatcttaccacagtgattcaaagtaaaatctaataagaatcagcatctcctaaaagtaattattatagttttcttcaatagaaaaaaaaatccaggtaaaaaaatggccaaggggtctaaactgagacaatcttagaaacttactatatccctttcctgtcttacttttctatcaggttctgtttgattttgacaactatagttaataaggaaggttcaagagcagatgcccctggtagggggcgggtagtagctggtggattagagctaaagtagagctggtaaaagcctcctggttgcagagctgagggcagattgggcaggtgcactactaaggtatggttttgagatctactatttccagcaccttgttgaaaagttgatagctacattcatcacccaggtgaagtctaccataatgaggaaaaaattgcttatcttgccagcagccctcaggataaacttaggagaactggggagatttgtttttctgatgattcttggattttgtagtgcagtcattgtttgctttgctgccttgtaggggaggaagggaagaggctaaggggagagggtgggtgaaacagctgtcaaagaaagaggagtcctgaaaagctatttgtgtttgggagctggagctcaatggtagggctgtggtagttttgtaggccacactctcttgttgctgttttgcttttgggacataacactaataaataggattagtggttttttttttttttaaacgatacccttagcttgttagagttaaaacagcttttgttctaaaacactctatcagagactattaaagaatgatttttcttatataactgttgcactcaacatgttccattgtagggactgtagcatggtttctattcagatatcctggaccctcagacctcaaattaccgtccaaccatttccttttctcctacccacttccctgttcattctgcagttcttgtaatcaccccagcaaatgtttatttagcgcccgtatgccctgtaccatgctggctgttgaggatgtggagggaggcagagagagagagacagtccatgacctcaggggctcccagtgtagtagggagactggtaccaacaagacctataatgtggtaagtgcattaagagaattgagtaaatggggagatggggggaggagggtctaaactagctgggaccggtggaagtcagggaaagggacctgggggatgtaacaggagctatccttctgtgttttaaacagtagaaagaatagagaaatactggtttaatgggtagaacacagggtgggggaattaggactcttccttttcggtcttttgtgttcaaaagtatagcagctttctttgcttcttgctcctagcatcagattatctattcccctggaattatgtgggttggagaagaatggaaaggaatttgcccacctgcatggagagagagggaggcagtagggatgtgggtgtttaaaagcccttggcatgattggctgtaagtacagatggctatttgtgttaccattattgtagctgttatgcctacattccctttggtgtgcctctctacagggataattgtggggtcctgacttataagtcttcctgctgctggataaaatagatgctgatgtgttgtgcgttacagggtatacagtgaattctgtgtgggctgtcttcttactgctgccttgatcttttggggcctcaaacataaggggaaaatgactaattttgtgtgtgcaaattcacattggtgaaaaccagtaaaaccataaaaatggttatattcaattttcctaagggattgacctccaaatgaagctaaaattaactttggtgaatgcttatatttttaaatttttaattctaattttttttttttttttgaaatggagtcttgctctgtcacccaggctgaagtgcagtggcatgatcttggcttactgcaatctcagactcctaggttcaagggattcttatgcctcagcctcctgagtagctgtgaccacaggcgggcaccaccacacctggctaatttttgtatttttagtagagataaggatttaccatgttggccaggctggtctcgaactcctggcctcaagtgatctgcccacctttcctcccaaagtgctgggat

SEQ ID NO: 103562 - DNA, 2198 bp, Homo sapiens
gtgctatgtggggtgtctgtgtctgtgtgtgcacatgggttgtgcctctatttaagcatacctgattgcctataatagtggtatttattaagctcgtgtgggcagaagcacaacagttcagcccaagattactaaaaatatagcggactggctgcttttataatctgagggagaggttagaattggtcttttcattatccaggctgcattttgcattttctttctgagcaacaagggtttgctgcctgaggaattatgaggaagactctatctatctatctatctatctatctatctatctatctatctatctatctatccatctatctatctatctatctagagatggagtctttcctgctttgttgcccaggctggccttgaacttctgggctccagtgatcctcccaccttctgtgatctgattggaacacttgtgaaggagactgtccttttctctttctattctttgaccccgttgtctcctctttaactgtttttctttgagaagatatttcatttagagccatagactgttagaattagggaggacttaaagattatctagtcaagaggttgcaaactataggcctttggtgtggctcccacacatgggattttgtttggataacacagtattttaaaggcctttggatttaacatttaaacattgggaaagctcacatgaaacccagatttgtggcttcacttggcagcacggggcccacattcctacatctgacaatctgcaggagctaaatagtggctgttctcttttggaatgacccgtttgcttcagtattgcacagtctctacctgtgcacttcactctttacctctggtgagtgttacaatcccggtctaatccagtctacccattttacagaagagaggaagagatttgctgaaaacctagtaggtagttggaacaacttagggtttgtgtctcttgacttttagttgattacgattatttctactagtattttacttttgcctttcttactctttttttgttgttcattcaaaatattcattgtgtctgtagcaagagtcaattctgagagtgtgaaaaggaatgtgataaagtctcctttcttgatttggtcttgagggaccaaatgagtctactttggaacagccaccatccaccattactgtgtcacattatgttgtcatcttttcttcgcatcatctggaattttaaaaatttgtctccttgtttactggctgtcttcccaagtacttgagtgtaagcactgtgaagccagtgactgtgtctcatttaatgttgtatctccattgcctgtcacttagtgaattctcggtatttgttgaatgaatgactaaaggaggcatttgaactcagctttgaaagatgaataggaattttctatgcagactgggtaagggtgttccagacatagatactggggtgagcagagtcatggagacatgaaaatacatagtatattcttgtgcttctttcgggctgggtttgttcatgtgccacaaaaagctatttttgatacagaaagaccatctggatttgaaggactctagatctttggttaaaaaaaaattgagaaactaaatgtgtttctgagccaacttcagtatagctttttcccctctgtaagtcttttagccagatgctgggcattcattatcattaatgatttatagacctttaccaacatatttaccacagttttattatataacagatgtgaaacaagggtatggttccaatgtgccttcagtctagcaacacactctgccttgtgcaaagcagtctaatattttgcaagtccagaacaactggcagtatgtagttatttttagagtatataatggactaagtggtgagtttctgagggcatagggcagaggttctcaatattagccaactgtgcgttagaatcacctgggaagcttttaaacatttcagtgcttaggccataccctacccagaccaattaaatcaggaactctgggggcaggacccaggaatcaggtttgtttttttaaacatcttcagatgatgctagtatgcagtaaggttgagaaccattggcctagggggacacaaacaagggaaggagacagatttttgaagcttgttgtaagttgttgaggtataaggagggatccccaagaggtcagtcattaagaagattaggtaattgaagagaatt

SEQ ID NO: 103563 - DNA, 1125 bp, Homo sapiens
ttgccatttaatggttgtatggattataggattttagaactgaaagaaccttatctgtatggaatatagatcctagatttgcagggtgaatgatcgctgtgcggttcttttgctagagataatcatttcaaacaaagtcatgttcaaaggccaaggtggcccccctttagggttttacctctggctttcactggttaagtagctctagttagtttgtttcaaggcttaattagaccagtgtttcttaatcttggctgcctgttagcatcctctggggagctttaagaaaaatactgttgccccaacctcaccaaataatttacagaataagttttattcttcttccgggaagtttgtcatccattttccaacttgctaaagttgatcaacagtggctttattgttctttgacaaaagaaaaggcatatcagactttgtattatctcatttttagatgcaccagtcagtaagcatttggcagttgggggcccccatctgtgaccattgggagcttgccttatgaacccttagatcctgatctgtgacatagaatgtgagcagaaagttccatctggtgtgattgctgcctcctctcatgggttctctggtttgagtcactgctgttgtatcacacgcttctttatgacaggctgacagattaattccctagaggctgacctgatgtaaataggaaaatttgcttattatcagtagaaggagcaggttatttaattactattcaattttagtgctatttattttttgcttttaggactgaaacatctcctgttcagccatttgaattttgaaaagttgttagttgcttttgataactttgaggaatcagattaatttttaaaatggtttttaaatgtatgagctcatgctaagtgcatttgtttgtggtagtaattgctttctgaaatctgttttctgcaactcagaatagtataatatttagaacttggtcactgtttttagaaggaattctgaaggaattgtaaagaacagcctaaatttgttcttatcccttggtttttctacaaacacaattttagtattgtggcattcagaagttaatgcattcttggtatgttgtttacaagtaatattttacaaatgtaa

SEQ ID NO: 103564 - DNA, 1169 bp, Homo sapiens
catggccagtatttctgtttttaagtgacctcttggggatttgccacagtggctgtttaaacatccctcattgtcctacatttcctttccttttgcttcccttcacttaatcttgcctcttaatttatagaaaccctcagattggagctcctttaccttcgtgccaccaaatttgagtgccacttttcgtcctttctgtagtgagttctacttggatttttcccaagattttaaatctgcccttctatatctttttttcatcaactttaaacaaaataaataaataaaatctagcacatttagttatctttaccctccatctgcttttcactctcctcccttctacaagccaccttcttaaaatagttgtctgtgccctttgagcccattgcagttctggttttctctttaaccacaacattgaaactcttttctccaaaatcaccattaacccccttgcgactacatccaatgaatattcctttgtgtcatctttgtccttggaatgccgctcttcccctggcttctcttgtaccatgctttttagaatttctccctctgtctgccagtgcatttttgttatcccttcctcagcccaccacttaaaaattggtgcttgaaatgattctattctaggtctttttctttttaattcttttaagttatatatatttctccttgggcaagctcatctattgctaaggctttatttatcatctatatgctgacaacttccaaattgctgtctgtagcctagatctctttcctgcacttaggatgtctgtatccacctgctcagtgtgcatctgtgcttggataccccatagttaactgcaaacacaacatctaaaactgattcctccttatctgctctttttaagaagagatggagttttgccatgttggcaaggctggtcttgaactcataacgtcaggtgatctgcccgcctcggtctcccaagatgctgggattacaggcatgagccactatgcccagcccttatctggaatttctgcaaaattctgtccttgtgtaactcagcaaccagtgccaccatttacccagctgctgaagctactgttatagcctcttaaatggtccttctgtctttaatttcgtccctcccatcccacatcattgcgttgcagtaatttttttcagagtgatc

SEQ ID NO: 103565 - DNA, 1056 bp, Homo sapiens
tgttgcacagtgagcaaacttccttcatcttcagcctcttaactgcatgttatttttactcctttctcttaactaaatttgttttctttctcaggactttacatcctctatctcccttctagtgggtgggttttttgttttttgtttttgtaatttttaaaatttagagatggggtctctctgtgttgcccaggctggtctcaaactcccaagctcaagtgatccccctgcctcagcctcccaagcagctgggactacaggtgtgcaacaccatgcttggcttagtgggtgtttcggtgttccttgttctcctgtattacagagattagtattctgttgttctctctctcccctctccaatgcttacataaaatcctatacccttgggtgaaattccctgttccttaaaagctcgtgtaatctggctagtctaaccttttcccttatgcagtactgtcatttattgttttgtccctccctcatttaaaaaatgaacaaaaacttgtagctcttggattgtgggctttcttcttaccttaagtattgctattgtcttaagagactccagtgtctgtgtggaagactgatccagcaccttagctagtcttatgtctggttctctaattaatctgtttcattgcctttcttctctttcaccaactattctaaggccacattttggggttagtcaatttagaactgcttaatttctgaaaatttaaagacaagcgtctcattttctcattaagactcttcagttctctcatttaattacccccactgcctcttttctccaatgtcattgagaaagccagtgcattggccctctctgtattctctccctttttgttaactcccctgtctttgctcccttccctgtcttgtttcgactttgtcgtccttctcttaaacagctctttggccaatatcctctctttattttcatttttcattgtatttttcctacctggcaaaactcagtacagctctctgccttcctaatatccaacctttcctagacccttgactcctgcctggtagtatttctgtgtgtgt

SEQ ID NO: 103566 - DNA, 1370 bp, Homo sapiens
aacaattcgattcattttgatgatgcaaactctgacctgtaatcaaaatggtccttttgaggcgcaaaggtgaatttagctttgcttgggcttttaacacttgtatatgcatctgtttatgtcctttctgtcttatgtgttccttagttgattcttagtagtggaataaagctgtttggacattacatggtaaatatgttaaaaccagtattgtattatgtttttgtatgttatgttttgcttgagattcagagcacttaataaccattctgtatctcatcctacctctgagaagtttgaaagtaaagcaaggtatcctgttttctgcctccaagtagggaaagggaggggagttcatttacatacgaggctgagtggaagatgtgagggaattcagagttgtaaggcagagacatagatgtttccaggagtgggttcatccttactaaccttcatcttgtagctgttttgtttttggcttagcttcgaacttctgaagtttatactgaagcaagaggcaagacgtattggataaatgacccaggagacataatcagtaaaggtaaatttccatctgctttgggtcaaaatggagcttttttataaggaaactaggtatcataatgggaagtggttgggttatgagagggttcaagaatcaagagaataagtattcagttaaaaccatttgatttcattttttttctggtgttttagtaagctttaatcaggtatttcctaaggaatttaaaattatctcttaagtttgagaagtctgccgggctagatgaatggattgttagtttgttgccttggacagagacttaaagaactcttgaatctacattctgttatcttctgtatccttgtcatctttgtcattagttgaatacttaaacatagtttcgaattgttacttgtgtgtgtgtgtatgtgtatgtgtgtgtgtggttatctgttgtctctctaagcagagttaattttcttgaggaccatgccttttatttctttgcgttccctctgctagtaatgatactttgagttgtatatttcagaggatatatcttaagcatattggcaacatccgctggtgtggcaaggtaagagtcaagtggagctcagtggttaagagtttggggtttagagtcctattgactttgctgtttaatagatttattaccttaggcaagtttctcaatttctctgaggctcagttccttcatctgtaaaatgttaataatagtttctacctcacagagttgtgagaactaatgagatattgcaagtaaagcacttagccacaggagtggttacatatattaggtgtgtaaaaaagtaattgtttgatttgttaatttttatttttgatt

SEQ ID NO: 103567 - DNA, 1427 bp, Homo sapiens
taatcaacaaagcatttataatattatcgtgtaaggaaccatagagcaacctctctttccttggggctatttctctgctagatctcagcagcctcatatttcctggtgacttttttttctctttttaagagctttattcaagtcaaaggtgtcttgcctttacagttgcctttacagcttttttttttcttttttttttttttgagacagagtcttgctcttgctctgttgcctaggctggagtgtagtggcacaatctcagctcactgcaacctccacctaccaggctcaggtgattctcatgcctcagcctcctgagtagctgggattacaggcacttgccaccatgcctggctgattttaatagagatggggtttcgccatgttggccaggctggtcttgaactcctggcttcaagtgacccaaccaccttggcctctcaaagtgctgggattacagatataagccaccgtgcccagccttacagatattttttttaagataattctttcctcacctgttggattcttgtttatcctgtaccgtgggagacatatgggtgaggggaatggtatcccccatagtagattggataatgatctcaggaggtttttattggtgaatcaattattattttctttgttagaagaagaatctttagtaagaagggagaagaaacttttcatttgggagagaaaataaaaacaagctttgctgaggccagaatgggatcatgtgtaataaactatgaattcatcctctttttcctccttccctcctagttgcagttgatctcacaacagctgtttccagctgtcctctggattttgcccaggccccttgggatggctgcagtgactcacacagctgggcttttttccataatcgtctgaatctagctcctcaagaagcaggaggaggaggaggaaaagggtgacttggttgcactggaagagattttcttgttggtgtattagtccgttctcacactgctgtaaagaactacctgagactgggtaatttatgaagaaaagagatttaattgactcacagttccaaagccttaacaggaggcatgactgggaggcctcaggaaacttacaatcatggcagaaggggaagcaagcacatcttaaccatggtggagcaggagagagagagagtgtgaagggggaggtgccacatgcttttaaacgatcactcgagaactcactcatcctgagaacatcaagggggatgtctgtccccatgattcagttacctcccaccaggcccctcctctgacacgtggggattacaatttgagatgagattttgtgggggacacagagccaaaccgtatcagttggatcactgtctcccggcaggctctgggtttggtttattcttgaaagctatgatcctaggagataacattgccggcgga

SEQ ID NO: 103568 - DNA, 1060 bp, Homo sapiens
agcataaaggagaaaaagagggagatgcaaaatgttagctaaggcaactgaaaaactttttctgacttttacatctttttaacaaagatgtcattattttatttttttgagacagggtcgcactctgtcacccagtctggagtgtggtggttcggtcacggctcactgcagccttgacttctcaggctcaagcagtcctcccacctaagcctcctaagtggctgggactacaggtgtgccaccatgtctgggtaattttttatttattttttgtagccatgaggcactatagcctaggcactgtgttgcccaggctgattcaaactcctgggctctagcgatcttcctgcctcaacctcccaaagtgctaggattataggtgtgagccactgcatccgacagttattttaatgttaagcctgggaggccaagggaagtgttcctttggccttgggagctgactcagactttcctctatactccctccgcatctcagttccttccactatttacaggatctcctgtggctctctttggcaattagttgcaagaggtcttatatatattgaaatgagatggaatgtaaatacagtatttaaaaatatttgtggaagaaataattgaagttctgtagtgacagggccacactagggagcagagaatgcatagagggattttgaacctttgtaccttactttaggaacagtgttattgatggcaggtgggcagctgagagagttagaggagattttgttggcttttaaatatatctctagacttctgaaggcagcagttcttctattctcatgtatggtttggctggtaaattttaaggtatgaccgcttctattgtgtgaatgtctgaaagaactgtagaatccaagactgaccactgaggaatatgtgttgatcaaaaccatttgagctgtaagcccagggattttgaagggtggatgtctgggtgtgttaagaccaggtagaggagaatgcttattagtttcctaagtctcatattatcagagcccattaaatcaatattagtttgtatcaaatgccagta

SEQ ID NO: 103569 - DNA, 1082 bp, Homo sapiens
gaacagagaaggggttaccagcaggcccagttgataagctggtcagaagacaaagttgaagtttgagaaggaacagagatcttcattgtataggggataagagttcaaggagtgtcttttgaagaaaggaaggtcttttgaagaaagtaattgcaagttagcgattggaaaaacttactaaggtaggagctgcttagaactggaagagtccgggctgggcgtggtggctcatgcctataatcccagcactttgggaggccaaggtggggggatcatctgaggtcagaagtttgagaccagcctggcccacatggcgaaacccccatctgtacaaacatacaaaaaaattagctgggtgtagtggcacatgcctgtagtcccagctactcaggaagctgaagcagggggatcacttgaacctgggaggcagaggttgctgtgagctgagatcgtgccattgcacttgagcttgggtgacagagtgagactccgtctcaagaactagaagagtcctgaagttctttctggagtattggtgtgatagaagcattagtagtttcttttatgttctggagaacttctgtgcacataaatgtttatagatatataccccgtttgtataccaaaggaatcttcattatttttcactgaacaaaacaccttagagaacatttcgtttgttttgccaatcaatctaattcttttaaatgaccacatagtatcccacggtaagtttttttgtttgttttttttaaaatcatgatttgtttaaacatgtcctattgctcgacatttaggtcgtttccagtcttttgctatttgaaacaatgctgcttgtatgtatgttgctgtgtgcataagataagcacaagaagacggattctgagaagtggaattgtgtttctaagggtctgcacattttaacttttcataggtattgctgagtatcagagggacatttttctattatgttaccgtactttcatttttcacaagccgaagtgaaaaatggtatcttggctttttaatttgtttgttgttgttgttgttgttttcttttttcttctgtttttgaggcagag

SEQ ID NO: 103570 - DNA, 1101 bp, Homo sapiens
gtggtgttgacacttcgaggagagtgagaagttttagaagtagctgctgttcctatgtaataaggattcatcaagaagtgggatgaaagggttgctcagtctcagtaagtgccagctgggattgagttggtcctgatggtttaacttttttttttttgagacagagtttcactcttgtcgcccaggctggagtacaatggtgtgatcttggctcactgcaacctccaccacctgggttcaaatgattctcctgcctcagcctcccaagtagctgggattacaggcacttgccaccatgcctggccaatttttatgtttttagtagagatggggtttcactgtgttggccaggctgatctcaaactcctgacctcaggtgatctacccacctcggcctcccaaagtgctggggttataggcgtgaaccacctcgcccagctgtttcttaactatcagacagtacttggaagcccatgagtgtagctgagtgcacgttacctagtgccaagtgtcaataaactgagatgaatgggttcaggtagaataagggcgtgggagaaaacaaaggacagcaggagcttttcctacgagtttgagatcttgacgttagaagagttttgggtagcaatgatgtgtaaggatccaatggatgagtttggtgtaggtagtgccccctggaaataagtaggttgaagaacttggagtctcagttttgaaagtgttgtcaacttgaatgttgaaacgatctaggcctaagcattgaaactctgggcaaattgggagaaagtcatggaggttggggaagtggaaagaatgatgtataagtgggttaactcagtgactctcaactgggggtgattttgtcccctcagttgacattggcaacgtctggagacatttttgagttttataattgtggaggtcttactggcatctaggggttggaagccagagatgttactttaacatcctaaagtgcacaagagagtctcccacaatgaagaattatctggcccaaaatgtcagtaatgctgaggttgagaaccctgcattaactttaaaagaacagttgttgagtaaaggcaacagttgttgaatgtg

SEQ ID NO: 103571 - DNA, 1049 bp, Homo sapiens
caatgttgttttgtccattagaggctttcaaaaatttttatcaacatttaagtgcttaatttctacagtataccagggctggcagtaggtaggcaggtgatattttattcacataccctatatatttgcacattttgattgctcgttctgttaattaaggagagaatttctcttttgtagctgaaatgttttatgctttgaatccactcaaagacaaattattctggaaagcttgaactaaacctggtcagatgcttctgagttatgagagagggattgaaataaactttttcagctaaaaataattttgctcacaagttaccaaaaatggctgactagaaatgcttttaagatacttgtctaagctaccataagctaaaggtcaagaaaaaagtttagaacacgttatgagaaacgattggctctactttgctaaagcttttgccaaacctcttattctgtaatgaccacatgagacaaaagctggtgaaagtggtatgccttagattcagtggggacctagagattttttcagtggaacacatgtgctgcctatctcttctgacgacgaactagtacctgtggaaggcactagggttaggtgaaaatgggacacttcattctgaagctgttatacaattgcctatgccaattaattatttaaagcttttatcttctgttgcagagcaatttttgccctcagaatatttgtcagtcctcacaaagtgccaagtgatgggtatttagcatgtggcattgccgtcagtgttctgtcattttgtttagacacttctttgcatctcactgaattgcagaattaagaatcgttcacatttatgggcagcacgtttttgcagtatggtcatttatcattggagtttatattttatgcttccttctagactcttagtgtgctttcacgattatccagaggattcctttgcagcagcagtgtatgccactgattggtggtggtagccttgagaaactagggaggcatgttgactttccttaaggttgcttagtattgtagaataaaatcttgaatt

SEQ ID NO: 103572 - DNA, 1045 bp, Homo sapiens
ctacagatgctcttgcatctgcgtataagaatatacattatagcattatttgaagtagcagaaggttgaagaaacaaaaatgctcgttgacaggaaatctgctaaataaaataaggtacattcttgatgagaaaaaaaaaggtacattcatacagtggaatatcatgtagccattaattaggcagctctgtatgaacatagaacactctttaaatatatcaattgtgaaaatcaaagtacagaagagtgtatagtttgctgttatttgtataaagtaaaaaagtatccgtgtgtgcatagactctgccaggaaacacaagactccccagcggttgcctcctcggaggagcattgagagacagaggaataagggtataggtaaagacttaatttttattgtatataaaaaaatcataccaacaaaatttgttaattgtataccttttgttccttttgaattttgtattacatgcatgtattacttgttttaaaaataaaataatgtattaaaattacacagggataggtactgtgtaaacatagggtttatggtccttaaacttgctaattttcatagaaatgagtcaagttgtgtgttggagaaaaagtatgccaattctgcttaccacaaataaaaaatagtacttgtgtggtggcgcatggtcattttgtcattttgattttgtgtatgacattgtttattctatgtaggatattccagtacttatatttacttattatgtatttatattatatatatttatatgtttgtatattagctatgttttcttacattttttatttactgaaagtgctgatatggaggggtagataagagatgattaaaaatggaaagtacattagaaatggtgaatgtgtatacaagatgaatcattcaacaatacaattataaagggtcaagtgcaaatcataaagtggattgagaagaagcaaaatgagtgagaatcactaccataagcctctcccttgttcttaagaaatgtcccctagctagacatgcacccatgggttacttggatttttt

SEQ ID NO: 103573 - DNA, 3919 bp, Homo sapiens
aaagatatattagcccttatacaatctatttttttaaatcttaataatttgtgttgctttttctatagtcaccctccagatttgaagcatggtgactaaaattgctcgtaatactcaacaattacatttatgttattattatttttaagagatattcttagtcactcaggctggagtgcatcactcaggctggagtgcagtggtgggatcatagctcactgcagccttgaactcctcaagcgattctgccacctcagccttccaagcagctgcacccagcttccgtgttatgttttacagtttataaaatgctttcgtgcaggcccttatttattctcttcaacaaccctgaaagataggtgatgattcttcccatgtttcagctgaaaatatacctctctaagcctcatgactaggaagtggcaaagctgatgcttttacccagatcttgtggctctttatccagtgccttttcatggcccttaagactgaaagggtatgactgatgaggaatggagcaaaaggaatttcattggtttggcatgccgtatatttaatattgaaaacattttacctgttacctgacagctgattcatgtagaactgggatgacagttgtggtatgcatgatagtttgtcgttgttttttggctttttttcatctcaaagttattccatctctaatttagatcaacaacagatcaatcagtggattgataatggtgggtagtataaaatcatcagagctgaaggcatctagaaattatctgtaccagccctctgctttagtcatggaaaatagtcagtatactcatttttatagacagtgtatctcaggctcagagagagaatgtgacaacaaacaataaactcagactttgtctttaaggctcagtagaatctttcatttcttagtctttttatttcttggtgtgatttttttctgacagtttcttgtatggagtattttcttcttccttttacattttcttaatgcatatatattcacatggttaatgattcaaaatatgcaaaatgtagaagagtcaaaaatctctccctctcctagctgcctattttatctttttggaagtaactagtattgttagttatctgggtgtccttctagagacagtgcctacgtaatatttcttttaaaaactccattgacagtatgcgtactattctgcactttgctttgcttttctatttggaaattatttcgtatcagtttatatatgtatatatatttttttctatttattagctttctggacttaagattctggtctactgagagaaccatgtccaaatgtcccttgtaaagatgactgattagtacaggacctcaaataatatgattctgtgttttaatggaatcatgaaatcccaggattggagacctaatctacatctcttgttttttcacgtgaataccctgcagatacctgatgttgctaccttttagagatgtctgagtgaaagataggtatcctcgtctctccatgtgccccagtcagctgcccctggtcttttttgcactggtggggcacattgtgggtcagctatcgtatatgtcattgagttagtaattatactcaggatctgccatgagtcattgcacatggaatctaactgcagtgtgagttttattcatgatgacatcttgtataccagatgtttcccagatgcctaggtttatcctgattgagtgtcactgctgtcaggatgctgttcagtgaactaagttttgtgttgaattgtgagaaaggaaggtttagtttctaataggtgttccatctcagcagccataattgccactggctacccttaacccctctgtctgtggaaagccccaggattgagtgaatgctcttcttccctagggtatggcctctccgtaactgagacttgatgggaagtaagtagatttggctcaacaaatagagaatataaacacacgtgtgtgtgtgtgtgtgtgtgtgtgtgtgtgtgtgtgtgtgtgtgtactgaacagtaattggattctgattcagatgtggagttaatgatatcaaacttaggcttgactctagcacagttaatctttatagacttccacatttaaagatatgaaataaaatgtgcctttcggagttggcttttgcaatagccctttttctccgtgagaatattatagaagaggtagtattctagctgtttagagaatgagaatgaggccagtggggttgtgtctcactctctaggtgaatgtcgacctctactcagttctaatctcaccgtgcagtctttgtggtcccaaggctctgcagtaggtgaattaggcccgcgcagtctctgtggcccgagtcacagaggaaggtgttcctttcccaagtagtgaatggaagccggcagggcaccagatgctgtgttgtttcccctgttgctttttccttcacacccggtgtaaagtttccaggcatttgtgcaacctgatagcagaaagcgcctgtcctagcagtcgagagatgggttggcaggggctcaggttactccatgtccctgataagagccatcgatctgggctggtggctgctgataggtgggaactatactgcctgcattctacccagcaggaatgatgtgggtctcagtagtgtttcaggactccgagaaggtacccaggcaatttagaggtctggccagcatctctagggcagcagcacacactaagatgtagattttaccttagaagagatgggttttaggaaatggtggcacacaggagcggaagaagtaccagcataggaaaggtgaagtgccaacccgaggagtggaaatggtattttcttattccacctggtaacctaaaactcagttgcgcagtgacttaaatttgcagaggatatgtacatagataattttaatacactgcttggatggaaatagtcacagaatatatgtgaaagtgtagtggcaggtggctctgtggtaatagatactctgtgaatacctctgtctgagcagttatcacactgtattaaaatatttggttaagagggccctttctgtctgggcacagtggctcatgcctgtaatcccagcactttgggaggccaaggcgggtgggtcacttgagcccaggaatttgagactagcctgggcaacatggtgaaaccccgcctttacaaaaaaacaaaaaacaaaaaaaacgaaacttagatgggcatggtggtgtgtgcctgtagtcccagctactcggtaggctgaggtgggaggacctcttgagcccaggaggcagatgctgcagtgagccatgattgcaccactgtactccaggctgggcaacagagcgaaaccctgtctcaaaaaaaaggaaggccctttctggtaccagaaattctgtctctaatcttacttagctgtgtgtcctttaggcaagttacttagcccctctgtgcttcagttttttatttgtaaaatggagataataaatgaggcttgtactaaatgagtcattacagttttttgtgttatctgttgttatggtggttgttatagcacaaagcacgggcgccagagaccatggcaaacacatgatgactggagggctgcagagttcagtatttattgtgttcactgaaagacttctagtattaactatgctgggtaccatacagaagcaaatgcatgagatattaactgtgtgactgtaaaatatatgacgagagtcagttttttttgaagctgtgtagaaagaatattgatgtgagaagtttcagtatcctatggcagtttcagagaaggaatcttccttctttcctttgggaggcccttcagctttcttggtgttttgaagatagattgtatattttactttaaggtaggacaatacttaactatttcagacaggtatgaatctttcctttttttttct

SEQ ID NO: 103574 - DNA, 1857 bp, Homo sapiens
tagaaatttctgccaaaaattcaaggcacaggacacatgataaataccacttatgaagtagatgacattcttgaattgtcaaatgatggtgatggaataactgcttaaaaacctgttttcccaagggtggaaaacagcctttgaggtttagacttccacatgggtgtgttcagccataagacgtgggttttcttagggacttaggtccccaggtaacaccttggtgtgtgggatttttcccatgtataggctggttccttggtttctccgttgttgaagaagagagattttgcactgggtattggatattttattccaggcatgtggtttttgaggaggcatattgttgatgtattttttttttctggctgcattgatttttgtcagattctaactggaaataccacaagcaaagcatgatttatcatgagggatgggtggtgtggccgtgggactctcctagctctggggattggggtggaggcagaagctatgtgagtaaaactagaggaactacagacagggcctggggagactgggggtgtctgaatgtggcctgcagcagttgcttgagttggaatacttttgggcagaggctcatagaaatttctttcaattgcttttttttttcttttaagaagctttttcccatacaaattggaattgtttgaaggagtgggccttaattgttgccagccagagtgattttcaaagcagatctatatggatttcacttaggggttactttcagggggtatgtggcttgttctgagacaggaggacgttggttccattttcctggaagttgttgggactcctggatggccctgctctatttgtcttgggccattaggcaagtggaaaagcagctacatagttagccctgttgcatggagtttagtttcataattcatcctctcagggatttttatacagtcacacttacagcctaaagtttgttttctccctttttctttcttttccttcttcagttcagtggtccacaaaaattcttgggagggtaagtaataatttcgggtaaaaggcaggaattgtagatctttttttagccccctgccccgattaaatttctccatattcagcttctccttcatctgcaaaagcatctgcaaatgaggtcgctatcccctaatcagactggcttgtcccctaattagtctgaatatgtggctttgacagctttcacctgctgtttcttagtttctaggggataagataggattgtgtgatttcaaagtgaaaactggcaaaattgaaagatgttttgtggtggctcccaacatccacaaagcttaactcattggtttgcttctcatatacaagcttccaggaacatggttactgttagtggctggcacagtgggtttgaagactttgttggaacttcaggaagtttcccctttggcaaagcttacagggagttggtagtacttgtcctgaaagtctgaccctggtcttatgctatgcacaccttgtttaaaagaatgcagagtactgctattcagctattgcttaagcagtccgtttcatatatgtctgcattagttacatacttacataagattttactatgttttgtgttatatttgaactagaagtcatagtttcatacatgactcttattaagctgataataaattggcaaattttgatatcatccaagactttgaggtaatgctggtcatactcaaaaggtctgtatttgggtttagaaactaatttttctgttagctagcgcctctccattcccaggtgctgttcattactcattatagacatcttctgtccctctgctttgttaaaagtctttagctgcttgtcatgatactgaataga

SEQ ID NO: 103575 - DNA, 2226 bp, Homo sapiens
gctatacagcactcactaacttcctgcttactgtttaatctgcatggagtggttaatgtgcttctgattgattaagtgccagagttgggaactactagagatgagcagtgtgttaaaggggaaacctcatttgctcattatccagggtggaggagtggaatgaactgggtcattgtggtctctcttgtcagaggaaggggagacaattctttgctaaggagtgaaaggactgctgcagtatcacagtgtctgcaggggggatgtggatttcttagaacccgtgggatctctgttgggagggtgggtgacagattcactggctgttttagtggtacatggaaggcaggaacagtaaaaatgtcgtgtttcaaattttataagttttgttacgtatgttggttcaaaagtggcactttttgttctcattttgtctatggaaattgagctgggatgcctttgtgttgtctcttgtggtcccttttcagtctcttcaaacccgctctccagactgctaacacagtgatctatctaaaagagccaatctggccaggtgcggtggctcatgcctgtaatcccagcactttgggaggctgaggcgggcagatgacttgaggtcagaagttcgagaccagcctggccaacatgatgaaaccctgtttctactaaaaatacaaaaattagctgggcgtggtggcgcatgcctgtaatcccagctacttgggaggctgaggcaggagaattgtttgaacccaggaggtggaggttgcaatgaggagagatcgagccactgcacttcagcctggatgacagagtgagactctgtctcaaaaataaaacaaaagagtcaatttgttactccacgcttaaaatcttttgagagcttgtgttttttctcaggattgtctgttctcttgtttggcctgacttctgcgtaactttcaagctccgtctctttccacattccacctccaagtccatgtccagtggcttatagttttcttagcatgtggtgccacccagctaatgaatacctctgtgcttttgttcctttcccttctacccaaagttcctgcttcatctcttctacccccacatttgtaaggctcaatctttaataatgagtttggatattgattcctcctggatgccttttgtgactattcccatgtctcccacactcctgctgtcttccaagacatcatgtctatagctctgttaaaggactttttagattaatacttgattgaatgtctgccccaccacgcttacccagactgtgagatccttaggaatctgtaggattaagcaccatgcctgggcccaagtagtcaagaaactgtccatttttgttaaattgaactttgtcttcctgcttctcagttggggcctgcagatggctttaattgtttatccagattttccctggggggtctggcccttggtctgctttctatcccctgtgaagactgcatgttgtgtgatatgtgaatgttaacctgatcttttcattgatatcagggttaaaggtgagagaggggtctctgaaaacagaagctggggtagaatttaactgcagaatgtgttgggtaggcatagcaacctgatatttagtttcctgtgttcagatattaattgagtgcacgtgtgtatatgtaaaaagctcctttgtgatagtgtggttaaggagaaaagaggaaccacacaagtgagagaggcaattagagccaacctgttccagttcgctggagcaggctgttgatttacctttttacagtgctgctgcaggattctggagtgtagcagttcgcatgtattaccaccatttggggtgagaactatttgatcagctagggaccttaacctttctcttctcaaccagtgaatttcatcggatactatagctttattttttattttttattttttttgagaccgagtttttgctcttcttgcccaggctggagtgccatggcatgatctcggctcactgcaacctccgcctcccgggttcaaacaattctcctacctcagcctcccgagtagctgggatttacaggcacccaccaccaagcctagctaatttttgtatttttagtagagacagggtttcaccatgttggccaggctggtctcgaactcctgacatcatgatccacccgcctcggcttgcaaagtgctgggattacaggcatgagccacgtgcccggcactgtaacatgtttttat

SEQ ID NO: 103576 - DNA, 1223 bp, Homo sapiens
ttcctttgtctgtgccctgggggagagagagtcagtggtctcttcctcttcttataagggcactcatttatcatgtagttcccaccctcatgacccaatctgaagctaattctagaggtcctacctccaaataccattacactggggttagggcttcaacatacgaaatttagagggacacagacattaagcctgtaacactaccagagtggtaaatattgtagatggagaaactgaggaacagtcatgtaaaacttgttgcttttttccccatgtcttacaaggaagtctgcagatgtaaaactggaaatgtatttgagaaggagaaagtcagatctgatttcaaagtagaattattcttcagggtgactcaagagattagcttgagttgagtttgtctcccaactccctcccattttctagctactctgtcatttttttttcactatcacgctgacatgtgaacacaacagaagctaactagaaatttaactttcattttgctgtaaagcagactggtgcagacaggcctcaagtttacaggactgctgagaaagaaattgagttatgctactttgtataaacaagaatgttgctagtgaatctctagtttaacatctctcaggccttcagtttgatgtcaggctttaataatttgtagaaaaagacagtcattttagtaagcagatttctttgaatttttgttgatatacatttgtaaagcatagtaaacatctttattctggggcaaatgtgcacttccttcaaaggcaggagggaagaaccacagacatgattggaaggaaatggcagtaattggagcatgagcagacagatggagtgagggatggtgagtacatttggtgttttaggtggcccctaggagtattgagtttcttcttattctcctctacaaccccaatacaagcaggcagcttacatggctaaggtttcattatctaatccatcacagatcagcttgaataaacccattggctgatgctgatctagttaggaaagtagcaaagctgcttgagccaggattgggacaaatcggatcagaactgccatgtgaatcctggacgcatttctgtaatttgggtgggcaaagtagtttgggaagtcatttactcaagagaatgagcagtcagccatgagttttttcaaacattgtcttagggactctgaggggaaagtgtgtggaggatttgagatatttctct

SEQ ID NO: 103577 - DNA, 2146 bp, Homo sapiens
tcctgaggggccaggaggcacgacgagtggataggttttggggggaaatcgaacaaggttgagatggattccattttttcaaatccttccttagtgccttggggtggagtggaagccgggaaatcctggcttctctggactgagtcgaggaaaaggagatctggtgggaaacctcccgagaagagggagtaccttttggcagccctgggcacacgctgggatggggaagagaagtggcatttcaatgagaggagtgaaaagaaaactcctcgagagagccccgaggggatgtggctgagattgtgggttaaatcacacagagtgtgagaagtacaaggagtttggtaatgttatggggacacggtggtgctcagtctcatttactttgtggagcatactaatgagtctgaagggagacactagacatgtccctcctgttctttgccaattgcattctacatcaccaggacacaaaatagctctttaatgtcccgggctataaaaaaaatttttttatagggctattagaagactggattctcaattctggattgaaagataaacgtggttaatttgggtagggaatgggaaaggtattgatgtcagctgacttcatagttttgaagaagaccttgaaacctttggaggttttacgatttggtctttgcccagaaaatactgctatgacatgatgagtctcacctaccaacagttgtgcagacttgtgcctaattctctcggagtcataggatgttagagggatgctaggaggactagacatcatcttttccaggggttcttaacctgggaagacttggaagattcttactcatagtaggtgatgtgcactttttggtggaggagagtcaatagttttcatctttgttttttttggaggagattcaagtcccagcttgttttaaccaccttattttatagatggggaatcagaagtccagagaagatggtgacttgggtaaggccacccagttagctaatagtaaaactagaactagaagcctggtcttctaattcctattcctgtgctgtctccattacaccactcttggaaatctctgcagtgctaaaagacttcctgtgctctgctccctgcttttcaagcctctgcctgacttcctgtgttagggacagagctgtacttaagcctagcatgtttgttgtatgcttcttggtctcctttgcagagtttaccctgttacttctgttgatttaggtaaagtgaccctcttggtgtttatttttgaattcttttgttttgtttgcctgcttttattttccattagaactctgtcaggcagagggattgtgagaagtaaaagctcagggccatggcaaaaaagacaggaatgtgggagacttcaggtgaggtgagctaatattggatgataaggagggaagactggatgtaggtgctggtgagcaggttctacttggtgtgtgtgtgtgtgtgtgtgtgtgtgtgtgtatgtattcatttatcatttctgtcaatcctagttaatagtgagacccccgtccctttccctcatttactcctggggcctattatctgttggttgccttcaaactggctaaagatagtgatatttggaaatggagcagtgtgtagggacttcgcaggggtgtgcagaggaaagagtggttaggtccttgggggtacaaattggcagctgagagttatccctccgagaatccttttttcacttcttgtattttattttctttctatacattctcttttttttttttttgcccaggctggagtgcaatggcacgatctcggctcactgcaacctccacctccacctccacctctgggttcaagggattctcctgcctcagcttcctgagtagatgggattacaggcgtctgccaccatgcccagctaatttttcttatttttagtagagagggggtttcaccaggttggccaggctggtctcgaactcctgacctcaggtgattcacccacctcagcctcccaaaatgttgggattacaggtgtgagccaccacacccggccttctatacattcccattgttgtaggtccattcccctatgtcatacaggtattcaaatcattgatttaggccctgccttcaactagctgaatggttctgcag

SEQ ID NO: 103578 - DNA, 1019 bp, Homo sapiens
tcaagccccgcctgctccaggatacggccccgcccagaaaggagacagaccccgccccccccgcgctgccccgcactccagccgcgctgtgcctccaggacaatcccaggcccgtgccggagattcccgagcttccccgatcgcttcccggcctccctcgggcagccagcgaggagactacggagattgccgagggggcctggccccgccccccccgcgggccgccaccgcccccctcgccgtagcctcccgcgcgggctggagttctacatcccggtccctccctccctccctctttctctctccccgccttcccggtgctgccacagtggcgggtcggaggatcccggccagtcagctcgttcctgcctcgcgcccctcctccccccaaaataaacagccctccccacgcctcgggagcccggaccgcccccttcctccctcggccggcgtgctgtgagggagagtgtgagccagcgcggccggtgggcgagctccgggagtgcgagaggcggggcggcgcggcgggccgggccgggtttcgcgtgtgcgtgcgggggcgcgagcgagtgctcatcacgacccgccagtggccccgcgccgacaacccggcgggcgggcgggcggggagcaagcggtcaggcaaggagcggcggccgcgaggcgcggaggggcgcggagtccgctcgcgcgcacgcacgcacgcacgcgggggcgggggcaggcgcgcgcccgcctgtcgcgacagtcggggccgaggcccagggggaggtggcctgtcgcgggtcgcccggctcccggaggcgaggggggcgcgggcggatggcggagggcgcccagccgcatcagccgcctcagctcgggcccggcgccgccgcccggggcatgaagcgggagtcggagctggagctgccggtgcccggagcgggaggagacggagccgatcccggcctgagcaagcggccgcgcactgaggaggcggcggccgacggtggcggcgggatgcaggtgaccgcgcg

SEQ ID NO: 103579 - DNA, 1067 bp, Homo sapiens
taaaatctctttgcgttctttgagaacatgatcactttcctaattcctgttttttgtttctgtgttcctagcacctagcactgagcttgacataaaacttggctattccaagactcctgaagatattaaaaaacacaactgcagacctaagattttccctagaaaaacagataaagacccggagcagataatcttaaaatactgtcttaaccaggcagtcctctgaataaagacagggtctaagtccttccccaaaattgatcacctctctaatcagagcgaagagaggagatataaatagaagagaccattttctactccaaagctttcttttcaaaaaaaaaaaaaaaaattcagagaatacccttgataattcatgggccagaggaagtggaagcagctcctgccatgtgcctggctgatctgggagaagatacagagtctaatgagaaactgaattcagcaaaaaaggaacgagtgatgtttaagcctcattagggctatagaaccagcgttctgacaaaaaaatactcgctattgactttgacctcacttccctacctccctctgttcgtgggattattgaaccagggtttttcctataggccagaaccttgccagcccttttgcccttcacataatgtgtttgtctggtttctatttctgtagtttgatgaaggatgatagcagggtattgaattgttgtttttcatttagtgcagtcgccgccctcaccctgcccaccaccccccaccctgctctcaagtcattttcattgtctgttttttgccttgaggtttttattgcttcttcagagtggaagaaggctttgttttattttgttttccaggcgctggtatacataacctcatggatccatccttcctgcaaaaattatggtgtttctaaatcggcaacaatttcctttcactggggaaaggcagggaagggtcagatatttgctgagcccataacaactaccaggtgcaaaactaagtggggtttttttggttttgttttttggatttttttttttcgtttaatcctcacaaccgaccagagaagca

SEQ ID NO: 103580 - DNA, 1593 bp, Homo sapiens
gtttccaggacgacacactggcccgaagtcttactcccagtcgccactgcactcctgcctgggcaacaacagtgaaactccatctcaaaaaaaaaaaaaaaaaaaagaatgatacaacggactctgggaactcacggggaaggttggaaaggccaggtatgcgggatggtattggcaaggacacatatagagacacagagaaggagcatcgtagggggtatggggaagctatgcacatttcaaagtattagtagagcacaaggaagaggctgggacagggggaggatgaacttggagaagccatgactggaagcctgtgtcccatggcattgtcatctgtgtgtgtgccccatcttgactttgagctccacacaggacaggactctgactcatctttgttatagatctcagtgagtgcaaggcacgaagaagaaggggtgtcaatgagtgcttcataaatgaatgattggatgaatgaatgaatcatctgtttctccacttccattctgtggtctccggccaacattccctcccatttacctctcattaaactctttttgcagcagcactttctcttagttcttcctgtcatttgctagacttcagctttgtgatctttgggtcagacaccatgatgagagatgcagatcgcaactgagcgtcatttaaatattcagaagagctgaggctccgcaggctgaattctgaatatgcagataattcagaaaacactggagcaatagacttgttgaattcaaactcgaggtggagcagacgagggtacagctcggcttaggtgacccatcgtccccatcagctgctccttcccaaagctacggctccctcggcctttgagctttcaagcctcagcctcgtgtgttgcttcagtggcagctggaacattcctccctgcagcctgctcctcagacgcttatctcaccccatagggccctgctccatctcagtcttggatggggttagcagtgttttctggatcaaagtagcttctttccttgtgctgtatttaaactttgtggcgtaggcatcagtttccctaatgcctctgttatccatcttgcaggtctacagtattgagagacagaaagtcaagaagttctggacctgccaggaattcccactgtggaaacaaatccaccctccttacttcctggagaggggcaattccttcaggaaggtcttccatgagccttacatcagactttgtcctgaactccacccacagctcccctgtctgagcgtgtcccattttctctggacctctttcatctccagtcccagaccagcatcctcctgcatgtgcttctgaaagtacaggccactcctgcatcccttctatacctgggtcgccaggaaactcacggatccacttttgacgcagtctgttctgctctcccttctcaaatctgcccagatctcagctgtcccccatggtccttatcaaactcccatctacagcctctagaaagtgacttctgatcatttcctctatcgtggccctgaatggcagtcacatgtacccttcatctgtttggctcttgccccctgccagacccagcagcaattccatgcccc

SEQ ID NO: 103581 - DNA, 1005 bp, Homo sapiens
acaggtgcctgccaccacacccggctaatttctgtatttttagtagagacagggtttcaccatgttggccaggctggtctcgaactcctgacctcaggtcctcaggtgatcctcccacctcggcctcccaaagagctgggattacaggcgtgagccaccacgcccagctaagttgctatcatttttaaggtcatgctttggcaccgcaatgactccagacaagagtctcctttgtctcttggctgctggagggaaggggatagaggttggcgcatgtcccttggtgcatgttccagagatcctgttgctgtgggtgctcacagcaccctccctaccctccactcctcatttctcctgtttgggatccactgagctagatgcttctccctctccctgggctaaagcttatttgcagcaccctcagtacctactagcagagaggcattcaagctgaaatcctgcatctatatcaattactcgattacctatttcaaatctgaatccaaaaactactctgttaactctgtgtatgagtccagttctcttaaatgttatatgtgcatcaaaatgaaacacacatttgtctagacttcagcaggaaaatatgagcttgattgtgtttgtcatttttatacctacttctgaaccttcctgaagctgacacctgttactcagggcccaatttttccatatgaggaaagacaaaaaggattgtccatgagacactgctagtggccgggctgtgagtggccgggaccagtggctgctccctcagcctcctatggggtccccaggggctgtgggcatgaaacacaattcccttcccctgcactttgcagtcctaggcttgtttgtctccgctagccactgatgccttcagaagcccccattgtcaaatgcccagcttgaagctcgccacctccttccagggtgccttgaaaaagagcagaacagggcgctggggtccctgtcatggtgcacacagacaatgacatcgggcatgac

SEQ ID NO: 103582 - DNA, 2378 bp, Homo sapiens
ggatgagccaccgtgccaggccttcatggggctctttttgtaagcataagtagtcagtattgtatatgaattttctgccatgtggtagaaagagggtgcctgtctttgtactctgtgtgaacaggcacacctgtttacctgtcttggtttcaccggttttataggagttgcaacagaggatggcattttacacttacttttgtgcctttcctgttgtaattggtcctgtttgcctgagctgtttttgtgctactgttgtgtgtgaagatgtccgacacctaaacattttgcgggaagctttgcctgctttcctgagagtggtcctgtctagctcagctgtggctcccaagactccactttgcttctttctggtgggagcagccaggcacctggtttccctctcgaattcactttgagatgtgtgggctgtgctgtggccgcccctggcctggccgggcccgctgaccctctgcttctacctctgcccccaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagcctccccttcccagaccccgcagcacgcctctccccaccttcttgggactgctgtgaacatgcctcctcctgccctccgccccgtccccccatcccgtttccctccaggtgttgttgagggcatttggcttcctctgctgcatccccttccagctccctcccctgctcagaatctgataccaaagagacagggcccgggcccaggcagagagcgaccagcaggctcctcagccctctcttgccaaaaagcacaagatgttgaggcgagcagggcaggcccccggggaggggccagagttttctatgaatctatttttcttcagactgaggccttttggtagtcggagcccccgcagtcgtcagcctccctgacgtctgccaccagcgcccccactcctcctcctttctttgctgtttgcaatcacacgtggtgacctcacacacctctgccccttgggcctcccactcccatggctctgggcggtccagaaggagcaggccctgggcctccacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatatttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgctacgagccgtgtctgtagcatttgtctgcggccagggggccctggacaggactaggcctggcttctgcagccaatgccggctctgcatcgtcgggaaccagattggctgaggcgtaggctgagctagctgtgggcggttgtgcagaaaagctaagatggaaaggtgggctaggccagatccaaggaggctaagagcatcttagaaaccttggttcaaggccgagcacggtggctcacgcctgtaatcccagcactttgggaggctgaggcagggggatcacctgaggtcaggagttcaagaccagcctggccaacatctctactaaaaatacaaaaaaaattagccgggcgtggtggtgtgtgcctgtaatcccagctactca

SEQ ID NO: 103583 - DNA, 3628 bp, Homo sapiens
atttcggatttatctgcaaaaggaaaaaaaggctatttgacaaaggtctttagtgttaaaagaagtaacaggagaataacaaaaggaaaggtgtttcctgcctgtggtggggatggaccggcaggctgggcactggttttgagtggcaggtgcgcattaggggtggcaccatgggcactggcttccggcccacaggaggggacagaaagtagaaaatgaagctcagcttgggctcacgtccacggtgacgaacactgtcaaagtgtgcattacggggtgggatacacagatgattgtctttagttgcctttttgccctgtcaccacggttagttggttaaatacagcattgagtggagcaccagccatgagccctgttggcgaggtgacccatgagggttggggtggagggccaaggagctgggtggggtgccaagcctctgtccccaccccaggcccagatgaaggactgcatgcgcgagctggatgacacccgcgcctctcgtgaggagatcctggcccaggccaaagagaacgagaagaagctgaagagcatggaggccgagatgatccagttgcaggaggtgggtggggctgcaatggagagcggcaccgctgccctgcggccagcaggtggcagcgtggggctttcagctgaggacagggctggagtcctactgggctccaggaattggctggggatggctctcaggttacataaggattccctccagggttccgtttcatagcggggctccctcgtatgatcagagtgtgtgtgtgtgtgaaactggcatccctcacatgagatgaggctttgtggccaccaccacctcctgctgtgaatgctgcctggtgagaaggggtctgagcgtcccctcggccgccctgcccgtcgcacctgagcccgtcctgaagtgtttcccaggtctggagggtgccctgcagcgtgatgtgccggctgcgagtgcgtccagggtgtagccatctgcctgtggcctccagagctgactccaagctctggcttacccagaacagggaggggccgccctgagtgactctgtccacgtggtctccctggttaggccaggacacttcttacttatcgccataccctggcacctggcttgattcctagcacttaaatgtaagagttttataaacatatggtgtttaagctatatcttcaggggggcaccagccctgtgagctagagggtttctggaggaagggcttcgtggggaggtgggcctggggaagggcttgaggggagggtgcctggggctgggaaggatggtcttgtggggctgtggctgcctttaggtcacactctgggtctttgtggcaggaactggcagccgcggagcgtgccaagcgccaggcccagcaggagcgggatgagctggctgacgagatcgccaacagcagcggcaaagggtgagctgagtgagggggcagagttgggggggaccaggtgtgtccccagggtaggcccctcacttctcccgcccaccccgcagagccctggcgttagaggagaagcggcgtctggaggcccgcatcgcccagctggaggaggagctggaggaggagcagggcaacacggagctgatcaacgaccggctgaagaaggccaacctgcaggtgggtgccaggacttctcccactctgggctctggctggagccaccacggcagagctggccttggacccagccggcagaagcacaggccaagtgccagctgctccccaggcgcttaggggaaaatgtccaggcacctggacctgaaaggtccccctctggcttctgtgttgggtgttcagaagtttctaatcttcccttttctgggagacccaagactctggaccccaagggtttggtgggatcctgctgccaccttcctctggccctgctcatgccctccagccagggccccagccctccccaaggtcactggcccttcttctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaagtacgtgcccctggccccgcccaaccccagctgtcctggaaaaaactctggcccccctgcagtcctgcccaaatctgggccacaaccagctctctgtctcctgagcctggggctgtttccctccctcctgatggggccctcatcccttccacaggttgggtggttgggggagcttgtggggtttgaacaggattctctgttccacctctaaagccaggagttttggtggctgtgtctgagagtgaatcagagcaggaggtacaggggggtcctgcccactaggacagttgtcctatgggctcagcaggactgagacttccttggagggaatggggtttacagtaggcccccagacctcttttccagttacatagatgctctttgaggtgtgtcgcttcccttacctgagcccatttcctcatctgtaaatggggctatttgcagtgcccgtcgtaagaagccgggtacacataggtgtctagcaaaggcctccctacgtgatccctagatgccagtgagccccggggaatgggtggtcctggttagggcttgttggccggaccctctgaaggagggtgttccctctgagccaccttgtctgtcatgcagggagcgccaggcagcctgcaaacaggtgcgtcggaccgagaagaagctgaaggatgtgctgctgcaggtggatgacgagcggaggaacgccgagcagtacaaggaccaggtgtgggcgctggtggggcagtgagaagggcagcggggctgggcagcagatggggtgacaggcagggcagtggggctgactggctgcacgcccagagcccctaaccggggccacgggccacacgtccatctccgcaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggtgagccgccctgcccacccgcccctttgcctcggcacttctctcaaaaggtagcttgttcctcaaccagagcccacaagcaaggcacgaatgtcaccaagaaaggactgcacaaagcaatccctgccccttctggctccttgcctttgaggctttagcttagtgttttgaacacacagtaaactctaggtagtttattcccagctgtcctaaaagtctattgtcttttgaattggaagttgcttgaggccacctggcccagtcctggcacatgttaggtgcctcagttaaatatctgcaaaacgaatgtgagcctcatgagcaatgcctacagaggttaaaaacgctcctttgcgtttctcagggagtgttaacactcaagaagtagtgaatgtttgaagcagaggatcttattctctg

SEQ ID NO: 103584 - DNA, 1022 bp, Homo sapiens
gctgccctgccctgctgggggccgtagctctgagcctcatggtgcccacctctttcccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtgagtcctgggcctggcagccaggtcttgggaagggcccgagtggggtcatcacagagggtcggtgtgtgcacagactccgggtcgcgcagacccaggtacctgccagtccctttgctcctgacttgggctctctggggctcaggtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgtgcatggcctcctgctaccccatgggtgcccaaggctgccttggcttcacgcaggcttctgttctctccttccacctggattgtgttagggccccttgaccacgcctcccctcccatattccttctttctagcctcctgtctcggggttcagtgactcactttcttagagttcttatggtcagtaatccccactggtttcccgaggccccatggatcctgcagaactggcctgaggctcctgagttcagagctagggcagggtctcccagtgggtccagcttcccaagttgttgatgttccttcccccaggtgcgggagatggaggcagagctggaggacgagaggaagcagcgctcgatggcagtggccgcccggaagaagctggag

SEQ ID NO: 103585 - DNA, 1195 bp, Homo sapiens
tagatcctatcttgggcctccatgtgccaggccagaaggcctgaaccacctcgggatgggctgggagtccattccacagtcagggtaggagtagcccgcgagcgtgcctgattgtgggtttatctccaagtgcaaggatggggctgggtgatggggaccccgtggacaccctacagggcactggccctgctctctgggagcagtctccgtagagcaagaggcttggtgtggatgtgggctgggagcccccacagcgggcctgggggtcagcctcccccgggcttcacacagtagacagatgcccctttgcagaagctccatttgtctcgcccctgtggagagggaagtgactgggggaggcggtttcataactgggcagatccctggtgccccttccacggtgtggcaggcaggctcccagctgccccagggacgggtgtgccacctgagcaggtgccatctcgggcatctgcttactccttgctcctgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccaggtgtgtggccgttggccccatcctttgcatttcctctccttcaagcactgagtccaaagcaaagggcccatcagagaaagcctgggctccctcagggtctcgccggggaggggccgtgcggggccagtgcttagaggaccctcaggctctggcttgttgagggtcccagggagaaggccagcggaagagggcgtcttcatgcgatgggttgaggagtgacttttcctttctgattttttacatttttcagattttctctaatgaactggtttgactgtctttttttttttttttttttttttaatttttttattgatcattcttgggtgtttctcgcagagggggatttggcagggtcataggacaatagtggagggaaggtcagcagataaacaagtgaacaaaggtctccggttttcctaggcagaggaccctttggccttccgcagtgt

SEQ ID NO: 103586 - DNA, 1050 bp, Homo sapiens
agatgaggtggggcaggagcagtgggggtgggtccatggtcctttgtgtctccccgcccggtgcaggtggagctggacaacgtgaccgggcttctcagccagtccgacagcaagtccagcaagctcaccaaggacttctccgcgctggagtcccagctgcaggacactcaggtaggggtggcgccaggttcccagaaggtggacccctccagaaaggcctctgtgtccacgcaacattagcttcagagcccatcggattgcccatcctctccttcatctgcttcatcctgtgggtgggtctctgcgtcctcccagctccctccaggtctttacgtggccatcccctaaatcagcaggaccagctcctccctctcctcaagggtgtggggttcctgggttttggacaccaccctcctaagcacccgcacccctctcaacccgcgagtaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtttggaggcctgggggaccggccggactctgcaggctggggagctgctggccgggcactggcctgggcactgcaggacagccctgcccgctgggccggcccattgctgctctccccctgggaagccaaccgtgctctcccacatcagtgctctcaaggaaaggaatccagggatctgtggacttagatgggggacaccactattttcactattttacacctttattttcaccagtctttagctgaaattcagcattgcttccattatggatgtaggcagcaagccatggtggtggcagtccctgtgccgtcatcatctgtagaaatggccagttaccctgtcagggttgtggccgagctccttggcctcatgggtcccaggcctgcgctgtttgttatctgatgtgctatctagcagcacgtggcttcctgagccatggttttttaga

SEQ ID NO: 103587 - DNA, 1644 bp, Homo sapiens
gaacctacgttgacctgtcataaccatctaaagtccgtagcacattcgtatttttactgagttgcagttgtcctgtggtgtagcgttttatttccttttcttcccatttaacacatcatttgacttttaaaaatatttgaagcagtgaatcttactttggaaattgaaacgattcctctatgaggttttctgcttctcagaggggtgttgcccttcaatctggttgtctcagatgttgtttctgctgagagccatcctaagtgccatgattgtgaccacaggaggcagctttggctgctgcagctctctcaggcctgtcctgcaaactctgctccttggaggtgaaactctccttatactgatgttgctggtcgctttggcagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggctctgaaaacagagttggaggacacgctggattccacagctgcccagcaggagctcaggtgtgccctgggaccaagtccctcgggatggggagggcagccaggggggccttggcttggagacatggaccccgggcctctgcacacacacacacacacacaccgtggccctcttaggcaccagcaggcatggaagctgctggttcctcagcggtttctctctacagagtagaaagtctgttgaaggacctggctcaaagttgggggtgaggcaaggctgggctttaaagctgaaaggctacagaagctctcacagggcgtatttgagcctgggctatgggatagatggctaggaggggccggtgggtagaaaagctgcctggagtgcctgtgccctggccaggcctctctttggtcagggaagagccccagggacagcctcgctccagcatccccggcctccactctgaggggatttctctgtccaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgcggagcctccctgagaccgcagggggagggcagggttccccgtgctgggcccacagaatccaaaccagtcctgcagagcagttgcagggttctacccaactgcctggttctgaggccaggctccccttctaaggggctttgtgactcgtgcctcagtttccctgttcataagggaggattatggtatgtctgtctcgtgattatttgagggtgaaaacattacatcgttactttgaacatcagacttcagacaggctttattggaagtctaactgcaaacaattatagttccccttattgcgttacaaatattgctaacatctgcaacaccaatgccatgccctagaacctggcctctacccagggcagaaggctgggcaggtattattttagagatggggaagctgtgagatgtcctaagcagtgaagacaggaaccaagtgtcacccaccagctaagagagaagaggaca

SEQ ID NO: 103588 - DNA, 1025 bp, Homo sapiens
tggcgcctcacagcatcctaatgaagtaggctgtctccttttgcttattattcagatgaggtatagaaagtagctttcccaagtgacatcacagagttataaagctagacatagagccctgaccgtgcgattccaactgtggaattcacacaaggcagttccattatataagttcagattcacacacaattgaacatgttttttagagatacagacatggtacagccttcaagggaaccaagggaattacaaacaccagctttaggagagtacttaattcctggcagggaaggacaaggggtgagttggagagagacatgccaggggctagcagtttgcagtgatgtcctcttcctgcatccaggagttgggtgcgagtgtctgtgtgtttgtgatgctttaagcctgacacacgtttcataacgagtgctcagtattttgtataagtaattgacacggagacagaacccatggcactgagggctatgtgggctccccctgcattgcagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccaggtgaggaccccgcctgcccgcctgaggccaggtggcctgggccagcccttcctgcttgctgctggccctagttctcggcactagtgagctgtgagcattctttccactgttgtcttaaaagagccatttatttcatagcaaaacagttcttgtgcactcagggcatggtgaggggcctcatttgtcttttgtttgtttataatttgaaaaaaagtcatccacagctctatcacccacctacaatagtcctttcctaatttcttgctataggcacacttaaaaaaaaaaaaaaaaaaaaaaaagacttgaccaggcacgttggctcacgtctgtgatcccagcac

SEQ ID NO: 103589 - DNA, 1039 bp, Homo sapiens
tgcttgtgccgagctgtggccgctgggcaggggtgttgcaggggccacacagaacagaaagcaaggagagcagcccggggcaccgcggggctgaagagggggaggggccgtggcccacctggcaggtgagagaggggcacggagaaggtggcctggtggcgcaggtgagcgccgtgtggcagcctcttgaaggagtggagccatctgtccctgctgacactagctgtcacctggaatcctttctcacccaagcccacaggggaaggggaagggcttgggcacccacattttttggttctaaggaagcgtacctcgctgtttcaggggagctcgtgacctttcaaaattatcctttgatctaggaaaatcctaatgaacttgatcaagcgtctaaagccctctccattcagccccagatttccgggcgagtcatgctttgaggctagcaagtgttctgtgctcaaccaacactaaatgccagcctactcccctctccccaggaaaagaaactgctggaagacagaatagctgagttcaccaccaacctcacagaagaggaggagaaatctaagagcctcgccaagctcaagaacaagcatgaggcaatgatcactgacttggaaggtgagggggtgacgagcaggaggtgatgggcaggggctggcgggcaagggctggcggtcaggggccggcctgtctgaccggaacaccgaggccttctcagctcacgggtgagcctgggtcacactacagcactggctgctgccctttagacctgaggtcaccaggtcgaggggagccgtgtctggtgcctgcgggaacctgagcctccaggcccctgttgctctgtggctagatgcccccactgcatgaagcgtgtttagagagctttggcattgctctgttgtgtgccgtgggttttggaagcttctgagacttcctaggaggctccgggtttgacccacaggactcactagctctgtcactgactagctggctcatcttgcagctatgacttaagctccatgagctttagttt

SEQ ID NO: 103590 - DNA, 3470 bp, Homo sapiens
tctgacgttctcccaccaaacaaaagctcagatagggaacagcacgaagggtgggaagctgaagtccagagtcacccagggccagtcagcttaatcaccaagggtcacgctcagtccccacactgagtaggatctgtggttacttcacacgtgccttcacccccatgggcacctcagtggaggggtagtctggtgacctaggtccttcaccgactgtaagattagtgcctcatggagtcacacagcctgtaagtgggagaaacttatctcaaccccaaggccagaccccttccctgaatttctttcttgaggtgccccaggcaagggtagacccccagaaaagcttgaggacaagaccaggactgttaggtcgggtctgctgtccactgctccgcgctgaccatgttcctcaccacacagagcatttgccaagcggcagcagcagcttaccgccatgaaggtcctccagcggaactgcgctgcctacctgaagctgcggaactggcagtggtggcggctcttcaccaaggtgcgtgctagaagggcctcctgagtagctgggactacgggtgcacaccaccatacatacctggctaattgtttgtattttttgtagaggtgtggtctcaccatgtcgcccaggttggtcacaaactcttgggctccagcaatcctcctacctcagcctcccaaagtgctggaattacaggcatgagccactgtgcccggccctttttgatttttagtagagacaaggtctcactatcttgcccaggctgaccttcctggcctttaaaaaaaaaatctctttatttttaaacttgtccgggctgcttttgtgtataatacataatttatggtaatggcgaaaaaccaactcacaaaaagcctaaagaattaaataaaaattcacacataaacccttagcctaaaccaacagcagcagctattttagtgtttaatttctcgctctttttctcactgcctataaaacctcagctatgtaaacagtatacattcttccatagctgagtttgactcatataaacagttgtagttcgtacgttccatttatgattccttcataagcatcgtttttttagaggtagtgtgctgttccctagggaacacatcattatctgggtactttttcagagatgggtccttcctcattttcttgctgtgataaacaatgccgaggtgaacatcttcacgcacacgcagggatagtttccctggaatgtagttagcgggtcagaagcccgtggtacagagcgccaggaaggatgtgcctgcttgcagcccccaccacagcgtgtcttcttgcccctcactttcatgtttccagaggtgagggagaggcctcacacctgttggcagaggcgggcatcttccagccgagcatgtctctacctctatctcctctcccaggtcaagccgctgctgcaggtgagccggcaggaggaggagatgatggccaaggaggaggagctggtgaaggtcagagagaagcagctggctgcggagaacaggctcacggagatggagacgctgcagtctcaggtgggtgtcagtgcaggctcagtccaggtcgcacgacctgcctggtgctgccacctgctggccatcggtaggcacggcatgctggaagtttctattactataggagttttctacaactgagtttcctattactgtaaacagtgaccagtctctctgcagaccccattgggtgttaagtgatgtagggaggccacttaatagagtggaacgttcacaagtgttgggttcaaacctcagctctaccacatgacttgagcccatttcctgggaccttgctctggagctcatggggtagtgaaaaatcaaggacacgatgtctggaaggtacctggaagcttcagagctctccagatgaaagctacttttgtctgcatgttcctttccctctgggatcccgagccatggcgtccgtccttgaggatggagtggcttgagggtgttgcgaggagcttgtgttttccacttgttgtttgcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggttcctgcccgctgcacccggggaggggtggcgccggaggggcagggcggggcggaggagcaggaaccaggagctgggagaacatggaattagggtccaaggaggctgctcctcacgcaatctgcttggggctctcagtgagaggtgttccctttgggctggtagtttgtgacatgtgcatctgagatctccatgagcactgcctgggccagcatcaaggccaatttgatttccctgccattagccctggccctggctagccgaaggggcacagggccagcacctctgcgtcctgcctgtttcatgggtgggagcttgctgcaggaaacccttcagaacattgcaccgatgttctggccctgtgtcccagtttgaaatctggaatcctacaaatggggcttgggccctgcctcggctgtggccctgggctggcggaccttgccgtccccacctcagccatggccctgggctcacagaccttgctattttctccttggcgtttggatctggccttcggaccttgctgccttcaccttggccatgcctctgggcctgctgtccttaccgtgtctctggcccccggcaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggtgaggcccgtggctgtcgcctgccgctgctccaggggcgccgtggatgggagagtgtggtcacccttgcagggcctggctccccgctgctgctgcttcctgtctcttctgcctgcagcatgagggcttctgcttaactgcaagtgctccctggaggtcccatgggccttagttgagggatttcctcataagcaaaggggccctggggaagggtttgtcctttcccctctggaaagctcttctttgccagccgtgagacccgagcctgtgtaaaggtggccatctgtgcagcattgcaagtgttggtcactgtggggttggggacaccttggtggctctgtgttgagatacggggtactcttcctccactgtccctgggcggcagctattcctcttgagaatgagttgggtccctgtcggtgtctgcccagggagcagatagcagccggggaaccagttagaggagaaggcaggagaaggcagcctccccacctttcggg

SEQ ID NO: 103591 - DNA, 3218 bp, Homo sapiens
atttacaccattaaccaaggaatgtttcccgagcctcctttctccactctcacctttgggaaacgcacacgctcatcagtgcagaagcttccaggaaggcttttgctgtgggattatttgtaatgctgaataattaggaataccctaaagcccaccaaggggcctgcacgatggcatcaactgtggtgcgtctttccgtgggctgtgctgtggccgctaaaaggacaaggatgttggcctgggtgggagggtctgagcctggggaaaggaaactggcatcacctacctcatgataaacagcaacatgcattcgcctgcatgctgaggggagcacccctgggatgcagcagcgtgcattcgcttgcatactgaggggagcacctctgggctgcagtttgtgttgggaagagggaggcctaggtccctgatgctctctgggtattgttctgggaccttttgcaatgaagatgtcatgctgtattacttgttctgttaagtatatattttagcagagcacaggggctcatgcctgtaatcccaacacttggggaggccaaggcaagaagacagtttgagcccagacgtttgagaccagcttgggcaacatagtgagaccctatctctatcttttttttttttttttgagacggagtcttgttctgttgcccaggctagagtacagtggcacgatctcggctcactgcaacctccgtctcccaggttcaagcgatcctcctgcctcagcccccctaggggctgagattacagccctgtagctgggattacaggcacgtgccaccacgcccggctaatttttgtatttttaatagagatggggttttgccatgttggccaggctggtctcgaactcctgacctcaggtgatccacccgccttggcctcccaaagtgctgggattacaggcatgagccaccgcacccagcccctatctctatttaaaatgagaaaaaaggaatctatttctgggagtctctctgaaccctctagtttaggaggctgcccaattaaaaaaatatatttaaaaacagaatatatttccaaaaagatgaaactgacacatactcagagaaaatgtgaacattctaaaaagacaaagaaaaaacaaaaattacttgtcttatgactaaaaagaaatagtaacattttgttgtccttccaggattgtttttctttgttcatattacctaaaaattttaaaaaagctgaaacccagcacggtactgtgtggccaccatgccatgtctagagccaggctcccgttgttggccatgccttgctttgaggctttggctctgcacgagacgccgcagagaacgtcttgatgcctcgctccccttatcctcaccacttccttcttaggggtggaaatgctggatcaaagggtcttcacgttttctgacttttccatgcatggggttagcctgtgctccggagaccctgtgagcacacatgtccccagcgcagcttgtgactcctgcctctctgaccccgccaggtggattacaaagctgacgagtggctgatgaagaacatggatcccctgaatgacaacatcgccacactgctccaccagtcctctgacaagtttgtctcggagctgtggaaggatggtacgccctttgcccttcgccccctgcctcctcttggctgcggctggtcatcttcccacctccacagtgggccgagctgccaaacaaggggtacacatgtgccccctgacataggccaggtggtctctgccctctgtagctcccatgagagagggctcctcggaccgaaacaggaggccactgccttgcgcacacaccgtggccgggtcctcctgggcggagcgctttccgtgtgtgggaaagtcaagggcagccccgagcctcgaagcccagggtcccagccccgcgccatgttgcattcccgcctctactccttggtaggctggttgctttgagtggttctttttaattctttctgttggtttctccttttcctttgcctgggttttgctttaacctctctgttgcagagatgcagagcactcagagagcctatttctatcatcgctttcctattctccacctagaaccaggtgactggccgcccgagtggtgtctcttgtgtgtgtggtgcgtccaaagctgtgcaagaaatgcttctgcctaggttttctcgcgcccccccttgccttggcttttcctgcctgcttacacccccgttccctgatctgcccctgggcttctgggcaggttccccgcactgtgcctatcgccggcctgtagtagcaaactgggcaaatgaggggctgtgtctggaatttggagacgtcacattcaaatcttaaaacactgtaatcccagcaatctgggaggctgaggcgggaggattgcttgaggccaggagtttgagaccattctgggcaacatagggagaccctcatctctacaaaaaaattaaaaaaaaaaaaatcagctgggtgtgatggtgcatgcctgtagtcccagctgctcaggaggctgaggcgggaggatcacttgagcacaggtcaaggctgcagtgagctgtgattgcaccactgtactccagcctgggtgacagggtgagaccctgcctcaaaaaaaaaaaaaaatcttaaaacagcaaaaattgtttaaaaatttgtatcctccttagagcttcatgcctaaagacagcgtcttaaactgcttgaatggctgcgagtgtcttagcatgaggttcaggtatgcacactgctgtgtctgtgcacctgaaagctgaagtggcatctgtgtgttcattcaacagttgctcggcaaggtctgctccatgggggtggggccaggacacactcagctaaaagggccagttatgatgaggccacattaacctttctctggacaacctgagtggcttttgcaagttaccacgcccaggaaacctgtggtagccaggaatattgaccctgtggtgggtacataaggtcaaagatgactccctttttttttttttttgagacagagttttgttcttgtcacccaggctggagtgccatggtgcaatctcggctcactgcaacctccgcctcctgggttcaagtgattctcctgcctcagcctcccaagtagctaggattacaggcacccgccaccacgcccagctaacttttgtatttttagtagagatggggtttcaccatgttagcctgg

SEQ ID NO: 103592 - DNA, 1056 bp, Homo sapiens
ggtaatgattgctcattcaccccgtggctttcttcctctctgctcccaagtcaagcagagggacttattctcttgggtctaattagaactttctctcttgggtctaattaggactttttgtccctctcttattctctgaaaaatcttagctgcccaaaaggtgtcccatctcttgggtatcaatgtgaccgatttcaccagaggaatcctcaccccgcgcatcaaggtgggacgggattacgtccagaaggcgcagactaaagagcaggtatgtcctctggggccagggcagctggctgcctcctgggtgaatgtccctgcagcagcacagttgaggctgttgtgggccatcctggggtgtccgtgtcaggcactttcacatgattccatgatgcagtcctcacagcaacccggagagaggtggcataacgccatctagagcactggagaagcttcatggcacactcaaggcttcacgcccaggaagtgccatcctgagactgcattgtgcctctttacattgagatggtattttggctgattggtcatcaaggatataggcatgtcctgtctggtataaaagcaggaacttgatgccactgtagctgaactccttctggtgccagggtggcggctcccgccatcctcgagcctgtgccaagcggctgtttctctaccacctgctgccttgggcttgccacgtgtgctgagagacgagcagcagcgcttgctccttcctgccagactgatgtgcctgcctgcccctggagtggaggtcccgcccagtgcggaccgctttctgcctctctccggggtttctagtttcttttatggtgctggccatgggggtttttagggtgccaaacccatctctcaaaaatacttggaagctcattttgttagtctttctcccattcactgtacactgacagctcacggctgtttctgtgcagaagcattgcatgaaagacaagactgttgttttcaaaagacatcgcgtattattcctgccacctgttcgtttccctgaccattaaggagaaacctccattttct

SEQ ID NO: 103593 - DNA, 1068 bp, Homo sapiens
ttgccagaattggaccgtagacatcatttgggaaatgaaaacttttggccttgggtttaacggggagaagtgagagtgactcctgttctctgcgccatcctaaggacttggtcttctgtttctgaccatgccagagaaaagctagggtgggttgcacatgtagctgcaaatcacaggacctggcgctctcctgggccaggagacgggagtgtcagagtctcagacactgaggaaagctgaacgtcactggctactctgcggtttccagggtgcgtcagggctcagggtctgtcccagtctctccaacctttgaggtcacagcgctgatggagcctccactttcagcacctcgctgaggcgcccttgccctccaccccttacagccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggtacagggctggccctcctatggtcgagtgtggggcagaggaaggctggtacccacggcctcggggcatcagggtagccgatgggcctggggagcctgctagaggccaggggaaggggaaggccttcagtgtatgggaaaatgattcctcagatttgaggttcaaggttatttgttcctggtggtaccacaggcattcagaaagggtgcaaaggacatgttcttaactgcccaggactcgggtccactgcacagcccttgccatttgctgaaagtagaatattcacgtcctgtctcggggagtgtggaagaagctggggatagatgggtgctttgtgctggtgaagcccagcatgaatggcagtgcggacaggccatgtcggccaggagggggtgagccctctagggtggctgggcccaccgcacaccgttagacgcagacctggcgcccctgtggccccagggagttggggggtgtccctgcttggcttgtctggcttgaggatccctagatgagtggcccccacccccgggaatcacca

SEQ ID NO: 103594 - DNA, 1052 bp, Homo sapiens
ggcacctctgatctcttgctatcctttcttacttagggcaaattcattcgcatcaactttgatgtcaatggctacattgttggagccaacattgagacttgtatccttgtggttcgttgggataagagtcctggatccggaggggaggcatgacctctgtagagaagaagctgcctcctgattccagcactttcccctttatgggcccatcctgacaccttctctgtggagctaggggactgtcaggatcggctagtgcaaacccaacacagagcttagggctttccttatttacaggcaggataacctgtgctttgaatggcatggagctgttgaaagccgtctagtgtggctcccagaggtaggcgtttgggggatgccactctcctgcgtgccaccgtttagcctttgcttgtgggaatgttcttgttcccattacctgtaagaatgagacaaggctctcgaaggtgtgagctcctcttggacatgccatgccccttgaaggtgagaacccaggtagtttgcttttgctgtgttttgccattttgtgccattcttccttcctggtgaagttcagttcctttggacgagaataagaggacaatggaaggctggccaggcacagtggctcacgcctgtaatcccaacactttgggaagctaaggtgggtggatcacctgaggtcaggagttcaagaccagcctggccaacatggcaaaactctgtctctactaaaaattagctgggtgtggtggtgggcgcctgtaatcccagctacttgggaggctgaggcaggagaatcgcttgaatccaggaggtggaggctgcagtgagccgagatcatgccactgcactccaacctgggtgacagagcgagactctgtctccaaaaaaaaaaaaatgaggaaagtggagggcttgccttctccccagcttgtgttgctccttaatatttgcaaagatcttttggagaaatctcgtgctatccgccaagccaaggaagaacggaccttccacatcttctattatctcctgtctggggctggagagca

SEQ ID NO: 103595 - DNA, 1032 bp, Homo sapiens
ttcttttcttctgtctccctctctgtctctctctctctccatccctctctccctccctacccccgattttccattctttttaggaggcctattttaaaaacagagctgtgaggttaggagttctctagctgtgcttttccatctctgaatttgcagtaaaatccatttcccaagtatttattgactgcctagtatgtgactggttcttgggagggtgacattggagttcctgtcctgaaagacaggagacaggacacggagagcagtgaaatagatcatatgccttacatctggggttcctgttgtagaggggaaggcagcactcagcaaagacagcatgctggggttgggggtgacagtgggagccacgttgtcaaaacgcagactttggtaggcaccccgtccctgccctgagcccactagagtgagggagtaggttgccccaggcttccagtcatagctcaggctgtcagcgtgaaagaccattggccggtttggttgatttccttgcctgaagctgtgctgtgattttccacaggctgccggagcacagaacacccttgaattggtttgggagccagcgctctctcacttgcagtgaccgagttgaccctcccaacaccagcagaggggttgttccagacctcaccttgctgcggggaggccaggtttggcctgggccgcaggttggcaaagcagagcttggtccaaggggctttccaggcagatgcccggatcctgaacggtgacctttgactctccctgctctgttatttgtgtacgagctggggcccactggcagaaacaccacccagtgaagcccttcagaaaccgatgggtaaccccaaacctcatacagtaccgcatcatttcatgttacgcagatttcattgaaaaattaaaatctcttctgtgcccaattagatgtcagtagagaaaaagccataggttagtcatcactgttgtcagcagggaacacagctctggaatctgaagtggctgctcccgacttggccccgcggccccactttc

SEQ ID NO: 103596 - DNA, 2473 bp, Homo sapiens
tgggggctgaacagcgtgggtggacaatctgagctcctgggcggcaggagcagctgcccaatggcactctcccccgaagatgctcctcctagccaggtgtgagggtagactgcgagatccccacaaagacagcatctgtgacactgtgctccctgtctgggaaacgggcagctctttgggagcaaggtggggaggcttttgcatctggcgggagttaatctgatgtcttctttgtttcagaccgagaagatcaatccatcttgtgcacgtaagtatttctccgtctgggtagtggttcgtttcaccccagtctgttctcattcttgaggtctcctactgaaaccacaactggggcttgcagagtcccccattcccaattcaaggcccctcctccacttctccaagggataggacttcagtttgtgtgtttgctactcagtggtcccactgcatggatgagctcaatttcaatcatccttcctcaaggagccagtgggaaggagggtggagcttatggcagaaaggaaaagcaagatctctccacaatccagctgggaaccagctcctccgtaacttctgggtggaaggcattccttcttgctctggatggtggcttttctttacctgaattgaagtagacactggggcctctcagcctctgaacttaacaaggagatccataaaccccattgccaagagagttaatggcacagaacattcctttaagtgacgtttcaaaggaacatgtacaagtgcctttgacccctaagtccacagctgcctaaaactgatttttaaaacacttggatgtgaagtcacttgccctgacaagtgaccaggacaggcagtggatttcagtttacttctgtctggcccctggagagccatgggaagtgaactgcctgaggattccagagcgtttatgtggcagtcccgttttctgccacacgttgggtccttcacgggcacccaacagaatgcgaggcagtggagcgtgcagtgggaagggacagaggtcaaggacttggccatgcctaagcccgggacttccttgcctctcttggtagtggtgaatctggagctggcaagacggagaacaccaagaaggtcatccagtatctggcgtacgtggcgtcctcgcacaagagcaagaaggaccaggtgagtgctgcagcccttgtccctgtggccgcctgcttggccttggtgggatgatggaggaagagcacttagtggtcccggcttcagctttacaagaggatgctttggggaatgaagcagaggctgggcccatttccattgaggcagtggcgtggcctgtcctgggagtggtccagcggtagcaagcccattccatccttggcctcctagccttctgagttgctatggaaactggcgaggtcctggagtttgcatggcagccctcttggcttttgcagctcgttgctgtgtgtcctccccttctgaggctggaaggcagattccaagacttggtcctcaagttgatggaggcttgaaaggtctcaggcagacctgtatttgattccatttcttttccctgctgttgaaatgcctctgggtggacagccacccacccccaccaccccagcgaagacagaaagggcaattggaaagtcatctcacctccatttttttcctctcccttttgatggattatggttgaacccagcagtgtcctcgctaggtgagctgcacgtttactgcacgttctgcactgggaatgcgtgttctgcccatcgtgtgcccttgaattctgtattttgttctaagcagcttttcaccccacacttgtcactttctgcagctagaactcttcttttaggctcagctcactgactgtcttgggaggaggggctgggtgtggcacacagtgacctcctgtgcactctgaaatgacagctcctgcagaatggggacgggcctcacacctagttgttctcagaaactccagtcatgcccagatttccccacagcgcaccatagctgtcatgtcccatgcggaacctgaccccggcacggtggatggggactccgctctcacggagccctccacgctctgtggtccagaccagatgcagatggccggctgccctcacctgccaccgccgtgccagtcagaagcagtgccggggagttctcacgttggagtttttcagaggttggggtgatcagacttaagcatggctgtgggatgctctctctcaagcacacactcttaacctcccctgtgaaagctaagtgccagtggtgttccttgaagccatcaggggagcttggccgctcccggtggctccaccttactggcgtgccgtgtgcggccttcgtaagtaaggaggggtgtgagtctgcatgcaggtctggggtgtggcctgcagaatggcctaatgagtacagtcttctggaaccgaaccaaaagtaacttttcatgtgccaagcttctcaagacgtttgg

SEQ ID NO: 103597 - DNA, 1883 bp, Homo sapiens
agctgatgcgagctggctgctttgtgctgctcctccaggaaggaaagcccggccccagcatgaggctgctgaactacccatggtcctgcctgtcagtctcatttctagaacttcttctttctagaagaggaatctgcagttaacgggcccttttcaaggattcagcgttaggcttacttttttttttttttgtaaatccaacccaacaggcccaccatgctttgctctgggcccactgagcgggagataaaaaggaagtggcctcttagaacctgaaattttgggtgggggtgtttggaagctttgcccagtgttttttgtttctgctccccatcccctgaaataaaccaacaacaaaaactcacatcaaatccctaatcactaagccacttcgtgcttttggcctcccgtgacgagttctcttgctgcctggtgagtgtcacctaccagcccgtttttcctgttctctccagctctggcttagagacttcagttgaactgtgtcccagtttgtcagggctgaacaacagtgtgttcagagaaaggagttgctttcttttacatacctgatttctggaatgaagttatcagttgagaaccaaagtaattccctacaactaaagaaagataaatgaactgaaaagctgcaggtataaaagttgggattctgcacgtggcttctgtcaaatttgtttagtcttgaccaaggctgtcagccccgtgtggaccttgatcataaactccataaactcttgagaccccaggttttcttttggcaaacagacagtactgatgggggctcaggatgtcattcccacctggctttgggattcttcctgaagatcttgtctcttccacatgagctggtccacagatacaacagggcacaggtctaagctgaaaggagaggaagcgtgagccgtgctccaggagtgaatcctagcctaacagtcaccgacatgcctttccttctaccgaccgctcctccgaggcaacgtgttcatgcgctgttaactgttcacctcctaccattgatgtccctggtgctctcaagcacgtttgactcatcaaaaggagtttcacaaagctggttgctgtctttgcaggcctgtttgtgctccaacagggagctgagtttgtcatgagcagtgcctggctgtgtctgccatgctccctgtgtgtgtcccagctccttccctcttattccctgttgatccagccctctgcagaagtcaacaggggcccctcctgctttgtctttccttttcgcaagggaaatgttaggtaggagcaaggcggaaccggactgggagtgtcccggtggcatgtgctgtgggtggtcagcactcgtatgtggttttgaatttccctccagtctgacaaacctgttggagctgccttggcaacaaccccagaaggagaagtttccccctcctggccccacccacagaaacagcagtgctgtttctggcagatttgcctgtgtgctgggaacttacctgtgttttcctaatgcattttggccaagagaaggcttgtttggggcctcgcttagtctgacataatgaaagttaagagcaataccttgaggtttttttttttttttttttttttttttttaattatccagagtgtctggagggggagggctacccattctctgcctcctataagtggggacttgggtctcagcaggttcaaaccaggttccacctgggagatcacaggggctatggggcagaggcactgggccgagtcgaactggcttctggtgtggatgctgctgagcaggcatgtcccttggtctgggcctaccgtggtggcctggagggcacactcgcccatgaccacattgtgtgcctgggagcgacggaaggggcttc

SEQ ID NO: 103598 - DNA, 3669 bp, Homo sapiens
caactactcaggaggctgaggcatgagaattgcttgaacctgggcggcggaggttgcagtgagctgagatcgtgtcattggactccagcctgggcaacagagcgagacttggtctcaattaaaaaaaaaaaaaagaaaagaaagttccttctttttgtatatagctgacctgcaaagcaaatactaataggtttcttgctcttggagcagggaggaagttagtaacagaagttgtccatgttatgacaagctggttcactagtaaaagaaaaatatccagaggaacctttggttcttgccctgggtcatgtgtcacccgtggagcctcggggtctgcaggctgttaaaatctgctcctgtcttttggagtgaagtcttagtgcatgctgcccccctggctttgagggaaacagatttgttctctgccacttacatcttaaaaggcacagccggaaagttccttttgtgctttttctttaaacaagaactagacaaagatttccttcctgagctggctgtgccttatgacatactagcatttattctgccaaacggggcagttggtggctctgtctggggacttgtaggagaggagctctttgacccttcctggggacctccatctgcctttatctgttcagtgtactggtttgcctgtacagtcctgatttatgcctgttgttccacagttattattaatagcactctctttcactttcagaagcatcccagtttggaggataaattatatgtcactcacctattgtcagactaagccagggattctcactcttggcactagtgatatttgaggctggatgattctctgttgggggtgggggatcttcctgagcactgtaggatttttagcagcatcgtggcctctattcacttggtgccagctacaccttccctctccagttgtgacaaccaaaaatattctcagacattgccatcaagtttccgtggggggcaagattattcccagttaagaactactggactaagcattgcagattagttttactttgagtgtcatctccgatcgatcagtagtggctgcctggagccctgtgctggcaaggatttgagactcgatgcaggaattctgagatggattagtgctgtctgccgtgggcacgggtggggcatcacagcatgtagtgccttggattaggccgtggaggtaggtgacagaaggtgccagaatgccaggaggttttgacattatcctgttactggatgccctggcggtccaggtggagagacgaggcatgtttatagacagagatttgtggccctagctacaaaacaagacatttggtgcctacacctgcgccagcacgactgagccaatgtcaggtgtcctgggagttttgtcaggtgtggcgaggtcggatcttgcagaaaggcggtggtgtgtgtcagtcagtaagtagttacagggcatcccagacgtgcccagcgtggccttgggtgacatggtcggttcaccctcctgcccctggctttcccatgttgttaattcgttgtcatggccgttcctgggtcttcctgccttggggattggactgttgctcggaactctgtgatggcaccaaaggctttgaactggccaaggccaggagagtgagagagcgtaaacgttgtgttgctggcccttgccaggcagcgggggatgggtgggactgtgtcccggggcaggcacaatggtctgctgtaaagttcaggtggaagcagctgtggtctgcaaaaggtctgcctcgcctaggaaatggtgcttctggatcccgggccagaccctctggggtctcccctatggggaaaggtgtgtatgtctctacaggagaactcactggttgaggaatttgacatgagcccagttatctccccagtgagtagaaaaagccccttctatgtgaattaggtagaatgccaggtttggttcactttcagtgactttatggtattaatattttaatgagttcccagcattttgggggaagcagatctgctttcattctaggcctaaacttgtctgagagcaatttaaccctttgctctgtgccagtctcccttcccacccgatccctggttcccaagggaagctgcaccagaggtggttggtcacccagcagccgctcagagtgccagtgagtgtgcacatgcccctcggtgtctgacctttttctgtaaacaatgaggggtagaatttttgtgtatcttcacgtctgagcatggctcttcgaattcatacgtaaagaggcaggcacagataatgttaactggcttgtcgaaaagcccgcagagagccagccccagaaagcagtctcctgatttcctgtcctggtgcctgttaccctggcacaggcccgtggggcattggtgcccctcattttctctggctggtcttgaaggaattcttatctccagctcagtggttggggggcactaggggaggagaggccctctctttccttctctccacattctccctgccccgctagttgtgtctcctgtggaactgtctgctttccaatgtctttctgaggaaaagtgccatgtttggcagaggctcaggaaaaagcttcaaggggcagaaaagctctgtttgaatcgactcaccgggacaggcagctgaggaaggagcgccatggaagccacagatgggatgactctgctgaagcaggaatgcacccagccgggaggccgccagccctgccagccgtcagcacacaaaggcaccgctgtctgctggggaggttgggagcaggccctgtgtgcctaaatgtgcctgtggaggcagcgtgggctctccaagatggggcgtgttctgtgtctgcacctgctggtctctctgtgctggctgagctgagcacctactgtgtgtgtgccgggcactctgcagagagtgtacagacagcaggctggggcctgcctggaggaggtgactgtttcgtgctcagagacaggcaaatcagcttcaagatgagagccagagactagcacagaggaggggcgccccaccgagcctcgagagcttctggggtgggtacgggcctttgatagatgacacagcacttctatagggcaccaaaaaggggctgctgggcctgtctcagccttagacttgggaatagtgccacgtattgcctttgagcaagaggaagtgtgtcgtggaggagagactgtgggttttggactagacagagcaggaatctgcctctttagcttcctaactgcaacctggctggagcaagtcaactcactctaattgagcctttgtcctcttgtcctcctcttgggcttcatgacactcctgggcagggccatggtaagaagtaagacgccgtgtgtgtgatgcctgcgataagtacctgttagagctggcagtaggagtccaaacacttcttgactgaactgccccgccttccacggaggcttcaaatcgctcattccttccgtccacactcctgctcgcttaatgaaggtgatggccaaatgcatcttccaggcagccatttgaatctccccaaaaacactctcccgagagtccaggtgcaggaagtgagttgtcacagccgcccctgcagcgaccgcgccacacactggaacgcgatagcagacgcggtcctggcttatctggtctggtccacgcagagctgaggc

SEQ ID NO: 103599 - DNA, 1061 bp, Homo sapiens
tggcaaatccctattctttttttaaaaacatgactgaagcattagggcctccaaggagaatatctgggctagatttgcatcagagccctggtagtgctttatttgactgcagtgtttacacgtttctttttctctcctagatacagacagggcccatgttgcctttatattctcagagcttagccaagtacctggcatatgtaatcctgactcaaacccaattttcaggcagggccgtgttctcctatcttgtatggatagtggtttgttatgtcccattacatatggatccttttttctttaaactttgcagtctatctagacagtggtggtaatgcatcttgttgggttaaccactttgtccctggtttagtggtttacagtggcagcttgcagcctgtcctccaccacccacgctgtgctgtgaaggaggcattttactgttgagcttgatgcattatgtaggatgctcaagtttggccgagtctttggcttatgttcacgtctatcaaaatatcttgaggaagtcaggccttcagttctaaagtagaatgtctgtttcaaaatgctaactagaacagcctggtggaaaaacattctgtgggattccagaaaggtctgattctttgtctctagaggttatgagtcagtttgctcccagctctcttaattggcctagtgcaaaaagtgtactccggagtcatcttgagatctgagctactgagtaagggcctgttctcacacttggatcctggattgggatggttatctagcaactgggcatttttgcttttaggcaagacattaagactgagtaatgtgtactgatgaggcaggagacagtcttcagatctggacttcagactgtcttcagttaacctgtgggactccttctccaagagattcattcaatttttatttgttcaacaacaacaaaaatttggtggtggcctgaaagctccatacattgaaagtaattgggggacaaaaaaaaggatgcagagaaccagagctttcctttttcttggccataccgaatggccttcataggaacttagggg

SEQ ID NO: 103600 - DNA, 1089 bp, Homo sapiens
ttagtagagatgggttttcaccaggttggccaggctggtcttgaactcctgacctcaggtgatatgcctaccttggcctcccaaagtgctgggattacaggcatgagccactgtcctgggcccaacttgttttttcagtgatgcacatctttatcccaaaagtgtggagcaagaaagttgtgcagcctggttatatagagttttactgtgtcttaatcctatacagtttgcaaagagaagaggtgtgagcatgagtgatcttgtgtggctgacgtagttgtatgtaatgtgttgtccttctcctccccgcttaggtcctggctataagtcaccatggcacagcaagctgccgataagtatctctatgtggataaaaacttcatcaacaatccgctggcccaggccgactgggctgccaagaagctggtatgggtgccttccgacaagagtggctttgagccagccagcctcaaggaggaggtgggcgaagaggccatcgtggagctggtggagaatgggaagaaggtgaaggtgaacaaggatgacatccagaagatgaacccgcccaagttctccaaggtggaggacatggcagagctcacgtgcctcaacgaagcctcggtgctgcacaacctcaaggagcgttactactcagggctcatctacgtaagtggctgccgtggcaccccgcaggctgggtctgagggctccgaggtggggggggggggcgggtcttcccatcaccctcacgtgcctgggccctggctctctggttgagaagggggcttgaaggagtgctggggtgacatccttgaactttgacatctgaacatcctagtgggatgttcttatagcattattcttttccctttgcagccaaaagcaaaacaggaagcctgttttagaacatacgtagggagaagaatatggccctgtctgagggatggccacccactggccttcgttctcaagttttggtggaaatatgaaggttcaggtcaatgttgtagattccttcttttttaatttaatttaatttaatttaatttttttttttttttgagacggagtcttgctctgttgcccccg

SEQ ID NO: 103601 - DNA, 1394 bp, Homo sapiens
agttcctctctggttttcttatctgctaagcatcaacacaggcttgggttggaatactgctaatggaaacaagttccagcttcttctgtaagcaaacaacattcctgaggtggaaagggaaggggggcccacccgcagtcttcagctcctacctcctgggcactggcagctgggaggagccccccactccttgttagcctggggagagtgagggcctaggtcgaggctgctgtaggttattagccctgggtgacagaggagccactttattgacccaccctgtagataactgctctgacagccctggtgtgtattgcagagagtggccttgtgcatacctgtgagcagataggacattttgcaggtgggaaagccgaggcctgggtggtgcctgcaggattgcacagctggtcagcacctcgctggactcaaatccagctcttctgccacaggctttgtgcccatctcaccagaccagcatttcccagaccagcatggagagaggtttttcctgcaggatattcctgggatggagttaagcagatttcttttttctttttctttcttttttttttttttgagatggagtctcacactgttgcccaggctagagtgcagtggtgcgatctcggctcactgcaagctccccctcccaggttcacgccattctcctgcctcagcctccagagtagctgggactacaggtgcccgccaccatgcccggctaattttttgtatttttagtagagacggggtttcaccgtgttagccaggatggtctcgatctcctgacctcgtgatccgcccgcctcggcctctcaaagtgctgggattacaggtgtgagccactgtgcccggcctaagttaagcagatttctttttgcaggctgcttcctacaacattttgtgcatattgtgattgcaagagggccatagggagacggcattccatccttactcggccacgaaaccctcttccctctgcaaattgctgtctttatagtcactgtccctgagaactgtcctctatggatggatataacctgcagaaagagtcactagactcctggtaactgattttcagagggcccaggtgtcattcctaggaagaatggggattaaatagctcagaatcacaagatagaggagttgggagggaaattcctatcatgccattctccactgggagcttgagctacaactcttctgatgttaggtggtggtggtggtggtggtggtggtggtggtggtggtggtggtgtttgtcctcattctaaagctaggaaattggggtgctaacagcttcaaggtcacaggaattgtgagcaggggacctgggactccaatccaggtctgtctggccccaaagccataaactccattgtggtacatta

SEQ ID NO: 103602 - DNA, 1086 bp, Homo sapiens
ttagttctgtggactctctggctagaactttaaacctatgttagacagaaagaaatagatagtggccaccagtacgatgctgaagatcagtctggcaaaatccctcctgccattgactagctgtgtgtcctggaggcttgatgtcctcaaagtggggacgctaggctgagggcgctttctggttgtgaggcctgggtgtgctgacctgtgcagtatcatacaccttggaggaccagcgtggtacagaggggctgcagaggggtgggtctcttcccttttaatacaggtcacaggctttaatgacccttaggttgaaattagagcccccccacccccacccccttgccttacttctggcttttacacaagaatctgaagaatgtgatgctctatcgcggacggggcaggcttcgcaggctcttccgggctttgcagggcagcctttgttgtgctgcaggacctggggcattccgaattggttgtggttgggagtcagagacaactccaggcttattaaattcctggctgtttagggcgatatagacagctgggaggggtaagggtggggagataacactcctccacctcccagcactgttatcttagagaaattgggttaaaagtgagtctgctggaggggattggtagcagacaggaggacagatactggtgctttggccctgggctactggaaagcttgcgggtccacctctgcgcttctccttcctgatcacggagcaactgctgttgaccaggtcctatgtgacgccttgccagatgctctgtgtgcattcgctgtctcattgcacccctagaggcagtggagcagagtggttagggatggaagacctggagccccaagtgagacctgcagggtacagacaccggcagctagtgcctgtgtgtccttcagcaagtaagccttctggccttgtttccccatctgcaaaacgggataccactagaatctacctcacaagagtgctgtgtgctaaagtgagattcctggtgaaaagcactcagaataaagtgcaagtggccgttatttaattaccaacagggtcctgggaggtgggccttttcatt

SEQ ID NO: 103603 - DNA, 1058 bp, Homo sapiens
tgggctggtcttgaactcctgatttcaggtgatccacttgcctcgacctcccaaagtgctagaattacaggtgtgagccaccgcgcccagccagttcttctgtttttaaagtaaaaaaaaaaaaaataaggtgggggtgtgtgtggtgtttattgcacaagcattattgcaacaaagctggcaagaagcagatttgccctgcacctcatccaccgttttgcatttttctgggttttctgtccatatacacatgtattttacaaaattgtaagcagaatggagactgtgtgtgttctgagttactactataatgcaaagttcctatgtttcattggtcgccagaattcatattttaatgaccctcttatgtccactgaggagagggaccatttttcatgttgccagaaagttccacgagttttattgagtcttggaaattcattcagcaaatgtatccagtacatctattctagatctaggccagaaactgcccgctggtcaggatgcagatgaacaagaggtcccaggccctgtcctggagggggctcgcagcgtagacctaggaacatgccacttcactctggtgtggttgtgattgaaggggctgaggaggtgggggctgcttggatgcccaattccagtcaattccagccgatggaaaacaggtaaaaccactttgtcagtagtggtgagaaggcttagaaacaagggagctgggagatctgtccgggcttttggaggaagctcttcaacctgttcaccccgcctccgccgttgtgtcacttccaaggcccctggccagaaaacccactgggaggaagtgagggagagaagaagtctccaagggaccatgacaacagggaggcttgggaaatagcccccggcccttctgagggagaccctaccgagggtggcagtggagcaggggcagctgagggcaggggcagggggaggatagtggggtggagtggtcttccaaagtcggaaggccattggcaggagacttgggctctgctgaggcccctgccttttccaggatggtgtgagaatggtagcaa

SEQ ID NO: 103604 - DNA, 1039 bp, Homo sapiens
gattataggcgtgagccaccactgcacctacacctggccatgctagggcttttacatggattatctcatttaattcttccctggtttccataaggtaggaacttatcctcattttgcagatggggagactgtgcagggattcaaacttgggtgctccagctcctgactctgtggccttggagacgccctgcactccaggacttgtgtttcctcacttggcggtgagtggttgggctggtccttgaggcctccaccctcaccagtggctgagcattcattcaatgggcagagagaacgttgggctgcagcagaatgggatctcccgtacagcagttggcaacccacagcggggttgccaggtcagcattgatgccttggctactgacttcacctttaaccccactggccatttttcaaatgaatgtggttggtcctaagggagagcaggtggaaagaccctggccccagcgtgaatccaggcactgctgtgcctgtctgagtagtgccctctggggaaccagctagccaggcaacctgccatcatgttgcctagtgagctcttgacatcagccatcttgaaaccattgggttcctttcgtccttcatctgtccacccatcagattcatagtcattcagcagtgactcctactaggaggaactgattctaggtataaggcactggctgggtgctaggaatatggagggaaaagaaacataggcccttgtttctgggagctgatggtctcccaccagataccgatgctggaaacccagggagaaggcaggggggagtctgagaaggcttcctggaggaggcagccttcgagattgtaaagtagagacatggtgtggcaagtccagggagcaggggtgggacctcgttcagttgcccagacgcaggcagagctttgttcaggggtgattcaggttggtgaaggccctgtgagtcacctggggctggtgaaacgtttcctctcctccttaggccacgacccagcctctgcataggccaagacggcccgtgaaggcttgtttcct

SEQ ID NO: 103605 - DNA, 1198 bp, Homo sapiens
cagagtgctgggattacaggcgtgagccaccatgcccggcctccactttagttttacaagggcccaaagcaggaacaaacctccagtcctgtggcctacaggatgacagcctaagccctcctatcccccacttgaccttcaatgcccatagggaacctgccccagcccatttctcatctgctgttctggtcatcttcccaaaagaccaaccctttccttgcctccatatttctacactttgacactttgggtcaagtggaaaaagtctggtggaagaactagttctaaatatcagcttagtcacttacttgctgtgtgactatgggcaagccacttgacctctctgagtctcactttgctcagctggaaaatgagaaaagatatgcctaagtcttagcacttgtctgatgattaatatgcataagctgaaggaatgaagggggggtatttattgtgcccctgccgcgtgccagacccggtgagagacactggcgacgctgtggtgaacccggcagtcacagtggctgcttttctggggactgttcttgaagtggagggtgtgatctattgcagcaggaggttgagtaactgagcctttgtaactgtgagcaggattcctcctgagctgaagatgagtgccttaagccaggtgtgagggtggggaaataccctaatttgacagacgaggaaaggaaacttcccgcactccgctttaagtggtggggccaggattcaaacccaggggctgctttgatgggccaccctggtttcctcttgcatccgcactgctgagcagagagcccggcacctagcgggatatcaaagacacagaggccgccagcagtgaaagctgtgttgaaaagaagctagaggaagctggtgaaaaccagaggttaggaggtggggacagggaaggccgtgaagggaggggccttttattgaccagccagccctcggccaggtccctgcctcagacgtgcatgttggcaggaagaacctggctgggcatctctgtgactgtggttgaatgaaggagcacctgagccttcctttttttcttttttctttttttttctgagatggaattgtgctcttgttgcccaggctggagtgcaatggcgcgatcccggctcactgcaacctccccctcccacgttcaagcagttctcctgcctcagcctcctgagtagctgggatt

SEQ ID NO: 103606 - DNA, 1075 bp, Homo sapiens
ggcagagaggccagacccccactgggttcaaatttggcaccacttttcagacatgaccttgggcaagtcgatttctctgaactgtttttttcacttatgatatggaaataatacttgcctcacaagagtggaattcgatgaggtaatgtgtttagaaagtgcgtggcaaacggtgccttttaaggagcggcagtggggtccggtggaaagggccagggctcgggagtcgaggcgccccagcattgtgctctggccccaccctgggctcactgggtgtctttgaaagagttactcaacctccgatctgctctgctcccactgtgtcaaatgagctgacaccacttgccttgttgcctgttgtgagatgaagatcacacacacgccaccttctatcagatgacaggaggcagcgagggtggttcctgggggtgggtgtggaaggctgcctggccttgaatcccagctcagccactcaggggctttgtgacctggggaaggctcctcaacctctcggggcaggtctcaggtggaatctgaagggcaacgccttcccgcggggctgtgctgagctgagaccctcaaaacagtgccaggtacctgggaggtgcctcctgagtctgggcaggtcctgctcatcttaaccagggcttttggcctttgcaggatgttcactccaccagcttccgtctccactgacgccagttgctggttttgtcccctccatgtgcttgtgacagaccccagggtctggggtccttcagaggccacgggcccctctcctccctcggtctcggcagccttcccaaggcagtccttgggtgggcccctggagaatgcagacagttctaatagaacagggtgagcctctgagaacagagcaataccagccccatggcatccctggggccacggagtagggtgtcaggatccccctgccgccaagcacctgattcacaggaagctggggcctcatccaggcaaccgagccctaatgacagcttggccctaggagcaaggcagacggaaggaaggctttcttgactggcaagcctggctcccttggcacactcctcta

SEQ ID NO: 103607 - DNA, 1358 bp, Homo sapiens
tgtgacccggccaaggcccccttgctagtgagtgcaaagccaggactcgaactgtcccccagcttctgtctcctcctgggccaggcttcccctgagctcctccctgcccccagccctggcctgcagctgcaagggttattttcatctctcctgtcattccagcaaaaccactgggccagtgagtcagtcttgtggttaagggaggaagggtactgttgggagcccgcaatggaagacgtttcttcagcgggtggcccccgggccctgcagtacccctgcaccgagagaagagccatgttcctctaggcctgcccatggctttgggaagtcagtgccctggataagccaccagccttccccacaaaggctcaggagtggcagttgagaagtattcactcccaattcacttggacccccttgtcctctccacccaggtgtcagcggtgcccactgtgctggccatgaagaatggggacgtggtggacaagtttgtgggcatcaaggatgaggatcagttggaggccttcctgaagaagctgattggctgacaagcagggatgagtcctggttcccttgcccgcgtgggaccccaatagaactcagcccttccatgccagcccttcctgctgcctccctcctgtctggctcctggggcccatgcttagagcccaggctccagccctgagtgcttccgagctggcggactgcccaggggccatcagaggatggtggtgctgctgctgatccggggaccgctgtcttccctcccatacgcctttcatccctccttctagggcctatggcagttctcccaggatgtgtggcgagagcctgggccagcccacagcgttcctagtcaggcagccacaccttggtcctcatcttggtcccttccaatctgaaacctcgtgcctggctcgtctgccacctacatttctctttccagctgctgttttgtaaaaagaaaaagaaaaaagaagcccaaactagtgagagtaatatctaattatctcattttttgtaggtctgtgataaagaacttagtcatcccttccacctcctactgtgaagaacagaccctgggtcccacactgaaatcccctctagtcacccattcccaccccccagggagctgcctcccaggcagggggtgcagaaaatgattgatgggctggggaaccctggagagcctcgactccggaagtctcaaggtgcctcctcctctccttagctggcccgttggttttctgagcagggggctgaactgtgaacaagtcagacaaataaagcaagggtctgcaccatctgcaatgtcacatctgtgtgggctcagagcacttgtcaccctttcccagggg

SEQ ID NO: 103608 - DNA, 1033 bp, Homo sapiens
gaggtagaggttgcggtgagcctaaattgtgccactgcatgacagcctgggcaatagagcgagactgtctccaacaaataataatacaaaataaaaagcagccacagtagatctcagtccatgtgagtcttagggaaacgccagcctcacgttgttagcttcagcactgccttccgaaaccacaagggaaaagcctagttcctcttcctcatggcagcctttcaaatatctgcaggtggctcttgaacagtctgaccacagcccagcataggaggctgtcgggaaagccgagcacgagtgaacgagggaagtgtttgggctgtgtgggatccgtgctgtgtcggcccgaggaggggaagcccagcctcacagctctgacatggccccctctctcctccccacagaacaggaggtgaggttccgccctgcacactggcccctgcctcggcccacggccatccatcacatcgtggaagacttcttaacagactggactgccccgatcgggcacatcctacctctgaggcgcttcctggagaactgtttggacaccgatttgcgaagcttctatgcaggtaacttaagctcccagaaagacaaagggtctgagctccaggttgaagaaaggtcacagagacccaagacccgtggagtttcaggacccatatctggaaatccaaaccccagactactgttcccgacaatgccgtgggttaaattacaactcacctaaaaataatggataatatgtcttcttttttttttttttgagatggagtctcgctctgttgcccaggctggagtgtagtggcgcaatctcagctcactacaacctccgcctcccgggttcaagcgattctcctgcctcagcctcccaagaagctgggactacaggcacatgccaccatgcccaactaatttttttattttttagtagagatggggtttcaccatattggccaggctggtctcgaactgacctcgtgatccgcctgcctcagcctgctgaagtgttgggattacaagtgtgagc

SEQ ID NO: 103609 - DNA, 1028 bp, Homo sapiens
cagtgccagtaataagtgccactgtaataagtgcctcctggctgggtgcagtggctcgcgcttgtaatcccagcactttgggaggccaaggcagacagatcacctaaggtcaggacatcgagaccaggctggctaacgtggtgaaacctggtctctactaaaaatacaaaaattagctgggcatggtggcaggagcctataatcccagctactcgggaggctcaggcaggataatagtttgaacccaggaggcagaggttgcagtgagccgagatcacgccattgtactctaacctgggcgacaagagcgaaactccatctcaaaactaactaaataaataagtgcctcttacatagcagctattttcatgaacagccctttccactgacaggtccctcagacttaactcgggaaatgcattcggcaagaagtacccgctgattcgagctagctacgaatccaaaggaagccggggtctgtttatcctgggtactgccagccactcggtggactaccggaaatctgctgggggcttcatccacggattccgatacacaggtgagcccagctgagaaggcagaactgtccccagacggaaccactctcagcatcccagggtttataaatctactcctatgtccagaagcattaggggattgcttgtcagtagctcattgtcataaattgtcttggggaagtgacaacaggtttttgtggtctgacgacatgtttaggaaagtatcagataaagtgtaaaagtccacgcctgtagtcctagctacttgggaggctgaggcaggaggatcccttgagtccaggaagtcaaggttgcagtgagccatgatgataccactgcactccagcctgggtgacagagcgagacttggtctcaaaaataaaataaaattaagtgtaggccaggtgcaatggctcacgcctgtaatcctagcactttgggaggccaaggcaggtggattgcttcaggccaggagttcaagaccagcctgggcaacacggcgaaaccctg

SEQ ID NO: 103610 - DNA, 1048 bp, Homo sapiens
tagctgggattacaggcaagcaccaccacacccggctaatttttttatatttttggtggagatgagatttcacgacgttggccaggctggtctcgaactcctgacctcaggagatccacccacctcagcctccccaaatgctgggattacaggtatgagccaccgcacccggccttcaattctatttttgaaaccactctgtgatcaaagcattcttctgcaagccggcaggatccaagtccccagctgccctcccctggatggcgatcctcaccaatggaaggagcaggactttggaatcaagcctatctgtgtttagactctggctctgctgcttttaggagctctcaagccatgggcctgcagggcctgtgcctcctcacctgtaaagcaggccacataccacctccaggttgcttggaggagtcagaaagatggtgcacagatacacttagtacagggcctggtacagaattactgctcagtggatagatgtatctgtcagaggactcagaaaggggaaagtagaatgtcaggtttcatttcatcaccagcagtcatacctggtctgactgctatgtgcaaagttaggtgaattctccatttctcatactgtcatcttctcctctctcacagggcaaatttaacccccagtacagtgctagggaaaatactgtgagctcagggagaggcaagggcagagcctctcaagtgcactgggatgagggcgtaaacagatgaatgaatgaaaaatgaatgaatgaatgtcctattttcttttaggggccggcggttggagccaggcaggtgggtgggtgggtccagggagtggttttcacttagtggtcttatagctaagagactaagccatctttcctctgtccccgcctgcagcgtcctctttgtagccactggtttatcagtccccaaccaggttgacttccctggctccgaatatgcagagggttacgagtccgtgtccgtggaccctgaggactttgtaggccagaatgtgctgatcctgggtcgtgggaactcggcctttgag

SEQ ID NO: 103611 - DNA, 1050 bp, Homo sapiens
ctctcagatcaagacctcctggctacacctgcacttgagccaatattctccacttggctcactgttacacgtcctctgtgaagcccttccttaccacgcaacacatagtaaacacttggctctgctgtttatatgacacttctaaagtgtgtgtgtgtgtgtgtgtgtccgtgtgtgtccatccatcattccctgtctaggcgagcttttagaagagaggaattgtaagtcgttgagtgactgctgtgcggcaggctgtgcaagggaagggactatgtctttgtctcttaaatggtaagatttagtgcgtacctacccactttctaagcaagcagactagggagttccttctctgccagaggaggtcccagcaccttgggcatttggagcttgcttctgtttctctaacggggctctcctgcagcactgtaatggcgttgactggcgtcagaagctggactctcagcgaggggctgtcattgccacggagctgaagaacaacagctacaagttggcccggtggacctgctgtgctttgctggctggatctgagtacctcaagcttgggtgagattcctgtgcaggagctggcagctgatcttgtgaaaggaagggtctgggtagggaggttgaccctcccctccccgtgtactggacaattgactggcagagataaatccaggggtggggtagagatggaggggtcagttaggagacaaatgccaaacagcaggcatgctgaatggagtcctgaactagggcaatggtgtcaatgaaatccagaactgagaactcagaagacgatgttttccctttcccttgaaaatagcagtggactgccgggcgcggtggctcatgcctgtaatcctagcactttgggaggcccaggctggcagatcacgaggtcaggagatcaagaccatcctggctaacacgatgaaaccctgtctcaactaaaaatacaaaaaattagccgggcgtagtggcgggcgcctgtagccccagctactcagggggctgaggcaggagaatggtgtgaacccgggaggc

SEQ ID NO: 103612 - DNA, 1048 bp, Homo sapiens
gatagtggaggaggaaacacagtgaacaataaataataaattgatttacatcaaatggtgaatatatgccatggcaaaaaaatgaagtagagatgagcatggttactaagtcattgttctaattcatcaggtgctaacagttgggaggggtcaagtaggcacaaaacaggcagcgagctcagagccccatcaagggccccaggaacctggccagggctgcaactaagcagaggtgctgggtctgactgattggccttggccttgtcaacaaagttagctctgtcttgtgacacctttgtttttgcaggggaaggaaagatacaacttccccaacccaaacccgtttgtggaggacgacatggataagaatgaaatcgcctctgttgcgtaccggtaggtcacctctctggtgggtattgtggccagactggagcacgggccccactctatagaatccccagtgaccacatgagtttcttttttgctgcagttaccgcaggtggaagcttggagatgatattgaccttattgtccgttgtgagcacgatggcgtcatgactggagccaacggggaagtgtccttcatcaacatcaagacactcaatgagtgggattccagggtgagccgccatctccatcaccctcctggtgacaccatgtctctattccctacagtgcctgtttacgcaggctaggttgtataaactgtttcttatcccctttcgttacttatagagctacctggatgtttttttttgtcttgtgagttttttcctctgcttagttccttgctgagaaagagcatgactgtgtgtgtagaactatgttaagtgttaagaacttttctgcttattttttacgcaggaaccagttaactcccttcttccagtactttcttcatctctgttccattgtggcctcctgttgacttctgctccctgagcatctgattttttcctctccttattatctgggttggcagttttcctgtaagtctggccgctcttctttttgacctcttctttcattgactgagccactgccttca

SEQ ID NO: 103613 - DNA, 1741 bp, Homo sapiens
taaactgtatatttctgtttcctggcatcctgagcaaaagagcaataagattaagttataaaactcttgtcaggaaaagaaacacagcaattcttcaggaggaatctttgcttctcctgacatttcaaatagcttcttacctcaaaggacaagtaggtggaatttaggtagtgggaaaccagagcaccagacgagaagtcagcctacccaggtgcttctataactagtcatctcctgtcttagcctcggtcaccctacctttaaaatgggggcgttgggctagatgagttgtgcttgctgtgttctatgccaggtgttaagtggacaggaactgagcaagcactgaggattcgtctctcctgctctggccagagattgctttccacctcttttagacttttggataagacttctggatgtatggcttaaaagaaaaaactgggggttatctctcttactttgcatgtctttgcctgctcttcccacagtgagtgttgtggggccctagaatactacgacaaagcctttgaccgcatcaccacgaggagtgagaagccactgcggagcatcaagcgcatcttccacactgtcaccaccacagacgaccctgtcatccgcaaggtgtgcgcctccttctgcccctctcccccttgttaggaatgctgtcggcttctacagctgaagctgcagaaagaacagaagacatgggaataacgtatgtattataggtaaaagcactttgccaggtagaccggaaatgtggatgttaagcacagctggacttgaagcccagttctgccgcgcttcctggcttagtctctggagccttagttctctcatctgcaacaaggggtagatgtacatagcactaccactggggcaaaggtgaaagcatctgaagcacttggctggaatctagcaggtgcttagggtgctgcagtgccactgccacccgaaacttgctggctcactggctgcagtgtttttggtcaatgaggtggggcctccttattaaggatttatgtggtcagcaaaggagttctttcccatccatgtgagtgggcagtgagacctgggagtgtctttccatcttctctctttgatcctctttgcagctggcaaaaactcaggggaatgtgtttgccactgatgccatcctggccacgctgatgagctgtacccgctcagtgtattcctgggatattgtcgtccagagagttgggtccaaactcttctttgacaagagagacaactctgactttggtaagaagcgtgcctggggagcaactcaaaggcattgagtatttttgttggtacagaacaagtctctggtactagagaatggatagaaagtggtctgtcttcccaagggaattgacagcagcagtgtctgaatctcccacactctttagaggttaggagaagagactgtcactgcagtacctgcttgaggcctcagcttttggagtcctcacagcaccctaatagcaagcttccaaatgttgcttttttgttgtttttttttttttttaattgagacagagagtctcactctgtcacccaggctggagtgcagtggcgcagtcttggctcactgcagcgtctgcctcccacattcaagtgattcttctgcctcagcctcccgaatagctgggattacaggcatgtgccattacgcctggctactttctatatttttagtagagacggtttcaccatgttggcgaggctggtctcgaac

SEQ ID NO: 103614 - DNA, 1075 bp, Homo sapiens
tcagctcactgcaacctccgcctcccagattcaagctgttctcctgcctcagcctcccgagtagctgggattacaggcatgcatcaccatgcctggctaatttttgtatttttagtagagatggggtttcaccatgttggacaggctggtctcgaactcctgacctcaggtgatctgcccgccttggcctcccaaagggccactgagcccctccgttttatgtggttgttgtttgagacaggatctcgtgtcactcaggctggagtgcagtagtgcaatcatagctcactgcagcctcaaactcctgggctcaagcaatcatcctgccccagcttcccaaagtgctgggactacaggcatgagccactgcaccaggccagctcttcatatttttagcctgtcttttatttatgttttgtatggactataacttttttttcctctaatggttttcaactgcagaaaccccgagactcttcagttgaagttcgtagtgattgggaagtgaaagaggaaatggattttcctcagttgatgaagatgcgctacttggaagtatcagagccacaggacatgtaagcagcatcttttactactttctacactgctcttatgtgtgtggaccagctggtgatgggtattttcttaagccctagtatttccaaaaaggctttgaagccacttactcaaaacacatttcataaggttaacagaggtatttgaaaaaaatcaagaccggccaggtgcagtgggtcacctgaggtcaggagttcaagaccagcctggccaacatggtgaaacccagtctctactaaaaatacaaaaacttagccgggtgtggtggcacacacctgtaatcccagctactcaggaggctgaggcacgagaatcacttaaaccctggaggtggaggttgcagtgagctgagatcttgccattgcactccagcctgggcaacaagagcgaaactccatctcaaaaaaaaaaaaatcaagaccaaggggaaaagcagaagttcactgactgcaaacttctttttaacttcctggtatcctgaggaaagaagaaatgagtt

SEQ ID NO: 103615 - DNA, 1065 bp, Homo sapiens
tcaggctggttcatggcagatagcatgggcaggaaactaactccttgtgctggtcatgcgcactaaagggaaacacaggcaggcaagaagaggctctggagcttacctgggctcagttctgctgtgggtcaactctaggaagccccctgtatgctggtcctttgagcctcctggtgttgtgtggtccagcggccactacaccccagattggaactatcagtgaacagtcactatagatgaagtaaaatcatctggtcagtatttggaggcagtgtaccttttctaacacctccagtatgcaccgtctgggtctcttcctttctctaagcccatttttcgtagtttaaaggagttagtggtgatggtaaggtttagctgaagagaatggcagcgtgtgccttttgaagaagccactggtttaaaggtctgcactgagatcatatgtctgtctttccagagaacgcattcgactgcagaaaaagttccagaaacaatttggggttaggcagaaatgggatcagaaatcacaggtaatgtatttataccagaattctgccttggaatttggttctgtttatttggttgtctttattaatagcttagatgagatatacttcacataccgtacaatttagtggtttttaatatatttgaagagttctgtaactggtcaatttcagaccattttcatcaccctcaaaagaatcccttaccctttagcagtcaccctgtcttgatctgttttccgttgctagaacagaatacctgagagtgggtaagttataaagcggtttctttagctcatggttctggggactgggaagtcccagatcaggagccacatctggtgagggcctcatgctgcttgatagcatggcagaaaaagcagaagcgggagcagggtgcaacagagaaaagggctaaactttgggtagttagcccattcctgagagaagggcatgaggcatttattccttttaacgacctaatctcttaaaggccctacctcccgacactgccgcagtagcaaccagattgccaaatgaattccaggaggcacaccca

SEQ ID NO: 103616 - DNA, 1417 bp, Homo sapiens
agactactaagtcttagggaagttgagtttgtatgaattggtgaaggtatatctcagaaccaaaacaaggttactatatttgaaaaaacattaggacattttatcaaatctgacaccattaaatttttttaaacacttatgtaacacagaaaaagaaaaactaccaatcaatacaacaccctgtcaaacacaaggtgcagcctcattttaaagatgttacagtaaaaagagagtgtcgtggaattaatgaaatatgaaaaatcagttttgtttgcattcttctcagttttaagtacatattcacagtataattaacaaaaacagtagtagtcgctcaacagttgagggttccattttgcgtgttgctttttgagttctatcatttatgtctttgcttacttcatatggagggtgttttgtactctgaggccttcgttcatgccgctactcacatgatttatatttttcagattttggaagatggcaaagttcatgacacccgtgatccaggacaacccctcaggctggggtccctgtgcggttcccgagcagtttcgggatatgccctaccagccgttcagcaaaggagatcggctaggaaaggtacatgcctgtcagcaggagtctgaatctttgcagctgtggctgctactctcgagtccctgtttagattttattgtctcaaaatcttaactcctgaatttcttatagggatgccagctgagaaaggttatctctgggtgtagtcatagaagagctgggcacttacagaggtgttgtgaacaaattctgagactcttccacgctgtcctctcgcgctcagggatttctggttctgcagaaacttgcctggttgacctgtgcattctctgtcttttcttgttcttcgtaggttgcagactggacaggagccacataccaagataagaggtacacaagtaagtgtttctgcaactgaatgccccaatcagggccttgggaaagttgttctttattctaatgaccttcttctgaaagctttttagaatgggaagaaactgccaacaataattcataacttttagggatgtattctgggctttaacaataaccacatttttggaaatagccctcaaaacttagaccattcattaaagaggtctagcctattaaaatggggttttgggcccttttaaaaacctgttgaaaacattagctgggcgtggtggcgtgcacctgtaatcccagctactcgggtggctgaggcaggacaatcacttgaacccagaagttagaggttgcagtgagcagagatcatgctattgtactccagcctggtgacagagccagatcctgtctccaaaaaaaaaaaaaaaaaaaaaagtaaaacccctggttttaagatcctggtaccataaaaaggctttttctctctgcc

SEQ ID NO: 103617 - DNA, 1008 bp, Homo sapiens
tgcaacctccgcctcctgagtagctggtattacaggtgcccgccaccacgcccagctaatttttgtatttttagtagagactgggtttcaccatgttgaccaggctggtctcgaactgctgacctcgtgatccgcccacctcggcctctcaaagtgctgggattacaggcgtgagccaccgcgcccggcctccaagaaatacttgtgtagtgaattttcctctaggaactcgccttctaagcattttcagaaggttacaacggaagataaatgcataggtttttttatagaagtgtcgggcagccatctgctatacagcgccggttttttaattcccaagagggctatagcattatgcagagtgcagactctggggtcagactgctttggttcacgtttttcatccactagcatttcaactttgggcaatttcttcatttctctgtgctttggttttcttatctggagagtgcggataacattggctcctacctcacaggattgttggcaggactgtatgaatgaatgagtggtaaacagtaagaacagtgcctggcagtattcatgaacatttaacatggcaactttgggcctgaggtctgtggggacctccttggccctctggcagttcttctgcctggctttatgtccgcttgcactgcacacaggatttgcgttgatggcagaaaattgaaacaatgagaaaggaaaattgaatttcaggatatacttaaagatctttttttctcagcactctatatacataaatgcacttttgcaagtctgaatacttgtgtggcattatacaaagtgcttagaacaaggatcttgtttattttgcagatggaaaagactaaggtggctggacgtggtggctcacgcctgtaatcccagcactttgggaggtcgaggcgggaggatcatttgaggtcaggagttcaagactagcctggacaacatggtgaaaccctgtctccactaaaaacacagaaaatagccaggcggcgc

SEQ ID NO: 103618 - DNA, 1048 bp, Homo sapiens
tctaagctgggtaaacagggaaatgaggtcctgaagggcaagtgaggcagtgcaaaggcgggggtggggggtggagcggggagggcagtcaatgcttttgagcctggggttggggtggggtcaaagcattgttgaaatgggggtgcatgggagtgagctgcaacggtggcacgtggtagccagagagtgggatgcaaaagacagagagtggagggggtgtggatattggaaatgccaagggcaagggtaagaccccgaatgaggtggcttggggcaggcagaggtagggatgatcttcaagtatgcactggaaaggtcacacaaattaatagataaggcaaaactacaacattcgctgttgttttctatatacatcgagtatatattaagaaactgcctacccggttaaaatttgaagtgcaaatgattcatcaaattattctaataagccccaaatcaccgattggtttttagaaatgagtggtgtgatcttttgatgatgaggctgttatgagctaaatgatggcttgactggaccatgctttgacacaggaaaccacaccagatgctccccaagcttccctgttagagtaagggtcattccacctcggcgagtgcagaatcttctcctaagttgtcctctacggttcgactagaggacctctctgtgcccagcagccccaggaggtcagggccgggaatgggaaggtagtgggaggctgtgagaggggtagaggctctcatcggcagggcagtggtgtgcgcccagcccagcccagtcccaccagtcaggaccagtagggagactcttcttctcttgcccccatccttggggcgggccttggagtttatagaacctgagaacagagctgagtccttaacccagccttggggagcgaggagaggagatggagccttggtcccagcccttctcttctctctgccccgcccaatgcaggagccaccccttcccccagccagcttccctgacatagtaagactgatcggtacaacagtatttcaatatttaacaaccagtgaggcagca

SEQ ID NO: 103619 - DNA, 1026 bp, Homo sapiens
cagatgagaaagcggggccacctcctaccacaatccccaggaggaatggggcttccatgggacaaggaaagttactgagagaagttgcagctgatccagacagctcagcgaagaccaaggtcagggaggctgagttggttgcaccagttgttgcatatgtgtgggagaggtaggggttcttggggagaccgccaaggcctctgccaccctcgcttaggaagagtgggcacggggaagacccccaaggctactccccacctccctactccccgtggctctggtcagcagtggctgctttagttgccattgggaaggcaaacactgtttgcattcctgtcatttaaaacaatgtggtgttgtgacactctggaatctgaagataaatgtttaataaaaggattcaatttgatatgatgtcggaacttaattagatccacaatgcacagagggcttggcaagcccttcaattaggagctacttaagggtgttgtgtgtggggatctgcagcgctgtcaagggactgcgggggctgggatggtgcctcccagccttgagagctgccctctatagattcgggctcaagggcactgctttttggcatttctggtagaggtgatggagggtcccggcccattctgtgcttggaactctgcatatgctaggattgtggctgcagcatgtgaccacagaatgatgcaaatgaacctgacctatttgagactcagggctatgaccccaggtcaggtgcagactcttcagaggcaaatgttggacaggggaactgcctttaagcccacttggcccagagtccaagggcaatgaagctcaaggctgccaggaactggtaaacagctgtgtttgtgatcctggccaggactgacatcaggcaggcaggtactgatatagctacatcaatagtcaaatatgagttgataaaatgcctgctgtccaagcaccccgaaatgccccttctgcccactgctttggtccctccagcccctccactgggatctcttgagcctcccc

SEQ ID NO: 103620 - DNA, 1102 bp, Homo sapiens
aagcgttcaagtttattaacaggtaatgctaatactgagaggtagcatggctgaatgactttggcaaatttcttaaactttctatgcctcagttttctcacctgtaaaatggaaataataataataaaaaataatactgaccccaaaacaagttgctgtgaggatcaaatgagttactaagtgcttaaaacagcgcctggtgaataagccctatataagtggttttttttgtttgtttttgtttttgtttttttaaagttggttatattccttaaggcaaaatttcttggtaatggggtcatctctaggatgacgaacctggcagagttacttcatgccataggataagtgcagtcccattggatgctgtgatgacagatgacatagaaaacagtatgttactttcatccttctatcaaattcacataacaagaccaaagcctgcaccacatccaattctctgttgcatctcagaattctaagtccttcattaacgttctaaaatgttgaattctgtgtgctatgcagtttttaaacaacatctgttcatcaaccccagaggtgacagcgagtcagtgttgggggttgttcaaagcatacccacacctcttggctccctcacaggaatgttagggggtctaattaattactgtttgcaaagcaaccgagaaattctccagggaaagttgctgtagaaatgcaagtttcttccagcactttgggaggctgagacgggcggatcacgagatcaggagatcgagaccatcctgactaacacagtgaaaccccatctctactaaaaatacaaaaaattagccaggcgttgtggcgtgtgcctgtagtcccagctacttgggaggctgaggcaggagaatggcatgaaccccagaggcggagcttgcagtgagctgagatcgcgccactgcactccagcctgggcgacagagcaagactctgtctcaaaaaaaaaaaaaaaaaaaaaaaaaaaaaagaaatgctagtttctgtattattattacatgtgcttgtaattgttttcaaagtttacttattgggcagggagagggagaatatattttcttccttgacggcaatggataat

SEQ ID NO: 103621 - DNA, 1107 bp, Homo sapiens
cacacacccatacacacacgcacagaatgagaaatggagaggcatattttgacattcttccattcatctctctgcctattcattcattcaaaaatgcttattgatcgcctactcgatgagacgcactgttctagccactggggctccagcagtgaacaggatgagcaaggtccttgtttctctaaagcttacgctcattccactcgagagcgtccctgggtgccaggcccagcacagggttaatcacactaaggatgcattataatgcaaagaggatggacaccacctacacccctttccgggctagggatctaaatgccagggagatcaacctgtccaagacctcacactgggttgtggacctggaatctgaagctagatttgaggccgactgtctttctactcactgctcaaagccgactaacaaacccgagctgagagcggtggtgcagttggggaggaagcatctagctgaagtgtgctcaaataaggcatcgtctaattcgattatgcttgctagactgcaatgtaataaaacagagttttcatataagcatcatctcctaatgtttacagaacaaggaagcaaaattaagagaggaatttccagggagaaaagcatgtgttttaggctgatgtaaagagaatagacccagaaaacattgatttttgagtttacaactcagctctgacgagggggtgcctggtggattgggagggtaggaccccatgaagggccaggctggtgcccagaggaagctggcgagagtgggagggcctgctagaaggacctcaggatggaggagagaggctgacagggagaggcttgttaacaggaaagagggctggtgaaggcaggccacagaagacttgggcagcctgtaggatttatttcccacacctccttgctcctctccaagcctccagcttctcttcccagtgtctgcctttcacatgcagccagaatgacttttctagcaaagtagagcctgatgacgagtgtgtgggccctggagtcaagctgcctgggttcgaagcctgctctgttccttcctatgttgtgtgaccctgggcagtttacttaacccttctagacgtccctttcct

SEQ ID NO: 103622 - DNA, 1112 bp, Homo sapiens
gcagcggtcttgcacatgacctcacgtgcagggagctgttattccaccatatgcagagtctcatttggaactgatgtttacattcttacccgagatctcttctcagtatagcagtagctgctcagacataacaggaaagcagatcagccagccaaccctgggaaaaggtgtatctcaactagtaagaaatacaagtgctttgtgtgcggtgatcatgaccctcgacgtttgcatgcaatattctgggttcagatgttgttggaacattgtttcatgtggctctcacaaccagtcctgtgaaccagaagttggccccacagctcccattccagtgttgaggagctcaagtgacttgtccaaggtcccatgattagcgaagggtggagccaggattaggactcatggcctctaattcccatcggtaccacccatcctcaccttgctgcagccccagggtgactccaggccacaaagtgcctgccagttaaaagagcagaagacctcattacaaaaagcaagtgattttcagcgtcttcagtacacttttcctggcaaaaactgcaattacttttgcaccaacctaatgtatcatgattttagctgtccagcactgaggaacctgcttcctgtgtttgggagttttaaagtcccatcctccttgaggccaagatgcagccatgtgacccaggctgcaccaatcagacccctcacatgagactccactaggaagggcatgaagtgatgatctgccctctaggaacaggtgtggccctgaacatccatctcagagccagcaggggcccgagtgttggttgccctgcccctcgccagggttgctagctggggagatcaccaggcctggcacagtcatggtcgtaacttggacctcaccttgtggcctttagacctgattctgtggccctcagaattgagtcatgggctggttaatgttctggaggtcatcttctgctccagcttgactttggctctaggcacttctgctattgcatctaggaaccttgaccagtgctgccgtccgagcttataaaactcccccaaagcagcatgcttccttagggaaagtacagcagtaaaggcaggcactctgacct

SEQ ID NO: 103623 - DNA, 1048 bp, Homo sapiens
ttgaccagcagaggagagggagataaagccagtaggtgagagatgagcttggaggaggtgactgctattgcagatagaattggtggagaggcccctgggaagaagaatccttgggtcacagacaggtattctgcgatggagatggagcatagcatttggaaagagatttcagaatgatgaacacagcctcagacttcttgcttcccacaaatgcagagacccttccaccccccacgccccacacaaaaaagtattcaggtggaagctgtcaacccaggttgggtcagttggacaggtgactctgcctgtcagtgccagtcacacttctttaccttcaagacttcaaagtaaattccagtttggaagtgacagcttttccccatagggcgtgtttcagtggaagagcgtcagttccgtttccagggccccaaagccctctgtaagttctgttaccttctgggtcagttcctgtggataaaaggcttagccgtgcagaagtgtgctctggctgttgtgaggtttgcagatcagtctcatggacctgtgccctgcccgcggcctcagaacaagttcccgtgagaggcaagtacatctctcaaaactcattgaagtttttggtttctagactaatgttctgcagcgggagattctcaagtcagatgagaactaaggcgttctttttcttcttttctgatctcacaggagacccagcagtgggcaagaccgccctggcacagatcttccgcagtgatggagcccatttccagaaaagctacaccctggtgagctggggtgtcaagacctggccacagcttatagagaagtgctcggttcaccatgatgagtgacttcgaagttccttgagggaagccttaagacagctgatgaaaggctgctcagagggccacgtggagatcgttttttccactagcccagggtgagaggttggctacagagcagaatggccacaagcaacttggccaccacgtgtagcagctcacatcagggcagggaggtggagaggactagttggtcccctctgacttct

SEQ ID NO: 103624 - DNA, 1032 bp, Homo sapiens
cgagtactgtaacttctaggagccagatccccgccccaggaagcgcccctacttggagtcctcggaaactcttgccccacccgcttctgcgctgggcccccgggccggctgggaggggcggggccggctttccagagggaatctgcaaacttatcccgctgcacgccccagcctcgctggcttgctgtaaacaaggaacccgggggagtgcggagggagaaagagcttctcccaggcctcaccctactgcacacaccgacttccttcctcacgcctgtctctctttcctggttcccacccgtgccaggtgacacgcagagctgaagccatggttcatcaggtgctctaccgggcgctggtctccaccaagtggctggcggagtccatcaggactggcaagctggggcccggcctgcgggtgctggacgcgtcctggtactcaccaggcacccgagaggcccgcaaggagtacctcgagcgccacgtacccggcgcctctttctttgacatagaagagtgccgggacacggcgtcgccctacgagatgatgctgcccagcgaggctggcttcgccgagtatgtgggccgcctgggcatcagcaaccacacgcacgtggtggtgtatgatggtgaacacctgggcagcttctatgctccccgggtctggtggatgttccgtgtgtttggccaccgcaccgtatcagtgctcaatggtggcttccggaactggctgaaggagggccacccggtgacatccgagccctcacgcccagaaccggccgtcttcaaagccacactggaccgctccctgctcaagacctacgagcaggtgctggagaaccttgaatctaagaggttccagctggtggattcaaggtctcaagggcggttcctgggcaccgagccggagccggatgcagtaggtaggtgtcccagtgctgggtggtccctggggagtattgccccatggaaggatagggagtaaggatgactgggaccctctccagggtccgtcccatgccttcaatcctc

SEQ ID NO: 103625 - DNA, 2160 bp, Homo sapiens
ccatcccatgccacctgccgttacccaggcccaggctgggagcagtgaaatgagagcatccccagggtgcagccggcgtggactcagaggctacatgaagggggccgcttagtggccactgggcactgtggcatggactaggggtcagggcacagtgtggcactctctgtgtgacttaggacagggcttgtcctctcccagcacctttgctgcactctctgaagtgagaggggaggatcacatactctttgtagtgccttggagcctggaacttctgggatcccaaatggccgtttattccccagggacaggtgcatgtccccagctggcctgagccaggatgaggaagccaccgctgtaaatcctgcccctttcccaggccccctccttggctgctctgcaggataggggcagcctggtggctgccagtcctgtgtgtccgcctggcctgttgaggcagcctcctgagagcaccctggcagcatccactgtaccactgtggggagagggctgagcgggggtcctgccatcctggacccagtgctgtgggaagtcccaagggccttcgcagagccacagagcaggcgtgaaccaggctgggaagaaggcaggctgctcctcctggggcccaaccccacacagtggaggcttacctctggcttcctgtctatctgtctgcctccctgtcctgctgtgacgcaccctgcctgcccacccacccccaccactgccagggctgacgctgccctgcaagggtgcagagcgagactgctccttctgcctctttgggccaaagcccctggacctggggtgtcagagactggctggcatcccagatctgggtggtgtctgccctggggcttccttggccacatttctactgaggagcagtctttccaaacaaggccttcccaggcacccctcagggataccccagtcccacaccctccctgttctgcttcatcccctccctccagcctcgctctatgtaacagcagccaggctgaccccggagcatgcccacagcatcccatcctcagctgctttccccaggccctccccaagctgcccaggggaccggagaagatgcccccagcttctgtggctggagccctcccctctcctgaggtccctttcaccttgcctgagaccgggtctttggggatagccagcaggccctggcccctctgttagtgtctccactctttcttccctgggtccgccggctggttcacagagcacggaggagcagctggaggagcagcagcagcaggaggaggaggtggaggaggtggaggtggaacaggtgcaggtggaggcagatgcacaggagaaaggtgcagccaacccccaggaggatgattgctaagcaaagccggagcctcccgcccactccttgctggagccagctgcagaaccgggggccccggggctgctgggggggcaccagggttagctcagccacttgcctggcgcctcacccgcataaccatcccttctctcactttctctttgcagcccagtcatctcaggatcccgctaaccttttctccctcccaccactgcctcctcctccgcttcccgctggaggtcctgcctcatcttcatccacctcttcttcctcctggatctcatctgcaccctgcctcttccctctctgcccctgtccgggttttctctctgcctgctcacgcctccatcccgggtctgccctggtcccagcctcccgtgccctccacccaggccccctggccctgcatcccagagcgtcctgcctgccgcctcctgcgccccttctggtacctcctgcctcccagcctggggaggaggggcgcagctgcacctcctctgtgcccactaaccctgccgggcacctctgagactgggccctggctgcaggccctgccccccctcctctcctcccggcctcctcctcacgtttcctccttgcaggttcccgtccgcaccctctcagacctgaggctgagcttgcagtgagggcttctcctcggcccctcgcccgcccccagagctgccatccctggtttgtagcttggcggtgctggagggaggggtggagcgaggagggtgctcatctcttgatccttggacttgagccgagctttcggctgattatctccacccaccaaagtttctcat

SEQ ID NO: 103626 - DNA, 1948 bp, Homo sapiens
ggcttaaggattgcagagtggcagaaaaagccctggccatgtgcccacaagccccctatcccactcttttctgcctgctctgtgaccttgggcaagtcactgtccctctctgggccacaattgcctctaaaattgggacagacagctgctccctgtggcttctttcgcctggggcatcagtgcctctcccagccctgagcaacccccatcccacccccttcagagtcttggcagaatctggcctctgtaggtggccgccaccgagcccaagacggggcatggggctcctggatgggttagttggggagcccttgctgctccccccaactcagttctgaatccaccttctttgggcctcagccccaccccctcctccagaaggaagcctgtgactcaactgcctctctctctctccctctcccccacccgtcaatctcctctccgcccccttgccctgcatcaccccctccttaccggccccacctccgcccctcccatcctcctgcccttcccctcttttttttctagctgttacaagccagaggcacccggatgtgaggccccagatcacctccagggacttggggttcccatctgaaatcctttatttttgtaccatggggtgggccccgggcctgagaaggaagaagcaccctctccccggcctcctctgtctgcacccgtggggctgtgacttactcctgcctccaggggcggggcggggcccccctgggacctcttaaggcccaaggtgggccccaggacctctgggcagagtggactgctcatggcagatgtgtggcaatgtctggctgtgtctctccggcacctgcgtcccctctcccgggctcccctgctgcatggtggatgtgctccttcctggcccggtcacattgcctccttgagccttagtccagggggtcactcctcccaccccacctacctcacagggttgttgtgagggtgcacagaggagcaaagtccctgaaggccctcaggcagtatataggggccgcccaccttcagctgccctgggatgggaaggacccagcccgacccctgggcataacactgtgtttgcaaatggagattcaggtattggggatgcaggttgtggggagctggcctggcagagtaggggtagttggcttggccttctctttggtgatcccacccccagccatttgcattgctggcccagcgcctggcctggggggcggggagaggcagcagaaggggctgggcaggggcggtggaggactcaggaactgcccggggagagtgggtatggcggctgagccaggggccctcctgtgtttgacttcccgggatgggtccttgcttctcagctgtgtccgaccccaccatgtaataaaacccaaaggaacagcccagcctggctgttgccctctttctctgggccacttttggggacggggctaaactaaaggtgtggtagtctggtccaaaggaacgcggctttgtcccaaaagcccagggacgctgccctgttgtcattttcctgtgtgtgttgcagggagggcttggggaactggctatatcctttgccctggggccggataccagagcacctgccctacctggccgggagccagaaaacagaactctagggagagccctgggctgcctctgccacatcctaaacctctcagcgcgccccctccacttctactctgacacctgggccaccgccatccctccctattgctgccacccctctgcccaaaatcctaggaaatataaacaccccgccctctcccttctctgaccctgctggacccagcccagaccccagaccctccacccaccctggccagttccttcaactcctcagtcctccccgctgctcgaggaaatcctgccgggcagtgagcccctaaggcgcaggccttccacaggctggggcgggggcaccctcttgccagct

SEQ ID NO: 103627 - DNA, 1070 bp, Homo sapiens
atgatgcatggatgatggatggatgaatggatggatggatagatggatgatgtatggatggatgatggacagatggatgatcgatgggtggatgacggatgggtggaaggatgatggatggatagatggatgatggatggatgatggatggatggatggatgatggacggatggacgatgggtggatggatggatgatggatggatggatggatggatagacggatgatggatggatggatgatggacggatggatgatggatgggtggatgggtgggtgggtagatgggtgggtggatggatggatggatggatggatggatggaacagtggccatatagaccagtagtcagccaaaccaataaatgggtagattgacagtttgatgatagggagattgatggttgcacaggtcagtagatgcatagataaatgggtagctgtatgaatcaatggacagacggtgattggagaccagaagatggatggatggatggatggatggatggatggatggatggatggatgaatggacagacatacagatgtaaatacagaggggttggtgggtgttgagaggagaagctagaaacttttgctgaagcatgtagcaggcctagactgcctttggtgtccctccagacactcggctaggcctgccctaccttcctggcactgctcttcgtcgctgccgttgagacaatcaggctgcccatcacagaccttgggcagtgagatgcatgtgctgtcctctttgcactggaatgtggctctgcaaactgtgtggggacacagagaggggacaggtgggaggaagccagaggagccagccggggcttggcgatgcctgtagaaggtgtgctgtattgcacgttaccaatcacaaatctctttctctgctactttatttttatgtctcgctcttgtcacgaaggctggagtgcgatggcatgatctcactgcaacctcccaggtccaagcgattctcctgcctcagactcccgagtagctgagattaattacaggctcctgctaccacgcccagctaattattgtatttttagtagaga

SEQ ID NO: 103628 - DNA, 1032 bp, Homo sapiens
ggatcaccatcaacttcacctcccagatctccctcaccgggcccggtgtgcgggtgcactatggcttgtacaaccagtcggaccgtgagtatgggcagccgggggaaccccctgcagtgactcgctgcctcttggccatccctggaaccaccaagggggctgtgggcagctgcttatgaggctgaacaaaaggagagagagagtgtgtgtgtgtgtgtatgtgcttgcacaaatttatgcagctttgtgtgcccacgtgtgcaaggcagccacaagggtttgcaggaatacacactcatacatatccacgtgtgtgttgtgtattctgtgtgtgtgtctggatatgtatgtctgcttggactgtgtacacaggtgcccaggaccacgtctgtgggtgcctgtccatgcgcgtgtgagtgaacaggtgcatgcgtgtctttgtgcgccttcgcggctacgcatggcctaatggcgccctgcctgcctccacggtcccctgtggttttgcagcctgccctggagagttcctctgttctgtgaatggactctgtgtccctgcctgtgatggggtcaaggactgccccaacggcctggatgagagaaactgcggtgagtaacccgcccgcgcatccctcctctccctgcccatcccttctccttcctcacctttcctgctctgagctgagtggagaccccacttctacatgcagcttccattatgagcacccaggaagtggggttctctcactgtgccggggtggcaaaatgagacagaccagcaatgcagcctccccgagaccacctcgtgggacagtggcagggagaagtggggagccaggtctcctgacttccagctcagggccatcacccccagcccctgtcccagccagccttccaggaaggaacagaatgggtgagggagatgtccccctcctctgccctgtcaaaggtttaaatatgtgggaagagggaagcgagatgttcatggtggggggatgatcctgccacggtgctgggggaggtacctcatat

SEQ ID NO: 103629 - DNA, 1097 bp, Homo sapiens
agagccccagtccccccgtcggcacatggacctgataatgcagtggccaatggtgtagtaagggttaaatgagaaaatgtctgggctggccctggtaggtgctatttaccgcccttttctgactggtcaatgccgtaggggaggtgaaggccaaatctaagggtcttcagaggagggagaagggccttctgggtgagggaagaagggaaggcttccaggaagaggtggtatttgagctgggacagtccactatacactgggccatctaagggagatgatattactcctaatagcacagtgggtgtacatcctgtgatattattcataatatcatctaagggagatgatattactcctaatattatgaggggatctcaggggtagtggaggccgcagtgtgggtgggggtgggacacaggtgttctagaagtggcgaggcctggcttctggaggtctttccgggctattattattattaacagcaccatcagcagccactcccttgtattgaggactgactctgagccagctctgtgctccatcaagaggatcacaacacctgggggagaaggtggcattagtcttgtttctagatctcaggcaactgaggcactgagattaagccagtctgaggtcagccaggttcaaggtcactcagctgctgggtttggctccaaggtctgcaagccttgctactacccaagcctgccctgccttgccctggctgggaggggcgccccaggcaattcatactggacaagagcgggctcattgtcctggggcatgtccacagaactgtgtgtgtacacatgaccagggtcatccgtgtgcctggggtgcccccacccaggcttctgcccacctctaaattacctttgtgtgaattagaaaaagccctctccctccaactcctgcaggtgcagcttgagggcatgcaggctggggaggggagtgcaggctggggaggggagtgcaggctggggaggggagtacaggctggatttccacacccacttgccccttggacaagcatccagggcagcggcattaatggggtatacgcggccagttgaagtccatgcctgggactctgttcc

SEQ ID NO: 103630 - DNA, 1025 bp, Homo sapiens
tcattttcacagcggccaaggtacatgaggatgtagcttatcgcccttttaagggactctcccacgttcgactctaagcggaagtacccgctcagggctccggaagtggcctcagagcccctcagcaacatgcccgcagagaattcttccggaggcggtcacagacatctccgtgacgcagaacgagttagagcgtcccttggggtttccatggtgctgcccttagcctgcagtatctccacttcctctcccgcctgagcgccgggaacggaaaagcaggcggccggtcccagctgcgacgtagacgccgcgtgggggtggggttgggcgagtaggtgacgctctaggcgagctcgttggcctctctatggtgccgagcgcgcccgttcggacgttgcccctttaatcggcagagggcggtgcccaggaggtcccgcgagagctgcggggggcgggggggcggtgccgaggctgggggccggtggcggatggagcccgcgatggagccggagactctggaggcgcgaatcagtgagtgtccgggaggggcgcgggccggaccggaaccggaaccgggggcacgaggcgggccccttcccggcgggggcggggtacgggtcgccccctcctcacgccccgcccccggcccgggaggggcggtgtcctcagtcggcccctcagaccctggagcgatggaggaccccggccccggcgcggtccagcggtgggagcgggcgccgcccacctgtcggatccctgggccatgacccctgggacggcgagtgagctgcgccgggaacccccgggacggagagagcagcctccaacccccaaggctcacattgcttcacggagtagcggcccggggaaggagcacgcgagcggttccccggggttgcatctcacacccgggagggagggaccctactattttcaggccccgaatcctccactctctggccctgcatggcgttcctggagcccgcaagtagtcacatttgctcattaccccgtcctggaaggga

SEQ ID NO: 103631 - DNA, 1032 bp, Homo sapiens
ttagccactcatccgcccacgtcggcctctcaaagtgttgggattacaggcgtgagccaccgcgcccggcctagtgaggtaaatgatgttattgtcagcactatagagtggcagggtggagtcttaccctgttgtgaaacacctccctccctctctaggtgttctccccaactgcctgctagggagggtactcccctcaggtagaattaagagggctgagggtcaggggccatgggccaaggaggtcagtcagatctccttggatctggaggccctggctttcagccagaggcagggggagaaagatgatgtctcatgatgccagcgcttcctcttcactggcgtctgacccaggagcagtccagaatcagcttctctgacctcactccaactcacgtgtctttgacactttaagggacttcctgttttagggtcttctggctgggtgtcattgaatgggcagtgattctctaactttagactgatgttccccagcctttgtttggggactcggaggcagagtagacagttacccttacccctgggttggggagggtcatattcctggtatccccaggaggtcaacaggggcttcatttttctgagggactagagggtcttgtggagctcctgggacagagatctagatccagagagaacattcgtccttccgatctcagctcagctctgagagccctcccagagagcagctcccgagggctccagagccctccgaaagccctcccagagagcagcccccacctcccaggctgtctgcacttctccttgctatgctttgctctgtaacattttgcaacagtctgcagtacacggggtttgttaatctgagtattcattgtttctcttgctgggcagtgaacttgaggagggcagggattttgtctgttcactgctggagccccagcacccagaatacttaaatctgagttggatgaatggcggccagccactgggattccagggctttgggccccctgccataacatatggcccagggcaggcgccacatgc

SEQ ID NO: 103632 - DNA, 1024 bp, Homo sapiens
tgagtgtcagtttcttcacagttgaaggaacttcccacggtgaggcgggaatgaccgtgctgcctgccttatgcagcttaggcaggaaagtgcatgtgagcctcctcacacatgaccagttcagcacatgtgagctcttaccgtcactggtgacgggtcttttacagtctgttagatgatgtcaccacctccaccatgaagctgctctgatttgccacagcagaacgtcctttgccaccttgagttcccagggaactgtgtctgcccgtctctcatggcatattgtaattgtctctatggcaagccaagccaaggacgtgacacatcagagttcttaggccagcccaggagctgagctcataccttttgaaggtccctgcctgcagtctctgtctggccctgccctgccacaatctcaggccataactgatctggagagggagctgggcctttgcatatgcctgcagaaaccttagagggctgaagtctcggcggcgggctggggtggtgaccctcccctagggcgaccagggccccttggaggagggctgcagtcccagcggcctggggtcgtggccctagggtgaccgggactccgtggcgactctggctctgtgttgttcctcccacccaggcctccactcgccacccggctgctggcccacaagatccagtccccacaggagtgggaggcgatccaggccttgacggtgagaaggggagaggccaccatccgtcccccgccatgtgacgacaccaagggaggccaagactgaggttcttggggtccataaggctcttcagagcccaagagagttgtgctaagatggcccaggatggaggtccgggcctgccccaagggtcccaccacagccagcgggctggcctcccaccccagcatccatacacgtaggcctgttgctgagggaaggccctctagggtcatctggtccaggggttctttgcttcagctgcacatcggctgcctctccaggaagcgtgttcaacacatggaatcagggct

SEQ ID NO: 103633 - DNA, 1030 bp, Homo sapiens
tggggtgaacttggctgacagtattccagggcaggcagaggtcaggctggctggtgacctgctgcctccttcccatcggcagctagttctagggccatccacagggatccccagccctccatagtaccagtgagcctcactggcatgtgccagggccaagagggccttcagcgtcgcctccagtccagccctgtcctcgtattcttggggacactgtggctcagccagcacagtgcctagcccacagtcacccagcaggcgtccctcgagtgggccagtggcaggcacagagctgctctccccttgcctggatgcgtgaggaaaggaacctcttctccctgcagcccagccctgcaggctctctgctgccagatgacgagtgaagatgaaagtcctgatgtctattgtctgtgtgcacagagctttggagtggcctggccaggaagaggggaagcgtgtgtggggtcagcacaaggggttgccgggatcttggttactggttctgctctgctgctggttccctctgaaaatgtgggtttctcccctccgtgctgagcctcagaaaggggtagggagccccatgccagcacacatggcccctcggctctctggcctctgcagggtcagcccagctccttcacctctctcctgctttcccctcaggcctcagtgaccccacacccccttcaggcccaagcctggatggtaccggatggaacagcttccaggtaggaggggaccacaaactagtctggcctgtcccagtcccagggtcagggcagctgggacaagtggcctggagaaactaaaaggatggatgggctctactcaagagcccagggccagggggtggcccaggggcctggagacacccacccagggtacagggcctccccttacctccagctgtatcttccccaagtctcagccttggggctgcagcccagcctttgggattgggattgagatgggcaatccctcttcctttcccttgagggtgacagaggtccctggattgtagaacccccaa

SEQ ID NO: 103634 - DNA, 1057 bp, Homo sapiens
gcagggccagagcggggcagacatggacaagcgggtggtgagtggggggtcccgggaaggaggggcctgagcaggagacttccatccaatggggaagcaaggtcggggctggggtttccttgccagtctgagtgtctggcaccaagggcatggagactgctctgttccaaggcccctctggcactgcactcaagaggccctataccttccccatcacctttaccccacttccctgtgcaccagttcccataagccaaggccaggcttctgacagcacctgaacttctctgtccaatcagtgcgcaagagcaggctgtcaatggggcggcctcagagggtttcctgaaggaggtagcaattgagctggcttttgagggatacacgtttattaatcaagaggcagcgtttattggctgataaccgccagcttgttactaacatatgagtgcactgtctcatggaacactggcacaaccctaggggcaggcattgctttacacatgaggaactggaggctcagagataaagtcacttgtccaaggtcacatagctagtaagtggcagaactgaggtttgaaccctggtctctgatcccagagcaggcattccccgtaactccagatggggtgggagtgtggggccatgttttggaatcagttgacaattcagtgtggccaaggcaaggaaattgggagccatagagcgtttgaactcagcggtggctaggtcagccatatataccctgggacaggggaaagagctcccgctcccattctccctccacctgtgtgacctggggcaagctccctgccctccctgcatcttagtttcccagtctgcagtaggacttggtcattccttcctgcccagtcaagtggcttctgggaagaggaaagggcacgccagatggagaggggctccatccatgctctcagggaaatgtcacccccaccacgccttgtcatcttgtttccactctcatctgggactgtggccctcctgggttccctcctcccctgccccaaggggctggcctggtgctcaggcagggtggagg

SEQ ID NO: 103635 - DNA, 1032 bp, Homo sapiens
aaatcctagaatcccatgtggtctgctgtatggaggggacacttggctctggacatgcaacagggcaggtgaccagctcaccttgggatcatctccaggctcagtcaggcaaccaagaattcaggcagcagtcaaggcctaggaggcagcccgggtagtcacagccatacgaccatggccaacaaggtggagacgctgaaggaggaggaggaggagctgaagaggaaagtggagcaatgcagggtgagggccatgggggtcccctggatatgtaggggtggcaggggtgggtcctggcccatctcacaggcaaggaagctgaagttcagagaggtgacatgacttgcctaaggccacgtggctaggagccagcagagctccgccattccctcgtagcctcttctgtctgtaccccatgcataacttgggaaggcagagacttggtctgttccctgagtctccatgtgtttgtttgctgagcgagcgagtgaatgaataaatgaagagtgaatgaaagaatgactgaatggtgaataacaggtcactgtgcaaggccaggcgcggtggcttacgcctgtaatcccagcacttggggaggccgaggcaggcgaatcatgaggtcaggagttcaagaccagcctggccaacatggtgaaaccctgtctctactaaaaatacaaaaacttagctgggcgtagtggcgggcgcctgtaatcccagctactcaggaggctgaggcaggagaatcgcttgagcccaggaggcggaggttgcagtgagccaagattgcaccactgcactccagcccgggcaacagtgtgagactccgtctcaaacgaaacaaaacaaaaaacaaggcactgtgctaagtctatggagacacagagatggggacgagaagccagaaaagtttgagggagttcccaggggctggccccaagcaccaaccttggcagagagaggagcctggctgggaccttccacctgcagttgtgtggcctgggggaggtcaccaacccttccaagcctcct

SEQ ID NO: 103636 - DNA, 1089 bp, Homo sapiens
tatctctaaaagaagaggaaagaaactgagactaagagaagggaagtgagctgcccaagaacagatatagtgagcccctccacctcctgtgtccccacacacctgcctccatcctgcctctgggaattggtgtttcagccctcacaagtagggacagtcctcgcaggcttcccctccaaccctccaaccgcaccccaatgatgggtggggcagaattctgccagcaactctctggcagagtgatagagcgcgggaacctgaatttggcctttgtgacaccgacctccagggcagtcttcactgctgtcatcttgcgagttcagccctgcaggggaggcagaagcaaaaggaggctcctccattgtggagggtttgcgttagacaagagcaggtggcagcagaggctaattggcagtggtcagtgtgtgtggacaggttaatagcccagtcagtatactggggccgtggacagatctctgtcactccgtctctgttggccactgacccggacagtcattgatattaaatcctgggggtacaggatggtattgagtggagagaagtagacacaggattatggtggggtggtgagcagggcctagtgccaggggcacctaggaagacttcctggaggaggcatgatgcagggcagtgataatacaccaggagatgtaaacccagtgttatggcatggcagagagggattctgtagtccttggcctctcctggctgtgctgcacacctgcttggtatgtgggcgggctcacctcagcctcagtttccctataagtctgtgttgagggctctctggtcagggctgtcagcggcagcagctcctgcctgccttaggctatgctatgaaaagtttttcccaggaggcctcaaggctcaggttaaggctgtgggttaagaggttccccagggctcaggaaggctggttgtcaaggagctagggagaaaccaggccctgcccacacctgccttgcaggcgtctgtggaatccagacccctttggtctcagtagccacctggctgtgcccacccatcctgctgtcactcccatagcctagagggggaggcagaggctta

SEQ ID NO: 103637 - DNA, 1048 bp, Homo sapiens
gactcccaaagtcctgggattacaggcatgagccacggtgcccagccagcttttctttttttttttaattttttaaatatatatgtatatttaagtagagatgggatctccctgttgcccaggctggtcttgaactcctgggctcaagcaatcctcccacctgtgcttcccaaagtgctgggattacaggcatgggccactgtacccagccataaagtgactcttaatagtaccttcctttaacaaccagctcataaaattcctgcataggaaacaatctgtactcccaggtcagagctgggttggacccacccgaatgcaaatccttttgctgccacttatgaagctgtacaaccctgggcaaattacttaatgtccctgagccttggcattctcatctgtaaaatgggcttccagaaacacccagcacaggccaggcagtttagaatgtgcttagtaaatggtgattatcatcatttgttcagggacattagcatgaaggccgaatgttctggcacaaagacacgtctgtgggacaggcacagtggacttattgtgtgaggcaggatggtactgggctggaagacaggactgtcctttagttctaaacagtcctcctattgttggacactcgggagtgttccacagtttggcttatcggttactgtagccacagacgtcttccagcctgcagctttttgtctccagctggaattctcttcttgtgatcactttcccgggggacgcggactgggtcagaggtgcgaacatttctgtgccccgctgtgttccaaaggggctgtgccagtttctaacgccagccgcgtgaattcctgcagcagtaaccacaactgctatttgttaagtgctgttccatttacaaagcacttgcccctgtgttgcccagcgcccgtttggaggtaggcattacttggattccgctttctcaggagtccggagaaacttggggtggttgagtggtttgtccaaaggtccacggctgtcagggtgaaatcgcgaacctcaggcaggactgaccgagccaggc

SEQ ID NO: 103638 - DNA, 1031 bp, Homo sapiens
ggtggacggaacttcggtgcgacgctaaagtgtgcgcccgggaggatgagtacgctacacccggaagtgtcttcagggagaggaagccggcggcctcactgctatgggccgcaacaagaagaagaagcgagatggtgacgaccggcggccgaggctcgttcttagcttcgacgaggagaagaggcggtgagtggcaaagccggaccggactcccctcgagctgttcttcgcggccaaggccaggtctggggccgagcacgctcccgccgggggctcttccggtcccgccccctggcgtggctagagaacccctctcggccttccagcccgcgttcccgcttctcccttctcggccgccaccttctcccttcttgacctccccacctcgcctagtgtctgtgcgccgccagatagccggaagctcgggtctcagagcagtggcttcgaccaccctagcccagcccagtccatcggtccggcacacagcaggcgcccagccgtggttgataaatgatgagccaatgaaatgagagtggcttaagttcattcattcgctccctagacatttattgggctcctttggtgtgccaggtcccgtatcaggaagcagaacctctgagcctcagcgtctggccagataaataaatggcacatggtagcgggtcagcgaaaagcccagtgctggaccgtgggacaaaatgggaacagagcagctagcactgtggagatgagaaggggctgagattagaccgagggaaggaggtagggaaatgctgggcatcatcaggaaactcctagcgtgcatcaacaggccctacaggcgagtttagggtcaggtgtcctggggacatgggtgttggtccagtgcagggtttccgaaggtctggatggtggtggccctgaaaaccctgttgagagagtaatgaggtttgtaggtgtggaaggggttacctcatgtactgtgtgtggcccccccccccacccgccccacagcctggccctgttgcctgaacctgagatccctggagagt

SEQ ID NO: 103639 - DNA, 1031 bp, Homo sapiens
aaagagaagcccactcacgagcccccctgagaactggggaggccccgcagagtcctcacaatcctggcactctgggacacccactgctgtgggctggggggcagagggagcgtgtccatacccgcgtggctctgagaggcgacccgagcttgactggagggatctgcttggccttctccgggcaccaggagagggggtctgggcccgtgtccccagcctggactgggagggcctcttggagctcctgcaggccaggctgccccgcaaggacccagctggacacagggatgacctggccagggctttagggccagagctgggtcccccaggcacaaacgatgtccctgagcaggagtcacacagccagccagaaggctgggccgaggccaccccagtcaatggacacagccccgcactgcagtcccagagcccggtccagctgcccagccctgcctgcacctccacccagtggccaaagatcaaagtgacaagaggaccagcgaccgcaactctggcaggcctggagcagacgggccccctggggagcaggagcactgcgaagggccccagcttgccagagctgcaggtaaggaggtttccaccctcccaagggtagccagaaagtcagccccactcagccaagtctccttggaaaagcctccccttggagtagcctaagctcctgcatccccctccaggctcagacctcagcctccctgctgaccacaacccatcccgatcaccaaactggcccaacaatgatgatgagcaacacagttttaagcgtttatgggccaagccctgatctgaatgtttgacgtgtgcttttcccatttagtctccttagcaaccaggtgagaaatacactatttacagataaggaaactgatgcgcagggtgaagccacttgctggtggggcatgggcaaaacccaggtctgctcagtgcagaccacactgaggcctcaagcaagatgctctggccagggcctattcccctcctggctccaccatacctggtttatgttgtgt

SEQ ID NO: 103640 - DNA, 1101 bp, Homo sapiens
tggaggcaggggagtcgtcccaggttatacagtcagtggctagctggactgggactagaacccagggcccaggaaccacccagcgctctctctgcacctccacctggcacccatgctgcccccgtccctgccccgatttcttgcgtggcttcgaacggcagtgctgtaacttcgagcagtccagtcttcccatctgtggaatgggcggggacaggggacactggtcgctaaaggcgctgccagccctcccagggactctgacaactttgctcttcctctttctgggttatttcttcatatcctggagccagagtagtgaacgaggcggaaacagcaatgccggggtgcccctctagtctccatgaaacgggcccggcccatcaacgtggaaaatatctcaacctacccccacccctaggcagccttgactggtcagaactgataaccacctcattcatgcattctttcacacacacttagtgagcaccttctgtatacccaggtgtgggtcacaggtgagtcggagcgccatcaaagagttcagtctagtgagatggttgcatgcctgtggtcaggactgtgatggggaatgtggtagcagggtcgggggcacccctacccccaaagccctcctggacctgtgctttgatgcttcaagttccacttccaaagagtctgcagattccagagcgaggaccctgggctctctcctaccttcccagtaacccatgtgtggctttggacaagtgcctctgcttcacaggggccttggtttccccaacgaggatgactccaaagagggagcatttgggggctctgctaggaatgtgtgtagaagtccacaactcattccctttgcttaagctggggtcacaaacctaacgccctgaaggccaggcaggtaacaatggtgagaaggtgggggggcaccgagggcacttgtgtgactcctcggttccagatagctgttgccatggggaagacgggcccagagtttccacatctttcgatatttcaagaaacactggagatatgtatttatatgtgaaatctctaacctaatgtgaaatactctgaaaacactatgtgggcagaaacata

SEQ ID NO: 103641 - DNA, 1035 bp, Homo sapiens
ggaggatcactaggtttctccttgtacagacacgttcagtcctgtcggaagctgcgggaggggaggaccgccccgtcatttgccacatcaggcagccaggactcagagaggggatgtgacttaggaaggtcacagtgactccacttcccaggcagccctagaggttccagcctgacagcttgtcattcctgccccaatctcccagccctggcccagggactttcgcctgggactgcccagtggtgccagctctgtgggcccaggaagcctggctcctccgggctaggtgggggtaggggagatggcccaaaaagcacagaaatttagaccagggggtagatatttcctcagcaagtttttcctgagccttgctgtggtcaagccccctgcaaggccctggggccacaggaggtcccagactgaggggaagtggagccaggtgtggtcaccaatcttcattcttagcttgggatcgccctgggcagcctccgtctcaggtggaagacggggtgggcagaatacagagcagcgggacaaacgcagccccaggggttctcggccgtgagcagagcctgtgtctctcccttagacaggtatacagggaggggctgggatgccaacctactgggtcccccgactgtggctgtggaaggttctggatcttcagctgtcccaagccccggttggtccacttcctatacctgagaaggggctccgtgggtggagagtgggtcgggagaggtggccaggcagggtggctgtggtttccagctgccactgtcaccgcccactccactgagccatgccacccgttctctgcaggcaaccagacaccttggcctggtgaggcctcgatgtaggggctgataggtaggctcagagccatggcaaccggtggccacctcctccctgccggcgccaggagcggagactgcagagggaccgggacttagatgagagaggtctccccagcaggaagggagggtctggtggttggcacccactagatgagcatggtcagaaaaatatcaggat

SEQ ID NO: 103642 - DNA, 1127 bp, Homo sapiens
agaaggaaagggagggtgtggttacggaggggaaaccaatccatttcacagatgctacccctgaggctcagagaggaaatggaggggccaggtctcaaattggcattttccgcctccccacccctcctgtgtgcagcatagtgagtttggcagccacacaggacacctgtacaatcacacacactggctctttcattccatcctccttgcagcctccctccccctcgctcaccaccacctctacttcgcagtggaagaaacattggtttgtgctgacagattcaagtctcaaatattacagagactccactgctgaggaggtgaggccatgggtgtactgatgaacccccggaagggcctggggtggcctggctgggttcactggggtgggtcacaccagggcccacacggaccatagtgggccctcttgctccaggcagatgagctggatggtgagatcgacctgcgttcctgcacggatgtcactgagtacgcggtgcagcgcaactatggcttccagatccacgtgaggctgtgtgcagcttgggggctggtggtgggcagcatggctggaggtccctgggggaggttttggtgttgaacatggctcaccatggagactggatcccttcactcatttacccagaggccctatcttcagagccagagctgtgatgccaacacttagcatatctgggggagacgctggagccagcagggctcttcccaggccaatggaagggaggttttgtaccccctgcccaccccagactcaagaccttagatgcatcctgggaaggaagggccaccctccctggggtccatagtggggagggagtcatgcggctggccatgtggcaacctacccatgcggtggccttgcagaccaaggatgctgtctataccttgtcggccatgacctcaggcatccggcggaactggatcgaggctctgagaaagaccgtacgtccaacttcagccccagatgtcaccaagtacgtactaagctggactggggccttgagggaggcacttacccttgcgtccccgagtgggtttctaggtactcacctgagggctgcacctttctgggccctcgtttctctgtcaacaacatgggaagagag

SEQ ID NO: 103643 - DNA, 1073 bp, Homo sapiens
gcagcagagtgagaccctgtcccttgaaaaacaaaaacaagaacgggggcgagggaagccgggcatcctggtgggtccctgggctgtcaagaggtggagctgggatgttcctggggtctgttaaccaggaagctcaggtcgggctgcttccttccctggggtctgtctccagcccctggcacagggcctggcacacaggtgtcgctccaaaagtgctcattgtgggactgcaggggtgaggacccacctgacgtggctctgctggtgccctaggctctcggactctaacaaggagaacgcgctgcacagctacagcacccagaagggccccctgaaggcaggggagcagcgggcgggctctgaggtcatcagccggggtggccctcggaaggcggacgggcagcgtcaggccttggactacgtggagctctcgccgctgacccaggcttccccgcagcgggcccgcaccccagcccgcactcctgaccgcctggccaagcaggaggagctggagcgggacctggcccagcgctccgaggagcggcgcaagtggtttgaggccacagacagcaggaccccagaggtgcctgctggtgaggggccgcgccggggcctgggtgcccccctgactgaggaccagcaaaaccggcttagtgaggagatcgagaagaagtggcaggagctggagaagctgcccctgcgggagaataagcgggtgcccctcactgccctgctcaaccaaagccgcggagagcgccgagggcccccaagtgacggccacgaggcactggagaaggaggtaggcaccacggctggctctctaggaggccccttgccccagcgcccctccagtccctgcattcatgccctggcatttgtcttgcactcctacagtgatggggagctcacccctgatctgctgtgagtgtgcaccccacactcctgcgaactagaatcttcttccttagaccttagtagtttggtttggttttgttttgttttttcctagttctgcccttagcagccatagagaagagaagtgggaagagaagggagagacctgccaggctcac

SEQ ID NO: 103644 - DNA, 1035 bp, Homo sapiens
ccgggagcaggcagccagcagccctgtcctcaccgcggtccgcccgccgccgctaaatacccggatgcgccgcccaagcgccagacgcggagctgggaaaagggaggcagaggaggcggaggcagaggcagaggcagaggcagagcccgagcccggtgccgagaccaagcgacagaccggcggggctgggcctcgcaaagccggctcggcgagctctcccgacacccgagccggggaggaaaagcagcgactcctcgctcgcatccccgggagccgcactccagactggcccggtagtcaggggctcaggagcagatcccgaggcaggctttgctcagcctccgacgagggctggccctttggaaggcgccttcaacagccggaccagacaggccaccatgaccgagaattccacgtccgcccctgcggccaagcccaagcgggccaaggcctccaagaagtccacagaccaccccaagtattcagacatgatcgtggctgccatccaggccgagaagaaccgcgctggctcctcgcgccagtccattcagaagtatatcaagagccactacaaggtgggtgagaacgctgactcgcagatcaagttgtccatcaagcgcctggtcaccaccggtgtcctcaagcagaccaaaggggtgggggcctcggggtccttccggctagccaagagcgacgaacccaagaagtcagtggccttcaagaagaccaagaaggaaatcaagaaggtagccacgccaaagaaggcatccaagcccaagaaggctgcctccaaagccccaaccaagaaacccaaagccaccccggtcaagaaggccaagaagaagctggctgccacgcccaagaaagccaaaaaacccaagactgtcaaagccaagccggtcaaggcatccaagcccaaaaaggccaaaccagtgaaacccaaagcaaagtccagtgccaagagggccggcaagaagaagtgacaatgaagtcttttcttgcggacactccctcctgtctcctattttctgtaaa

SEQ ID NO: 103645 - DNA, 1041 bp, Homo sapiens
aggccaaggcaggaggattgcttgaggctaggagttcgagaccagcacggacaacataatgagaccccatctctacaaaaaataaaaaaatttaatcgggcatggtggcacgcacctgtagtcccagctactcaggaggttaagtgggaggattgcttgagcctgggaggttggggctacagtgaaccatgattgcaccactgtactccaacctgggcgacagagctagaccctgtctcaaaaaaaaaaaagtttaaacttcttgctcttcaagatgtgtagcactgacgctccttctgtagctgttgaatttggtgcctcctcaatggtgactccaggtctgtttcctttctggaccatttccccagggcctggcactgtcatctttccaggcctgcccttgccccacctgagctgctgtatccatctcctctccttcacctcaggaatccttaacttctgtgccaacaactacctgggcctgagcagccaccctgaggtgatccaggcaggtctgcaggctctggaggagtttggagctggcctcagctctgtccgctttatctgtggaacccaggtacacagtgagtggtggggggttgtggggactgaccccagctgcctgcttcccacagtcagcaaggctggtttagccagctcagctcagccacagccctgggcctactgttggcctcagagctgtgcagcagaaaggctgagtgcaggcctctgttttgctgaaaagctttggccaaggaactttatatatatattttttctttttgagacagagtcttgctctgtcacccaggctggagtgcagtggcacaatcttggctccctgtaaccttcgcctaccagactcaagggattctccatgcctcagcctcctgagtagctgcgattacaggcatgctaccacacccagctaattttttttttttttttttttttgagatggagtctcgctctgtcgctgaggctggagtgcggtggcatgatcttggctactgcaagctgcgcctcccaggttcacgccat

SEQ ID NO: 103646 - DNA, 1049 bp, Homo sapiens
atgtcgagccagcagctggatgagcatggtctgctctagccagcagctcatgttaagcgccacgggcagctgcggggtgacgtgtggcagtcggtgtgctgcacccggcggggccagaacagagggcccaggtccacccagaccgacgtgaggcggcacgaggcgagatccagacagcggcgcagaaagtgcgtcgccgcccctgtggctcccaggagccgccgctggcgttgccctgctgcgctggcagcgccgcgaccccctgggctagccgatcgcggtagggctccacgccgttggccaacccgcggctcagcgtgtcctgctgcaccagcccgggtccgccgccgcgcttcttccgcagtcatccagaaggtgtctgtaggaggcgcagcagccgctctgggtgcacgtgtttcggcttgggcgcctaccggtagtcgccggccgcccacgacaagctgtagggccacgcggggcgggagggccggccgtggaccagctgcaagtctgcgttctgcagaatcagaggctctgaggaccgccccaagggcgcaatgtccttgttctctgcgtcgcgcacggggttcagggccgcgggctaccagaagcggcagtaggagtggatggaggtggcaccgggcgcacccaaggtctaggctcacggccgcgctctttatggccgcctgttccttcctccttccctccacctccgctctcatatcagcttagccttgccgctgctgggagctcatcgccctaggccaagaaggaccttgtgggcagggggctcccaagggccaggagtgcgaagtcatgaatctcagatgctttccagcccgttccagggttcaggcatgcacattcgtccaggcttctgggagtctaagggtgcgttactttcacgcagtggttgcaggtctgtcaaagtttctaaaatcccaccaagctgagtctcgccattcagggatcataagagtctacaattcctttgcgcaattcaattctgaattcaattcagaattaattcaattctggccgggcgcggt

SEQ ID NO: 103647 - DNA, 1909 bp, Homo sapiens
tttccaacagtcttgcctctctcccctccaacgcacacttttctaggccctgagggtatgtctgagtacaagacagacgagattcctgacttcctagacttgggagaagggtgcaaaacagataataagtgaaaaataactttaagtcatggtaatatttttgaagaaacagggacaacgagattgggagtgacttgagatgtttgtatctctgagtattcaaaagggaattttacgcagacctgagtttagtttctggggtggtcttgccatttcgttctatcatatatgtgggtttgagcatactctgtatttgttgtatccaacctccaggagatccaaagcaggaccttgcttatgaacgtcagtatgaacagcaaacctatcaggtgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacaggtatgggctactggctgaaagggcctctttctgggtgggactggcctggtaatatagttcctacaaatgaggtgagcactctgtaaacagtactttcgggggggttggggggtgggggtctttgtgagtccttgaggctagggacattttattttgttagactttattttatttatgcatttgtttattttttgaaacggagtgtcactctgtcgcccaggctggagtgcagtggcaagatctcggctcactgcaacctccgcctcctgggttcaagtgattctccagcctcagcttcccgagtagctgggactacaggcatgtgccaccatgcctagttaatttttttgtatttttagtagagacagaatttcaccatgttggccaggcgtgtgttgaacccctgacctcaagtgatccacccgcctcagcctcccaaagcactgggattacaggtgggagccaccatgcctggcctaatttttgtatttttagtagagacggggtttcatcatgttggccaggctggtcttgaacttctgacctcaagtgatgtacccccgttggcctcccagagtgctaggattacaagcgtgagccaccatgcccggcctgttggactttatatcctcagaaatttatacaaagcctaaaataatatcactattaacaattataataataatgattagcatttgtttttattaccaggatagatccatcaatgttcagtgtgttgtttgtgtttttactcatttacccttcacagtaagcccatgaagtagcagtttttctcattttacagatgaggaaacagcacagaaataagtcatgtagctagtttaatggatgtgctgagatttgaacctgcagtgtctggcaccaaagcctaatttctaaactgtgctatgcagcccttcagtacatatcagagcaagctgaactccgcaggttttgaggggctgccgttgtgtaatgagcgttagagataagataggtcagtcaaagctgggatagtcaggagtgacttcaccaaggaaatagaatttaagcaagtcagaaggatgagggagagaaaacaaatagccaaaggcctattgatcaatgaataggatctctgacatgtgttttctttttttgttgttttgaaagagctgattgtagttgaaaagcagaggaaacctcagacattgcatggttttaggcctcacccctgccactctcgtgagcctaagttctacttggtgtggactccaaggtccttcccgcccctgcaagccacccattaggttgagctgagagatcagccaatgggaacagagtcacttatgaccaagaagaattgatctgggggttagttagtga

SEQ ID NO: 103648 - DNA, 1039 bp, Homo sapiens
agggcatcaggagaagaaaattaaacaacctgttgcaggtttgtcaagtagcagtgtttggattggataggcagcagtgtttaaattggatgctgtaggtctgttgtggccttggactgcagcagactgatttgcttctgtgtttagagacgtttggatgtgctccaggagatggaaacgctgtgttaaagaatggtggccaaaaaagtagttcttatagcagaaaacagcaagcagttaaatatggctatagttaatgatacagaggcaggagattatcctgaaaagcttgatgggtccctaactgatacaaaaacaatattttcttgtgttgagaaagattgaagtgtggagttgggttgaggacagttgtgggcttgaagggctttggcctcagctctgtttatttgacatcttcccctttctaagcctgggtcctcatctgtaaaatgttaggattggcattctccagtccttttggaattttagagatttttttcttgatttttagctggaccaagctgactgaaagattcttcaagaatacaccttggcccgaggctgaagccattgctccacaggttggcaatggtaggtgtgagctctttatatcttgtgcactgagtggaatccagtggctgagtcattagacaggaagctcaagagggtctgtgtctgttttgctcaccattttgtttccttggtgcttggtatgtagtaggtccttggcaaaataacttgtcgaaggctggatgatttaagagaggacagagatctctcatatatggtgaaatttagatctttgtactgacttgtttctatttccttctataatttgggggtcattacagtcactctggaataagctctctagcttcccacctttgactttcttagatgatgtcctttatatatgggtgaggtaggcaaatccaacttcattattttgcttgtggatattcagctaccctggcaccaatttatttatttatttattttattttattattattattttttttgagatggagtctcgttc

SEQ ID NO: 103649 - DNA, 1047 bp, Homo sapiens
gtgttgcccatgctggagtgtagtgtgataatggctgactgcaacctgtgcctgctgggctcaagcgatcctcccaccttagcctgccgagtagctgggaccatgggtgcgcaccaccacgcttgtctaattactcttgtgtgctggtttttttatgcacttggatggcagaagtctctaaatggtgaaaggaaatagatctgaatgagatcttaatctcatcgacagagattgaggttgatggagtcaaatgagaagtggattttctcattgcatgtattcttggggcatatgcatagcaatttagatgttgtttagtcttcagaattacctttattcctccccaccaaagagctaaagctgccaggataccccagttttatggttagtgaagcacccttctgccatctctttcagatgctgtcttcctgattttatacaaagaattatactacaggcacatatatgccaaagtcagtgtaagtatttaagtgtcgcagttttttttttgtttttgtttttttaactctgtgctgtttttgtccctagaacacagtcatttgtttatattggttcagtgtctgggcatgattggcatgtttttgagttttaagaagcggtggaaggaacagtttaacccagaaagctgttcagacacactaacgctatataacctatgcattcttttaaatttctctgtccccacaattctcctggactgggcaatcacccatgcactggttataggctgccagcctcataggatatttccaggtacctgctgctgcttctgcttggggttctttttcccttcagagcattgagcctctgtttctctgagatgtacataacactgtcactgtatgccaagcacaatgctaggcacttagcacacatcttcacatatctaattctactatcaatcgtgcaaagttggtacccgaggtgccaagaggttaccttttctcaaatttatccagctagtaagtgacaaaactccttgaatctagaccagcttgttataacaccagtattctacacattatc

SEQ ID NO: 103650 - DNA, 1040 bp, Homo sapiens
cccagagtgttgagattacaggcgtgagccactgcgcccagctatataatcttacttcattgtgactagtcaacaatcttttgcccacattttacagagattaaataccttgtgagaaccccacagttaataagaggtgggactgactccaaagttgtgtttcttctccatcacaaatacattgctcatggtatggttccccagctcagaaactatcagtggttctcagatgcaagcaacataaagaccagaccaggggtcagccaccttctctgtggagggtcagataataagtattttagtctcgagggccatgatggtttctgtcagatctgttcagctatgtctttgtggcagttatcaacaatatgtaatgagtgggcatggctgtgttccagtaaaacttctttatttacaaaacaggtggcggaatagatttgcaggccccctgacctagatgcttgtttggcgttggaagactgcaacattcctggcccgtagtctagtgatgcccggtgcagcattatcttctcttaactccctagccttcaagtgccacgatttaacttcttcgcctttgctagtgtggtttttttctgaaacacttttccttctctctgctttgccagatcatcatccctgctctgagggtcatttaaggtctgttgctgtagaacctaaccacgtgttgcagtattcagtgcgtcagctgctataggactttctatcttccctctcacttgcatatttacatagtaagaaagagaggacagataccaattctcttgtatttgttcacagctgtcacagtataccatgggtaaaacacattaaaattaaatatctgtatcttgatatctcttgttttctttacaggggggaccttccttggagcagaggtttgaatcctattacaactactgcaatctcttcaactacattcttagtgagtctgagatttggccaagagggtgtgtgtggttatgatgaggttcagcattggcctccagcttttttttttttttttttaaattagcagg

SEQ ID NO: 103651 - DNA, 1015 bp, Homo sapiens
gcgtaccacagtctagctgcatctgaatagatggtacaagagcccctgtggtgtttctggtggcccggtcaactgcattgtgaggcccagagacaggaagtgactttgggttgtgtttgactccagattggatgtttttaccacagactacctctaatcctagagatttttacttcactgtgtagtaagtaacattcagtaatgaacagaattcacagtttagtcaagatggctttgaaaaacagtgtacggaatggtttagaatgagaagtggtcatctcaccctcaccttgccccatccagagccagagcattgcctcgttttcagcattgtggacatggatgatcactttgggcttataccactactgcatgtttcttttcttcctcaacagtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgagtgcagcaggccgacagccgtggcctgcgaatttccagctgcttgccatctgttccaaatgaatagatcactgcaaggagagcagatgagtcaccatgtcttaggtggtggtctgttgactctttgtaggtgcttgagtacaaacagtagcagagtatttgtgctgggggctctggggcttgggagtccattggccaacagactgaaccagcacattgagatttgcgtttgtaaacacttctgtgtctccagtgcttttgtttagataagcacttctcacacgtgttggtgtcagagccactttaccctgttaaaatattgagaaccacaaaatgtatctattttaaaaaatttttttctttttttttcagtgaagagtggcatttttgcagatctctctgtctggctgagatagctggcttctcatttctgcttctgcattca

SEQ ID NO: 103652 - DNA, 1050 bp, Homo sapiens
acatagtgtttgcatcatgcaaaattcaactcagtgggaagggcaagtaacatcttagtgttgttattaggaaaatagctttgacctcatgtgctttctgaaaggaggagtcttcgtggttgtattttactgatgagaggggcctttgcatgtgttgggaccaaaaaaaaaataagcaaaatgaactgccatcctgtaagcaaatattggtaaatcgaagattagcataagattggttttgctgtttcttggtattcctttgaagttattccccagttgttgagggaagctttcaaggctggcagtaggtgagatgcctactgagtaacattcagaggtcaggtgtgcctgcctttacctgcctcctatcagtattcacggtgtctgtctctttcaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaaggtgatgcctattgcctctggcccctcttgccagagccagaatatctatttctagagaaccactctgatctcttaggacaaatttccaggagaggaaagaggactgttccctcaggccattgaaagttgagactaaaactgggcaaacagctgtggtaaaaagctagacctggacgattttggtagttaacaacagttttttattttgttttcaaaatggaatgatgatggcagcttgctctgtcaccaggctggagtgcagtggtgtgatctcagctcattgcaacctccgtctcctgggttcaagcgattcccctgcctcagcctcctgagtagctgggactacaggcatgcgccaccatgcccagctaattttttttttttttttttttttgtattttagtagagttggggtttcaccgtgttggccaagatggtctcgatctcctgacctcgtgatccgcctacctcggcctcccaaaatgctgggattacaggc

SEQ ID NO: 103653 - DNA, 1207 bp, Homo sapiens
gtcgtcatcaaggttgcatcaaaggttttgggtaactcgatcctaactgtgtaaaaggattgacctgctagtgatgtgtgggacaaactggagagactaagacagaggtgccagtaaggaatccagaagatggctaaggaggatctggagctaggatggaagttaggtagatctagagggaggattggaagagatgttggggaagttcaatggctggtatgaaacaactgggtaagtcaaagatctgtgcagagaatggtgaggccagttggcagtggggacctcaggaagtccgtctcatttgacccagtaccactctccaccccatccccagattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggtatgcctgtcccctgggcttggggtcttgtattaagtgttcagtatctttcattcactattgtgggcacatgaagtatatcggggaacaaaaagattcctggccttgtggtgctgccacaaggtgccaggtgtggtggctcatgccagtaatactagtactttaggggaggctggggtgggaggatcactctagcccaggagttcaagaccagcctgggcaacgtagtgagaccttttctctattaaaaaaaaaaaaaaaaaaacacaagagataaacaatagatggttttgttttggttttttttttgagatggaatttcgctctcgttgcccaggctagaatgtgatggcacgatctcggctcaccgcaacc

SEQ ID NO: 103654 - DNA, 1047 bp, Homo sapiens
ctgtcagggtggtgggctagggctgtcttctaacaaggatcctgttcaaagcttctcattcttcccctaactgaactagtaaccttgaaacgtctggccagtctgaatcctttttctgtcagatggatagagcagtgttgtgtatgggtttgttgagtgtgaagggcagataaaagaataatccgcgtgaactgtgcagggccatatgaatgtcacggctttgcacacacatagtggacacccacatcagaaacttcctttcttggcttcagaggggcagctgggaatctgacctagtgatcatacacactgtaggaaaggggttggggaaatccccgtatgtaactttgcttttctttctcttctagcttaatcgaaccctgaagaagatgggacagagaccttgatgatattcacacacattcaggaacctgttttgatgtattataggcaggaagtgtttttgctaccgtgaaacctttacctagatcagccatcagcctgtcaactcagttaacaagttaaggaccgaagtgtttcaagtggatctcagtaaaggatctttggagccagatttgtcgtctcattattgtaggagagaatttgtgggttgtggcagtaatacatttcccatgtgtcctgatgctttcaggatacatcagttgttagtgtttaaattgagttatttttattttgtgcttttgagatggagtctcactctgtctcccaggctggagtgcagtagcgtgatctcagttcgttgcatcctccgctgcccaggttcaagcagttctgcctcagccttccaagtagctgggattacaggcgtgtgccaccacactcagctaatttttgtattctcagtagagatgggttttaccatgttggccaggctggtctcgaactcctggcctcaagtgattcgcctgccttggcctcccaaaatgtgctaggattacaggcatgagccaccacgccccgcctaaattcaaaatctttttgtttttttttagacggagtctcactctgtcgcccaggttggagtgt

SEQ ID NO: 103655 - DNA, 1522 bp, Homo sapiens
catatctgcgaggcctgccctttaccaagctgggactccaccagcttgggaggtggtattagtgcttttcctgatttgcacatgggacaatgaatgctggaaggactgctgatccccccaaccccatggtcacatgggaattcagccctcagaggcggcgtggcctgctcttgcctctgcccacccatctccggcagtcagggctgcagttttcagccatagaagggcaaggctgcatgcggatgcacccaggaggctgcccggcgggaagactgagctgtctctgctggtttcagcggcctggagtggggagggaggagggggataaataaagcctgcaggccagccagctgtcccgtgctggggcccccagacaggccctgccacctctcacctttcctagtttagaaaatccctcactgcttccccaatggaggctgccccaggagtggcccagtggggccaaccagctgttctatgccagcagctccggagtatgtacatttccactctggttcaaacttgttcttctattcacggccccattaagaaaaacattcatctgcaggctggaccgggttgggatgcagcaagttggtgtggctactccgagtgtgtgacacacctgcaggggcctgtgagcagtgggagggccagacatgtggattcccagggctggtggcttcctttctccaggcctcagtgtcctcatctataaaatgagatcaattcttgccaaacagagttgctgtgaaaagaaagtaaatgagacagaggagcccagcactgcgccctgggggaggtcacatgcgggtcttagttatgtctttgccacggactccaggggtggcttcctgcagagaggcaaaggatcttaagcttgaaagcctgggcttgagcctcaccccttcccagtgatttcctagcctctgcttggatgcctccagggcccgtgatctcatgccctgccctgccctggcagctccagctctagcagcgaatgtttgctgcctcagtttcccccttagtaatccacagactcccccccagcaaccctgctgaggttgatgctggctgggacaaggtcttctctgttcagctcctttctgactctgaccccgcccctatttcccagtcacctcccctcttgaccaaccctcctccctttgcctcttgcagagattttgattcgctttccaaggacaatgtcttcgagaataaccgtttggtaagttcccggacaggtggaagcccaagaggctctgtgtatgtgtgtgtgtgtgtgtgtgtgtttggtggggagggcaggggtcttgcacggtggctgcccttgtacaccggccctggctgcacctttccccaccctctgcttcccaccagcctcctcatgcatggagcaccaggcttcccctttctccaggccatcctgtggtgcttgggtgggattaatactgaggggagcccacagtcaccccatcccactgaagggagctgggcctaggctgaggggtcgccccctaac

SEQ ID NO: 103656 - DNA, 1064 bp, Homo sapiens
gaagcggggatcgagccagagaatgatgccgccagttaatattgcgacagtgcccaaacctcccatccagacacacagatacacacacacagtcctcattctgacccagcgcctgtggcagggaagtctcctcgggagggagtgttaacacagccatggtcacaacagtacccactgagtgatatgccaaaattgaaatttcaccctaagaccctctctgggtgctcccctctccacatagaagtgggctcccggaggcggtgaccactgctttacagccgcatccgcaccggtgccacgcagaaatactgcgcgatctgggctgctggagctggcagctagcgcctctcgctactatagaaacgcgcacacaccagtcagcgcatgcgcactttccccgctctgtcctgcctcccggaagtgatttcctctgggttacggcgcaggcgcaagataagctaggagccgcgcgagtcgtagtgtcgctgtttgcgggtctccgcgcgggaccggggcgcagcggggtcgctgaggcgagggtgtcatgtcagacaacgaggacaagtgagtgcgggagcggagtggcctttgcggcaaccttggaaggggcggatgaggcaaggcttgggtcggctgaggagcctggcgtctaggggcaatgtctgaggggactggggtcctgagggggccggcggagccgaggaagggaagggcgggcgacccaggagcacagccccggctggaggcacaggagggcccaggctcgagggtccagaggggatccgtagaaaaggtgtccttcagcaaatgttccagcgagccgggctctgtatcatgcagtgggaatattgaggtgaatgaacaatcgtccctgcctctccacgtgctcactttctagaaaaggggtcacaggcccataagtaagcaagcaagcaggtaacggtggtcgcgtgagcttccccagttctagacgtatgtagtataggagtactccagaggagggtctggggcagctccaccgggtggcattaaataaaagtctgggacggtcctttgcagtaatt

SEQ ID NO: 103657 - DNA, 1070 bp, Homo sapiens
gtagagacggggtttcatcatgttggtcaggctggccttgaactccacccgccttggcctcccaaagtgctgggattacaggcttaatcccagagccacaatacaaagccaccatgcccggcctctgaattttttttttttttaatttttcttatttattttgagacaggttcttgttctgtcacccatgctggagtacagtggtgcaatcttggctcactgcaacctccacctcctgggttcaagcaattcttgtgactcagccccccaagtagctggtattacagacatgtgccaccatgcccggctaatttttgtatttttagtagagatggggttttgccttgttggccaggctggtcttgaattcctggcctcaagtgatccgcccacttcaatctccgaaagtaccaggattacaagtgtgatccaccgtgcctggcccctctttgattcttttaagtgatgctctaagtaactgatctcttcttcctgtacagttttgatggcgacgactttgatgatgtggaggaggatgaagggctagatgacttggagaatgccgaagaggtcagtattcagcctcaggctcccacctctgcagcccaagctgccaaatcgtctgacaggtgatgattagctgaatgtgtctgccttctatttgtggtcaaggcccctgccataagcattcccagttagagtgagctgtgttccagtcttgcatagcagaacagccctgcagggtgggcctgaaagcttttgtccatgtggtccacagcctgtggcttctggggcagttagttcactgacaagttaaacggtgccttccttcatttggcaaacatgtgttgaatgtttattatatgccaggtgctttctgctgggtgggactgcttaaggagcaaagggaagaggtaagcagggctcagatgaggcagtattttgtagcctaaaggcaatgggaagctactgacaaactttgagccagggcacagtccaggttacattttagaaagtacattcctgcctcgagtaaggagtgaactggggaagggcaagagtgaaaggtg

SEQ ID NO: 103658 - DNA, 1024 bp, Homo sapiens
atctggctcaggacaaatgcttagtaagtaattgttaaatattcctgccttcaccttgacttttctagccacttggcccattggctcagctcccctatctgaaagatgggaagactattcctagcttcctgcttagggtaatttttttgtgccaggacctcttttacaggaccaacattctgataccaccccatctccaggccctctgctctcttctggatgaggcagttagctctggaatctcagacctccattaccaggtctgaggcttggtcaggttagctgactttccaagcctctgaaatgagaactgtaatccctgcctcataaggttattgtaaggattacatgagttgttaggaagcagttatgtggtcccctggcatgcagtaagcattaacggtggctgtagcgagaattgtgattgttgtcattatcactctccctgtaacccaaaagtgccacctgagtctttccctcttttttgtcttggtgtccaggaaggccaggagaatgtcgagatcctcccctctggggagcgaccgcaggccaaccagaagcgaatcaccacaccatacatgaccaagtacgagcgagcccgcgtgctgggcacccgagcgctccagattgcgtgagtgattgccccttcactgtcttctccatctgtcaggccacagtaagctcttgtaccgctgatctttcccagcctggcacctgaaaacagactctctgctctcacattccaaaagtggtgccgtccctgcgtaccaggcattgagctagtcccctgccctcagggagcttgtgatctaataggagaactaggacatgaacatctgagaagtcaagtaacaatatgggagaaaaacgataaaaaaaaaaaaacagaactagatggttgcgtgtcagattagtgcagcaaaaaaggtgaattcagagccaatgtgtaccagtgtagttttttttttttttttttgagatagagtctcgctgagtcacctaggctggagtgcaatggcacaat

SEQ ID NO: 103659 - DNA, 1072 bp, Homo sapiens
taaattacttaaggacacattcttgcacattccatgtgcataataggtgcggaatgagtgaatgcccttgaattatttatattttgaaagaaagcaggcacatgcagatcaggtattttgccacattctttaaagctttatattttgggaaagtttaaatacttattaagagaggatatagggaaagttaaatacttcatctctgcccttgggaaattttcaggcttttgggagtaatataaatcgaaatatttagtaataaaattagtaagctggtagctctcagactagctgattatcagaatcatctgggcagttttgcaaatgcaggctctcaggccgcttcactagagattctattccgggggtctggggaaggacccaggaacctgtattttttagcatgctctcctgttaattctggatttgttggtgtgaacctgagctggaatcatcaggggtggcttcctagaggagatgggcctagaattggcatccctttgcttggtggtagagtccccactgtgggccaagtgttatgctgggggctgggcctccgtggtgaatcacatgtggttctgggccactaggagctcatggtctaatgtggaaagtttccaaacaagtagttacagttcaatgagattggtgccaagaaaagtatatgcaaaatgagtccaggtactgaagagtcagcacacgatttccagggtggagacatctgaacctctcgcaggtttttagggagaggaagagcttgtaagagcacacaaaagggaaacaacatggcgcatctagggaaccagaaatagtttggtatggctggaatgtggagtaaatacaggaaagtagcacgggactgtgctaggaaggcaaacagggaccagactgcactctggcctgatagccaaggggagtcatgacagtgttgtaagcaggtgagccccctgactgctggcctcaggtgaagggtggggagggctgggcaggaagggcagggcctctactgaggtgttgtgtctatagagaatggaaatgatgccgggcatggtggctcatgcctttcatccca

SEQ ID NO: 103660 - DNA, 1622 bp, Homo sapiens
atttcacccatctatacaaaaaataaaaaaattagcatagctggtggtgtatgcctgtagtcccaagcaggagaattgcttgagcctgggaggtggaggttgcagtgagccacgatctccccattgcactccagtctgggcaatgggagtgaaaccttgtctccaaaaagtagagagagaaaatagaaattgaaatgaggtgcactgggcactgaggcaaggctctggggttggagcagttagaatggtgtgcctttgcacatgtctccctttccaccaggacattctgctgtggccgctggactccggagtctgtgataggcctctgccagggaagatctctggcagtgcccctacacaccactccctactgtgcctgcctacctagaagatgacgtttctaggtggggaccaggatgccgttccaccctcactgcctgttgggcccttctccctgggtttgtagtctccctaacacctgtccctatccctacaggatgtgtgcccctgtgatggtggagctggagggggagacagatcctctgctcattgccatgaaggaactcaagtaagtcactcaaatcatggttcacttctccaaatctctgggaggcatctgttgggctctctgttgcaccctttgctcccacttgcctggctggagaagttgatgcttattcctacagatccttaggaacagctcaccaggaagtaggaggaagagagaagaggaggcagggaaagtgggagggcactgatgagacatggacgtcttctggctgttggaatttccctgttcctgctgcaggaggccttaccaatattctgtcattcttccccctcttgtctgatataaaaactttctttttcttgtaattgctttcttacaaagtacactcatcagccccaagaggctgctcctaagacttctctttgcttgtgttttgcacacaatctgttccttctgcggcagagctggggtcaccagccctcatgtacttgtgacttctcccctgccacagggcccgaaagatccccatcatcattcgccgttacctgccagatgggagctatgaagactggggggtggacgagctcatcatcaccgactgagctggagtcatcttcctgcccttgccccatgcccaattttcattctcactttatatgtgtaaataataaaatattcaactttccaacccccttcccctctgcttatctgcaatgtcaccacctgttgcttccccgttaccgccatgctgcgtggagcatgcacctattccagtggccctgtgactgtcagctccttaagaagcaccaggggcccttagcccctttggatcccccacatccttccctccatctccctgttccccagagcaaaggctgctgcaggggagacacctcagctgccttccaagcagacagacaagtctttgtgcccagggagctggttgccacggaaacccccaatttcctttccagtggggactggctgcaggggcttctcccttctcaggagtatcacagagcaggtctcatcaagccacccattgtttcctaaggacctgcttcgagcctcttatcgtgggctcggatcccctttcaggagcagtgcccca

SEQ ID NO: 103661 - DNA, 1451 bp, Homo sapiens
aagtcagcagctggagcaaggaccgagcacctgcctacccctgcccccatggctctgtccccactcctcctcaggactctgcccacacgctgtcctctgtggcccacctctttggtgtgccacacccatgccttcttcctagcctctataagatatcctttccctcctatttggggctggtgatcccctgaggccttggggacatggtgctggggtggtggtgctcctgggttccaggtgttacattaagtcagagctggagttcccccttcctctgcctgaggttctaatgggtcctcttcctttctccaccctgcttacccaacctgaggtaagaccagtcacactggctcctccctcctagagggggtcagggggagggtgtatattgacatgaacagggatagagggtaaactggctccctgaatatgccagccttaacctccattccactgccagctccccttcaaagaggaggagctgggcttccctaacctctgcaggaggcagggcctccaggcctaggtgcagcctggccctgggatgggatgtggggagtgaatggtgaggatctgcattggtgggaggggtgtccgctgccctggagaagggttaattcagggagcagtggacttcacactcccatccaccctcctccaagcctgtggaatcctttaatcaagttgggtgctgaaatttcagctctgaaatgccgcctttgtgctggcatccaggcagccgccccagagtgcgggggtcactttctcggccccatttctctaaatggtctctttgttccctgctgggctgctcagtatcagatgtgattaaagggagatggggtttgggctggggaggaggggaattgggggttaacccttaggggatagagtgcaagggaaatgggacagaaggggtgtttttcctcctgtcttcctcttcccattctcctcttttggggagtcccctgctattcagctgtctgggcctggcttttgacttctcttgaataaaatgtcccggtcaccactattggttctgttttcttagggtttgggcatagtctcttgagtcatttccagaaacacctgacccttttttaacaagtggagctcctgccttcctgaggcctgtgcacacttggaacctttggtctaagggatgcacacaacccaggtcttctgacttccttggggtcatttcccctccttccacatcctcagtgatttcccactcactctcatgagatgtggggtcttggaggtgatagtgtcatcttccggatgtgccccctgctccccactgtgccagctccatatccctcatcccacggcgagcaggagtagtgaacagaccacaaatggacaaaagtcctgcctttcaatgaaggggaaagggtgggttgtaaagattataaacacataaggttagtactgattgatccatgaca

SEQ ID NO: 103662 - DNA, 1015 bp, Homo sapiens
tgtccagaggcagcaacacatgtttctgagacctccaggctgccagaggtcccagcaggcctggaagggggtatcagccctcaccgcccccttccttgtcatgtgcagggtcagggtcacactccagcctccctcatccatccctcattcattcaataaatactaatcgtgctccaggacttgtgctgaaccttggcaagagagtgggcagcaagaccacaaggtccccatgagctcccagggagctgacagacttggaaccacccctcaggcaagcccatgtgtccccagtcagtgccagagctgaagctaaaagtccaaggtgatcctccctgggtcagtagacacccaataatgtcagccgggtcacgctgggcctgtgagggctaggagggaaagaagagtgccctttccccatcctgtaggaactttcggtcccacacagcctcctgggctcatagacacccagagacccccctcccaggccagctgatcttctgctctacagaccagagtcacacactgcctgccccgctttcccccacccctgccgctccaggactggaatggcaggcggcatcccggcctctcctgaagcgagcatgcagcccctttgccatttcctagcgaagtggctgctagctagtctcaggaaaccaatactgtgaaagaactgatgtgcaggcagtgcacagccatggggtgatttgaaagtctcgggggcaagggtccccactgtgagttcagcttggccaagggtggcagctacctccctcagccccacttccatcctccgggttctggcactcctgatagtccgccttcctgccttaacccaggccagccgctgctccatcctctctcccctttatcctcctgtcctgctcctgagtagtccgtgcttctctccttccttgctgtaggaagagtcccatcctgcacattctcctattccagcccctttagccataggacaaatcagggcctggggctggggctcagagctctgttgtaa

SEQ ID NO: 103663 - DNA, 1048 bp, Homo sapiens
agcctgacatggtggctggcacacagtgggtgctcaagaaacactaagccaatgactgatcaccaaggcctcttcccagtgtgagctctctcagccttcctgaatttccccctccctccccaagttgcgttttcccttctgagccatctgtgtgcttgggaggcagagaccatgtccttcctgcgctagaggcctggctgctccatctccattcctatggcccctgccagccttcctccccagctgtcagcaggctttgtgttagaagtgtgggagctttgcctgctaggcacggaccctccgctggccatgaggagggcctagtcatttacaaaacacctttgaacccagctgacccgagctgccaaatccccctccctgggacccctgatctttcccttcctggttctcctctggggttgcctctcccctccccagcatggccctgggcctcctgtggcttgctgagcccactgacctcccctcttctttgaatcccgacagatgggcttgtcaagaggctagaggagctggagcggaccgctgagctatacaaaggtgggtggggggtggcctcgtcctggcactagctctaccccagggagcatgctctcagcagagtggcaacaggggtgctggcactaggaatgccagcctacaaaatactaggaccatgggcattaagagttcttaagaatatatacttcttctgaatttaaaaataactcaggggcctggtgcagtggctcacgcctgtaatcccagcactttgggaggctgaggtgggcggatcacttaaggtcaggagtttgagaccagcccggccaacatggtgaaacgccatctctactgaaaatacaaaaattagccaggcatgatggtgtgtgcctataatcagtactcgagaggctgaggcatgagaatcgcttgaaccagggaggcagaggttgcagtgagccaagatcacaccaccgcactctagtctgggcaatagagcaagaccctatctcaaaaaaaacaaaacctgatactcataaaaattcagaga

SEQ ID NO: 103664 - DNA, 2035 bp, Homo sapiens
aataaacacaaacctggatggcgcagtggtcgcagtggcttcagaccctccttgtctgcccctcccctccaccgtctattgacagcgcccttgctatgcaccatttatgcctcactgaagtgttgcagggctagcactgtggtcccctcacagctggtgatttgaggctcagagaaagatcttgcccaaggccacgccctgtgtggggacacagtgggttttaactcagatctgtcctgaaggcctgactttgccacctgcctccaaagctttctgctttgtggaaccttttgtatctcaccccccgcccccttcccccgcccccaatctgtgacctttctgtgcttccgacaggaaataaacctctgggggagagaagggcagacatggagccagggcgactgagcccccaagtaggggagggtggtgaggggtaagtgctgactccaggcgcgcctgtgctgcccgggtggtggggaaaggcgtgtggggagaggtgctcgggggctgtgggaagaggggcgtggggagaggccatggggagtgtctgcagagtggcagaaacagggtggccacttctcctgcttctcctggccagcctcggcctggtgtaatcagtcatagtggcccttgtcactctaacgtgttcctgtttggacgatgaatatggccatcctgagaatgcgagggggcaacagggtgtgcgaggtgggctgagtccaggatggaaaaagggtttctgcatcagctttgagcatgcattgctgggcagaaacccaaatgggaggcttggcaggggtgggacatggaggaggggctggctgtcaccaggagcccacctgggtccccgcagagccatcagacagaccacactgcctccctgaagggggcagccagagtggaggccaagagcacaggctggaactgacagcctgggttcgttcctgacctccctgggcctcaatttccctatctgaagtgtggcacctaccttattggcttgttaggagattaaatgaacatctggagagggcttagaacagggcttggcacagagcaagcactcttaaatcttaaataaagtcagacgggccgggagcggtggctcacgcctgtaatcccagcactttgggaggccaaggcgggcggatcacgaggtcaggagatcgagaccatcctggctaacacggtgaaacctcgtctccactaaaaatacaaaaaattagccaggcgtggtggcgggggcctgtagtcccagctgctggggaggctgagacaggagaatggtgtgaacctgggaggcagagcttgcagtgagccgagattgtgccactgcactccagcctgggcaacagagcgagactccatttcaaaaaaataaataaaaaataataataataaagtcaaacgcagtcactgctctagtggtgcaggggaagccacaggccatataagtagaagccggccaggcatctgtggggctccccagaccttcctggggcctagatggaaaatgagggccagcagggaccagtggggaggggtcactatgggccgggctggaaggtgaggggagtttgcggagggaaggcggcttcctctgcaggggcctgttcaccacgctcatgattcggagggaggcaaagaaaggaggggtgtgatgtatgggaggaggataaatgcatagagggaatacatcgcgtcttgccagattcgtgcacctggatccaagtgcaggaggtcagatgtcaaagtgtgagggagatcgtgggacgctccgtggggagaaggcaggtgctgggatcagcagatgacctggctgccagcacagtgtccacagcaaaagcccctggccctggacacccaagtttatcctctagtgggagagatgccctctgggaaggtgaggggacatggccacctcgtggaaggcagcagggcccatggtgttactgagcgcctggtcccaccctccccaggaccccaggggacggagtcgtatgctcagcctccagtgagcaaggaagtcagcggg

SEQ ID NO: 103665 - DNA, 1141 bp, Homo sapiens
tcccaagtctccgccggaccctcctttggatattcctcgtgtctccgattctgaggcatgtcctccattaacccttatgtgactccctgagtgcccccaccttccatcttttcatccccctgcgtccccaattcccatcccgagaccgcccgtgtctcatctcgaacttgtggaccccagggaccccagcttcgaccctgagtttctcccctgaaccccagtctcctccgtgtgtctccctcagtatccctaacttcccgagtcaatccatctcttctctttccccgaccctcagtgcctctttaggccccattggccgtcctaattttccttcctgtgctcctctaagtgctcacttgattccccacttcacgtccgtctccacctttcgtggtgcctctactcatttctcactccctgcttctcctgcctttcctccctgctttttttccttgcctttcctctctcgcgtgcctccagacctgcccccgacatgctccctccttcccctcagcctggccaccccagagtctcccacccctaatcctgtgtccacctcctgctcccacagatgacttggaagctggtgacagggagcatgtgaccagggtgatcatgggactgggtcggggcaagcctgtgggtgtgggacagggagggcacagggcaaggggacctgtggccgtatttttaatgggctacccacatgaccccaacgaatacctccccctagcttctgggtctttccctcacctgcctcttacccgcccaacaggatgtcaggcaggttcggtttggcaacgttgaggctgcacccttgggctgaatgcattgtttttgaatgcattgtttttgttagagtttctgcctggagtttggaacctgttttctgtccaagtctcagtttcctcatctgtgacaggggaactgtacctcctgccctcgtaagtctgccatgaggttcaaaatttgaatgagaaaatgtagaaggtaaagctttataaccagtatggccctgtacaaatacatgattttactgttgggtcataggcagaattgaaaggagtggaaagggaaagggctagaatgagaagacaaggagagaaggatgagcaggaggtcccttgtctttcagtgtatc

SEQ ID NO: 103666 - DNA, 1025 bp, Homo sapiens
gccacctgtgaggagagttggggcccagccgtcttcctggcctccttcctttcctcgtggcagaggcctgcatgtgggtgccagaggccagctctccccctccatcttgggggggcggagcagttgggcccaagctgcccgggagggtgggtgcagacacaggctgaggaccagccctggccctgccccgccatctgctttcaccaagctgtctctccaccgtggcttcccttctccctccaggccaaagtgctgctgattcccactcccttggttttcgcctgcccagcgttgctgtttgcgtggagggtggggggagctcagtggcagggaatcagcggtccgtggggtcgtggggacgggaacatgtgcccgaccgctccatcccctcctcctccttaggatgcataacctaccttgtcttttttttttttaattttctttccaggtagagtagctctttgtacataaagaatacttgaaaaattaattgtatgatgtatgagaagacagagtctcctagttttgtatcttgttgtatgactgccatgagttccaccagaaagccactctattttggtctctgtgacattttaaatgcgtgacagaagtgagcaaataaagtgaggaagaaatctatatatgagataatatagattgtattgaaatctctgcctgtgggtgaggtttttccttcctcctccctgccccctgctctggctttggggtgggtggagtggctgtgggtacaggcggcttaggaaaccctctccttcctgtgtgtaacctttcagtgatgggggttcggattgatagggaccaaggtcaaggcccaggccccccttggacaaagggtctccccaacctccagccagttcccaacccaggacggccgggccgcaggcggtcgatgctccttccctgtttggtcaaccaggtccatggggcccacatgctggcagccccgctcctgcaggcatctcccaggatttcctgggatccccctttcagacgagcttcctgcg

SEQ ID NO: 103667 - DNA, 1022 bp, Homo sapiens
ggctgcagtggcggaagtgctggcgccatagccacggtcaggctgtgccccacctccagcctcaccaccaggccaggaggcagctggcacagtgctcacgccgcctttatttattggaccagaaacactcacatgtcacttccagaggaacgggggacagccaggctcgcccatgggccttcaggaatatttatacatggcccagcctgcactgcccgggcgagggcagaggacactgggagcaaggcttatgcccctgctgcccgtcctgtgctgggggcatgctgggaccagccgcacccaggccccaatgcttgtgtgtggaccagcggctgcagccttctagcccctcctccccgcgagactctcaggctgaggtcggcaagccgtggctcccccacacaccgtgcaataccctgtctgacctgggctcttcccgcctgcatccctcccctgtccacctttgtccagtgctagattcacctcaccccgggcaggagtggggatgtgggcgctctgtggtcctcccctcctgacccaggcctctgtggcatgctgcaaggatcagagccagacaccaggagtcacaggccccacccaggaagggcattcagggcccctgggcaccgcttctgttgaagcaggggcttctgggcccctgggtatccccacctgtcgtggccacacctctgcctgcctcatgccccttccccctggcctaccaaggacagcccacagcccgcactgccggctcacttgggtccttcctcgatagctttgggcagagcccttgcttcctggctgcttcagggctcaggggctcccagccctccttcccaggctgatgctgggtcctctctctctttggggcttctccctcccgtttcaggggaaaggtctgagtctccacgtttcagaccagcttctgggggaaggcagtccggcagggagaccgggaggggtggccacacagtggggagctgggaggtggggggaatggtcccagactcctctcggggccc

SEQ ID NO: 103668 - DNA, 1059 bp, Homo sapiens
agaagatgctgcgcttcctggctgtgccatccccgcagcagtggccctgtggtgtggggagtgactacatccttttcatcagggagtctgtgctcagaggccaagtgtctgcccaagctgtccccagagttcaaactcagattttgagactctggagtccacgtgctctgggctcctgcaggtcacctccatccccagagtgacctctgctgaccagaaaccctggacccaggcccagagagtagggctaggaaccagatcgggggtggacatggaggatgggaggaggccctcacctgcgccggcttcccggtggctggttccttgagcagggccctagccttgccccgggcaccaaggtctccaggacctggccctgccatctcctcagccacctctctagtgcgcagccccttgcacctgtccaccctctgcctcggggccttggtgcaagctgccccctctgcctgtcgagcctctcatctccggcacccacctgatggtcctggctcgagaagcttccttgtgtgcatctcctgtctcccgcctccatcgtgccctgccacaccattcctcccttcctccctcccttcctccacatgctcatatcacatacggcattgcgctggctgcatctcctatatgttctgccccccgccccgcgcagacagcagtcccctgggagcaggacacgtagccaccccccatctcctccatctcctctatccttccatcccctccatcccttcgtccctccatcccctccgtccctccatccctccgtcctctccgtctccttcatcctctctgtccctccatccggtacagttccgtctgccagaggcagggcttgcttcatgccttctgtgctcctcctccacactcaacctccttttccccccaacaggccaccctgcagttctgtgtggtgaagccactcatggcggtcagcactgtggtcctccaggccttcggcaagtaccgggatggggactttgagtaagcagcgggtgctccccggggtgtgtgggaggagtgttggcgcaggctggtgccttg

SEQ ID NO: 103669 - DNA, 1023 bp, Homo sapiens
ccctctctgagctttagtttcctccactgtaaaatgagtgtaatgatactcctctctagagatggttgtgaggatcagatgaggtcatggatgtagagctttcagcccggcgtggtggagcccacggcctcctgttcagggaggcagagtctgaggggatcacgcccactcttcatgaccttgcgttagtctcctctggggctccgtaggggctctgtcatgtcagcccctccagcttcgccaagagtagtcacgaaagtacatgaaacccacagccaagtcacgatggccctggagggcggggcctgctgctcccttctgtgcagggcccaggccacagggcgggcacacccacaaagcctccacctgaacatgccaagtctccagttctgcttccagaccttccttccctagcatgttcctaaattcagaatctcaccactggacctgcagggaaagagttaaaactatcctgggttcagggtggggcattgagagccattgtttaccagttggtgcagccacccaggttccggccagctgtgactcactgccttgtttgatgattatattgtctacaaaattttgatttcatgattgttagctagtgtggccttgttagaaattattccccagccctgtgggctcagatgttctgttcttgttcctggcggtggcagggagagatataagaagaaagagaacaaaagaggcctcttcctttctttaccagggcgagagagcacaccccacagctttgtcctagaggcacagagacaggcctttgactcctcagggccagtgctcaatatccagaccttctggagagattccctacttaaagtagagattcccagatcaaccacccactaccctagcccataggagaagttctggaatggagccctggaacctggcacatgtctaaagctccctgggggttctgatgtccagcccagcctgggaactgctgactggtccagggtatggtcaggtgatgattctggggcctgctggcctggg

SEQ ID NO: 103670 - DNA, 1769 bp, Homo sapiens
gtgggaagattgattgagcctgggaggtcaaggctgcggtgagccgtgatcgcatctgtgtgctccagcctgggcaacagagtgagatcctgcatcaagaaaaaaaaaacaaaaaaaggaaatggtttcgtatattgagtatattgagctgcagtccttctgggatctgcccctgggagtcccatctgcccctgggaagaaggtggttgtcacgtctattaagagagtgacccctgatgtcttctcgtccccagcacagtccttgttttgtgttcatcctggtccttctctcctgatactgtgcatttgtctctagtttgagatgtggtgtctagaatggagcagaaagttccagatggggcatgggggtggggagcggacagcctactctcattccaacgatggaggagttcctcccagaggctggccccaaggccatcaactttccagtctccaaagacaaaaccctccagagaagacacagcctgattgtccaggccaggagagagaggccctccggtccctcacgctggttgctgccctctggacttggcctgagggctccttggtcatttatgagagggcttagcacagagcctggcacaccagctgtggtagatatttagggagatgtagagtcattgtgtgtctccgaggcctctccaggggtctggtactggagccgtggtgggaagggcggtgggcagtgagcttcccggtcaagcacctccctccagccccgtctcagcttctccgctcttcttacatccacgcacgcatcttttatttgtttccaggggatgtgttgagttttccattttaaacacctttgctaagatgttggaggtggtgtttcacatggctctgtactttccaggagggagactgatgtgtccagttggtcagtggggccaggcttgggccggttgcgtcacgtctgaggagattctgtctcatcttctccaagaattagggagtccattatcgactcactaatgattgtttaaagggaactgtcagcaaattggtactttacagactggctggccccagagcacctccaaaaggtcaagaatcttgaactgagagggatgatgacatttgatgattctgatcagttgtgtgcagagccggttacggagggacctcggccacgtaattcaaaagtgtgctgactgctgacatgtgttttgatgcaggaaaggacacgagcccagatgccaagcctttcttgggagaggactgcagggatgggctctcccgggagggagcttccagatagagagggcttatgggcctggggcccctgtggcttccctggagggttttgttgttcgagactggaaagctgatagtcttggggccagcctctgagaggagctcctccagtgttggaatgagagtggggtgtcccctcctgccctgcctgagcctgttgtcatggcaggctcccctggggagatggtccatgtacgtctgtccattccttccttcagtgttgatgacatgtttgtagctgccaggccctccggtagtcattggaggtaggactgcattctacctgcaaggagtttacagtctggaaaaagcagtaggtaacacaccgtggactcttgactgtgccctcagctcatctaaggctctgcacgttcacagcccctgaccccaccaagggaggagttatcccgcttacagatgaggagattcgggcatggagcgcttaagacacttgcctgaggccacacagctcctaagaggtgggaccacag

SEQ ID NO: 103671 - DNA, 1283 bp, Homo sapiens
agcttttacttttttcctctgcttcctaaaagtagcattcattctcctaacttcctggtgaggtagctgcctaactaaacagagcagcagtggtgctgcctctgtttaccagatgggaggaggaggcacaacctgaggacatccctgcagccactcggccaggaagtgtgtccacccgccatagcgtgagggctgcgtctgtcttgccataagttaagggacggggcaaggctgcaacccaggtggcagtgatttagctcagtgctgccacagtcacagccggagtgaggtagagggaaagggcacacactgatggcccagagctgccagtgcgtgaggtcccctggggagcttgtggaaactgcatttccatcctcatccttggccttcctgtgggcaggggtgtgggctcactgccacctgcacctgcaagactgccccacaggcactgctgcatgcactccacgagccttgtgcacgcccgctggtctgagtctcacaatggccttgggaggcaagtcctgtcatcccgcattttgcagagcagggctctgaggctcaggggtaggtcacgtgcatcgggtcacagatgagtcggtggcagagctggaagcccacctgccctcccgtccctgtggacaggagggtccccagctgaccccacacctctgcccccagatctacatgcacctgcgctgctacagctgccccaacgagcagcgctacatcgtgcgcatcctcttcatcgtgcccatctacgcctttgactcctggctcagcctcctcttcttcaccaacgaccagtactacgtgtacttcggcaccgtccgcgactgctatgagggtgaggatggggacggagtggggagggctggcggggggctggggggctgggagcccctgtccccacattcctccccgaggggcttcatgaggactgtcttgacacaccccttgctgctttacctactacagggtttctgtcccaaattgacaggtaacagcacatgcagctagagtctcacctcacaggtacctggaagcaagggccctccacctgggtctcgcttctcaatgctggcgtctcaggcaggtacctggaagcaaggaccctccacctgggtctcgcttctcaatgctggcgtctcaggcaggtacctggaagcaagggccctccacctgggtctcgcttctcaatgctggcgtctcaggcaggtacctggaagcaagggccctccccctgggtctcgcttcttagtgctggcgtctcagacaggtacctg

SEQ ID NO: 103672 - DNA, 1040 bp, Homo sapiens
gggtggcgtgtgaatgagagacaggtgtggagactgcactcactggcaggtaggctgtatgtgggggaggtgggggtccttgaatttgttttctgtctgatctgcagcctggaactgagccagggggccttgtctggggaaggacagagaggcagagagattgcagaggagaggggaatagcagcagccattaggaagccttgggcctttgcctatcactatagcactgctctccaaacttccttggatcacacagccctatcagtaaaaaagaaaccagaacaaaacctcttgaacatgcacccccaatatgtggatattggtgtaattataagtgtatgttacaataagtatacacgtatattactttactgtttcagtgtgtacgtaataaaacctacaccaaaaacagaaaccaaaggccaagctaaagatgtaataaagaaaatttttactttgttgacggtacagaaacctcctgggttcatacacggggtcattttttggaacgtgcgctttcgtgatcagtgagagagagtttggaaggtctggctggcttcacgttcggcttgtttagagactgggttttaatggctgctttccctgcaaaagatcctgtctgggacaggaagctgcacacggagcagacgcatccttggctttctttctaaatcgggttactcatttttccatcccgtccactgagtatgcaaaggatttgttgaaatttggccggtacatttccatcctccctgatgccaatcacgtttttgtaaacgaaatggaaggtattttattttaaaattcttaacaagcgagtccaaaacccactaaaatgctttggaaaatttttaatggactagaaaattctgttacgtagctttttaggagttcagctatgagaggattttttttttctttttaaagtcagtgacagacatattgttttggtgcatgccagtaataccagctacttgggaggctgaggcaggagaatcacttgaattctggaggtggaggttgccgtgagtcgagatcgc

SEQ ID NO: 103673 - DNA, 1001 bp, Homo sapiens
gtgaattgcctaagatcctgggggaggaagcacccaggttttctggttttgagtcctgggcccttcctgctgagtagctacccccaacacagacctgcccttggagagcttgcagccacactgggaaggccagtgtattggattgctgcttagacctggaaagcacgtgaataaagcttcaggttaaaaccatgggggttccaggaggcagcagtcggctctgcctgggggtgagctgaggagccggtgctctctggaacaagggtagttgggctgaggctcagtggacagtggaggttggcaggtgaagtgcaggaggtctttgcagggagtgggaccaccttgagcacacacagaggaatgagacaggcaggttactcaaggagcagaggtctcgtgaccacttcccagagcatgtggggtcctagcctcatctccaggaggagaaagtgcatctatacacagatttgtcaatggagtttaaataggatgtgggaaaatctagattttccaaaacagtacatatttgctttgagaagaaaggtagatgcaggatgcataggttagataattttaatagcagtaacctcagagcatgtaagtatgatttgatttactggagtgcctggccgtctcagtcagtgggagcacggcttgggctgggagatgaggttgacaagggttctttctctcaaatgcttcctttggtttgctaagaggtatctcctactcggccgggggcagaagacttttccttcttttcccagtttgcagtagttgggccagatttgtggaagtgggagaaaggcctgccctgcttctacatagagttggctgtcctgacttgatactcggtgtgccttccagagacccgcctccatctcctcaactccctggcttgatgcttaggtggtgatggctgttgggcacaggagttacataacagatctgtgatggacccaggagcagagccagctgagtgaatgtcatggagtgggagt

SEQ ID NO: 103674 - DNA, 1050 bp, Homo sapiens
gtagcttgctgcagcttctacctcctgggcccaggagatccttccaccttggccttctaaagcgctgagattataggtgtgaaccaccatgcctggtcagctggaacttttttttcttttaagacagagtcttaggctgggcgtggtggctcatgcctgtaatccaagctttgggaggctgaggtgggcaggtcgcctgaggtcaggaatttgagaccagcctggccaacacagtgaaacccagtctctactaaaaaaaatttgccaggcatggtggcacacacctataatcccagctacttgggaggctaaggcaggagaattgctttaatccgggaggcggaggttacagtgagctgagatagtgccactacactccagtctggtgggtgatagaacaagactccgtcttaaaaagaaatggtcactaggagcacgggaggaggagggagagagggaggtaatgcgctgagcagttctggtgacccagagagagaattgggagatgcaatttaaatctgtgcgcttattagccctgtggccttgggcaagatgcttaccaggttctaattcctgctgtttaaaaatagggggcaaatgattcactttccttcatctgtaagatgggagtaataacagtgtggctgtcacgtggctggcctgaccaatgtctgatggagctcagcacggtacctggcacacaggacatgcttttattatgaccttacaggcccattcatttatttgagaaggaggcatcgcaggcctgtgtgccaggctgtttgcggggagccgccctcaggagccgagtgcagctggggagagagaaatcagacacacaagcaattatgattgtcctgggggctcttagggaaccttaggccattgtcgcctgggcgggcacttgtctagtgaggtgatgtgtattaaggtggaggaagaagtgggctccaggtagaaggaagagcacatgcaaagcagaggtctgagttcatgtctatggagttgtttgatactaagtctcagcacttagtagacctgaaataaatg

SEQ ID NO: 103675 - DNA, 1038 bp, Homo sapiens
gtggaaacagccccggcaaggcagggtacagctttttattgttttgaaaacgagtcacagctctgggcctttagactggggatctggtgtgggagttctggaaggccaatagctgggcccctgggagagctctgtgtggggtctgcaccaggccctgcagccccgggtagtaagcactcaccgaagaccatgctgccctgcactgtgctggggcagccctctaaaaggtggttggcagagggagcccaatgtgtaacaaatatgtgcaagacagtgccctacttgtggtggaaacagagggccctaaaggggcccagaggacaataggaacaacagtccgtttattgagcacttactgtgtgccaggcacagttcaaagcgctttcatgaattactgtatttaattttcctaccacccagtgtggtgggggctgtcactgtctgcattttgtaggggaggcagcagagagtggaacagctgagttttgaaccagtaggtctgacctcagagcccatgctcctcccccataaccctggggtgctggaagtcgtcttggccctgaaggacgaggggtgctccacctatgaaggagaaggagggcgttccaggtagagggaactccgggcagatgtggaggtctgagctgcctcacctctcagacgcagaggcttgaactgcctgtgactgtgttgggtctgtgtcctgaagacctttggaggccccgccaaggagtttgaacttgatcctgatgtcaacagggaggccttgaaagtttctggaaggatgtgacatgctcagccatgtgttatggggcagtattaccatcccttctcatccctccttcattcctgcagagaacttctggaagaccaggcctttgttccgttggctttcctacagcccctggcatcgcttttagaccccgccgcctttctcttgttgtcttctagcagcttttggtcttgaagaccctgtgtgactcagggcaggttctggagcccactgttgtaacggtgtctgccccactgctgacccct

SEQ ID NO: 103676 - DNA, 1034 bp, Homo sapiens
atccgtctccccacccgtgcctcctctccgccccgcgaggtcgcccgtgggtgtgcccgctccctttccacgccaacgtggcgggggcagctcctggagtgtaatcggacctgtccggggggcggccccgggagagggaggcggatggaccaaggcgctttgcaagagggattgtgtgctcccgggtgggtgtgctggcgactggcacggccgagtgagtgggggaggcgtccgtgccctgtgcgggtggcagtgacctgggagggtggtcggcggggggctttcggggctgcgtcgtgagtggagggtgtacacgcccgccacacaggtccgcaggtttggaaggggatcgactgggacctggggctcgaaagatgtttgcccccaaagggaccgtggagactggttttgggtgtctgtatccttcccgtgaattgtacatttcctcctgggcacacccttggtacctcgcttggatccacttacctccagtgctgggtggctccaggccaaggcaaggcagttatgctgggggttgggcatggattcccaatacatatcccctctggaggtgttgtataaggccagacgttttactcctccctcctttccagggcattttggggcaaagcaggtatttgcatgcctgatacctgtggtgaggtgaaggccatgtattatttatctgactgctggtgcttttgtaaggaaagaagcagcaatctgtgccctggaggccctgcgctgcagagtcagccaggcaaacaagctcacctgcacctgcagaggcagcgcaggtctcagaggtgtgacttcgttgacaggttatgcctacagtgtccctttccatctacctatttagcttccttggtagaacccctaggctctgcacctctgaaccttgcctagggtgctgtgcgtatcagagttgggacctgggacgctggggtgggagagccccagcagccaggtatgtgtgcccacctggacagaaacatttgatgcccaagccatcaaggagctctcaagcatgg

SEQ ID NO: 103677 - DNA, 1133 bp, Homo sapiens
tgtgtgtgtgtgtggatgtattgacctgtgtttcccaagacagcaggtgccacggcccgccccgcctgccagcccgaattcccgttctcctgtgtctactaacaaggacatgggggtgggcggtgacctccgcatccctcagagctcagagggtcctcgctgccaccggtccccccctagcccgtcatcagccggtggcagctccatcttccattcctggttttagggcagaatccatggagactgcttccagaaggcatctggctctgagttataaattacttccctggtcctgacagtcacctggggtcccccctctccctggttccacctttctgaggaggagcctggagtcagggctgggttttggattaacccatccttcctagttaacacctttttgtttttattttattttatttttgtttgttttctccgtgtgtgtgttttcctaatttatttacctctgtttcccctttttcctttttttttttaattaaagagcaaagctttttattactttgtaatttaaaaaactgaaaaaaaaaaaactgaagaactttggggggaattttgtacttttttcctgtgtaaatattggacttttttgagctttatcgtggttgttaatttgaagtaataaagtagaaaagataaagtgatgcaggcagccctttgtccacctctgtgcccttagggcctctccctgcagacccggaagtgggtcttgctgggagcagcaggagtcagtgaggaacaagccctcgccctgaaggcaggtgtggctggggccactttcagaacacttgggctgtggttgggatgtccgggggctttgaaaacacgagtgcacacaggtgccacgccacaggtgccacgcgggggtcttgtaaagagggctggggtggggctgagagcttccccctgcacactccaggtgtgctgatggcctggggcccctctttgagaagcaaggccctaaaagctcttcacacatgattttatccacacaagtatcctgagttaggtcctgttaatagccctgccttcggacaagaaactggtcctgctgtaaaatatcttgcccacagtcacagctctggtggcagaggcaagacgagccgaggtcatct

SEQ ID NO: 103678 - DNA, 1054 bp, Homo sapiens
aaggttcggcacggaggtgccacagctcgtgttcctccccaggctttgctgtggctctggctgagtcactgttggccagcctgcaaccgagtgggagcccagggtgaggaccggaggtcaggagttagagccccggtggtcccaggcctgcctgagaggcttctgggtgggaggatgggaagatgcatcttctagagtgttctaaggcaagactctgaacagtgacctcttggggtgcagagagcagagtgggactaggtggcagaggcctgggttcagaccctagctctgccctgagctgtgcaaccccgggcaggtcacaaggcctctctgggccttggtgcctcactaagattcagggatcattctggtcctagccactacttcctggagttgcttaaagacagggcccacccccacctcttggccagtctcctgggagagacatgggttgcaggaaccacaccctgtgcccatgagcaggcccccaactcagcccagagctctctcctccacagatgcggcccccttcctgccagccccctgcccttccctgtggacggccccaggatgaactaggtaacgcagtcgggcgctgcccccacatatgctcttctctggccccttctcacttcctcctgcaccaggggcggcagtggctggacagcagggcacctgggggcttagggtaccccttctgctccagctttgcctgctgggcctcttcttcctccgtggggaacgtggccccattttcttctccagctccccttgagcttctgtcccaaggcaggcggtgtctgtgggttccctgggcctcctggctgtggcctccactgcacctgccagaagccattgccaggtcccggcagggggaaggacagctccctgatgagaagagcccctggctaggtaccgggagagctggtctgagtcctagcccagccttccactagttttgtgactctgggcctgttcttttccccctctggacacccctagccagtctgctagaggcctctaaacagctttcctgctcggtttagcaaccttg

SEQ ID NO: 103679 - DNA, 1910 bp, Homo sapiens
tggctaggacagtgctggctgcagggggtctgggagcgtgggcctcacagtggccttctctatcctctgcaacaccctccagccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcgtgagtcacctggaggccaaggcgggcttgggggactggatggggaaggccctgactcagagggccagagtgagctggtggcgggaggggctcccgacagacgggaggtacgagctggacagtgtggttgacctcactggggtcccagagccctccagcctcatccgtgctgacagcttgtgccaccatgggcagcagggccaggcagggcgctgtctcccgtcggaacaaggaggatctggcttcacctggggtccctcctgggtgcccgcagcagggcatgggtggtgctggcggcgccccctgctgccctgattgctgcctacaccgtcctgctgctcctgttctgcacatcccaggtggctacctgcaccatggcccctcgggccagcctggacccagtcatggtgcttgctttcttcttggtcatgggcccctgggtctggctaggcagttgttctgtttccctcttttaagagtcccaggggtggggttgggtggggagcagcattggccggccgtacccagagctctggaatctgtgaaattgtatgtcttgtttcacatctcttctggaaaagggggcttcctcgagccaggctcagccccgtgacagccccatgacagcgaagggacctttctgtccccgcccctgtccctgtgctgggcccacgtactcacccacgtactggtaaggatcctctgaggtctggcttttccaaaatttgccacttgaccagtgagcgcaagaggctgagcctcagctgtgctttttgtccctttcaggtgcccggctcccctgggcacccagagccccccagataggccggtggaggaggtggaggagctgtccccccaaaactactggcctgtggtctggactccagggccccatttctgatgtcgccaggtgtgcctgagcccatcggggccaggcctgaggaagtgtttcttgggaggatgggatgaccccctgttcccaagagatggcagcacagtggaggccatggtggaaaaggccctgccatggggtccttgagggccaggacagcctgagggagggatggtggccactgcccacaaggggcctggtgggaacgggtcccaggacagactcatagctagaccccgttggcggcctctgtgttgaaccagaactcattaaacacctcctcttgcttcatcctggtgtgcctctttcatggcagggccctcagccaccctgctagatggttaggaccaaggctctgttctcctggaagccaaggtcggcacattggtcttgggcttctcttctctctgggtttcttgttcactaaggagtaacacagaggtcaggcagagaatgggggtctcgcaggctagggacctcagggagaggcctctgttgcccttttcagcaaggctggaaatgggatatgggcaggggacgtcttctctgacttcaccctagaccttctggctccaaatggggcccatggccttgagcacctgggaccagctctttccaccacagggcattgggcactgggcactttcttatcgagatagtcactcccacgtctggttcgtgatgggcttggccctccagctcagcacaactgcaagaatggattttgtattctctagacggacactgtccaagatggtagccattggccacatgcgacacattttta

SEQ ID NO: 103680 - DNA, 1011 bp, Homo sapiens
ggaggtggctggaaggtggatggtcgagggcattcttttctgccttccccccagtaggggatgcgactttctcctgcaaggcgtgctgggcactggcgaggtctggcctctgggcaggggcagtacttgggaagaccaggccaggctgtgggagcctggggggtaggaggtgtaagagggctgatgcccgttgtgatcccttgagaagcttcttttgaggggcccctgaatgagcatcccccaaagacatgcttgcttggctgcttcctctctggccacactgaaacctgtcctcagcctgccttagctgttccccaggtgtgtggagtgcaggctgtgggccacctgacacctgcagaatgtggtcttcgagaatgcaggttttcgagttcctggtggctctgcctggccttggtggactggacccctttcccggctccccacgtcgctgaccctcatgttcctgcttcctctgcagcaagagtgagccatggagctacgtgtggggaacaagtaccgcctgggacggaagatcgggagcgggtccttcggagatatctacctgggtaagtgttcctagctccagctggagcccctggggccagcccatgggaccaagaggaggaaagaccccaggatttggggatctgaagtcagaatgtggctccaggggcatgatttgccccagggccatcccagatggggaaggaagcagcaggttgccgggaggcaggccagggggctcctctcgcaggccaggctgggcactggagggtatttttagctccagtttctgcaggagtcatgcggttcttttgtgcctcagtgtcccgggtcagctgggtcaccagctgggtgtgggaaaacccaggcggggttcacatcctctcccctgcttcctgggagaaggatattggtagatagaagggacttgggttgctgctggacccctagccaggcccccctctctatgtcctggcctcctggaacccagcccaggcaggctttggg

SEQ ID NO: 103681 - DNA, 1032 bp, Homo sapiens
cacatagcagtcagggggtcctgaagggcttgccccttcccgctctcgttctctgcagacagccggtgagtggggagagactggggggtcatgtgcagtatatttatgtaagacacccagacagagggcacgggtatttatataacccggcgtgggtatttatgtaatataggatgcgggtatatttatgttcctttcctaacctgcgggtttcctggctgccatgtgtggtctctgaattggtgttggcagaaagtggactgaggtgttgggggggggttgcgtgcacacccccccttaccccccaacagggctcactgtgtgtgcctgcttttctttcttccgttggagtgtacacactcgggaagctggacgtgtgtgtacgtgggatgtgtggcgtgtgggtttcctgcaaacgtggactgtgttcccctggcagcgtggcacctcagctgagacaggccaagcatatgggcagcggcccttgattgagagcccagagtttggccagctctggtggaggtccctgcctcgtggttattggtggagggctggtgagctccttgggagccaggtgccggggttccctgtctctcctgggatctgcccactgtccctggaatccatctccctcccaggctggcctggttgttgggggcagcacttggcacgggcaaggggctgatcttctgtgccagcacagctgctctgcagtcttcctgttttgccctgtttgtgagtgtgggagaccaccaggtgggacagccggagccctgtcctcggcgaggctgtaccatctgcagggtggtgtgggacaggtggcatggcctctgtgagcctgagtaccctgtctgtgaaaggagttccctcttgctagtccttgatgctggtcctcttgtaaacacccctccccctgtttactgcagtccctggtccctgtccccacggcagcactgcctccaggccttcagtttcctcctctgctgaccaggaacagggtgtccggacttttgccccaggccagagcagagg

SEQ ID NO: 103682 - DNA, 1096 bp, Homo sapiens
gtccagcccccgagaagcccaaaagtgcagagatggaatccagggagggaagcgggcttagcgcctccgtggctccctatgctcagggcaagcaggacagagggacagggaggaaccaagatgggcatcaggaagcttccagaacagtgagcataggagggccggaggggcagtgttgaggggcagggactaggacctggatccttgtggctttagcttcctggtctatggaccccagtctctaagctgggccggactgggtggcactggctcagaccctgtcatcagagccacctctgctgccaccctccgcctgccggggcagaggaagtcttaggtcctggtccaggctcacctgcttctgagagtcttggggctgagtctgagtggccccgagggagcccctcgctccccagcatctcacctgtccggcttctcctccgcaggccctgcgtcttcccaggtgaccacgccggcttcaggacatgcacggacacagccgcaacggccaggcccacgtgccccggcggaagcgccgcaaccgcttcgtcaagaagaacggccaatgcaacgtgtacttcgccaacctgagcaacaagtcgcagcgctacatggcggacatcttcaccacctgcgtggacacgcgctggcgctacatgctcatgatcttctccgcggccttccttgtctcctggctctttttcggcctcctcttctggtgtatcgccttcttccacggtgacctggaggccagcccaggggtgcctgcggcggggggcccggcggcgggtggtggcggagcagccccggtggcccccaagccctgcatcatgcacgtgaacggcttcctgggtgccttcctgttctcggtggagacgcagacgaccatcggctatgggttccggtgcgtgacagaggagtgcccgctggcagtcatcgctgtggtggtccagtccatcgtgggctgcgtcatcgactccttcatgattggcaccatcatggccaagatggcgcggcccaagaagcgggcgcagacgttgctgttcagccaccacgcggtcatttcggtgcgcgacggcaagctctgcctcatgtg

SEQ ID NO: 103683 - DNA, 1080 bp, Homo sapiens
gctggagcaggaggatcactcgaccccagggtttgaggccagactgggcaacatttaaaaaaaaaaaggctagtccttgtggaagaatgctcagaagtcactgatgcatatccaggaaattgttttaaaattgtttcaagagccctggaatgcctctggtaaatcccctgaaatagaccaatcctgtttcacctaatgctccacaaatgaaggggacgacaagggcacctttgttcatggcagcactgtcagtcccagtatagaagcatggagttatttaatgaaagggtcactgatttcaaattctaggcaactggacccaagataaattgcaaacacatttaacctcttcatgttacattatggcagaacactgacccttaggtttggtaggctaggagcgtagtaaataggccgggaaatgacttcatagattcgattcccatgtctctctccccttttaggtggtttttctcctctgtgcctatgttacagtgtacatgatatatgggaaattccgtaaaacttttgacagtgagaatgacacattccgcctggagtttcttctggtcccagtcattggcctttccttccttgaaaactacagtttcactctgctggaggtaagggaatggactgagtaccagttctcaaagggaaatatgctccctgcatccttccctccagaccctgggcttgccttctgcttacaactgtgaccattactcatgtatctttcagttataagttgagaagaaattgacaagctatttacaatgctttagttggaaatgagcacatctcaatagtcatgatgcccataaaccaagcaggcatcacagccctacttctggctgttgagacgttctgttcaaccgattagcagatccctgtatccctgtagcacagtccaggcccagaaatttcaactcagtaagtttggactgtggcccatgaatctgcaggcaacaagcatcatgggagattctgatgctggtgtttatggacatgactaattttttattatttttttgagatggagtctcactctgttgcccaggctggagtgcagtggcagga

SEQ ID NO: 103684 - DNA, 1100 bp, Homo sapiens
cgcctcgtaggccagggtaaggggcttgcactacattctgattgccaagggcaggtattgggtcattaaaaaacccaatccactagctgctatgtagggtagaaagcagtccaagtacagtgactagctatggggcagttgcagttgatcaggaaaaaggctctaggtagaaagacatgtggacacaagttctaggacttgagaaggactgctgatttgattgtatgagatgtacaatagacaatttgaggccaatcgctaagtttacagctggggggaagggtgccagtaaccaagtcggggatcagtaggtccatagtcaaccggagatggactccccctttgctttaacaatcgaacatatactgtgagccggccattaagagatgataccaagattatgcatcaagttataaagcagtcctttcatcagatggtaaattcttatttcatctccattttcttccagtccttaagggaaagaagttaagtcttccaatgccaatctgaggaccttcagagacagtctacgccttaacaagcacatgaaggaaactattttgaatgttctctttggcaacttatccataatttgggatcaaatgttaaaaccagaaaagtgtttagtgtggatttcagcaaaacctgatcatcccacccagaagaccttctcatcaatagatcgcccttaaagacccattgtaaggtcataaaaaacctcggccacctgcacaaagatggtgcctcactgcaacaagaaaccttaaggtgtcttaccgacgaaataaaaaacataaatgattgttctccaaggcctgagggcaagactcatgatgagcaagtcaaccccaatctggaacaatgtccctcctcttagaatgtcccaactaaagaccagttaaaatattagggtacgttcttgtgaatttccactttccaggtagatgaccaaatttaggtggtcaagatataaaggtgtcagctagttttaagtgtgaaacttatttcactttcacactgccttcaggccagaagcaaaccaaatttaccaggtttggctggaggagttttgtgactcatcttttactggtttgaatttt

SEQ ID NO: 103685 - DNA, 4019 bp, Homo sapiens
tcctgcttcagcctcccaagtagctggtactacaggtatgtgccaccatgtccagctaatttttgtattttttgtagagacagggtttcaccatgttggctggtcttgaactgctgacctcaagtgaccctcctgccttgatctcccaaagtgctgggattacgagagtgagccagtgtgcccccggtcatggttgcttttttaatactttcaaaaatgcttagtagtatattaggtttccagttttccatacggagaggtcagtcattttacactgtttagtggtgggtagaaactgagacatagcagttgcatctacagttgcagaatatcctaggatctgggcttcctgactcaaggtttcatattgtaataccgtgtttcttgatcatcctcaagtaaggggcctaaaagggtgaaaaggtctagtgtcctttaatttttactgtgcttttgaatgtgccccattaaagaatcaaattatgagtatatttttacagtactaattgggaggctggccagcataactaaatatcaaggagacatgtttaatacttttgtacccagtagaatttttacattgttatgtttaggtcctatatctgccattaaaaatcttcttgtatcttcccattaggtggtcgttctcgttaccggaccacttcttcagccaacaatcccaatctgatgtatcaggatgagtgtgaccgaaggcttcgaggagtcaaggatggtggccggagagactctgcaagctatcgggatcgtagtgaaaccgatagagctggttatgctaatggcagtggctatggaagtccaaattctgcctttggagcacaagcaggccaatacacctatggtcaaggcacctatggggcagctgcttatggcaccagtagctatacagctcaagaatatggtgctggcacttatggagctagtagcaccacctcaactgggagaagttcacagagctctagccagcagtttagtgggataggccggtctgggcagcagccacagccactgatgtcacaacagtttgcacagcctccgggagctaccaatatgataggttacatggggcagactgcctaccaataccctcctcctcctccccctcctcctccttcacgtaaatgaaaccactcaagtggtagtgactccagcagacttaattacattttaaggaacactgtctttcctttttttttcctcttcgccttttctttttttttccttttttctttttttttttttaatttttccccccaaccatcgtgatttgtcttttcatgcagattagttagaattcactgccaggtttcttctgcccaccaaaatgatccagtctggaataacattttgtaaaaaaaaaaaaaatatatatatatatatatagctgactggaagagattaatttcttcccccaacttcttgcatgttgaagatatttgagctatttttcatctaaaagagtaaggtattaggcccttttgtgggagccccatgttttgtttttctgagttggtggggagggagggagggggagggctgaattgttttgcagaggaagatggcatctgtgctttaaatttctcattactgggttagaaaacaaagagggattgccctgcacattttcttttgtgcttttaaatgtttcttaagttggaacaggtttcctcgggcctgttttgactgattgctggagtgcatttgatagttaaaaattactaattggttttatttcccttcacactctgcctccccacttctccccccgttactgaaaaataaccattttagtgtcaggctagaaattgaattgctgagttttgtgtatcctttaaattaaaaaccacaagtgtttattgtagtggttaaactgtagcatctcagcatctgggtggaagctgcctatatttcttcccagtttaactggggaccatctgtgaaattaattttccatccagacagctgctgtgagcaaatgaacataaatgctcgctggaaatttactaaccagtttttatattgacctgcagtgtaaaaagcacatttaattataaacaatatattcaaaatgggcaaattttattttcaaatgcagtgtagagctagattaaaagcaactctttgccacctactctgcccttttggcaaagttaccttgaacaaagaatcttaagggtttattaagaactctttattttcttcataccctgttctctgcagtgctttctaacagcttctgggtgcagattttcttcggcatccttttgcactcagcttattacaggtaggtagtgcttaagaaaagtcatggaggactaaagcctaagtccttttcacttttcctccatctgaaggtaggtgagttcatcctcttcatggtaatgctgttttaccaagactttatagcagatggacccagaaagaattttctgctattgtgttcactacaacaggatagggacatcagacagccccagaaaccccttccagatctgatatgggactattaatttttatgctgttaattggtattcattcacaatgcagttgaagggggaaggctccactgcattctttggctaaggcctgaatgcttgctcatctgtaagatctatactcgaggttttgttttccttttaaaattctttagggagagagggatggtttctgaggggttctgaaagtatgattcaatgtgcaacatacaggtaggtcttcagcataagctgaaatatatgcatgtaaaaactttgacatctttttttttaattttccactttcttcttaactttacttctctttttgtcccccccccatcttacagaagttgaggccaagggagaatggtaggcacagaagaaacatggcaaactgctctgtgctttcaaaccaaagtgttccccccaaccccaaatttgtctaagcactggccagtctgttgtgggcattgttttctacaaccaaattctgggtttttttcttctttctttaaacatagaggtaccaccacaagggatgccctactctctcgcagctcttgaaagcatctgtttgagggaaaggtctctgggcaagcaagtggttatttggattgcttgcttccctttttccacctgggacattgtaatcataaaataacagtaaattccaaacctcaaaaactattatggcctgagcacagctgaaatctagcagagtttaactcttctgcctccatgtctgtcacttataattcaggttctgctgttggcttcagaacatgagcagaagaatcgttttatgctagttattgcattcatggttgaaactcaacttagggaaagggttccaatgtattaagcaatgggctgcttctccccaatcctccctaacaattcgttgtgtggacttctcatctaaaaggttagtggcttttgcttgggatcagtgctctctattgatgttcttgctggtctccagacacattcctgttgcattaagacttgaaagacttgtagatgtgtgatgttcaggcacaggatgctgaaagctatgttactattcttagtttgtaaattgtccttttgataccatcatcttgttttctttttgtaggtataaataaaaacactgttgacaataaggtgtgagcttttattgcttaattctctgaataattcaacgtagacgtcttaaaacagtttttgtttcaagacaaagatgggggatattggattgactgattactttcgcacctaaaactgaaaggaaaaaacttaatacaagaattggaattgaaaaccctagcaggatacctagtaggtaagggtttggatatatctgtatctgctcataagtaaaacagtgattgtgcaaatggtactcgcctaagtaccattaggttattggtattaaggtactaagtacaaggcaggtatcagccactggtttgaaaaaattcaaaccagtaaaagatgagtcacaaaactcctccagccaaacctggtaaatttggtttgctt

SEQ ID NO: 103686 - DNA, 4681 bp, Homo sapiens
aaagcgtgattctccccattccctgccccccccacaattttttttaactttggtttcccccaccccccttttattttcaaagtctcttcctgctcctaacaaacaggctttggtctgcagcaaggcctaggcatgactattcaaacagagggagaggagacagacagctgaatggctcagcttctctctggtggtggtttctggctggatagaataagcctgacgaaacctagctattgtaagctagtttcttcagttattcttttccctatccctgtctaagctagatatatacagagaggtccagttttatgaatgcttattagatggaattttataagtctaatgcagtatcagaatagcaaatatgtgtattgcccagtttaatttactgaggtcaaattatcatgggcacttggctatcccctcctacccatgcacttatctgtaggtgtgttatcaactgatgattttctggagtttttgacccattaccatttaagatatacagagaattttatggtagtttagcccactattctgagctaaacaggtctaactcagaacttctatattttaaaaaaaaagattatttgtattacaaggaaatccttaaattattgacaggtatttaatttgcccagtaaggtgagaagtaccatattattcccttatactatataatataaagagaacaggtattcaaactggaatacaaaagtaatgaagcctttttatgcattgcactcatcattccctccttcagaggtggtgacctgcagccatgatggaaagttctctctgcccctctgccctctgaggtcatgtctggatctgtgccattagaacttgggcctgttgggagaggaggcggaggcctgaaagcagtttacataaagctttcagtaatggttggtttttaaacaggcttgctatgtgctggtagcttctttgtgcatcttgcctagacaattaaaaatatttgctccatgtccccttgcatttctaaaccaaattaattggctaccattagaataacttagactcttcatcccacccccactcatccaagtgaggggagagggaaggtacccgagtctgtttcttgttactcaacatcagtgcttgttttgggcccctttgtttgctgccttgtaaaaaatcaaaagagggagaaaacccaccaaaatggcagaattctgaccaatgtcctacaagatcctggaaagtgaaggcttctacctcatagacaggggtgcaattttcagctgagtcaccagggccttttttcacttcctgtcaagcgatggtctcttaaatgttcccttcaggtaagttctttgattcccataattttataatagtcatccttaggctaccacttccctttccactgggatattttttatttttccttttttttgtttgaactacacactgttaaactaaaagtattgaatttattttgttttgttttttaacagaagctttgatatcagctgcagatcactcaatacatggccgagacaaatctacattggccggaagcagctctagatgagcctcttggctagacttagtccctccttattagtgattggcgattcaggccatgtcatagggcctttcagacaaaaggttcttatcccagtcagctggccaaaacattaactttggatttcttaccctgctacagcatcttctagaaaggcagcaagataatattgtggcagtgcacagataacatcagggtagacttgactggagaaaaccaaattctgcgcttgctcctgtgtgcccccatccagctgtgcatgcacacacaggacacctttctagtatgaagaacttgcatcatgtctgccctctattgagcacccccttctagaaatacttccaagtattagcatgtgaactgttgactccaccctggtgctttctgctaggaaagcacacttaacgcatccagtgtagtaattgaacttgttctactgccatggtcatatgcagtgggattgcataaggagcattatcctagctctgaagataccatggagtagaattccccaccccctgtcttacatccaccctggccctgtaaattcttttttcctttgttgcgtcaacgaccctagccggagactcaagctgccccctgtgataagtgccttctcgtctttctggtgtgattcaggactttaggggtcagtaaagaccgaggagcctttattgtaataagaaacagacataatgccccttcttcacaagccctgtaacaacagctaattttttttttttaatctcccctttctcccttgaaattaatccagtctgggcaatagatgcagtctgaccctttggatgtaacttacatttttttttattaattatttttttctacaatcaccccaattatccttgggggaggcgttggaggacctgaaatttttacccgaacccaggttctccggcgcttggcaaccaaatggggctacagagaagcatctaagccagttcacagagcgagcgtgtgtggggacttctcactgccacggacccttgatgcatgctccccgcgctccagtggtcccgtgtcagaaggcggagttttcgaaaggaggccgccaaaaataaaaggcaaagagacgggatcggctgcagcggtttcccaaaggaggagggagtgtgcatcggtctggtaacaaacagagaatgttttttaattatttatatcacaaaaatctgtgttttatctaggatattttctgaatattctttgtaaaatgcagatttttttccacaaaacagtaggattctttgttatattcttaaaattgtttgtttaagtaggtaaaaatatacattcagctgaaagcattacactaacatttacattttaagccttaggaggttattcagcccaattcccagcagtagagagaatactaaacttgtgtctcaaggtttcatggttttcccacgttctttggctattaatttaatttcccaggtcacgtagacaatcattgataattgaaacaagtcctgagttgaaataaccttgagttgagcaaaaatatcctcattttggcagaagctgggcttggtagtacagtaaaattttagtgtaatgtgctcttgtaattgaaaggggatagataatctggatgtttctgcaaaggaaaataggtgtgtacttaacagctttggctctactcagtttcttaaaaagataagagcaaaaaaagttaaatgttaatcaaaacatttaagtttcctttaaattgtagtaataaaatatatgaagctcctttttttactttgctctgtgactggtttaaaggtaagtttgttatgttgttggtagattttgccaggcttctcccaacagagtagaagtgatttggcctcataacttcacagtggtttaccactttgttctatgttctggttttgtaaaggatagtactggaatttgcgtctgaagaccaatattggtgtaactcctgtcagtatattggtaaaatgtagcagaggcaggagtttggatgtttggatgggattcccttaggattctacagccaataaagatcctatttcctatgcatgtcccaggaatcagtaatcctcttttactctgttgggatgagtctttttttgtttctgttcagagtggttactaacttcaccttctttcctcttgctgtcatctgcattcgtgcttcccacctgttgttggcatgtcctttaccttctctttccctgccacatcaacctacacactgactcatcattgacgtggaagatgtggaagatgtcaagtttgtgatcaactatgactatccaaacagctcagaggattatgtgcaccgtattggccgaacagcccgtagcaccaacaagggtaccgcctataccttcttcaccccagggaacctaaaacaggccagagagcttatcaaagtgctggaagaggccaatcaggctatcaatccaaaactgatgcagcttgtggaccacagaggaggcggcggaggcgggggtaagggtaagtcctggagttttccaggtactgccaaggtatctctttacgccttctgtgacttgcttttagttgctgtttttaagaaggctgtaagtatgttgcttaatagcaaaggacactgcctaatgctttttataacctttttcaactaagaaaacgtgaagtttgttgtgatagtcctattagttaagctaaattgtgaatttttttttcttagagactggtctgaggtttggttttgtttgtttgtttgttttgagacggagtcttgctctgtcgcccaggctgaagtgcaatggcgcgatctcagctcattgcaacctctgcctcccaggttcaagtgattctcctgcctcagcctcccaagtagctgggattacaggcacccgccagcacaccctgctaatttttgtatttttagtagaggtggagtttcaccatgttggcctggctggtctcgaactcctgacctctggtgatccacctgtcttggcctcccaaagtgctgagattacaggagtgagccaccaaacctagctgaggctggtctgtggagtttcaccatgttggcctggctggtctcgaactcctgacctctggtgatccacctgtcttggcctcccaaagtgctgagat

SEQ ID NO: 103687 - DNA, 1024 bp, Homo sapiens
acctgactcagtactctaatagttattaaaaattttaaaagcgtaatgtgcaaagaaagtactgtagccttgggagttgatattgcagacataatcgtccacataataactttctgtgtgatgactgcattgttggtcatgttttcaggttgatccaactaatggaagaaataatggctgaaaaggaaaacaaaacaataatatttgtggagacaaagagacgctgtgatgatctgactcgaaggatgcgcagagatgggtgagtatagcaccaaggcaattaacctctggttttatagttaactggaaatttctaaattggtattccaaatgttgtgtaatatttcaataatgcctatccatgcagtttgctcttttaatgagcacagtcatctattcatgaagcctgacaaaccttacaaaaattgcatgatagcatttggctttaaagttcgattttctccactttaaaagatttttaaaatattggtcacttttcttctgatagttggccagctatgtgtatccatggagacaagagtcaaccagaaagagattgggtacttaatggtaagtttaaaactaagcattttctgttgattccccaccccctgcccataagtgaatgttcatgctctatttcagggataggcaaactttctgtaaagggccacatagtaagtatgcttggctttgtaaaccaaatggtggtctctgttatagccactcagcactgctgttttaggacaaaagctgtaggctgtagataatatgtaaagaagtggcctggactgggcaccgttggtggctcatgcctataatcctaacactttgggaggctgaggcgcgtggatcacctaggcccaggagttcaagaccggtctgggcaacatagtgaaatcctgtctctaaaagaaaaacaaaacaaaacaaaacttagccaagcttggtggtgcacgcctgtaaccccagcgactccggagattgaggtgggaggattgcttgagtctaggagacaggttgg

SEQ ID NO: 103688 - DNA, 1717 bp, Homo sapiens
atcattccaaatgctaaacatgaagttctaataatttttttctatattccattgtgctaatattccccacttctgatcttcaccccatcacttttaatgtgctagattagacagcaaagaattaaattagctttttgtattttgtttcttcttttttttttttttttttttaaaccttggatgaggtctcaagtgtctttttgttggtttcagtgtctagttctggctcctaccagagagcttgcccagcaagtacagcaggtggccgatgactatggcaaatgttctagattgaagagtacttgtatttatggaggtgctcctaaaggtccccagattcgagacttggaaagaggtaataatatatagtgtaaaagaattgttagtttatcttactttaccaattcctgtggaggaaattggagaaaaaaagtgggttcttgtgataaactcagaatttcagcagcttagaaattctcagatgtgactaaaacagctattttgagagagaaggttcagcatggctggaaactttgtgaggatttggtgattgtacataagtcctgacatggttttgcggttactttgttaaaatttagcttctctgggccagtgcggtggctcatgcctgtaatcccagcactttgggaggccgaggtgggcggatcacgaggtccagagattgggaccatcctggctaacatggtgaaaccccgtctctactaaaaatacgaaaaattagccaggcgtggtggcaggtgcctgcagtcccagctactggggaggctgaggcaggagaatggcgtgaacctgggagtcggagcttgcagtgagccgagatcgtgccactgcattccagtctgggtgacagagcaagactccatctcaaaaaaaaaaaaaaaaatagcttctctgcagcattgagtacagccaccagggctgctgctgctgcatttttgtagagtcggggtcttgctatgttgaccaggctggttgtgaactggcctcaagcgatcttcccgcctcctcttcccaaagtgctagaacacagctgtgagccactgcacctagtcgattggctcgatcattggttttgttttacaggtgttgagatctgcatagccactcctggacgtctgatagatttcctggagtcaggaaagacaaatcttcgccgatgtacttaccttgtattggacgaagctgacagaatgcttgatatggggtttgaaccccagatccgtaaaattgttgaccaaatcagggtgtgtaaagctaataataagcagtctttatgccatttgtccaagttccttagcctgaaagaaagcctttccttttttgatagcctgataggcagacactgatgtggagtgcaacctggccaaaagaagtaagacagcttgcagaggatttccttcgtgattacacccagatcaacgtaggcaatctggagttgagtgccaaccacaacatcctccagatagtggatgtctgcatggaaagtgaaaaagaccacaagtatgaaagatattttactctgatttgataatgctgataaaccttttctaataaccctccaaaattagtactgtagaaaccagtatattttgaggcctgagaacattaaaagcattgctaggtttctgataatccatcatcatatcatttgtcagagcattatggttaaatgcaaggattctgaattcttgagttt

SEQ ID NO: 103689 - DNA, 1358 bp, Homo sapiens
gactattgtagcagcttttgtttgtttgtttttggaaacggagtctcaacgttgtcacccaggctgaagtgcagtggcgcgatctcagctcactacctcctctgcctcctgggttcatgcgattctgcttcaccctcccgagtagctggaattacaagggcccaccaccactctggctaatttttgtatttttagtagagacagggttcaccatgttgaccaggctggtctggaactcctggcctccactggcctcagcctcccaaagtgatgggattacaggcgtgagccacctagcctggcccttagaagctaacagtgagttggtcggagatctagtagataaagaaaaagcactttggagagatgaagctgggtaaatcttatcttcagtgagcttaaaagtttttttaaaaactcttggtttgtgtctttaaacacaataaaatacgcaaaataaaattctcttacagaatatgtaatggatgtgttgatggatcagcactttacagaaccaactccaattcagtgccagggatttccgttggctcttagtggccgggatatggtgggcattgctcagactggctctgggaagacgttggcggtatgtatgagcaagagaagatccttgatattgtggtaacttattttgctattctagttgtcatacgttctcagttcttcgtagaagtgccattcagatagttagatactattttagttattaaatatatggaagcattttatgttcaaatttgtattgcttcctgtatatagcagtggtaagttctgtttttcactttcctatttatgcattaattcagtaattactaagtatctaagtaagattgtacttctaagcgtaaggttgtcattctttcccccctccacagtatctcctgcctgcaattgttcatattaaccaccagccatacttggaaaggggagatggcccaatcgtaagtgtgtttcagtttctttgtaattctaagaaaaactacaatttagcgactatttaggcttggtgctttacattatccatttgtactcttaaccacaccctccataggtggaaatggtttcattctcatcttacttggaattaaatgacttacccaagatcactcagcaattgaatagctgagcttacatttgaaccaaagtcttactcttaaagaaaccatgcatgctgtatgggcatttactgtgcagtaaatcaagtgttttctggttttggtgtggttttttttgtttttttgttttgattttttgtgtttttttgagatggaggttcgctccgtgttggtcaggctggtctcaaactcctgacctgaggtgatcagcccaccttgccc

SEQ ID NO: 103690 - DNA, 3034 bp, Homo sapiens
aattactgaccggataaaaacatttgagcagcatagtataccagagagtacagtgtgcgtatttaaagatggcatggatatgctcaaaagtaaaaggctttcttgaattttgaggtcattaattatgtcagcattaattataaacatggaagacggcatattttccaagaaccacatgtttcaaattaaatgtttagtgtagaatagaatgtcttgaataaatagccagggaagtaaggagagaggaaaaaaaaatacatgaatgataatcatcagtttaaagccttaacaggaatcttactttcaagttttattttttcctaagtcactaaggtttgggtagcattgcaatgtggcaataacaatgaagtcttttataatttgcaagagtgataatccaaagactttctacctcttgaaaagtaccttatttagctgcttcatttgcaagtgtggcgggagcggcaattgaggtggccttttggtctgttcagtattgagtcttaagctgaggggcatattaaatatgtcgctgacacgggtatccctatgctatgtgctcttcctgttctgattcttaatttgtcttcactgtctcagtagtggtataaatggaattagccaagttctgcctgttgagtgtaggtatccagtgatcccaataaaatctcctgccatcaatttttgttacgtatgtatttagaggaatgtctggctggttaagccagagttctaatggctttgaattgcaggaaattgaggccctgtagaataatacacctacttgcctatcaatgataaagtggaactttatataagatgaagttacaagtgggttagagtgggaaaagggaactaaattcagtacaatattttacaaggagtaaagaaactgagaaaatgctatacagtttgtatgccaaacaaagacctgtactttacaagatcgaaatagggaaaattaaggccatcttagtgttaagattcttctaggaaaagtagcttctgatttcttaaatattagctttggctagtggtcatatttgtattcctcttgagcttgtctgttgtgaaaggtatataaaaagcaagaagttgatcttaagtaattagttgagtgttaaagccttaaataagtcttgttagtgtttttttctctgtaaattaataataccatttgggaacaagaaggagatagaaggtaaaagtagagatcaaagaagaaggaaaggtcataaatctatgttcagctttttttttttttttttgacggaccctccctctgtctaccaggctggagtgctatggtgccatttcagctcactgcaacctccgccttccgagttccagcggttctcctgcctcagcctcccaagtagctagggattacaggcgtgcaccaccacgcctggctactcttttgtgtttttagtaagagacagggtttcactatattggccaggctggtctcaaactcctgacctcaagtgatccactggcctccgcctcccaaagtgctgggattacaggactgagccactgcccccggcaggctcagctcttttattagcgtaagctaaaaatgaagaccagtctaccagtcctttccaagacccagttttgctttgcagataagcagacaggtggagtgcttatcacagtttaataggggagcaggcccaagaagctattctaagattgagggacttgcttggagtgtatcttccttcttgtccacaatcttccctttaattgaaacttaacttaatgtcatcctttgcctgcatgtctgttacacaaaaatagagacttgtgtctgttttgtttagtaactccagcacagcaccacttcaaacagtagccgatacatacttggtacctagtaacttggtacctaataactatttgttgaatgaaatgatgctaacttgtactgagtgctggctatgccagatacttttatagtacattacacattattaggtcattttctcagcagcctctgaaataagtggtattatttctactttgcataggaaactaaggtgtgtggaagttaaataattctcttcaaattatacagtaagtggcagaataaaaactcaaaccatgtctggatccagaatctgtgattgtaatccctaggatgtatttctctcaataaagggatttttaattttttgcctattgtagctatattcataaacagtatttattgttgggtagtaagggaggttttacacatttctccatacctttaaatcacagcaaataaaatggtctttttggaggtaggctggtagtatccctagaactccatcctttttgaatattcttatggcatgtacgatacgttgctttaaaaatactgatgaactaactaaaaattctgttcctagatttggagcaagaggtggtggtggccttcccccgaagaaatttggtaatcctggggagcgtttgcgtaaaaaaaagtgggatttgagtgagctccccaagtttgagaaaaatttttatgtggaacatccggaagtagcaaggctgacaccagtaagtttacatgtgtgttttaatgtacagattattgaaccaagtagatatattggttagagtttattcatacgctactgttgccgttttacattttattctagtgtggtgatatttttcttaaaaaattttttggttaatttttttttttttttcctttttgtagagaccgggtttcgccatattccccaggctggtcttgaactccctagctcaagcaaactacctgcctcagcttttcaaagtgctaggattacaggcgtgagccactgcacccagctgatttttttttttttttttttttttttttttgagacggagttttgctcttgttgcccaggctagagtgcaatggtgtgatcttggctcactgcaacctccgcctcctgggttcaagcgattctactgcctcagcctcccaggtagctgggatcacaggcacccgccaccatgcccggctaattttttgtatttttagcagaga

SEQ ID NO: 103691 - DNA, 1096 bp, Homo sapiens
atatggaggacggttattgtctctgcaaagcaacttcttcaagccggccgcggggtctgtaccgagatcggaatcaggcaaaatcctctattctctaaacagaatgcgttacgcatactgcgcatcttagcaacagcaggccggctaacgacgcaaagaatgttacgtcgcaccagaggcgcttcctcccacctcatcccacgttctagttcgggtggcgcgagaactctacgctcgctccgtactttgtttttcttgtacagaccgcaaaatacacccatcgtcgcaactgacgtaaagtgcttccaagaatacccgtagttccccgcggagccctcgggctattccgaggcgctgtttacgtatcgtctccgccgtacgcagcgttaagttggagccgactcagcggcggccgccattttgtgcagtcgctgggaaggaaggagacgcctaaaccgcggcactgcccggtttgagcgtagccaaacctgcccaccggctttgtagccccgattctctgtgttttgctcccgtctccgacgagagaggcggcgacggtggcgtctgcgacgggagacagcgcgtcggagcgagagagcgctgcgcctgccgccgccccaacagcggaggcgccgccgccatcggtcgtcaccagaccggagccgcaggccctcccgagcccggccatccgtgccccgctcccagatctctatccttttgggaccatgcgcggaggaggctttggggaccgggaccgggatcgtgaccgtggagggtaagggtgggggaggagaggagaggcctggcgtgggggtgggggagttgcttcttggggaggcccggcggactgcgagcctgggagccttgctctcgacccgggaggcgaggggaggcgactcgaggcgagacagcggtttcgtgcgcggacctcggccccggggtcactcgggacccgaggagggcggccgcttggcgacgctgggcctctccgtgcggacggccgtcgtggcgcggcccggccccatcccagccccgcgggggatcgggaggggcggcctggccgcatcagcccaggcccgggctttggcgcctcgcc

SEQ ID NO: 103692 - DNA, 1390 bp, Homo sapiens
gtggtggcccacgcctgtaatcccagcactttgggaggctgaggtgggcagatcatgaggtcaggagttcgagaccagcctgattaacatagtgaaaccccgtctctactaaaaatacaaaaattagccgggcgtggtggcatgtacctgtaatctactactagctactcaggaagctaagctaggagaatcgcttgaacccgggaggtggagattgcaatgagccgcgatcacggcattgcactccagcctgggcaacagagcaagactccgtctcaaaaaaaaaaaatccataaatttgacacaaaatcctgaacaccttagtggaacaaacaaaatttgtttgttttcctttcttttaaacctatggattatatcaaacaaacaaaatttgaattggcttgatagtctcctggagttaaggctgctatgtcacagcctattttgatataacttcttagtttattaatcatttgttagacttttttatccccataatatctttctttttctttttttttcttttattttatgtattttattttatttttgagacaaggtcttgctctgtcacccaggctggagtgactggagtgtagtggcacaatgaacactcaccgcagcctcaacttcctggacttgagagatcttcctgcgtcagcctcctgagtagccaggactccaggcatgcaccgccatgcccagataattgttgtatttttgtagagatggggttttaccatgttgtccagactggtcttgaactcctgggctcaagggatctacctgccgcagcctcccaaagggctgggattacaggtgtgagccactctgcccagcctcattcctatatgttttctttgcccttttgcaaatgctataatttatttccccatttgggtgattcaaaatcatctccttttggaaataatgttcttaacattcaggctcttcacctacagtaatgacaagcaattgtctctattcttttttgcacattgggtaccacactagtaacagcaaacaatagtttgctaagaaaaaaaaatcatggctatacatctagaagctctagcttcccagtcttgtttaggttatctataatggcatgggaggcatggtgcttcaactgggggaatctatcttcttttatatttgcctctgtcagaacactcttcaaaagttccctgaattacagttttgaagatatgacacaaatctgtgtccaagaaggacctagaccagggagtcccaaattgtcatctctgtattcattctgcaatatttatggagtaccctgtatattataggcacttttccaggcgctggagtttcaaagatgaacagatatttagagtatagttggggaataagacccatacatttaaaa

SEQ ID NO: 103693 - DNA, 1033 bp, Homo sapiens
gatgtcaccttctttttgtttgtttgttgtcacccaggctggagtgcaatggcatgatcttggctcactgcaacctccgcctcccaggttcaagagattctcctgcctcagcctcctgagtaactgggattacaggagcatgccaccacacctggctaatttttgtatttttagtagagacagggtttcaccatgttggccaggctggtcttgaactcctgacctcgggcgatccgcccacctcagcctcccaaagtgctgggattacaggtgtgagccaccacacccgtcctaaggatgtcaccttctgatccaacatcattagcataaattaagaggcaatatgattagagaaaaaacattaaaccagggtcactagcatagtgaccttgtacaagtgatttaaactatttgaactgcattttcctccctctcaaaattaatttatgtttattgattacttaccatgtgccaggtgcttttatgcatcatcttatctaattctcatgtgaccccaatgtaactcacagcctccttggacctccctgttgcttttgtgaagccaatctcagtaagttgttgaatccctccccatctcacctccccccgcaaaaaagaacccagaattccatctttaaaatgttgaaaaaagtgtatatttttctgcatattttgggagaagacagaggggagaattacttaacaaaacttcttaaacatacccttttttttttaaccacctcttctctttcctcaaaattcttctttggcggtactcccctttcccccatcttcccaaaatctcaaagcctcccctgccaggcatggctcacaactgtaatcccagcactttgggaggctgaggcaggtggatcacctgaggtcaggagttcgagaccagcctggccaacatggcaaaactgcatctttattaaaaatacaaaaattagccaggtgtggtggggggttcctgtaatcccagctacttgggaggctgaggcagggagaattgcttgaacccaggaggctgagg

SEQ ID NO: 103694 - DNA, 1020 bp, Homo sapiens
tgcccaggctggagtgcagtggtgcgatctcggctcactgcaacctccgcctcccaggttcaagcaattcttcctccttagcctcctgagtagctggaattacaggcacctgccatcacaccaggccaattttttgtatatttagtagagacggggtttcaccatgttggccaggctggtctcgagctcctgacctcgtgatctgtccgcctcagcctcccaaagtgctgggattacaggcatgagccgctgagcccggctttacaactctttttaaaccaaaaatatttattctaaccttaataataataataacaaataatttctgttgtcaatgaaaaataggaatatgatgttatttataaaataaattcatgatgcaatatgtctaaactctgaaatctaaacaatgaacttttaaatatctatattgcctttctcatagttttaaaattttatctcttgatgcagaatataacgtggctgtttttgtgaccaatcaaatgactgccgatccaggagcaactatgacgtaagccccaatattctactttttatttcacagaggttaatataaagagggttagagcgtagaatagaaaataatttcaaggccgggcacggtggctcacgcctgtaattccagcactttagcaggctgaggcaggcggatcacgaggtcaggagatggagaccagcctgactaacatagtgaaaccccgtctctactaaaaatacagagattagccgggtgtggtggcgcacacctgtaatctcagctactccggaggctgaggcagaagaatcacttgaacctgggaggtggaggttgtagtaagccgagatcgcgccattgtactcctgtctgggaaacagagcaagattctatctcaaaaagaaaaaagaaaaaagaaaagaatttaaaaatcattagtctttatgtgggcacaaatatatcacaaatcactttattactgggcgcagtggctcatgcctgtaatcccaacactttgggaggcc

SEQ ID NO: 103695 - DNA, 1050 bp, Homo sapiens
taggcatggtggctcatgcctgtaatcctatcactttgggaggccgaggcaggcatatcacttgaggtcagtagtttgaaaccagcctggccaacatggtgaaaccccgtctccactaaaaatacaaaaattagctaggtatgatggctcgcgcctgtaatcacagctactcaggagactgaaggaggagaaaacaaaaaaaaagctaacaactcctttagaagaaagtagattttaaactgtatatactttccaggtaagatttgaaaagaaaaagaaaacctatgccaacaaaaaacctttggtcgatatttctcttctgggcccttgaagttacctttttgaccctttggttcatgtagtcaaatttatcatttaacaacatgtgattaataatataataaactatttcatattgaggaatgaggggtatgaagagagtgaattaattcactttgcagttattgaattataattcagtgatattatctattacaggtctatttttatagatctgagaacaaaaggactcacaaagcttagttcctagtttttctcttgtaactgatttgctgcataagctcaagtcatttgcctaatctctgtttgccagtgtcttacgttgtaaaatgtaaaacaggccataaaaactagcttccaaggttattgtaaagttttgataatttaatagttaaagtcattactgcctcacatttctatgaccattatcactacctatggtaagttgaggcacttatgaataaacaaatcttgtatagactttaaatggttgctagcatcctctagaataccttcacaggtacattgtttggcttctctgttaatttacggaagatattatgttttgtagtggttgtctaaacttttttagaattgacttattggatccttaatcttggcatactccagccgtccagatcgccttagggacattgctgatcgctttaatgtagaccatgatgcagtactggacaacgtactttatgcacgtgcatatactagtaagagccccatgcagttggatgcttg

SEQ ID NO: 103696 - DNA, 1021 bp, Homo sapiens
gctataaatcccagctacttggaaggctgaggcaggaggcttatttgaggccaggagttcatgattagcctgggcaacatagcaagactctgtctctaccaaaagaaaaaaaatctaaaaacattgtacatcagcagttatttagatttaactataaagatttttgttttctttgttcattatggtttcttgcatcccagatgttattttttcctgtatttttgttttgctgtaatacttatttctttcagaaatgtaatacaggtggtaaactttgaaccttagtatgtctgaaagtgcctttattttgctctcactcttggctgttaatttgtctggtcacagagaactttgcatggtatatttctatcttcttgggtatttgctccttccatccccatctcacagtctttctgaatcatacaaatcatttaaggctctcatttcaaggcctgctttttctaatcttccctaattactcaatttagaaaatcttgtccttcttgacctattatagaatttactatctaaaatactcacttagaaaacaaaacagagaactgtttgcagaagtcccttttcagaaatgccaggcataagaagtctctgaaagagccttttaacttggggaaggagggtgaaatgtcgtacagggctttaacaagggtgctcagctggagttcagctggtttcagaaacaattgattaaggatgattcttatctcagagagggaagaattgttcttgcagagtagcagccactgtttgggcaatttggagtttttttttttcgagatggagtttcactcttgttgcccaggctggagtgcaatggtgcgatctcggctcactacaacctccatctcccaggttcaagcgattctcctcctcagcctcccgagtagctgcgattacaggtgcatgccaccacacccggctaattttgtatttttagtagagacagggtttctccatgttggtcgggctggtctcgaactcccgacctcaggtgatccaccca

SEQ ID NO: 103697 - DNA, 1297 bp, Homo sapiens
cctcaagtgatccacccacctcagcctcccaaagtgttggaattataggcgtgagccatcacgcctggcctaatttttttcttcttttgagacaggttcttgctctgttgcccaggctggagtgcagtggcccaattacactcactgcagactcgaactcccagggtcaagtgatcctcccacttcagccttctgagtagctggaactacaggcacataccaccacgcctggctaattttttttatcttttgtagagaccaggtttcaccacgttgcccaggctgatctccaactcctgggctcaagcgatctgcctgccttggcctcccaaaggactgggattacaggcatgagccattgcacccagccatcattttaatgtattgaatatgatgtacatgaggatatccagatggcactgggaaatattgaattcagcttgagaaaggggtaggcccagaaatatggacgaattaaccaagggggaaagagaacttatagagagagaagagaggagaattgagaacataactttgaggtatgtttatatttaggaagaggactaaaatgagaaacccagagacagaggaagtagaaggaaatctggttgtaaaagtcaagcaaaaggaaagtttcaagacgatgagttgtcagcaatgttacacacacacggattttgaggatacagcctgagaaagatcattataagttcaaaattaggagttcaagcgaacatttgccatagggtgaggtgatagaagctttatgtaaacaaacaacaagggagggaggcagtatgaaattgaccaatgaaaggaagaaggctaggcaccgtggctcacgcctgtaatcccagcactttgggaggctgaggcgggtggattacctgaggtcaggagttcgagaccagcctgaccaacatggagaaaccctgtctctactaaaaatacaaaattagccgggcgtggcggcacatgcctgtatttccagctactcaggaggcttaggcaggagaatcgcttgaactgggaggcggaggttgcggtgagccgagatcgtgccattgcactccagcctgggcaacaagagggaaactccgtctcaaaaaaaaaaacaaaaacaaataggaagaaaaaatatactagtttgaggaggtattcagaggaaattctttttaataacaaagaagacctatgcacatttgtaaggctgttcacagtgaagccccagcctgcctctccaagctcagtactcaccattgccactattagaggcaaagagatgaatctgttttag

SEQ ID NO: 103698 - DNA, 1790 bp, Homo sapiens
gaggctgagtcaggagaatcgcttgaacccgggaggtgaaggttgcagtgagctgagatcgtgccactgcactccagcctgagtgagagcaagactctgtctcaaaaaaaaaataaaaaataacatccgagatactttataagtaagatttgccagttggaaaagaaaaagaaaacagtaatattctaaagccatgttttattctttatgaaaatatctggaaattatgcatttttaaaatcatttttttctgtatttcacagaatttcgtactggaaaaacccagctttctcataccctctgtggtaaggatatataacaacaataacaataataatcatggctattacttatcaaacatctactatgtgcctgatactctaaataatctcatatctgaacatacttgcaaggaaactaaaacacaggcagattaagtaaactgcccgtggttatacagctggtctttgaatgtgtgatccttgaggtgatgtatgtgctgcactatgaacacctgagtagaaatagagagaagttgaatgggtgtatgaatgtgttggtgaggagtccactgtctcagtttttcccattccatcttttctatatcttttttagaagagtgacacaaaatctattgagtcctagaatctttcactttccatggcataaaattggccctaagagagacttaaaaacaaaattgttttaaacaaaataacgaaagatatctccttttccacaaatacactactgtgcatttctttgagctatggagaaggaacttggcaaagtggttaagaaaggagttctggccgggcccggtggctcacgcctgtaatcccagcactttgggaggccgaggcgggcggatcacaaggtcaggagatccagaccatcctggctaacacggtgaaacccggtctctactaaaaatacaaaaaaattagccgggcatggtggcgggcgcctgtagtcccagctgctggggaggctgaggcaggagaatggcgtgaacccgggaggcggagcttgcagtgagccgatatcgcgccactgcactccagcctgggcaacagagcaagactcgtctcaaaaaaaaaaaaaaaaaaaaaaagaaaggagttctggaatcaaaatgccggacttcaatcctggttctatcgttagtagctgtgtgaccttgggcaagttgctctacttctctaatttcccccaccaataaaattgaaataatgacagtgccaaatgttaggattgttttgaaaagtaaatgaaataatgtatgtacctggtataaagtagctccttagtgttaactactactacataaaaagtaattgcagtctagcgtggtggctcacacctgtaatcccagcactttgggaggccaaggcaggaggatctcctgaagtcaggagtttgagaccagcctggtaaacatggtgaaaccctgtctctactaaaaaatacaaaagttagctgggcctggttgaacatgcctgtaatcccagctactggggaggctgaggtcagagaatcacttgaacccgggaggcagaggttgccgtgggccgagatcgtgccactgtactccagcctgggcgacaaagtgagacctgtctcgaaaaaaaaagtaaatgcatttttaaaatttgacatacattaatttaaaggtaacatattagttatatagcataaattatatttgtgactttttttttttgagacggagtctcgctgtgtcacccaggttagagtgcagtggcgcgatctcagctcactgcaacctc

SEQ ID NO: 103699 - DNA, 1046 bp, Homo sapiens
cccagctactcgtgaggctgaggcaggagaatctcttgaacctggtaggcggaggctgcagtgagccaagatcacgccactgcattccagcctgggcgacagagcaagactccatctcgaaaaaaaaaaaataataataataataattaagacgatctgtaactccaattcaattctaaagactagtaagacataaggccttgctaacccatttactatttttttaagttttttcttaaaataatttattattattattttttaagcctacagcatgcagtattcccaggttccatttactattgaagtaagaacgatagggcttatcatttgttttgctgatccacttgcccatacacaatagaacctgtgatctagcaagtggcatgctatttgttcagccaagaattgctgttcatgttctgtagatagataggtagatgatagaatagatagatagatacatagataggaaggatactaatgatatgaatactttctcctctcttaatatttctatttctattcctgttactaatgctttctttctatttccagtaagttactaggaggtggaattgaaagtatggcaattacagaagcttttggaggtaggtagaaccttaatattttgttaaatgaaatattatacacacacacatacacatctatgtgtatacatacacatataattaaataaacaaccaataataaattgtaagtattttggaacttacaaaatctcaattatcataacatgagatcattctgtactgcaacgaaaatatatatgaacattaacagatgggtcttatcaacacttttcatcttttatttgtgattcctatagaagataatagatttttttttttttttttgagacggagtctcgctgtgtcacccaggtccaggctggagtgcagtggcgcaatctcggcttcctgcaagctctgcctcccgggttcacgccattctcctgcctcagcctcccgagtagctgggactacaggcgcctgccaccactcccagctaatttttttgtattt

SEQ ID NO: 103700 - DNA, 1018 bp, Homo sapiens
caatgttttttctttttcttttttgagacagaatcttgttctgtcacctgacacagggctaattttttattttttgtatggctggggtcttgctatgttgcccaggctggtctcaaactcctgaggctcaagagatctgcccaccttggccttccaaagtgctgggattatagacatgagccatcatgcccggcttcagtttttaatatactgaaaaacatatgaaaaacaggtattaggaaaatccagtgattgtcattatggtcaggttatctcacataaaccaaatattatggaggacatgtcagaatagtaaatgtcaaagatgttgtaggtaatgctagcagttagaagagtaactgtcagattctgacagcatacatttaattggtagcccaatgttgtagtgcatttaaagctctgaataagaaaaggcctaaatttaagtcatgatctcattcattcattaaatgcaacacatattaattgtgttaattgtgctaagacctggtaggggcactttaaaaaccttgtatgtagtctattaacatgattttttgggatgtgatcacaggtcagacaaaaatttaagatatatagataatccaatacatttacatttacatagtttaagagagcaatttaaatgtaaattgaaacaatgttggaagttatccacaaatttagtgagggctgcagacttcaataaggaaaagaaaaatctagatagtgtacctgcacaacttaaatctaaaggacatgggctaagcgatcaacccatttggagggaatacacttggaaatcttataggcccagcaactatttttttcttcaacttttattttaaattcaggggtacatgtgccagatatgcaggtttgttacataggtaaacgtgtgccatggtggttgggctagcaactattaaagaaagctttatttgtccctcttcttcctgagaaaaattaccctggaaagctatacctctggaaaatcccagacaaaattcctggttga

SEQ ID NO: 103701 - DNA, 1026 bp, Homo sapiens
aagggcagctctaaagcctgtgttcctaaccataatcttgtactgccttcaaggacaagtgaactgtagcttataccaaatgatgatcttaataactgagtatatcattttgggcaacatttgaaaatacaaccatgatctttaaactctttttgaacatttccttttatctttctgtaggaaccaggattcttgactgcatttgagtatagtgaaaagaggaaaatggttttccatatcaccaccgggagccaggaatttgagtatgtatcttacttttttataatcactaagcataatctttggaataccatgtttcttttcctctttctggttacttctactataagtagtagaagtagcttcttcatttgaagtttgggtttgtttgtttttttttctaaatgataactgaaacaaattctagactgcttggaggagcaagattaaatgtcttacaagaaattcagacccaaaatctagtttctgaatcagccaatattaatctcaaaccacttttaaaaatcagtttaacttttcatttactttccttctccatatgaaggatgtttcattgcacattttgggtttactcaaaaagcaattgttagattaaatatttcagaaatattgcagttatttttgctcttctgcaggagaagttttaacatccctttttatttactcttttatgatccccaagacatatcatcatcttctcaatgcaagtttactaaaatgtgggttttttctccctaccttactagaaagaattagtgtttcatgtgttacagcagtgcccaagagcatttagaacaaaagcagtatttcctctaagtatttctcaaaatgctggcctcacaagatacattaagaaaaaaaggatttcatagtcaaatatacctccacttgaacgtctaattgatagctcagacttcacaggtccaaaaatcaaacttctgacctttgccccaaatctgcttctcccaaagtctccctcatcttagatctatctctttcctgatc

SEQ ID NO: 103702 - DNA, 1049 bp, Homo sapiens
gttcttggctttgcccaaaggtgagccagtggtgttggacagcaacttttgttgaagcagcccagtacagtgcagcagaggtactgctccttgcagagcagggctacctcataggcagtatgcccagaagtagcagctcagaggcagttttgccattatagttatacccacttttaattacgtgcaaattaaggggcagtttatgcataaatttctagaaaaagtggtaatttctgggtcattgggtcattgcaatggaaaggggcagtaacttccaggtgttgccatagcaatggtaaactgacatggcacattggtgggccatgtcttatggaaagttgcttctgccctggaccctgttttagctagttctcaatttggtctggtgtctgagccccacctctggagtcaaatcccctctcctaccttactactttctagcagggcccactgactgtgaggggcctttgcaactgccaggctgccagacaaaagcctatatacctttgacccaagcttttatgtagagcttttgggaatcactagaggtaccagctcttgaaataggaaagcaaagaaaggtagtcactaagtcttcctcttcatttaatagcaggcctctccatttctctattggtatgtgagggtctcattcccagtgagtctgagaagctctcttcaccaacggccatttggtttccttcttcagaggcagccaaggcaggagagtgatgcaagtggcagtgtgatcctgaacttggaggggactcaaccgaactgaatcactctgaacccagctcagttgctctagcttctgagtacactcaggcagtgtacccacaagtcaattccacaactgccagggtgttgaagaaagccctggagcagtactcagggtttgggaaactgctctatgacattagagttgttttctttggaaattaaatcttattaccaaagaaaagaacctctctctttctcaagcacccactactgcaccaagaatcttctcctttcttagcttaaactgtttattcttttttatttgt

SEQ ID NO: 103703 - DNA, 1106 bp, Homo sapiens
aatctctttcagtggttttagaaaatagaagcaagagaaaatcctggtcctttggtgatgtagttatttgcattctccaggggcagaggaaaaaaaaaatctttacaaatttaaaagaacatgttggtaatgaagttctgtagaaggaaggagctgaactgagggggtgaatgtgtgataaatttgttagcttttccaccaacaggcttttcttttgaattccttgttacattgccatggtctcactaacattcttgggaaatcagggcacagtcagaacatttggcagcctgctgagtatgttctactcagatatttccagaacatttggctacatggtgggtgggttccacctggcagcttgtataaaattggcatcatggtggaaggagatggacacagaaacacatgacatagtatgggagccttgcaggctggcatcttatcagtctgctgtgcccattctttaatttacagaacgtggctgacattaagaaactgaaatcagtaggaatctgtaccatcaaaggtatacagatgacaacaagaagagctctatgcaatgtcaaaggactctcagaagccaaagtagacaagattaaagaggcagcgaacaaactaattgtaagcaaaatccattctttgctgttttagcttggcagggccttgtgaatctttataggctttctcatgaaaactagaaattattgtgggaactgagttcctgtagatcacagtatattatactccccatgttaactttttatcacttcagtttcaaagcaacagcaattgatttctgaaagatgaaggtagggattaagagacctggaacactaatgaaggtaattatttttgccaaaactttttgtctctctttatattactttttctggctgtctctgcctttccttctcctttccttttttttttttttttctgagacagagtcttgctctgtcgccaggccagagtgcagtggcgtgatctcagctcactgcaacctccacctccggggttcaagcgagtctcctgcctcagcctcctgagtagctgggactacaggcacacagcaccacgcccagctaattttgtatttttagtag

SEQ ID NO: 103704 - DNA, 1074 bp, Homo sapiens
ggcccgctcgtgggtgtgggatccgcgtggtacgggatcggagcgaagcggctgctttgggaggcggggttaggggccctgctgggccctgggtgccctagctccagtggggctcggcggctcccagtgccgcagcggggccaggaatggatgtcgctttttcggctaagacccgcgtctactccaccacagctagatgagaccctgtcggagagactatggggcctgacggagatgtttccggagagggtccggtccgcggccggagccacttttgatctttccctctttgtggctcagaaaatgtacaggtaaggaacgagggcaaaggcactgggtacgtgcatgggatggtcgtggtgctgtgaaagaacacggggtttggaagcagcagacccgtgttgggtgaccttgggcttgtaccctatcctttcttagtttcctcttctgtaaaatggggattcttacctggcaggggagttgtgggggttatttcagattgttggagataattaatgaataaggagctttgtaagaactcaggagaatgttaaaccgccatcactagatgatacagctaccatagctgctcctcctgtctctggtaggagtatggtgtaaggagcgggtagaatacgtttatcaaaaacattggagtatgtaatgtgagaggtttggttactgggtagttcttgcctgttttgtttgcatgtcttcatgctcaccctctggggattttcctctgcaggttttccagggcagccttgtggattgggaccacttcctttatgatcctggttcttcccgttgtctttgagacggagaagttgcaaatggagcaacagcagcaactgcagcagcggcaggtgagcccagaccttgggctttttgccagtggtggagacgcaagttatttcactaacacattggtccccaacctttttggcaccagggactggtttcatggaacacagtttttacatggatggtgggttgggggtggccgggggtcggggggggggttctggatgattcaagtgcattacatttattgtgcactgaatttctattatt

SEQ ID NO: 103705 - DNA, 1480 bp, Homo sapiens
tgtctgggggtgatgggagacagtgacagatcatcaggcattagattttcataaggagcttgcaacctagatccctcgcatgcactgttcacaagggtttgtgttcctatgagaatctaacactgctgctgatctgacaggaggtggagctcaggcagtaatgtgagcgatggtgaacagcagtaaacacagatgaagcttctctcacttgcctgctgctgatctactgctgtgtggctcagctcctaacaggccatgggccagtgccagtccacagcccaggggttgagggctcctgttgtagcacctgagttgaccaacagttaatgtgtgggtggggattgggatcgggcccatgctcttttagttgtctgactgtgctttcagtattatttttgtagacgttggccccatcaggtatggtgagaataagctctctaggcctgtatgatgccttacacccctccttttcttttccagatacttctaggacctaacacagggctctcaggaggaatgccaggggctctaccctcacttcctggaaagatctagattgttattgctgtttgagctgtctcagtgggataagtttgaaattcaagtgtttgaactgctgataatttggatttttttttttttttaactttggcacattgatctatctaaacctggtggggagaattatccccacattgtctcatggaaagactcaacttgcaactgtgccctccacactatccttacttctgtctccactctgataccagagtgcagccatgcagatggttattccagctctggtcacccgactcctttcaccaaattgctcctaactggaagatctcactttccccttgtggggtaggaaccgatgccagtgggagggatgtgcccctgaccattaacgactgttttttttttttttttttaaagaatggagttgttggggcaggacatgcacacaatgtgaaacagacaaaatgcattacacctgtagtgtaaagtggccactatgaatccctatgtatgagaggagggaggcaggctgcagcttcagccacagaatggggactatggaagacagcaggagctcatttcctctgcacattttggctgttagacctgtgtgtgtgtttaaaaaaagagaagtcagtgctcactttttgtatttaaatattaaaaatgattccaactgaaagtgtcatcctaagtaccttgaaatgagaccacgtcagagacatgtactgcccctcacattttctcacctaaaccagcagcacctccatcttaacagccataggcccaaattgtttccaagtgaaaattcatttttagccaagtacttcatagcaatctttgccctgaatttaggcagtcactttgagatccatcagcctaaaacaaaggattgggtctatgtacttctttagtctataatgacactgtgtaattataaagtatttgtagggaataacat

SEQ ID NO: 103706 - DNA, 1126 bp, Homo sapiens
atcttcatgtcgtttcctctctgtatcaatggaagttcaacccgcccctacctcttcagatagttgtaggccacttttctcttgtaactttggaaaacaaaagaggagaaataagtatcataccatatgcgtgtctccaaagtggatgtggttgcctcaaggcaggtggcaggcaggggtgacctgctggccctcagatcaatggtcgtggcaggtctgagagctgtcccactggccagacttctctccagcagcaaagccagcctggggcttgcatgttgatcctgagcaagcttaacggggtgaagctgggctttctcccccctgtgactggagtgcatgttgacaccagcactttttctgcacatgtatcttcaatccaacaaggccgtttttttaatgctgagtaacaggccaccaagcggctactgcgttatatcttctcagcaactggccgcagtctcttctgcaccattttctacaccagacctgcttggcaccacagggagctcttttcctgccctgcacaatgacattccaaccaccaccagccagacattacagccaaccttgctgattgtcacaagcaggaccttggggccactggcactgtcagatagtaagccatttcttgggtagaggaggaaactcctctccacaaatccacttgggcctgtgcaaatggcacttgaaagagtccccatgcacttggagtccatgagccaatgggatatgcaaagacgcttaaacatttcagggctggtttctctgttcatatccaattctggtgcttaggaacagggacccatgctgatgcccaagggcaaaaagccccacttcctttaaggaagtgaacaggcctgaccctgatgcccaataacgggcaaccctaggctttttgtttttcttgcttttattcctttttgttgttggccttgtgctgcgtttgtttacaaaagatgtattttgtttaaccaaatattaaaaatggaaaactccatatatgtctccttgtctgcctgaattctataattgtgtaaagaaaaataaactttagtatgacgctgttttaaaaggagttcattgccagcgtaagtcatcttttagagacatatcattctttgat

SEQ ID NO: 103707 - DNA, 1050 bp, Homo sapiens
tcgctcagctggggaggagcatgtccgagaatgtctacttttcgaggccacccgaaacaaaatggaaagatggtcaggctccttagtctcgctatcctgtgagtggaagctcatcttgtatgagtggagcagtgaaggacgtttaaaaccgtgttttttgagctgtcgagaaggtaggcaggaattaaggcctcgccaacggcttgacattgtgaagaatagaaaagtaaatacaagatgtgactggtgttttgaaggtgcttaacgttccttagggaaagaatgccaacttgggagtcagacagggctgggttccctttcctgccctaccatcgaaaggctctgtgacgttgggaaagtttcttaacctttcagttctccaaccacctcatcttaagaaagtacagatgggttgtaaaaattagaaatatttaagaagacacctaatagtgcctgatgcatactagagactcagtaaatgtttgaagtgaacgagatagttcctaatttcctgtgcagattaaatagcagtgggtgaaagatagaacaccaataccaccacttacatttgtaggatagttacgatagacattttatccagctttgaaaatgtttgtgactttttatagtttatggcggcaaatttgcatgaaacttggtcctaaactggggaggaactttccctgcaacctaagcaagttattttcaactgctctttgccattgtagtctcaggtgagcacttggaagccagctagcctgtcaaagttggtcctgtcttgtgcctgtaaggccataatgaggatggccaaacttagagagagggatggccaggacgatgtaaaagacccaggaaacatccaggttacaattacaagctctgatgagtcaactcaggaagttacaagattatggacctgactcaagagcaaacaaactggatgtcaacacatggtcaaggtgctgaagaaacatgataggaaattgcagggcagagttgcaaagacggtagtaccttcatttcttgaccagctcatttaatattcctaga

SEQ ID NO: 103708 - DNA, 1028 bp, Homo sapiens
tcaggtagaataacagcctgaatcaggctggtggctgcggattggcaaaaagggcagacatcagggaaggaggcaaggtaaaatgctagaatcatcaggactggactgaggagactggtggctagagagatggtattgtcattgtcagaaataaagaaggaactggtcaggcagtaagaggaaaaggctctggttttggaatctgaagacctgaactcatggcctcccccaagctctgagatctccctaggttctttttaccccactgttaaaagggaacagtaatgcctacctcataagattacagtgagaaataaaatgctttattaacattgttagtgtctgtgctgttgtttaaaagagggttgggttgggtgttgagtttggatatcagacttctaggagttatccaggcaattggaaattcagtctggagttctgggcataggatggtgttagaaatgagtgtttttatagttttcaaaatgacagccaaagccatagaacaagatggccaaggggaaagtttggaggaaacagaacagggccactgacagactactggaaaaaactggcattcaggagacaagagcgggggacggggtggggaggcacatcaggagaggtcaggtgatgcgtgagcagggtgggagggaagtgcttcaagagggaaaggctgagtggccagcagtatcgaatgctgtaggagtcaagaagagggcattagagagtttagaaggccactggtgggccaggcatgatggctgacgcctgtaatcccagcactttggtgggaggccaaggcgggcagatcacttgaggtcaggagttcgagaccagcctggccagcatggtgaaaccccgtctctactgaaaatacaaaacttagccaggcatgatggcgggcgcctgtaatcccagctacctgggaggctgaggcaggagaatcgcttgaacctgggaggcagaggttgctgtgagcaaggattgtgccactgcactccagcctgggtgacagagtgagactc

SEQ ID NO: 103709 - DNA, 1029 bp, Homo sapiens
taacccacagccatctgatcatgttactcccctgcctcagcctacgggtgtctcaatgcctggtgcagaaggtgtgtcgctgctgtccgtctgttgtgctgcttccacctctcatgtagtctcccgacactccatgtcacccatgctgctcctcaacacactgagctgcttcctggtccctgaacttgccatgatctgccacgccacgctttgttcctctggctaggatgtccttcctccttctgcaggcccagcacttgttgacctagcttggcatcagccctttgcagaactgtcctcggcttccccaggcagtgctttatgttctcttcacacagtcctagagtgcagcacttgagctgtattgcaattaattaatttcctgtctgcctcccccactgggctgtgagctcactaggggcacctgtagtcctagtacccagcatgaggcttggcataaaacctgggagagcctcggtggctgttgttgaatgaagtagcgaatgctctgcttgatggagaggtctgtggcactgtcatgttttaacttggtgtgtgcccaggttttctctcaggtagagaggacccctgttcctctgcagtgctggggtcggggggtggtggcctttgttaggtggggttcctggctggctggttggcaggctggttggtcaggactccctctcctgctgatgtctgggctcttgtcaccagatgggactgagtatgggctgagtgaagctgacatggaggcctcctacgccacagtgaagagcatggcggaacagatagaggccgatgtcatccttctgcgggaacggcaagaagctgggggccgcgtgcgtgattacctggtccggaaacgagtaggagacaatgacttcctggaggtcaggtgaggaggccgcgggacattttggggtccccattcttcacagaggttggtgactgagcctgtggcacttggcgtgtcagctccatcctttcccctcctgaggcggggaaagagtgtccaggtgtctggagacg

SEQ ID NO: 103710 - DNA, 2344 bp, Homo sapiens
aggcttcacgggggtctgtagccccagagataagcccccacccttccacagcttaagcgtatttcatgctttcactcactgcctcccgttgtcctgaagccaccaggtggctccagcctatcctgacctctggcttccttgacagtgcactgtgggagcatcaggcagacagccaccattctgagcatggacaaggactgtctgcgcactggggacaaggccactgtacacttccgcttcatcaagacccctgagtacctgcacatagaccagcggctggtgttccgggaaggccgcaccaaggctgtcggcaccatcaccaaggtatggccaggacagaccttgcctgcctccaggaagcaccaggggccactcctgttctgtgaccctgagtgcagggcagaggtttagtcactgccatgggagagctggacccactgaggtgtggcctcggtgccatctctctactcccttagaggtatcctgtggcctcctgtcctgggcagtggtggtgaccatggagaggagaaggtagggttagggtatgatcttcctccatagaaaactggtgacagaatgtctgggcccagccaggctcagcctccagggtgctgtcacaggttcctatggcctcactgggaccatgtctaaggtctcctctcagagcagaggtctggttggagtaagtgcagggggttatgggcgtgagttctcttggggcttaagctgttggtgtatcctggacacttgcccactgcagaccttgcccctggtcttggaggggcatttgatagaggggtttgacccctgctccgtacaaaggaggtactggccccagcctatctgagatcttggaatcagtctttggctggccttgcctccagaaaaggcccccatccatggtcaccctggggctacagatgtccttgaaggcctgcatgctcctgggactgctgagtttggccaaggctgcagcaaacactgtaatgtcctctgggactcactgggcttcttttgtgctttgtatgagatagaacttgggccacaagggaagatttcaagtcagttacttctggccaaactccagatgtttccagctgaggagacattcacttggtctcttcgggaggccctgagttaacacttgccctagacttgttacgggggcagcagcagcgtgctggggctggagctgcagcatgctctgaggagtctccaccagcttagcaatcaggagatcccggagctccacttgccaggctctgtgcaggctctgggctctgggggctggactgagcgggaggtgggagcaaggttcaccaatttctctgcaggaatagtagctgcagcagagaacaggatggagcctttctgggctgggcagaggcaggaagtgaggcatgagtccagggccatagcagtcctcagccactgagtggggatgagaatgcctcttcatccccactgcctcctgtcacagccttcctgccatctgccttgccctgaactggcaagatcaaggaatgaggagtctgtgggagaagggggctgagggtggggggtagccaagccagtgccactgccccgcagctccagcctcagcctctctccatggctcccacagctcctccagaccaccaacaactccccaatgaactccaagccgcagcagattaaaatgcagtcgacgaaaaagggccccctgacgaaacgagacgaggggggcccgtctggtgggccagcagtaggagcacccccacctggagatgaagcctcctctgtaggggcagggcaaccagctgcgtccagcaatctccagcctcaggtgagcacgggcccctcgcagcttcggcatggtggtgggggctgtggcttttactctgattcggtgagggtgacatgtaggcaagcctcaaacctggctagagggtctcctccacagctctggcactgaagtgctcctaagaatgaggcatttgtctctagaagctataaggcagtgcttccaaatcagggaatacagcccacctgaaaccagtttaattggccctaactagcatttggttttaatgaaataaaatagaacagaaaaatgtcgaagcttccctttcatagtaagattaagtattgcaagtattgctggtgtgagtgtccaagtgatatatgtgtgcactgcagtccagcaggtttgagagacactgccttagagggtcctcctctgtcccctccctgacgtgcacacatcctgaaggggaggtggctttgggatgtgccagtgcgcctcttactcggcatctcctgccagctgtctcccacaggcactctctcctggcgtgatgaaggc

SEQ ID NO: 103711 - DNA, 1072 bp, Homo sapiens
atatgtctctgtctctctctattgtgtgtgtgtgtgtgtgtgtgtgtgtgtgtgtgtgtgtggtgcaggagtgccacccccagggccctgtcaacctctcttttctcctccatggctgtctgcctgcgtatctgtctctgagaatcctcggggcggtcaggggatgtcaggaggggaaggagccgccctccctatcttgctgctcctcttggcactcaggggcaccttccatggagccagaccgggtggaggggcttctgggatttggtgtctgctgctgccagagcaggaacccccagtctaggacttgggcattttaacagggagaaagtagtggcttcccttttctctctctcctcctttttccctttaagcccacagattcaggtcatgccaaaagctctctggttgtaacctggagacatgtggaggggaatggcgatgggattataggactctccccatctcgggccctgaccctgacccttgccaccaacccaaagacagctggtgggtttccccttggagacaatcctgcgtttgcctgggccggccctggctgccctcagctttcgctgatctgcccggcctggagcctcccatcaccccgcttcttgttgggcctcaggcactggttaccagaagggggtctgggtctgctcaggatcatgttttgtagcacctcctgttggaggggtggagggatgttcccctgagccaggctgagactagaaccccatcttccctgagccaggctgagactagaaccccatcttccccaccacgccacccctgtggctgctacaggagcacagtagtgaaggcctgagctccaggtttgaaagacccaactggagcgtggggcgggcaggcaggggttagtgaaaggacacttccagggttaggacagagcatttagccttctggaagaacccctgcctggggtgggactgtgcaggccagagaaggtggcatgggcctgaacccacctggactgacttctgcactgaagccacagatggagggtaggctggtgggtgggggtggttcgttctctagccggggcagacac

SEQ ID NO: 103712 - DNA, 1044 bp, Homo sapiens
caggagtgtgctaggcctgtggcatctgcccaggtaagatatgctgctaacaccattcccaacactgtggctagacagaggcccgatgggcactggagaaaaagaatcaagtgtgccccacatcagcatctatgaagccctctatgaaggtggttctatctgttgatcacaataaaaaaacgattgtggatgaattcattccggtttcagatgaagtgtgctacaggtggccccttaacccactggctggaaacactgctcaggaggctaaagataggagcttttgaagcctggttctcttcagagccccagggaaggagcaggggagccatctggccctaggcgaggctgtctccccttcccaccttctctgtcagtgaggcctcacaggtctctgatgctcttaatccctttcttctctacccaggcccctacgatggccacgtaccaggtggtggagctgcggatcctgactaactggggccaccccgagtacacctgcatctaccgcttcagagtgcatggggagcccgcccactagccctgcttactggtgcctgctgccagccatctgggagtgggtgaacagcaccccgccgcttcccccacacgcttgctcggcgctctgacttctaggagcacaagagaggagcctgtggccccatgcagatgaaaaggacgggcagggtctcctgagcagcaggtggctcgaggcggttagcaggctccagcagctcccttcttccttccctctgtgcccgtggcgtctgcttcccatcctgggagtgtgtatatatgtagcatatcatgggggactgggaagttgggagaggtaggacctgactggtcttggctggggtcaggggctggtgcctgggagctgatgaagcaggtgccagggctgtgggaggggcaagctacggcctgggctaggtgagctgcctctgcccctgggcaaggaagcgaggccctctgggaggagggtgcttagctccagagcaggatgggacttccccaggcaggaagcacttgatggagagctgc

SEQ ID NO: 103713 - DNA, 1018 bp, Homo sapiens
ccgcgtggggctccttcagagagaggagatgcaagctcagctgcgagagctggagagcaagatcctcacccatgtggcagagatgcagggcaagtcggccagggaagccgcggcctccctgagcctgacgctgcagaaagaaggtgtgattggagtgacagaggaggtgaggcccacatgcccctctccacacacccacccacagctctcctccctgggagccctggacagtcccacactgccagctccctggcaggttccaggatggaagtgccaagcaggaggctttgcatgctgtggggctggcatgggtgggtggcagtgtgcccacatctgcctgggcaccagcacagtgcaagcctagaaggggtcagcccatgggtccttggcccacggccacgaggtgacagggggacacgtctgctccctgctgcaaccgtctcctggtgcctgcattgcagcaggtgcaccacatcgtgaagcaggccctgcagcgctacagtgaggaccgcatcgggctggcagactacgccctggagtcaggaggtacgtgctctgctttcctcgctctgccttgtcctggaccccgcaatggccggtcccctggcatctaccaggttggtggtggggcagagcaagcaaagctcaggatcagcagaaatcacccaacctagtacccatgacaaaggcaagtggcaattcagggaagtcaggacgtaccgagtaccatcctgggccagggagaggctgacctttaaagctgctctgagcatctcggttagggttaaaggctaggcctggggcatctgccgtccaccttcagcgaggagacagccaatggcctgagcggggccctcctcccgtgcgggagcccaccctgccttcctctcctgtctcaggggccagcgtcatcagcacccgatgttctgagacctacgagaccaagacggccctcctcagcctcttcggcatccccctgtggtaccactcccagtcaccccgagtcatcctccaggtg

SEQ ID NO: 103714 - DNA, 1491 bp, Homo sapiens
ggcgtgcaccaccacatccagctaattttgtatttttagtagagacagggttttaccaagttggccaggctggtctcgaactcctgacctctagtgatctgcctgccttggcctcccaaagtcctgggattacaggcgtgagccaccacgccaggcctcctcaccttctctaagcctcagtttcctgctctttgatggaggccatcgtgtctcccccacccccatagtgagctgtgcgagtagaaagccccagcatggtacctgacaccgcagaggtgtgcagtggagctgaagcgggagtcttgcgtggttcagagaaggctgagagccagggctctggaagcaaacagaccttgtttgaattccagttccgccacttcctagtcatgagggtccctataagcatggctctgtccaacctgtcctctcactcccgtctcacaggaagaactgtctgccctgagagcagagcatcagcaagactcagaagacctcttcaagaagatcgtccgggcctcccaggtcagcgggcttgcggcactcagggcctgtgactgggtcctgaccccatccaacatgttcacctcggacccctcggcccttccaaagggactgtttgggtgttgcatggggaggggagtgccctcctctgacttctctgtttgacccccgaccccttagttggagagctgtgcaggggctccctggggtgtgccagggcacagcggcctgtcatgctggtgtgcatgtgctgagtgtgggtgaacagatacctcagtgtgtcagacatggacgagactcatgagggctttgacaaggaggccagtttgatttttgctgcaggggtcaagagaccttgggcaggggtgtggttaagcaaagacgctaacagacagcagatcctactctggaacaccaatttctgagatgagtatttcttgtatttgtcccttcttcctacacaggagtccgaggctcgcatccagcagctgaagtcagagtggcaaaggtactgggcgccaccagctggcctcggcctgctcctccccagccccacccactctccaggcaggactggggagcagagccgcagagcagagagttctgatcatcttgccaagcagatggtagggggaggggttgaaacccagctcaggacccctgcccagggcctgtctttgaggtgccatggaggttagcaggggggtcctgagggcggggggcaggctgtgtgagaggaccgggattcatttatagacacagcatcctttcttacagcctcacataactgccttctcatgccccagatgtccatgcttgtggaggatgtgagaggctgaggcagagtacattctggactctgggcttagaaagggagcaggctcagaattagctccttgggacaggcaggggttctgcagccagaacccccaggagaggccttgccccttctcaggttcacaatgagtgctgggcacccgctctcctgac

SEQ ID NO: 103715 - DNA, 1011 bp, Homo sapiens
caaggacccaggccaacttcctgcttttcctactaccaatcggtcccttttccaacaccagctaaaagtagaggggatgccagatgggcgtctgacctgggaagatgccaacaaggccaggacatgaggctgcttgtttttcagaggaggactttctagctggactaaccagaccttcgggtttctgcagcctgggttgggaagtggacttctatactcaccacacaacccagagaactggtcatttaagtatcaaccaggaatattagaagtgatcaaaagtcacaagcaagtgctaggaattcccaagtgactttgttgtacgggccagcagaggcactaacgttgagactccccatgttggcagtcggggactttgaattcgggtgtctagacctgagtggttcattaatcttcctcatgtcacagaatgctacctcttgccagatctttgcactttggcttcctttgtcctcattatcagttccagagccttgatttctgccccacatggtgaccggaactgactgtaattcatgctgccctcctcctccctattttgttagtttgctaacaaatatttgttgtgtaacaagtttgtatacagccttgttttgcgcatgtgtgaggctaaaaaagattctagctgaggacacacaactagaatcttcaatacattcctgaaacaactggaaaactttatgcctgagtagaaagacccaggccctacagcctgtcagagctgagcccaaaccctggctttggcacttacaggctggggactgtggacaagttacccattgcctcagtgtccaggttcttcccttgtagatgggagtaatgatacctaccttgcttctaataatataaatgaggtatacaaggagcccggtcccagcagacacttaccattttatcatcatcttaccaagatgtggcagcacagtgtgcaccgtggggacagacagtgcaagcgccatcaggacgtaggtgggagcctggccaacttgg

SEQ ID NO: 103716 - DNA, 1844 bp, Homo sapiens
gaggtcaggagttcgagaccagcctggccaacatggtgaaaccccatctctactaaaaatacaaaaattagccaggcgtggtggcgcgtacctgtaatcccagctacttgggaggctgagtcagaagaattgcttgaacccgggaggcggaggttgcagtgagccgagatcgcgtcactacactccagcctgtgcaacaagagcaaaacgctgtctcaaaaaaaaaaaaaagaaagaaagaaagaaagaaaagaaaagaaaactgaggcttagggaggtaagcccttgtctaaaacagaaccaagatgtgaattcagatccgacggtggagtctgtactcagaaccaccatgacatgctccaggtgtgtcctgcaatctctcaggtgcatggtgggtggtacagggaggcgagccgtgatctaagggccgcggatgttccagacattgaatggctgcccccctcccagggggctggcagatattttgggccttatttcccagaacgcattcatttttcccagtccctcccacacaccctaaccctctttaggattcttcccagacgcttcagacacagaatagtgaatggtgactgaggtcagtgccacaaaagaacaagggatagcaggaccaggaacactggccttgaccaggcaatgagataaagggcccttgtctgtgcccactgttgcttaggaagagcctcacatcagagggggtgaggatatgtaaagcccacagatggcccttgagtgaggaggagagcaggggtagtgggagagggaataaggctgcccctggctttgcaccactgtgggccagatgggctggagtcgagcttctgtacccaggagattcaagtaccctggcggtgggcacagttttgtttttgttttgttttgttttgttttgttttgagactgagtctcacttcttcgcccaggctggagtgcaatggtgtgatcttggctcaccgcaatctctgtctcccgggttcaagccattctcctgcctcagcctccccagtagctgggattacaggcatgtaccaccacatccggctaatttttatatttttagtagagacagggttttaccctgttggccaggctggtctcgaacttctgacctcaagtgatccacccacctcggcctcccaaagtgctgggattacaggcgtgagccactgcacccagccacaattatattattaaaaggctcttttagacctgacatgactctttctggctccaagagttcaggcacatgcttctctgcatggaagattgataaggttgttagaacctctggttctgctatttttggtaacattctttgaggagagttttaggactgtggctgaatgactctagctgtactataatgatacagcgtcataaaaaattctcctgcctttctgtatttggaaacacatcatctataacgattcctttttattctgtctcatctcttttaggtccccagaagtatgtgtagtggttagaaaaagctctttgtagtcagggcccttagtaaacttggctgaatcatggtgaccaagtcctggctgattaacgctggtagcagagagcactgtgataacagcgcagagagctttaacgtttcaaatcgctcacatacacatacctggggcttgcaacagcttcctgagaacgcagagataggatttagtatcccgtttcatagagaaggaaaccaaggcttaggtgaaattacttgctgacggctgcaaagaaaggaagtgagcagaatgctcgtctttgacagagctggtctccatgcctgcacactccggcttgcggcccacacagttcttagctct

SEQ ID NO: 103717 - DNA, 1014 bp, Homo sapiens
ctccagccctcctcagccctgcctctggcctgtctaccccgggtctcccaacaagtttaatttgttgacggtcacgtggctgggaagtgggggagacgagatttggtctcaggacatctaaggtccagagcccctgcactttaatcacacccctcaacacagaggtggagcagagagagccctgaaggcactgggcatgcagcaggtgcctgggagctgttagccatctttctgaagtgtgccctgtccaccccacccttttcggtgtccaccgacctccaccatgtctgccttgcccaccctcagggtcctcagcctacagtcctccagatgccttcaagatcagcatccccatccgtaacaactacatgtacgcccgcgtgcggaaggctctgcccgagctctacgcattcaccgcctgcatgtggctgcggtccaggtccagcggcaccggccagggcacccccttctcctactcagtgcccgggcaggccaacgagattgtactgctagaggcgggccatgagcccatggagctgctgatcaacgacaaggtaggcagggctggcagggagggctggctgggggagggccacccttccagaagcacccactccacactgggctctttcattctcctgctcattctcctgctctgcatattcagcacacattaagtacctaccgtgtgctaggctgggctctgggaatataaagacaagccagacatggagctgccggaagagaggctgtgtccaatagaggctctaagtgttgttccattttacagaggaggcaagtgaagctcttggggatccagtgacttccccagtgacccagctatgggacagggctgaggtgtctgcccccagggccctgctcatcatcctggacttaaagagaagggaggtggccgggcgcactggctcatgcctgtaatcccagcactttgggaggccgaggcgggcggatcacgaggtcaggagattgagaccatcctggctaacatggtga

SEQ ID NO: 103718 - DNA, 1035 bp, Homo sapiens
gtgcccctggcggccagcccggcgcgggcgctgcccggcggcgccgacaatgcttcggtcgcctcgggcgccgccgcgtccccgggcccgcagcggagcctgagcgcgctgcacggcgcgggcggttcagccgggccccccgcgctgcccggggcacccgcggccagcgcgcacccgctgccgcccgggcccctgttcagccgcttcctgtgcacgccgctggctgctgcctgcccgtcgggggcccagcagggggacgcggcgggcgctgcgccgggcgagcgcgaagagctgctgctgctgcagagcacggccgagcagctgcgccagacggcgctgcagcaggaggcgcgcatccgcgccgaccaggacaccatccgtgagctcaccggcaagctgggccgctgcgagagcggcctgccgcgcggcctccagggcgccgggccccgccgcgacaccatggccgacgggccctgggactcgcctgcgctcattctggagctggaggacgccgtgcgcgccctgcgggaccgcatcgaccgcctggaggtgagcgccgcgcgccgtcgggggagccgcccgggtggtgtgaggggccgcccggccgcggtcgtccggcggtccccgagcctccggtctcccgtctgtgttccggggacgatcgcgccttcctcgctggcgaggcggggggatttcgatagggaacgcgggcaggcgtctggcacggtgactgaggcacagagggcgcgccagaaagattcgctccccacccttttccgtctccaggcacctctctgagcctcagtttctgtgtctgtaaaataggtataacagtgtccacttgtagtggaaattgaatcaaatgtaggtgtgtgaaaatgcttggcacgtactaggacctcattaaatgtccctttcatttccttcttccggacacccccaaatcagcccagctccacgctcacactttatggccaggagatggatgcgctgtccaaaggacttggggtcctcccctcattacacagagccggg

SEQ ID NO: 103719 - DNA, 1076 bp, Homo sapiens
taatcccagcacttggggaggttgaggggtggatcacttgaggctcggagtctgagaccaccctaggcgacatggcgaaaccccatctctacaaaaaatagaaaaatcagctaggcatggtggtgtgtgcctgtagtcccagctactcaggaggctgaggtgggaggatcacttgaccctgggaggtcaagtctgcaatgagtcatgatcgtaacactgcactccagcctcggtgacagagcaagaccctgcctctaaaaaataaaaagagtggttaagatggtaaattttgttattgtaacatattttactatgattaaaaatttgaaaaacaaaacaaaatcaatagcagttaagatggtaaattttgttattgtaacatattttactatgattaaaaatttgaaaaacaaaacaaaatcaatagcaaaaagataactaaaacccaaaacttcatctatccggacagtaacccagagctctctttcccctgcatcttgctccctccccaaccttctgaaatctttaggacaatgagattcaaagatgaatgtgaacattcctaatagcgagcagacacgcagggggcgcacagccaatctgacttaaagctggatgggaacaggtccccctctgatccctctagaagggatgtggccttcattagagcaaattggtaccaaagtcttttctgtcttttccaaaggatgagtgagctcagagcttgacaaagacatgagcctccatttaaatgacggccgccagcaatcagcctttatgaacacaagggcctgggaaacatcggtgcggagccagggtgggctgatggaaacagaacaaagccgggtggcaggggtcctcagtcctgtgaaataaggacaagccccccaccagcttatcctgcctatcacgcctcagggcctgaaactgcagcgccagcaacaggctctttcagagaagatctggatatccctaggagttctcggtaaaggctcagatactcccagccgtgagcaaggaaacaggacacactttggaaaaggcaaatgtggaccctgtcccccaaggggactcat

SEQ ID NO: 103720 - DNA, 1035 bp, Homo sapiens
agcgctctggtctccccttcctcaccaccccacctcctgtctggcctctctagtatctccccgccctgcagcctggggtcctgagcgcttctgctttggcagcggctctggcctggtccaccagtctccatcctggcctgcacctgccccctgtgtcttccacaccagtgccataggggtcagggaggctaccgccccagcgccacggcctctaggcaggcaggagtgtgatctagttccttgtcatgcctggtcccggcgctggggatattcaatgcagacagaccctgctgttaatttccaggctgcaatgcccagagcccccacagctcaacacagcctgtgtgccatctgcaaatggctgaggtgcaaagtctcccctagcctccacctccccgcccccctcctccttgcctccctttgcctgaagcccctcccctgccacctgccctcccgggccctgccctgtctcctccctcggtattgacctgcggttttgtccttcccccttcctaaggacagggctgggtcttcatcccctctctgcccacacctcagtgtctggcacatggtaggcccagatcatctccgtcaccaagctcagtcctcttcctatgctggctgggacagtgaggcttgggagcggctgagaggtagacctggggctcagtgcaatcaaccaactgcctctgagcattaccagtgggcctggcctgggccaggcaggggccagcaggacaaatgggagtgtgtccctgtcccggatacggggctgccactgggcaggcaggtgggaagggacccacagtgaagcacccacagggcaggggaggccagccagtaagccagggctggtcctgctcagtgccactgctgcacctcacggccacctccttgtcatcttgagcacctgccttggtgttctactcccagaaagccctcattcgtacttatttttttgaaccccaaattattagcgcacctactatcggccaagccctggtgagcacgtcactggccctagcccatgtccct

SEQ ID NO: 103721 - DNA, 1686 bp, Homo sapiens
cggcagggactggggcccaggatgctttggcctatggggaaaagccctttaaaaggcagggcccaggccctggagccagcacaagactggcctcgagcccctgagccaggaggtcctggaggagagccaggccggtgggcccgcccaaggctggagggtcagccccaacagggagctgggttggccagggggctggactgctaccagcctctctggcctatggggacccaagaggacacatcccccttttgcccactcttctgtgtcattttgttgttttggtttgtggtggtttttcttttttcttttgtttttcttttttctttctttctttttttttttttttttttttttttttgcacttcgcccacacaggacagtggagccccacctggtcagttccacttccgggctcccatgcacttgcccaaggcggcctctttgggacggggatggtttgaggaaacacttttaaagaaaaaaggaagacattgaaaggttttagtttcttccctatctgcatgtcctctcatatagaaagcccagaattaggggctagaactccaggagagggtctccccgactcatctcttgctgacggtcaccaggatgcagaaatagggagatggttagtgggggccaaagatgccccctcccaggccttcgtggttccctcctccgccccctgcaatctttggaggagtcagtgcctcactccagcagtgagtgcctactgtatgcaggtagtcagccaggcaaagagagactaacggtctcatgggggaaccctcttgcgggaggccgggtagctggagcgaagcgttccggctgcccttgctgctgggtggagtggagagggagacttctttttgttggttttaatttaaaaacacaaaggcctaaagaaatacgtatcttataatttttttaatttttgagacgttcatttaatgaattgtgcacgaatgaattctatatatataaaatatacatatatagctctatatttggggaggggcactgtctcttttttctctcatttttaaaatgaagtgttgttgcctttgtatgtggttcaaccatccagctcccagctggctaaactttgcctccagtggtcaaagatgggaaaagagtggggttggcaggagatggaaaacggaggtgccgccccagcatggggggcaggtcccccagtccaccctgcccctccccctgtggagaagacgcttagttgggggtgtgggtttgggctccattctggattcggcggttccgggggaggggtgggtctgtgccgattactctgtcttgtacgtttgttctgctgctcttcaatattgtatcaacgccaggaaaggggggtgaaaagcctcttttaccccccaaataaattgtcacattccgaagctgaggcctagcccctaggttggggtgtgtctgtgtcttcttccagctgtgactggcttttcaaaagtagcaggcccatgtccctccagtgacaggtgaagagggggaagccctgtcccaccgctggcactcacttgcttcccggttcctatctcccacactcccccagctcacatgtgcctcagtgggaaaaagagatgcctgctgcttcttggacccttgagaataacgggtaggtgagagtgggaggatggaggtctcatcactgcctgtccc

SEQ ID NO: 103722 - DNA, 1146 bp, Homo sapiens
ttttcagaggtgattttatgacaggaaagtgaaagaattagttttgcaaaaaaacaaaaacaaaaaaagaggaaaaaaaaaagaaatagaaaaaaatattgtgggattcctatgggggggtggcgggggagaaagagctatttaagaaaaaatagtaacgcagtgattgcacaggtgaggtggcaatgtcaggatggggcggaggcctgggcccagctggcaggtcccctggcatcgcaggcactgtggagagggcctggacccagatctccacacccgtgcttgctcaaagggaaggacaacagcgggcccccgggagctaacccaagctgcaggtcccggcaagctgaggtttgggagggtgggggttgtcactggtgattttctccagggggctggtgagtgggcagtttggtttcttgcccccttctgttcctttcccagttgttgggccatctggtccccaccaccgccaccctatgggggagacctccctccccacgggtcaccctaaagcccacaacctctctgagcctccctggcctgaaaggggatgcaggcttcaggaggcaagaagctgggcccctgggggtggctggggagagggaatgcatttcccttgccacaggtggtctgcttctgctggcctgagctccaagtggagcagcccgggccagccttggtgcatgaagaggcaccaggcacaccgccttgaggtgggcagtgcccatgggggcccgagtggatgggaccgagggtgagtggagcctccttcctcccctctctagtacccccgcctcccacacacttgcacggatcggcctcccttgggagatcagcctccatgggcccctcgtccacccttgctgctttccatttgcctaattaccaagcagaagttgcaatctggtttgctttatttttgtatgtgaaataacccccaaagcccaatctcctcctacgttcaatattggttggggcatccgtcatctccccttaagtgcgccccctccccacccaagtatcataggaaaccggtgaggtctggtgtctctggtttgagacggtaagttgggacccatccctgtctgggtgcccactctgacctttagtttgcccttctgtgaaatgggtgtattgggtagc

SEQ ID NO: 103723 - DNA, 1218 bp, Homo sapiens
ctcaagaaggacatccgccgctgccaccgtatgtcccgccgtcccctgccccgcccggacccgcaggggggcagccccggactgcgcccgcccatttcgcccttctcggagacggtgcgcatcatcaaccgcaaggtgaagccgcgggagcccaagcggaaccgcatcatcctgaacctgaaggtgatcgacaagggcgctggcggcgggggcgccgggcagggggccggggcgctggcccgccccaaagtcccctcgcggaaccgcgttataggcaagagcaagaagttcagcgagagcgtcctgcgtacacagatccgccacatgaagttcggcgcctttgcgctgtacaagcctccgcccgcccccctggtagccccgtcccccggcaaggctgaggcctcagccccgggccctgggctacttctggccgcccccgccgccccctacgacgcccgcagctctggctcctccggctgcccctcgcctacaccacagtcctctgaccccgacgacacgccccccaagctcctccccgagaccgtgagcccatccgcccccagctggcgcgagccggaggtgctcgacctgtccctccctcccgagtcggcagccaccagcaagcgggcaccgcctgaggtcacagctgctgccggcccggcacctcccacggcccctgagcccgccggtgcctcctccgagcccgaggctggggactggcgccccgagatgtcaccctgctccaatgtggtcgtcaccgatgtcaccagcaacctcctgacggtcacaatcaaggaattctgcaaccctgaggatttcgagaaggtggctgctggggtagcaggcgccgctgggggcggtggcagcattggggcgagcaagtgagggggctccaccaaggaggggggcttgggggggccctcctgcccgaagtcatactcttgctcccaccccacccttgcccccagccctctctccctgtgctttgcttgtctcaaatggctcggtgttgacccagggatggggctgggtagttggggtcccagaaagccgggggtaggggccaccctggaatggggcaggggaagggcacaccccctgcccatgcatggtagcccactgggtggtttctggaaagccctagaaactagggttcctctgccccttccacatcccacctgtctctctagcttgcttcctgctctcctgtgcggcgtc

SEQ ID NO: 103724 - DNA, 1098 bp, Homo sapiens
taagccagcaaacatctctcctgagagttgtgatcaaatggtaatctagtcttgtctgagaggcatatgggctacctccaggtactagttaagcatccaatgctgtggggagtgggaggtagagagacctcacaacagatcccaccctcatggacctcacagaccaaccgtggggacatggccttcttctcggtcccaaccatctcccacctagattgagggcagccatcacctaacaagcctccctgccccagtaggatctctaaaacccacgccccttgtggcaccccacacacaccccagcctctgtccccagcccttgctttcagtcctgtgactcctcgccatcttctcacaccactgggatcttgcccagaggactctctgcctctaccatctgtctgtcttagcaggccaccgcagcctctggaactgtctggggtgcagtcagggctcagtaaggaccaggactttttcctacttaggtgtcagggccgggctttgatgtttcattctccaagcctggggtctgtgcttctctgggctctgtggttctttcgctgcacgaaatcacttcatattcccactgcccaccgtcctccctgtgatagggcagctctccaggggagagtctgtgcgtgtgcagctgtaaccccaagcaactggtgcctggtgcctcagtaccttccttagtaaagaaaggactggccatgcagacagcttacatcgccttaggagtcccttagcctctctccatttagtggcatctgacaacgggtgggttggaccggaacctggggtctcttgagagccctgtggctttaaagagatttcatgcctggaaggacagctggaaggacaggcctgggagcctggggcagtattcctggctgcccacgacctctgcaccatcatcctgccccagaccatcttggcacagagaataggcagtggtcgggcccacttctaggcctgtccccaccaaactcacgtctgaccgggttgggttccagcccaggctttgggatgcattggtaccagttcactctgagccaggcactgggcagacaagtaaatgagacccatccagggaagtat

SEQ ID NO: 103725 - DNA, 1031 bp, Homo sapiens
cccgccggggcctgggcgctgcggcgcgtgcgcgagcggtgccgcaccggccgcgggcgcagggagtattatgggctgtgggtgccgctgagcaagatggagctgtctgcagtgggcgagcgggtcttcgcggccgaatccatcatcaaacggcggatccgaaaggtgagccgccgcccggggcgggccgccgctgtccgcagccggggccggggccgggggccctcggggcgaagcggtcccgctagcccggctccctcgcccagccccgcgccgccgcctcctcgcgtccccgcatcctccccacccccacccccgtttttctcccctctgtttttcagggacgcatcgagtacctggtgaaatggaaggggtgggcgatcaagtgagtgtcgcggggtccgggggcgtcgcgggaggggaggcagcgggcaccggggcctggggtgggggtgcgcgctcttgctctcgccgcgtgcctgtccctctctggtcttcatcctgattttgtgcgtttgtgactcggcaggtacagcacttgggagcccgaggagaacatcctggactcgcggctcattgcagccttcgaacaaaagtgagttgttggggaagctggcaggggctgcgaggccgaggctcggctggggcgccgcgcggggaagcgggagagccggggagggcagcgcggagtggggcccgggaaggggctctttttaacctctggtgtttttcggccgcagggagagggagcgtgagctgtatgggcccaagaagaggggacccaaacccaaaactttcctcctgaaggtaacctggcccagccccagcagcatccccctctcgggcccccagccccggcacagcacggggcctggaagggagggacagatacgcggccgcccaagcgggccggccttttcagaggggccccagctgggcagggggtggttgtgagcccccccagaagcccctgatggcaggcctcagccagcatcagcttcaacaagagggttttgggactggggataatc

SEQ ID NO: 103726 - DNA, 1017 bp, Homo sapiens
aaccacctgctgttcccgggtggtccccgcttttccacacctttgtaccttcacctgggatgcacctatgcatctttcaaaactcagttctggggtctcctgtatgaagccatatctggccctgccaggtagaactggccagccttcctttgccccattttggtgtttatagagcatcaagaacacaggagagttcttcctggtgacttgccacctccctgcaaagcatgagctccctgagggcatggccccctgtgctgcttgttccctggacagggcctgacactaggtagacagtcaagtaatatttactgggcttcaatcatatgcttgtactattctaggagctggggacacagcagagaacaagacagacagagtccctgcccttgagagtcttggattcttatgggggcagcagacagacaacaaacacacaaggcaagatgatttcaagtcagatatgtgttgtgaagaggctgaataggaatgcacagtggagaggaacagggcgcatgggtggggtgctcagcatggtggctggggcaggcctgtagagcagccacatctgagatgagacccacaccaggaaaaggaggcagctgtatagatctgggagaggaggtttcctagcaaaaggccctgaggcagggacacacctggcatatctgagggacagaaggaagccagcggggctggagccgagtggacagagagagtgaggtcagcgagggaggcagggccctgcaggccatggaggagagcctgggccttgatccaagtacagggaggaggcccccagtgacaactcactgcagaggcgaaggggcctggcacagcaagctggatgcagaggctgagccctgggtgaggttccgagggccaagaggcagatgcatttccaatctgctgcagcgcagcctccccgatgtatattcagagaggcaacaggctgtacattaaaatggaaagagctggaaactccctggaaactccaagcctgggcaccatctcaca

SEQ ID NO: 103727 - DNA, 1230 bp, Homo sapiens
tgcagtcagcccagatcccaccactgcaccccctaacctgtgcaccagagagagaccctgtctcaaaaatgagtaaataaggaaacggcccggggctccaggcccgccctctgctcccatcgccccacccctgcactcctcctgctcctggtctgagctcccctgtcctcctcctcctccttcgccaggtggattctgagacccattgtcatgcagaaaggtgcttcctctcttggttctgcgacgacatactgtctcctaacacaaagtaccaggtcacctggtacacatcttggagcccttgcccagactgtgcaggggaggtggccgagttcctggccaggcacagcaacgtgaatctcaccatcttcaccgcccgcctctactacttccagtatccatgttaccaggaggggctccgcagcctgagtcaggaaggggtcgctgtggagatcatggactatgaaggtgagacgtggggggctgaggagagtgggtgcaggagggacagcatgaggggcagatggttctccaatgctgtggggcgggtcagtgtcccctgggtgtctgtggggaccgggccagcgcccactgcaactggcagcctggatacctgggctgggaggggagggcccagggccaggagagaggcctgctgggccctcactgttttctccttgttttttctcagattttaaatattgttgggaaaactttgtgtacaatgataatgagccattcaagccttggaagggattaaaaaccaactttcgacttctgaaaagaaggctacgggagagtctccagtgaggggtctccctgggcctcatggtctgtctcctctagcctcctgctcatgctgcacgggcctcccctccaccctggacccgctctgtttctgcctggtcatcctgagcccctcctggcctcagggccattccacagtgctcccctgcctcaccgcttcctcctcgctcttccagactcttcctgcagaggctcctttctgcctccatggctatccatccacccccacagaccccgttcctccagcctgcgtgcccctaacctggcttttcccatctccccagcataaccaaatcttactaaactcatcctaggctgggcatggtgactcacgcctgtaatcccccagcaatttgggaggcaaaggtgggagaatcgcgtgagcccaggagttccagaccaggctgggtcacatgacaaagc

SEQ ID NO: 103728 - DNA, 1099 bp, Homo sapiens
acctgctctttaggatcatcccgggttggacacagcctcctaggcgggtgtccaaaggcagggtccacagagcttcgggactggggcgtggaggtgttgtctcctcctctggacacagggatctttgtccaatttacagaaagatgtggaagtcctgggacagatgaattaacacacgggtgcgtgagtgcagggctgtataaaccagggaaggcaggaagcgggtgcttgccctgcactaggccaggccacgcactagaaagttcaccggacagacccctctgcccccccatccccgcccccgtcccggcccccgcccccagtcacatgactcctggcctctctcttctcccctcccttctctctgtttgggaccctccccagaaaaagtgccatgcagaaatttgctttattaacgagatcaagtccatgggactggacgaaacgcagtgctaccaagtcacctgttacctcacgtggagcccctgctcctcctgtgcctgggagctggttgacttcatcaaggctcacgaccatctgaacctgggcatcttcgcctcccgcctgtactaccactggtgcaagccccagcagaaggggctgcggcttctgtgtggatcccaggtcccggtggaggtcatgggcttcccaagtaggaaagaggctttgcagttataagagtgcaaacccccgggggcacaggcttggcaggggctgggggttgggggttgggggttggaggaggttggcggggggcgggggcgggttggaggaggttggcggggggtgggggcgggttggaggaggttggcggggggcgggggcgggttggaggaggttggcagggggtgggggggtggcggggagcggggggtctgtgggaggccaggaaggaaggattgtggctcagtcaaggcccaagatctgacaccacccgggagggagaattccccagacagagcaatgtccagggagaggaagagaagagaggggaaaggaagcaagagctcctggcactgcagctgctgcccctggggcctggctggtttccctcttccctctcagagtttgctgactgctgggaaaactttgtggacca

SEQ ID NO: 103729 - DNA, 1033 bp, Homo sapiens
gggaggtgaaggctgtagtgagctgagatcgtgccactgcactccagcctgggcaacagagtgaggctttgcttaaaaaaataataataacccaagatgaattaaagacttaaatgtaagacctcaaactataaaaatcttagaagaaaacccgggaaatatgaaatactctactggacactggtctatgcaaagaatttatgattaaattctgaaaagcagatgcaaccaaaacagaaattgacaattgggatctaattaaatggagcacagcaaaagaaactatcaacagagtaaacagacaatctcccttttctaagatgctcttgtcacctccgtgtttttctccaggccttctgggcccttctggtgccagttcttttctcttcctaatgatctcatcctcacctctccctcccttcctccctgtggtgtcccaccagttggtacctcctaacttctctctttccctctcagcagtcctgaagtgtggatgttttagagaatgacttaagaagtttgcagcttggacccgtatcccactcattatcaagaagcaactcaagatgactttccctggggcatgtcagttgcctcatagcctgctggtcctgtaagcaagcactaagctccacagtgccagttccttgccccaacctggccccatccaagtacagaagaccttcctttcctcctttttccatattgctttctgttctaagtgggtgaataattttataattgaaaaaataaagataaagtctgtaaatccagccgggtacggtggctcacgcctgtaatcctagcactttgggaggctgagatgctcggccaataaatttctattgtttatgaatcacccagtctgtggtattttgttataggacatatggactaagatactgagttaaggccaggtgcggtggctcatgcctataatcccagcactttgagaggccgaggtgggtggatcacctgaggtcaggagtttgagaccagcctgaccaacatcgcgaaaacctgtctctactaa

SEQ ID NO: 103730 - DNA, 5816 bp, Homo sapiens
atggtagaatgtactgggcttctttttttttttttttttttttcccagacagagtctcgctctgtcgcccaggctggaatacagtggtgcgatctctgctcactgcaagctctgccttctgggttcaaatgattgtcctgccttagcctcccaagtagctgggattacaggcacctgccaccacacccggctaatttttgtatttttagtagagatggggtttcgccatgttggccaggctggccttgaactcctgacctctggtgatccagctgcctcggcctcctaaagtgttgggattacaggcgtgagccactgtgcctggcccatactaggcttctgatggcctgtgagcccgctgggaggagtgggttttgagtcagctgcctaccagatgtgcctcccaggcactgcagtattttcccagtcccctcccagtttagccctcctcccatcactgcagcagccggcacctggggacatgtgatgccgttaacaggcacgactgtgagtgggacctgcgtgtgtcatcccttccctcagcttggaggtgtttgacctcacaggtcccatctgatggctgcactatcttcctgggagctcctgacctctggtagcaggtggcaggagaaggtactgtcccagtgatccagagtctcccaacatcttggcaccatgaatcttttgtagattcatgtaaattctccccaagtaaataagataaatcccgacattacaaactccaggggtggacagacttgccctccagctccagatgtgtcgcgggcaatcagcagagcgggctgcaatcacagagcccaggagccccctggaggggtcggggtgcatctgcaggccaggtggagccctgtccctttggctggatagcatgggcatccggggctgtgtgtgctgctggcctggctttgccccaagcaactccaagagcacaccttggccctctgcctgcaccatctcccgggtgagctggcagtgtcagttttggaggtgctctggcaagcaaagatgcctttcctaaaacgaaggctaactccttaatgcatccagatttgtttctcttggccagttttcagtttgtccttcttgtatgcttctctgctgggtatcaaaggagtaaacgctgggacgcgagtgctctgtggggcccagaggcagggctgagctggccgaccctggggttgcccggggcgcactctctgggctggggtggggtggggtgatggccagccgtggcatgggaaggagttgagtgggtagacatggcatgggaagggcattccgggtgggaggaacagcatgagcaaaggtgtggcgggtgggagggtggggctgacccgcgctgccctggcttgcccccgcagcggctgtacagcatggacctgcggagctcccacaaggccaagggcaaggagaagctctgcttctccctgacgtgcccactcggcagcgggagccctgagggggtggtcaaggcgggggcacctgagctggtggacaagggccccttggtgcccaccctgcccttcccgctccgcaagccccgaaaggcccacaagtacctgcggctctcgcgcaagaagttcccgccccgcgggcccaacctggagagccacagccatcgacgggagctcttcctgcaggagccaccggccccagacgtcctgcaggcggctggcgagtgggagcctgctgcgcagccccctgaagaggagggtaaggcggccccagcccagagaccctcagagctggaaagggccctatgggtcataaggtccagctggttcaatgtccaaagagggcctgtagtgctttgtggggccagtcgggtctgggctcagggcccaacactagcccagggctcctcctgtcgtcccgctctggctgagctcttgtctaggtggggaggatgcacccagtgccctcctcccaagtgtccagccctgtgtgaggccctgagctgactgaagacacagagaggaggagctggagttggggtcgggttgggtggtctgcatggcttcccaccttgtcaacgctgcccccatctgtgtgtctgacgctgcagcagatgccgacctggccgaggggccccctccctggacacctgcgctcccctcaagtgaggtgaccgtgaccgacatcaccgccaactccatcaccgtcaccttccgcgaggcccaggcagctgagggcttcttccgagaccgcagtgggaagttctgaatcaccgtttttactcttcttaaactgttttcttttgggcttggggtgggacttccagagatagggatgggttgggggcggggtaattattttatttaaaaaaataccgagcagcaaaaggggagaagatcccactactctcccaccacctgccctttctctgagggacgtttaccacgaggcctcaggctggggatggagagagttgctctgggagttggggtaccacccccagggcaggatggggacaggatcacctgcccgggacaccaccattatcattctcctctagtgacgcagcagctggttctgggagttaaaggagcattggaaggcccaaaccctctcccttgagtggccaccccagcctggttggctggttttccccttttctcttgtttcaattgggtctttaccttgaactctcctctctggctttgcggtgggctgtggaggctggttttgaccaaaagtgagtggggcgggaggaaggggcaggaggaagggttgaggttacttggggcgagtcccttccccttcagagaggcttctatccttcccagggaggaggcgccgctgagacccttctgctgagagctctgccctcccctcatcacctggcctgtgcagaaacgctcatgcacacctggctgcacaggtgtgcacgcattacccttcgcgtgtacgttcccatgtgccccgtgaaagcatgtgtggctgcagacgtgtccacatgggccttgcgaacctgggttagaaaccctggccaggcgaacgtggggtgattcacagcacaaaagacctcaccaccacacctgcactcaccccaccttgcatgcaccttgctacctgcttgcggctttcagtggagggcaggggtctggcacaggtgcgatggcaccccatgctccaggcatacagatgtggtttctcggctgcaccgggccaggctgcgggtgtgcaggcgtctgctaagttgtgtgatgtatcagcacaggctttgagacgtctggaccctgtccttcctcccgtgaggggttcttgttctttctgactcaggtgacttttcagcccttccaattcccctctttttctgccctcccctccaactcagccaacccaggtgtgggcagtcagggagggagggagtgtcccaccacgttctcagggcagcccttgactcctaagccccttcctccttccattctgcatcccctccccatccaacctaaatgccacagctggggctgagctgtattcctgtggagggacctctgccgtgcctctctgaggtcaggctgtgctgtgtgatgggcaggctttgccccagcccacccctggcaaggtgcacttgttttctggtttgtacaaggtgtcctgggggcccgtggcttccctgccagtgaggagtgacttctccctctcttccagtcctgtaggggagacaaaaccagattggggggcccaaggggagcatggaaaaggccggctcccctgtctttccttggctgtcagagtcagggtaacacacaccaagagtggagtgcggccagcaagtttgagacctgcccgccctcctcgcagctctgctctgtgtcctcaggaagtcacagagtctactgaggcaaggagagggtgattctttccccaaatcccttcttccctggttcccaaaccaaagacagcctgcagccctttctgcatggggtgctctgttgacaggcttcccagatccctgagtctctctttccttcctcctcgatctttagttgtccacggtcaattcagtgcttccattgggggacagtcccctccgggatgacctgattcacctccagcccagggaatggaatctagaggaatacgtggggtgggtctggacaaggagcggcaggaatcaccacccatctccagctgtggagccctgtggaggggaaggggaagcttggggttcagaggggactcttccaggagaggggtgcccagcggaggtaaagatgatagagggttgtggggggtctctagttgaatgttttggcccatgactttggaacatggctggcagcttccagcagaagtcacgctccccatcccccaggggacataggacctttttcctgcttcctggtcactttcaaagaactatttgcgcaatctgtgggtctgtggattcacggggctttctgtgtgggtgctgcagttgcttttgtctgcagcagcaggacacatctttcctcttactcagccctttatggcccatggggaactccgtggctcagggagagctgaactccaggggtgtgacctgggacgggtgggcctgaggtgcccagctcagggcagccaggtggctcatgggctgtagtgagccagctccctgggggaaaaggctgtgggccgttaggaccatcctccaggacaggtgacctctatgaggtcacctacggctgtggccgtgcaggcctccttccagcccagagtggcccagtagagcaaggcagacagtgacctccacccccgcagccctcttaaaaggccagtactcttgggggtggggggagggtttagaaagcatttgcccatctgcctttctttcccccagcccccacccgctttgaatgtagagacccgtgggcacttttccttttgtggtggggggtgcggaggaggtacccccacccctggcacagccgcctggaatgcaggactgtcactgctgttcgggtgatgacctcgttgccaagctcctcctgtccccttgttctgggggcaggcgctgtgcttctgtgaggtggtttagcttttgctttcgaagtggccagctgcggccaccaggtctcagcacaagagcgcttcctttgcacagaatgagcttcgagctttgttcagactaaatgaatgtatctgggaggggtcgggggcacgagttgattccaagcacatgcctttgctgagtgtgtgtgtgctgggagagtcagagtggatgtagagcgcggttttatttttgtactgacattggtaagagactgtatagcatctatttatttagatgatttatctggtaaatgaggcaaaaaaattattaaaaatacattaaagatgatttaaaaaaaagaaaattcctgggcatttgattattccttctggtggttgtcaagtgcatccgtccaccaacagactttgtgcgagcaacaaggctgtttatttcacttgggtgcaagtgggctgagtccaaaaagagtcagccaagggagataggggtggggcagttttataggactggggtaagcagtggaaagttacagtgaaaggtggttagctattgtcagcaggggagggggtcacaaggtgcctgttggggagatcataatactcattgtccggaagaaggtcaccaggtcgatcagttggggcagggcaggaacaagccataatggacctgcaggccatctggatgtatatgtgcaggtcacaggggttacaatggctgagctgcagctcagaggccagacagtggtgtccccactgtgctgaagaaagagcttcagcccctggcaatgcctggggtttag

SEQ ID NO: 103731 - DNA, 1068 bp, Homo sapiens
tcatcaagacgtcactagatgacaggaatttttcagttccgttgtaattttatgggtccaccattacatgcgcaggccgtcacggacagaaatgttattcggcacttgactgtacatatattgtttttaatggaaaagtttttatgtttgcgtcgatggtgagtgatactggtttttccatttatggaagtcatagtttgcttttaaaataatttaaaccaaaaaagctcctctaaaggcagatacgaagtaaacaggagtgctagtggaacgagggtgtggtgggtgtcaccacggtggttccacagataggtgagctctggagccgctgcgctgacatcacagggtctgccccagcaggagggtgctccctggctgggtggcgagggtagaagatcccctgtagcattacccgggggcctgcgctaggcctgctgaaccattcagccactagacatttaccaaatacctgctgtgtaccaggcccagagacaagggaacttcagacctggctgtggcctgggtggggtgcactgaagagggagactatgctggggatggggatggggtttggagggcggggaggaacagcaacagcagcaaacacagtgcgctgacgacacatcaggcacgctgttactcttgtaacaccctctaaacacttggaatacacatctcatcagcacaagagtcctttacagagggggacattgaggcacagagctgttcaggaagttgctcaaggtcgcacagctagctaggggcagagatggacttgaacccaggccgtgagcctgtccccagagccctggctccttttcatcctctcttgcctggtgtggggcttacaggcgccctctctcctcctggcacccgagggtctctagtgattgtggagtctaacaaggagttggacccagtcacattgtagagtgatatgaaccaggacaactctggtgttgctggagccctcaggaggcccaggctgggtctgtccttgaagtaggtgacaatgacaccttaccaggacagggtgaaggcacacttgcagtgggcactgggtcagca

SEQ ID NO: 103732 - DNA, 1126 bp, Homo sapiens
aatgaggccttgcccagggtcatagagctgggcagatgtgaactacgggctgcctgatacacaggcaactccactagagatgactaggactcttgcctgctggccttttggccagttcagtgagaagtgctgaggctttccacctctgaaggtttacagctgtgtgacccagggcaaagccctcaacctctctgtgcctcactttccccacctataaaaatgaggccctaacctcacagggccctgctgaagattgcctgagacaagacaagattcattaacaccctgccaggggcagagtgggagctgtctccacccaggctggggagactggagttaggagccgcagacttttacgctccctgggcttttcattgatttaactcaggcttatttgccttcactgtgtaccacactgatcgaaatgctttccgtggcttaacacatctaatcttcactacagccctatacgactggggttactggtgggcccactttaggatgaggccccagagcggtggcgtctcctgaacgaggccgcaccccgcagtctggaccagagcccgtgctgtgtcttctgtgcagcagctttaaatcggagtggggactggggcttgggggttggcctggctctgcggggttccgggtggttccacctgccccaaggccgcctgcgtcacagctcagcagcgcctccaaaccccgcttcccccgaccccccgggaaaggccggcgggggtcctgcacccgctgcgccccttcccactgcgtgccctcaccgcagcagggcgagccctgcgcggcggggctttggctgggcggccggggcttgtttacccggccgtggggcggggcggggaggtcacgtggccgtgtttatctcggagccggcgcgcgccgtccctgtccccgcccccgcccccgccccctcggtttgccggtaatcccggcgcgcgcccctccccgtgcgtgcgtgcgcgcggccggcgggggcggggcctggcgctccgccccctcccacggggtgatcggttcccgccccgccggcgccgcgagcccagtgcagacccccgcagtcccccggtgtccacgccgcggtccgcgcagcccaggcaacgagcgtgtc

SEQ ID NO: 103733 - DNA, 1032 bp, Homo sapiens
ctcacccccctccactttggtcctgggttctaggcctggctgcccacccgacaggcatgagccctgggacagggccccaccatggctgggtctctgcttcctcatcttcgagttgagatggtgaagcctcctttgcaggctactgtgagggtgagagggtggatgtaattgagcgaatgcatgttcagcccagtccaagtgctttagtaaacatttggttttaagattaagttagatagatagcctagctgttctttttgttttccccagtcaggaaagggacctaagggattccattcttctcaggagtgcaaagtatccttagaaatcatttaggccagtcctctgatttttcagatggggaaactgaggcccagagagggttggtccttaaaaaaatataactgccaaccccatgcactgtggtgcccacttcatgccatccacagtgccaccacggtctgggagtgaggcaggtatggctgctaaccatccccacctcacttgggggaaacagaggttcactctgggggagaagcaggggagccagctctgtcttcccctcctcgggggccctgcttggagaaaaagctgagaaagagggtggggggtggggagttaggcaggctgtgtcctccaggcctgggagccttggctgggcagtgccggcctgggtggggtagtgattctcctgctcagcatctgccctgtaggtggggagacttacattcttctcagtaacagtaacaggaaccatgatttaaatggacactctaggatgggcatggtggttcatgcccgtaatcccagcattttgggagactgaggtgggcggatcacttgaggtcaggagttccagaccagcctggccaacatggcaaaaaccccgtctctaccaaaagcataaaaaattagccaggcatggtgatgtgcgcctgtaatcccagctacttgggaggctgagacaggagaatcgtgccactgcactccagcctgggcaacacagtgagacgccgtcccccacaaaaaaaa

SEQ ID NO: 103734 - DNA, 1996 bp, Homo sapiens
actttctaacaaccacagggctgaccaccccttctgaaggtggagactttgccagtcttccatggggtcctgccagggtcttttgagttgagagtcctcaagtcactggcccattacctctgagccagaggcagccactcacagactgaaaggggactcagcagatgggggaggagcgtggggactaccccagagaggaatgttttcgtatttggagactcttccaatctaaaaaagaaagtaagcgttcccacctgtgcactggggctctagacactgtgggtctttggccacgcatgcacacctccatgcagtctcagctcccagtgtgtgacatgagccctgggcttgggcctcaggagcctcagaggtggctggagccagacgcactcctgtgctgtcctagggagggcagtatggggcgggcatgcagcagtcgcggttatatgggttggcgaggatctggtggacagtccccggattgtgtttgtgtgttggggagacacctgtctgcagatgggatttggagctgggctcctttgggccttaactgtccttccgagtggctgtaggggcaaccacgagactcactgtgtctgcttctctctcttctcagggtaaagtcgagtatctggtgaagtggaaaggatggcccccaaagtaagctccttcatgtgtgtgtgtctgtctgtctgcctaccgacccatgcattcctccacctgccttttgccccctcccctgcctagcttttagctccagctactcttgtaactggacagctgaccttgatttaatcatcatcttctctgggcctcagtttccccctggaccacaggagggtcaaggtgggtctccagcttctcttctcaccctgccctcctgagtgttgagctcctctgctagttggagcttctgctctccctcctcccctccctgtggcttttcttggcaactgggaggtgaaggcccagcatccgggctactggagatggctgctggacaggaggaggggaccccagctgctttaagcacagtgctgcatgagtcctcagtgctgtgtggccaggggcagagcctgaatccccctcacctctagacggcactttccagtctatagagcaggttcccatacagctttgtaaggtaggtgtgatcaggcgctctcaaggtgaggaaacaggctcagagagggtaagcagcttgccttaggtcacacagcaagtggaggcagagttgggacttgaactaggccttctccttttcaggtgtctcctctgtgccttcccagcctcccatctcggagttgggaggcagggagctgtatctgagacctcccagcttctccacctctcctgctgaggccccatcaggaacccaccaatgccctccagcagggagttgttgggagggaatgagctagtcgtggggcctccccattggtctgtgggtgccccaccccctgccccgcctcccggagactgagtcctggaaaccccctctgcccagagctgctgctgtcgggcagggactttttgctgtgctggtgggggctgacctggtatggggtcctgtgggcattctggggtgatggtggggagagacagcagagaggaagacagcccacagtgcctcagcttccctctctgcaaaatgggttcagaaacccaggccctgcactcatctcacaggcttggtggccctatcggatgaaaggcctgggcacatgttctgggtgacctgtggatatcctgatgacaggggttgggagctggcaggccgagaatacactccacccctcacaccaacccccacttcagttctcccttcccgaatattctgagggctgaaggagaatccctcccccgccacacccagctgctagaaggtgggcttccagcctgagtgaagggggcagtaaagggagtgacgatgcccagagtgggcagcaggagcaccgcctccctgggcgcgcacacccctgcctctctcgcttcg

SEQ ID NO: 103735 - DNA, 1130 bp, Homo sapiens
gtctcgtgccacaaatggttgagcccccactaagcacctagcgcccagtacacgcgggtttggggaaggctggggcagcgcggcggcaaaatccgtccccgggggacctcagctccaccgcggccgctcctgccgcgaacgagggcccggcccgggagccctcgaggcagcgcccgcgtctgacccgtgcgtctgggcaccgaccaccgagggtcgggtggatggacaaatggaagggcggatggaggggtgggtggacggacgtggagacactggccaaactgcgccgcggagaaggccggattagggagacctcggccctgcgacgtccggacacggtgggaagccttttgggtcccggctctcctgcaactcgaggggctgcgcctcgggcccagtctcctccgctgcgggaggtgagcaaatggcctccccgctctgagccttgactttgtcgtcggctccactgggccctgccacttcggcccctggcagtcaccgggaggctatgaggcgcccgcctgggtattaaggatcacgtcccgccccggcgtcacagcaagacggggcgcgcgagcctccgccccgccccagccggtgaccgagccaaataagtcccacggcagcgctcgcggctcgcggcccgcggcccaatcgcaacccgcgggggcgggccccgggggcggggttccgatgggggcggggctcgggggcggagctgaccctcagggcgcgagccgagcccgcggccgttccgcgcgctcccgccccgccccctccttgcgcgcgctcgctcgctggcgccgaggaaaacgttgcgcaggttcaaaaatggaacgtcggcggcgtgagggagcgcgagggggtgtgcgcgcgtgcgcgtgcgcgtgcgcgcccggacgagggtgacggggaccccgccagccccagcatcgcgcgccgcagccgcggccccgcagctccgcccccggcccggcccggccccgggcccgctcgcccgccgccccgcatggagctgtcagccatcggcgagcaggtgttcgccgtggagagcatccggaagaagcgcgtgcggaaggtgaggctgcccgggggcggctcccaggaccccagtggggtccctcccgtcc

SEQ ID NO: 103736 - DNA, 1053 bp, Homo sapiens
acacttttcattatgaaatgaccttatttatctctagtgatgtttttccctcgatattaaaataactgcaccagccttcttttcgttagcatttgcgtggtattttccccccatgtgtttacttttgaccatcactagctttatgttttggaagtgtctcttgtgggtttctcttgtaaactgcatctagctatttatgcattctgataatctttgtattttaactgcaatatttagttgcatttattgaatcacaaaatattcgaatttatagctatcgtctatttgtcccctccctgccccgtcttgtatttatttttctctccattcttgcctgctttacagttgtttgggttggtttaatcattctttttcctcctccaataatttggataactatacacagtatttccagtcctacagtgtttatcccagtaatgacaatctggattcttaaattcgtcaaagtgtatttggtatctatcttcaccttcctcctgaagaatataaggatcttagaacactttaactccattcacccaagtaaatgccatcactgttgtgtattttaaatctgtttttatccagaagtcattgttattgtttcacactatcgctgttcttcatttttctttattcccagttgcatcagacctccgtctgggatcatctttttcctgcctgaagttccagctttggaatctccctccggagggtctaccagtggcaaactcttaagtttttgtatttgtaagtgctatgatttcacctacgttctggatacatgtgcctcatactgggtacataattcttgaaatacattttcactgaatatataattctaagatgatggttattttctctctggctttgttgctcttgatgaaaagtcaggtgtgaatctattattctctttttctatgtgccagaaagaggtgttggattttattgtgagggaaatagggaggaaaatttttaagcacagggtgaccccgtcagatctgcattttagaagcacactctggcactgtgtggctgagatcggagggaggg

SEQ ID NO: 103737 - DNA, 1007 bp, Homo sapiens
tgccattgcagaacagccctgagctgagagccaccgaggggtcgttctagggagtgacatggtcagtccactgccagtgcgagatggtggaggtggctgaagtgagaggtgctggtggctacgtcttggagggtggttggtggttgctatagagactgggagaaggggatggtgagaggtggagggaggtgagccagaggaggccctggaacactccttgggtacctggcttggctggctcagttcacctggacaggtactggaaaaaggggaggaggagggggaggaagaagtgacttgggagaagaagagggcagggcgctcaggtctgggtatgttcagtttgagaggtcgtgggacctccaagaggagccatcctgggggcagttgcagcgggatgtgtgatgtaattagggaataactcgcagtacctggtgacctgtgaattagggggaaaagtctagaatgttcccttgagatagcctaagacggtgcttctcacaaataaatgtgcaggtgagtcccctgggggtcctgctacactgcaggttctgactcagtgggtgtggggtggatcctgggaatctgcatttctgacaagctctcgagtgaggttgatgctgcaggtctcagaccacactttgaggacagaaggtctaagacacttagaggatggtggcagttgtccttgacatcaggaacccacatagaggtggaggtgggtctgagagtttgggtttttacaagctctacagataattttgatgcctgagcaggtaacgcgagccagacatgggtacagacatactgggggtgggaaggggtggctgcataatttgtggggtcccatgcagaatgaaaacatggagccctttgttcaacaattgttatgaatttcaagacagcagagcattaagccacatgcctggccctttgaggagggaagtcctgtgtgactgactgaccacctgcccatgaaggtggtcctcctggggcgggggtttgag

SEQ ID NO: 103738 - DNA, 1004 bp, Homo sapiens
tgttagcccagtggttcctgccaatgattggtgatagagctggccttgcagggcccggttggggagtggggaacgggatgcttaggcgaggaggctgactgaggttcagagcctggctccaggtggtcagagaggccacctgggggaaatgggccagaaaatgcggacgggactttgttgggtaaggacaaaaatggtagctgttccactcaagggcatagcaggagcacaggcgtggcagtgagaaagcccagggtgttctggccacgggacccagatctgcacacctgtagtcaaagttggtgtcacaagatagagagatcccatggaaaagaggctggaaccagatcacagagggtcttcagtgtcactgccaggagtcgggagctgacaccctaggcaccggggaactgctgggggcttttgaccagggtagtgatatgtgcagccgggtaatttagggtgacgcctccgtgtggattaggagtggaggatgcaccaggaaacagcataggatgggaggtcagaatctggggtctgctgaattggcttcttttcttttgaacttaataataatgagacataataggtgttcaatcaggccgggcacagtggctcacgcttgtaatcgcagcactttgggaggccgaagcaggcagatcacctgaggtcaggagtttgagaccagcctgaccaaggtggtgaaaccccatctctagttaaaaaaaaaaaaaaaaaagtacaaaattagccaggcgtggtagcacacgcctgtaatcccagctacttgggaggctgaggcaagagaattgcttggactcaggaggcggagtttgcagtgagctgaggtcacaccgctgcactccagcctgggcaacaagagtgaaactccatctgaaaaaaaaaaaaaaaaaggtgttcaatcaatatttatagaatgaatgaatggcaaccaccttatactgtgatatttattttgcatacgttgtcttgtcaattctcac

SEQ ID NO: 103739 - DNA, 1041 bp, Homo sapiens
cggaggatgcaggggtctgtgggggctggctctgtgtgggttcagcacatatgagggcctactatgcgctaagggcttcatgtgaattaactcactcagtctcacatcaaccctgggagcttctgctttgcagatcaggaaactgaggctcacagaggctaaggagcttgaccgaaggccctagctagcaagccgcaaagccagtcagactctgatacccagactctcagccataggccaggtggccccaactcaactgtggccatgggggcatggcctgtgccctcacatggcacctgtgggggaagggcacgttgttcccagctggtcagtttcaaaggtggcaaaggtttgtcttagagatgcagagtccggccctgcccccggggctgttcttgcagatctcagcaccatggaatcccagagtttgatcaggatacagaccattggcaccaggaggggctcctctggaccctccctaatgagcaggggaggccgtcactctggaggttcagggataagaggtggggctctgagaaagctgaaggggggacacagggtaggggagagagcggggctagctgcaccaactccagccctgggatcctagaggtgccgcgccccgccctgggctgcacgcccatcacctcccttcgaggccagcccacctcggccctttggtttggctacaggtctggggcattaccctagcagggtcaggtgcaggcagagacgtggagaccctagccttggatcaggccttgggcgggtggagaacggagaaaatgcagaggcacgggctgtgctgccaccctcgcaacccccgaaaccagcccaaagtgattggagaccaagggaccatctgcacgagaaattctccccatttagaaataggggaaactgaggcacagggaggccatgtggcttgctcagagtcatagagctgtcacgctgtcacctagtggagatgtgattggaatcctgggctttctgtctctggcccccacctgggggcccctcacggttcctctcttctcccct

SEQ ID NO: 103740 - DNA, 2116 bp, Homo sapiens
ctgggattacaggtgtgagccaccatgcccagtgagtttattttattttagtcatgttcatttgttttctagttcatctttagtttgatttttacaacatttattctcctttttctgattacaaaacgaacgtgctcattgccaaaaacattgaaaatacaccgtaaatacacaggaaataggaaattactcatgatttggctgcgcagagatcactgtgattagcatttggtgggtcactttgacttcttctcattgtgcactttcccttttagtaaatcttacactgggaccatttcttatgtcctcactcttcttcaaaggcctcgtatttgatggctgcataatattccatttcgtcattttatcattatttaatcaagcgtgccacacacagatgatcgtgacaccccctgtgcccatcctcctccacagacacaacccctggccacccccgcatctgtaaacacacccggccgtgccgcagtggcccctaagcctcacaattgaggtgatttcccagaggaggctgaacaatgccctggacatgtggacccagcagggtggggttccagccttttcctcctactgtccctcagacagacagagagacagacagatggccagccagccagacaggcagacaggacaggcgggtgggacaggcgggtgggacaggcaggcgggacaggcaggcaggaggcaccaggggaaggcggaggcaatagcgttgggggtgtctggccttttgggggggtcaagtggtagggagatggggtccttgggagcagggccctggcctggatgggagctgaactctgcagggtgagccctagagaagagcaggtaacagggagggacttcctctgcttaatcctctcaagggcaggcagaaggaggtgactgatggtctcagaaccaaacagttgaatttcagaatcctgggaccacagaggactgatgaggctggccccagggaccacatcctctaaccctgtgatgatcaagtggaggtgcagaggcccagggacttctcaggcctcctgactccagcaaagagctgctcctgcctctcgctgtggcctggaccaggttgctctggtccctgtgcccagagccaccgtgagctgttgaagtgggaaatggggcctgcagtgcagatggagctggagttcccaggactgggcaggggcttggggtggtcctcgagccagcaggagaggggagggagagggtgggaggctagagactggcagcccagatgcatccatcccactgcagcccctcctgcctgtcccctcccggccctggaagacccctccaggctccccaagggcagagggcagcatggggagcgggcttggtctcctgcagagtggaggtctctgaagcctccagctcccagcttctccccagactgctctgggcctgaaactagggggcgtttgcagaaaaacatggaaaagaattaccctagtttctggtggttttgcagaacagcaagtccccggattcccgggtcagcttgaccgagctagctgtgggatcttggacaaggacccctttcctcctaggaccccaaaggcactcccagggtgagggctccagagcctgaccgcccccaggccctcccctctgaatgttcgaatcctgcataccatggctgcgtggcggtgggaaccactatatcccaccaggcccggcccagtgcggagaagggatgggctcctgcccttagccagaggcacaggctctgcagagaggcagtgatgatgccatagagcgtgacaagggcagcaatgctggggttgcccaaggaagggatcaaagtctcccatcttgcagacagagatactgagtcccagagaggggaagtggctgtctgggcactggagactagaacccaggagtcttctacctctcccctcttccggctctgaccccgagagcttccctggggaacggtaggtgggctagggagccccataaggtagaactgaaagcagaaactcctcccctgttaactgactcctcccagagcccccgaatctctgcttccagggttggggttcatttgcttctgcgatagtctgggatgggtgggactggcacaaga

SEQ ID NO: 103741 - DNA, 1027 bp, Homo sapiens
ccaccccaaacctgccatccccagctggccccatcagtttcagtagctctgtccttccaagtgctagggcccaaaccttggaataggccttgaccttctctttcctttaccaccacccttcatcagataggccgtactgctgttggctccgccttctgttcctcgccctcaccagggctgctggcccagcctagccccaccagctcccctcctacaggctgcttaagcctaagtcagatcatgtgtttctctgctcagaccctccccggctcctgctccggtcctcactcagagccgcagctcaggtgcttacaaaggcctgcaaggacctatgggatttcaccctgactctgtctgcttgggccccctctgctgacagccctcctcctgcagagcccagcctcagtgggctcactccctcacttccttcagtctgtgaggccctccctggtcaccccacatcaagctacccccacctctggaccctgccccatccttccgcacagcaccaacttctattccctttactcattggttgctttcctgcccatttccctgcatttgaatggaagctgcacagtgcctagcgtgtggatggtattcaagaagtagttgttgaattgaataaatgaatgagtgaatgaatggctgaccattccctgtgttctttcctgaggaatgcccacttggctaagaatctctctccacccggcactccagacttgtagcgagttgaagctagcctatcttccccacgctatacttaaactgagctcgtgcaaccagcggaccctccaaccaccaccggccatatttcccaccaggaccacatcccctgtccccagcctctgtgtgagccgtcacctcctccctgaaggcctcctgattcatccatgtctccctctctccggtgccctcctgagggggcctcatgactggtgactctcccaccctcctgatggacggttaactcgccaagggctccgtctccttcatttctgtaaccccggcactcagcagagcctct

SEQ ID NO: 103742 - DNA, 1371 bp, Homo sapiens
ccagtggtggtgacaggagcttcaccgtcaccatcaccttgctgcaggagtgggcacaggtatggctcagttctgctgccgtggagtgggggtcctgggagagctcaggctgataccctggctttgccccacctcacggtgaccttgggtgagtcacttgtctcagggcctcagcctccctgtcatagcaagggagtcatccctacggagccgtgctccggtgggtagtgggggaggaagcgtgcggacgtggaacacagtcagactcaaacggaagagtcatctgcttttgttatgtgctacctgtttggattcctcctggcgcctaggttgaccctttctgttcccttttttggtgttaaggaagcgtcggatcacttccccgtcccagtcttctccagcctgcacttttcccagcttaatcagtctccagctgcccaagcgtcccaagcaggccctgggttcccgccaacagcggctgcctgcatcccggggctccaggccgggccagatgggcagctggtactggtggcaggaaatagctctgatggggagactgccccctttctggtgctcaaccacttcgtctctgacagagcatagagtctccagaaggttctactgggtggagccagggacatgctttgggtcttcgtccatcccttcctctctcccaacaggacccagtgtctcccagcccagggtggggtagattctgccccgccccaggtgggctctcattggcctaagacaattactatatcccatctggtggccattgtgattggttcagggatggctacaaggctgaagtcaggccaatcagagcaaagatatctgagctccccgggaagaagactgtctctctctctccactgaacatggagagaaggacaatatctacacccggattggatcctgggcaacatggcgaaatcccatctctacagaaaaattagccaggcgctgtagcctgagcctatagtcccagctactctggaggctgaggcaggagaatcgcttgaccctgggaggcagaggttgcagtgggctgagatcatgccactgtactccagcccgggtgacagagagaccctgtctctaaaaaaataataataataataacaaaaaagagtctgggtgcggtggctcacgcctgtaatcccagcactttgggaggccgaggtgggcggatcacaaggccaagagatcgagaccatcctggccaacatggtgaaaccccgtctctactaaaactacaaaaattagctgggcatggtggcacgcgcccatagtcccaactacttgggaggctgaggcaggagaatcgcttgaacctaggaggtggaggttgcagtgagccgagatctc

SEQ ID NO: 103743 - DNA, 1051 bp, Homo sapiens
tggctttattttaccttcttctgatgaataataacacttttacatatttataaacctttttttttttagatgaagtctcactctgtcacccaggctggagtgcagcagcgtgatcttggctcacagcaatctctgcttcctgggttcaagcaattctccctgccttagcctcctgagttgctaggattacaggcgtgcaccaccatgcccggctaatttttgtatttttagtagagatggggttttgctatgttggccaggctggtctcaaactcctgaactcaagtgatctgcccgcctcagcctcccaaagtgctgggattataggtgtgagccaccgcgcccagcctggagaacctcttttgtgaagggcctgctcaaagtctcctgccccctttctactggttgcctctgtttttcttattgatttgtagaagttctttacatatttgggatatgaatgctttgtcaggtactcgttttgcaaatattcacagaaggattctaaactaggaactgatgaggttgaactgcatatctgaaagctccctctggctgcggtgtgcagcacagactgactgtgagaccaggaaggggtggtggggcgaccagggcagcagctatgggggtggacagaagggaccagcggcagagctgacaagaaacatctgccacatcgtgtcatgacaagaaacaagatgtacatggtgacaagggaggggggcagcaaggctgacttccaggcctctctggctggctgctgagctgacgcacgctctgcaacccggccgctggcagccaaaggccgctttgtctatgcaggccccacccaggcctgctggtggagatgctctcgggtcaccgtcaggacactggagagagtgcctagtgttgaatctaagtctcccgtggcaactaggggacaaatagcctcccccatggcaggcgggtccccagaagaccctgtcccccagatgggttggcatctgtgggatctggacacagtcgggctggacaatgacctcctgtctacagcctccttgcccctgct

SEQ ID NO: 103744 - DNA, 1032 bp, Homo sapiens
ttgaacacatggccacaggcgcgatgtatgtggcactttgcagtttatgaagcactttgctgctaagcctgagtgagcctcaggctggccctgggggaggggacctgcatggggatggaaccacgcaggggtcagtccaggaaggagctgtaatggccagtgctgggagagtcagggcaggcctgctggtggaggtggccttggagctgtccacgtcctggtcgtgctcggactaatctttcagcagacggcaggcagccgtgaggcagggctgggtggagggcctgccgaggcctctgaggtgccatctccaccagctgagctggcttccaggagggcgagtcccactgtcacgtgacgcgtctggcctcagcacacttcttccgggaaagagtgaagggccccactgccctttgccatccagcttcctctggctttgctaatggccctagggggcaggagaccaactgctggaatcccagagccctggaggtgtgcaagggcaggtcaaacagaatttggaggatctggtgcaagagccaggaagagagagagagagagagtgtgtgtgtgtgtgtgtgtgcgcatctgagagagagagagagagagactgactgagcaggaatggtgagatgtttatcatgggcctcgtaagtacctctccacgtcttgtcttcccctccccacattgaggagcctcttctgtgacaactcttcctatgttctggtttatttcattgtttattacctgctttctctactggagtgtcaaccccattagagagctttcctcctggtccccacttttagaacagtgcccagagccctgtggacaatcagtaactattagtgcaaagaacagttagtgctgggttggtggggagggcaggacctggccccctgttgctccatggccccactgagtcctcgctttgctctgctccgagggcagccccccttttcagccctctggtaggcatcagtctttcaaagccccccatcttgagagagaagcatgtctgtctctcctct

SEQ ID NO: 103745 - DNA, 1071 bp, Homo sapiens
cccggccgacaggtggacgcggcgcgagtccgtcggtccgtctgcccgcccgctcgccgctctgggcgtcctctgcgggctgcgggctgcgagctgcgagctgcgagctgcggctgctccggttttctctttgcagcgaggctggagggtgggcttttttttttttttttcctttttgcgcgcgtatgtatgtgtgtgcgcgcaaagtatctctatctagggaatgaaaaatgggcgctggcggccggaggggagccctagggaggcagcgggggaggctgcgggtgcgcagggaggcaggcaggccgctcccggctgcaggaggagaagttgccaccctttcagctgttccggcctttataaaggagaagggagagtgcgagaggtgggtggagacagcctttcctcttctggcccggagtcagcgccaggaggggggggacgcgggagctgggggagggcttggggccagggcggggcgcttagggggtctctgagagccgagcaacccttcagtccatgaatctggccctggggaaaaaagaactaggggtgacccaccgtcccgcccctcagcacagtgaccatggacaggttaggagcccacgtggtctagggggatgtctccagagccaaggccaggagtccacgctcccctccaggaccagacatttccaccctggcacaggcatggcagggagggactcaggctctgcagtctgagagcctgaattcagatcctgccctggcactcgggagcttgggtcaccttgggcaagtcacttccctctgtcccctccatctagcctcaacctggagatggggctattgtaaggactcagtgttagcaagggaagacaccgcaaggtgaacccacagaacccggcagccagcgcccttcagctgcaagctgggtccgagtctcctcctcctagctggttgcctggcacaacaggccctgccagcgttggctgaatttgaatttgttgaactgcaaagtcacacaaacccccacagccctgcagcatcttcgcagggctaccaacatgatcttcccgtcagtcaccctgc

SEQ ID NO: 103746 - DNA, 1017 bp, Homo sapiens
ctcacagaggagcacactgagagagtcacacctgctctctcttcatagactgtcttcttggacctggacagggtggaacagaggaggaaggacatctcaggtggtctttacagaccactgcaggcacccacccactgctgcctaccacccagcagcgtggcacagtggcagagacacagcctgaagacacatcaccttggtccaaatcctggagtggccacttgctggacaagtgtctgcaggaaggttttttaacctctcagtacctcggtttcctcctttataaactggagatgaatttataaactggagctgggtgtggtaacaagctcctgtagtcccagctactcaggagactgtggatcgttttgagcccaggagtttgaggctgcagtgagttgtgactgtgccactgcactccagcctgggcaacagagcaagaccctatctctaaagaaataaaaataaatctataatgggaaggagtgagagagaacagagaggcatggcaaaattttagtggtgatggaaatgtttgtcatttttgattgtggtgatgggcttatgggtgtatacgtacatcacaacaaaatgtgtgcagtttgttgtacctcagtgcagttgtagagaatttttaccctgctcctggagtggtctggaggctcccatgaggtcctccatgtggaggcgctcagcaaaacaccttagcaggaagcaagcgcctggaaccttccatgcagccttcaagttcactggtggccccgcactgctccaggcactggggagacaggtgtgaaccagcctaatgcaggcccctgcctttgaagagccccattgagaaggacaaccagatgtataaacagataaattaggagacagggtgacaagggagatggggcagcgggacgaggagataacccccaaacactagatttgaagtctaacgactcagagataaaaaccctcttccaccggacagctgggtcatttgaccttgaccttctgtgtcttctataa

SEQ ID NO: 103747 - DNA, 1027 bp, Homo sapiens
cgtgcatggcacgcctccggagttatcctcgggaagaattggccattccaccaccagctcacctctctggagccccctgccctagggggggcttacaggccaaagcaggcaggcaggtagacagtcggaaagacccagacgactgtataaacaccctggggccgtggttatataagtcaataagcaaacagagggcagccggcatgagtgactaagagtcttaataggaaccaccgcagccatgggcatagtacgtgctccccgggcacagatgtgctctggccatggggcacgtccctgctgaagccacagagttatcatcgatggtcccaggtggaaggggtgttccatggaggatgggctttcctctgccccttcccccttggggcaccaggggacctccctgttcttccttggataacgacagtgctcaccacgccccctcccagctgtgggaccctgggtgagtgtgattctggaacctgtcccatttggtaatggggttaagctagcaaatgaatgaagggggttggcacaaacggagcactccatacatgggagctgtggttaccttcctcccacttggctgaggcacctgaggcacaaacctcattcagtcgcacaatctgcctcaaagggaagcaagcggcatgggaaggatcatacccctcttacagatgggaaaactgaggctcagagagggaaagtgacttctctaacatcaccctgttggttagaggtggagctgggtttgaactgaagtcacagcactcccaggaaagtgctcaaagggagggaagaatgaattaagccagaaagacagatccccccatcccacccaccagtgtgagtgagatattttcccatgtgggatctggtgggggcgtgcagggagggtgagcgtgcctgtgtgatgcggtgtgaagggcgactggggggcctgcgtgcacacaggcattgtgggtgtaaaccaatgtacactggcccgggaggaagggaggatgaaaacaccccctggcagccagca

SEQ ID NO: 103748 - DNA, 3511 bp, Homo sapiens
gagccaccgctcccggtgatgcattttcttacttagagcttgtgctctctcaaaagcaggcttgtcactagggcaagtgtaggtggctgaggtaaaaccactgcagtaccccaaaaggaactgacccaaaggacagccacaggaacattgggctggtaggggctgggatctggttgtttgcctgtggtgtgggtcttgtccgctcatcctgacagtaactcaggcaccagtatccaaagttaagttgttgctgttggcaaaaatgaaagttccttcctcttggtgaggttcagtgacttgttcagagttactggctttttgccgtgtgcttgacatcaatcaggccgcatggagctgcagttcctctgctgtgggaggagcgctggcagctggagctgagctgtgtctaccttctcctagatgcgcctgcttcctctgcgccagaagaaggcccacctgatggagatccaggtgaacggaggcactgtggccgagaagctggactgggcccgcgagaggcttgagcagcaggtacctgtgaaccaagtgtttgggcaggatgagatgatcgacgtcatcggggtgaccaagggcaaaggctacaaaggtgagctttgcggtggcttgagttgctgtgcaaacctgggggagaagtggtttcaggcccagctgttcgttgatgaggctcagagtgagcgctgggtacagcgcccgaatcggacagtgtagaaccattctctactgccttccttctgagaacagccttgtggtcagaagtggctgggatagcggagggccaggggacaacttcttaacacgttcctggaccctttgctctttgtagcctactgataactgcaaaggggagcttggaattatgttagtcagtccctgtgaatgggggagcttaaactaatggatgccttaaaaagcacccattcagaattgagttcagggtgacacccccagagcctatccagcttgacaggggagacctgtgggtaatgcacatgaaataatcttatcactccctcagatgacccagccatggttggtaattgctgagtagcaggaaggggtcagtgggaggtgctgggcgctgaggtgaagtaatgtgtatccattccaggggtcaccagtcgttggcacaccaagaagctgccccgcaagacccaccgaggcctgcgcaaggtggcctgtattggggcatggcatcctgctcgtgtagccttctctgtggcacgcgctgggcagaaaggctaccatcaccgcactgagatcaacaagaaggtgaggttctgagagtggctccctgggggtgggaagaggcccccgtgatggggagtggggtttctgtgcctgtcagtgctgcttcactgactgtagcttatgcatcacgtggacatcagtggcttgcttctcatggtcagttctggcccatcttgatgatttgtaaggtgccatcctgtagagtggctgtggtggggctgactggtgtggctggggatactagtcttattggtccctgatgccaccaccaggggggtgacaggcctgtgttgtacagcaggatctttagttttagcccagccgccttacagaaaggaacctggagggccagccagctttttgctctgaccttgggatacgctgtgactgggactgaggcctcagctgccttctagcgtgctttgcaggtcagcacactggcatgtctgggttatttgtccctaatgccccagccttacacccttcttgttcattcagatttataagattggccagggctaccttatcaaggacggcaagctgatcaagaacaatgcctccactgactatgacctatctgacaagagcatcaaccctctggtaagtaatgggtgttctgctctgtgaggccatcccaggcctcgtgcttttggggataggctgcttcctaggggctgctagcaggatcgttaactgaagccaacacaacacctagctgtgtcccttgtaagtggcatgttgtcatctgagtccactcgtcggggttggctggtgagaagtggggtctcaggctcagctgttcagtgatgaggcctggaatgtgcgctgggcacagcgcccgagacagactgcggaaccgttccttgttgccttccttctgagaacagccctgtggtcagggagggcctgaacctggaggggtcatctgcacgacaatcccctcctgggcctgtgctgatccgatgctcgttttccagggtggctttgtccactatggtgaagtgaccaatgactttgtcatgctgaaaggctgtgtggtgggaaccaagaagcgggtgctcaccctccgcaaggtgaggcaggtcctgacttgtcatgggggggctcttgtagagggaggatccaaggccacagacgctggtggccctgtggtgggagaggaaaggaaggagagggtgttggcagtcctttcacactggctttgaagtcctgagatgaggaaattcccagtctggccttgctgggctgtttgctgctttgagtgtgtcctcatctgccggatggtgggggaggctgaattgatcgtgtggcttcccagatgcaggggcgctgtgaacagtgctgaggaaagcctggctcctcgtaatcctaaatcccttcccctcttggcccatagtccttgctggtgcagacgaagcggcgggctctggagaagattgaccttaagttcattgacaccacctccaagtttggccatggccgcttccagaccatggaggagaagaaagcattcatggtgagcacctctgcctgcccccctcgctgggtgtggtggcttgggcagccgcctgcctttggctccagccggggtaggggtggtcttgatgccttaggcctctcttgtggctgtggagactggcccagagtcttggtctcctctagagtgggcatctgctgtcacctgtcatcttctacctctgaccactgcctctctccccacagggaccactgaagaaagaccgaattgcaaaggaagaaggagcttaatgccaggaacagattttgcagttggtggggtctcaataaaagttattttccactgacatcttgcctctttcttcaggagagaggctgggactggggaggcagatgggggcccttgaggtgccttgtgctccccaaggccactgccctcctttctgtagcttcgctgggtttgccttctggcctcccactctgtcccccaccctcagtccctggagggaggtaaaagctgggcctggttctgcagctgagctgtagaaatccagcctggagcagtgggcattgtgcaaatgtttgtcaccagggtgaggcagctgggtctctgctgtttgcacagcttgggtgatgccagtgctgtggagacgagaaggagacagggaggcctggatgttccctggcgcgtttgatgctggtgtgcaggcagaccgtgggtttgttacttgtttaaaaagttcatttggttttaaattaatccagg

SEQ ID NO: 103749 - DNA, 3939 bp, Homo sapiens
agggatgcccgagattaaaggtattaaaggtaaattggtgtcgccgcaaaaccagcgtgggagccaggaaacgagagtttcagtctttcttcgctaattccagagatagctgcatatcacaggaggagaagcgacgcagccatttttcttcgttattatcaaatttggctgctgccggacgccgtagatttgtggctcacccacccttagcccacctctccgcggcttttcactaagtttgaacccgacccctcgccgtagagtgtgtaatttctgtctccgaagctgacgtcaacttctgaacgaaagctaggagcggaagagcgtgcgtggaaatggcgctcggtacgtgcccccgacctgtcgtctgccgcgggggcgcgctcgcacgccggaaggggcggggccagatttggctttatatagcggacccgtaaggccgaccggcctctaccggcgggatttgatggcgtgatggtatgtgttgtaatggcggccgtttcattgtcaccggcgtcggcacggctgaatccgcgacgcatcgccgccatcccgtcttggccggcgccgggggtttgctttaggggcacgggcgacccagcggggacttcagtctggcctattttctggaaagtcgagaggcttgtgaagagcgcttggaggactggctttgggcctgcaggtcggccagagagaggccgtaagggtgggagcaggcttggaggcccggcgtttttaaagccatgagtcatttctaagtttcgacctcaccaattctatcattagttgggattagggcccataacctgcttgtctgggtagaaggaccttgggtggaggttctcggcgccgttctcattgggaggtaaagaagcttgggggaggggagtgttgtggagtcctcctgaatatctggggccgctggtgcactccgaaggcctctggagctcgcagaaaccacagatgatgaacttattgacgggcggacagaaactgtgtgctgattgtcacgttctgatttggctctgcggagttctttggcctgtgtgtatcagtgtaattagtgtccgggcaccggaggcagcctatagcttaacattgctagctgctacccagcgtttgtcccgggagtccctttctttagcggtcaaaaccttgctaattggcatataaagctgcctgttaagcagtttttagtgccactacttagtgtatttttgtgtggttagataaaaaaaatgggtcgttttcttacaggttgagaggatttgaaataagattcagcttaaattttgtcgaatacaaaagcattcttgacacgtgcgagcctggaagagataatgacctttttattcggcttgctgggtgtctggtcaggattcttcagtattgctgagatttggaacttaagcagctgggaactagagaagggggcactgctttggtttgggtgctgacggtgatttttttcccacctagtctcacagaaagttctccgctcccagacatgggtccctcggcttcctgcctcggaagcgcagcagcaggcatcgtgggaaggtgaagagcttccctaaggatgacccgtccaagccggtccacctcacagccttcctgggatacaaggctggcatgactcacatcgtgcgggaagtcgacaggccgggatccagtatgtacagacatcctaaaagttgggggaataggagtggagggggagggaaattgtagagatggagtcaagctgttagcagagggcagacttttttttttaagcaggagttacacgttgtcagaactgctgcgacagcagaatgggaatgcttaacttgaaaactaatattccaaggctacagatggtcagcactgtttgctttaggtgcggtgtggggtattgatttcagagcatagtaaatttgccaggaaccttagcaaagagaagttaacactagtgtggggggttggagctgctgaggctggcataagaactgcctcattcatgtttttttcacctgaaagcttgaataatggccacttacctgtgtgtgttctacttagagatgtctaacagcactggttgctgagccatggagacattaatgttaggcagttgatactgactaatctctgagctcagagctattgttagggcactgaattttccagataaatagcaatcttgtctgcctccagaggtttctgtagaagagaattgaagctggacaggtatttggctgtctagggtcctgatattttttgtttgaataacataaatgtgctttgaatgagagataggcagtaaggacagccctgtgagtccgtactgcaggtgtggggcccagttgcccttccggcctaaatgggcactttgcattttcctagaaaacattacaccccttgcttgggctcctgccaagtctgactactgctttttttttgcagaggtgaacaagaaggaggtggtggaggctgtgaccattgtagagacaccacccatggtggttgtgggcattgtgggctacgtggaaacccctcgaggcctccggaccttcaagactgtctttgctgagcacatcagtgatgaatgcaagaggcgtttctataagaattggtaagggaggaggccatgcagtccctagcttgggagcttgggagctggagagcagggagcagcgtgtgcatggtttctcagctctgtagcaggcagggagctgctgtcttgggtttagtttgcctctcgaacagaaaaatacctgggatcagacttggccagccatctggtttcagccggaagctaacaccctcattctgagtccaggctagtgggtggtggctgaggacccagttggttgaggagtccaactagaaaccaggagaggtagcagaataattaaacccctataggggtggcaagggcctctggccctgggtggaatgtcccatttccttcatcactgagtgggcttccccagggcagaaaggtttgtcccggagcaagaattttgtttgaatgcgtgtaacttaaattaaccttgtggacctctgctcagctccgctcggctctgcccgatgagctccatccaggctccgcttgctggtggaaaaggctccttagaagccggcaatgagctccatccccacgcggtgccagtgtgccttccgctcacccctcggaggggtgatgaaggcctgcacctggtcccctccccaactctgctctgctcctgaaggcataaatctaagaagaaggcctttaccaagtactgcaagaaatggcaggatgaggatggcaagaagcagctggagaaggacttcagcagcatgaagaagtactgccaagtcatccgtgtcattgcccacacccaggtgagcccagtgccccggggtggcttggcctgccacttagtagaagtgacctatgtgatcatgggggtcccgtgcccgcacgcttatgggtaggcttctcccttgccagcagagggcactgtgtccttactggcccttagcaagggaaccattcccctttaaaattcaactggtgactcaccagtaacactgaaatgcctgcctgaaagtcggttgtgaggtactggctgctctcctggaaacctagttgatgagctgagcaggctttttattgacttggttagagtgggtgcctcttgctgtcctgttactggttatcctggctgatctcaagtgctgagtgcaaccccatgtggtgagggccaccacggatgagagtgcatgtccaccgttgaaattttgtcaggacattgccaggctgtccttgagtgaaagctttatgcttaaatgcatttttttttttttagagacagaatttcgttcttgttgcccaggctagagtgcaatagccctatctcagctcactgcaacctccactttctaggttcaagctattctcctgcctcagcctcc

SEQ ID NO: 103750 - DNA, 4152 bp, Homo sapiens
atttggggccgacaaagtggcaggaaacagccaaacaaatcaagcgtgaagatggtttcagcagagccgacggctcagaggggctgcgaccggggcaggggaccggggatgcggggcagggacacggcccacacttgctgtgcacgcaccgccctcccccaaacactttgcaaagaggtcaccgcactggctgcgagcgcgccctgagccccgggccgcagcacgcgcgcccccgcgcccgaggtcgcgcgctgcccagccccccgcccgcgccccgcgagctgcgcccgccgcgcacgacgccccctcgcgggagccctgggccgccggccgcgcgcgcaggggagggggcgggggcgccgcgcacgcgcacgggccggcggcgcgcgccgagcggggggcaccgcgcgggtgcagccacgatggaagggggtgcgtacggagcgggcaaagccgggggcgccttcgacccctacaccctggtccggcagccgcacaccatcctgcgcgtcgtgtcttgggtaaggacggactggccgacggctctgccaggccggggtggtgggggtgtgagcaaaggcggcgcgcccggaccgaccccgaccccgaccccaacgggcccccggcggcggcgcggcggcgggcgaggagctgtcctgcctgcggggcccgctgccgccgctcctccttcccgggcccggggcgggcgggatccctggtgctcgcgggagacgccgctccggctcccggagccctggtttcctggggcccccggttcgtgcgccccccttcccgccccgattgctgtgacctccaggccgcggctatgccgcgaaaggctcggattgtgcgcggccgccagggcggactggggaccgtggggacggagccagggtttaaggtggccttttttggggggtggatcagggcgtggaccatctcggtggggtgcatgccgcgcctgcgatggacgttggaggaggagagggccgggaaccgggttcgtattgcctagcccggcccgtgtggagcgatgagtcgggaactgagtacctctcttccacccgggaactgcctctccttctctgcgtgaccttgggctgggagccacccaggaaatgttctcgagaaatgaggacttcaattccgaggtggggagtgtcatctcctctctcatgcctcagtttcccaatttatagacaaggtgggcggagccttcttgaggcccccttgggctctgacatttcatgaaccggtaacacccctcccactcagcatgcacctggatgcccaaggcgggtgtctgggagaaaggtctgctcccacagtgaagaggccagggtggcctccagcctagctggggggcagggtcctcagtgcagagggctgagtgggctcttgttcagacgggtggtcagggagaggatgggtcagagacagtgagcacagagggaggggttcaggtgccttgagtggcacctcatggaaagaagccctgctggggtctggagagggggtttctggggctccctgggtttggctggctgtatcccagaaactcccactcgaggttctggcctctgcaggcctggggcccgttccttgtgggcttagactaggaatgggctagactgtcagggaccccaggggctaccccaaggccagctgtgacctcagggtgcccaagcttcctcctttccttggttttcagggtctggttggtaggatggcttgggtatgtatccctggtctgcgaaggatgaccccatttaaagccttttcttctcaaatgccgtcagatgggagctgtttgagggcaggaaagcccagttcctttaacccttgtgtcggtgcctgcacagagccgggcaccccagcacatctgtgtttgtggctctgaattcatttatctgtgccagtctcctgctccccagatgccccaacagacccttgccaaaggtgggagccctggggggcacctgccggatcaggcgggtgggctgcgttcactgctttagtctgcccacccctgggcctctggcctggaagggcgaagccactggctttgtgagggggcttgtctgcttgggtcatttctgcctctgatgccttcatttagcaaagctttattgaatctgctgggccccaagggaaggcagcgtgactcagaagcagcccttgttctcgggaagccacagtcccactggggagtgagccaggtgcccccaggcagaggccgcaagagccaggagaggggtctccctgctgtggaatcaaatttcatggtgaaggtgatgtcagattgggcctggtgggatgagggtttatacatatgcacatccaggggagaggacgtggaaagcaggaggaaggatcagcccctctgagcacccatggggtgcaagaccacacacagctacctagctggttccccaacactagaggaagctgcggctcagcgagcgaggccaagtgcctggcccaaagtcactaagcatgtaagtggcagacgagcatttgagcctaggtcttcctgtctccaaagagtagttctccccctggggcagggaagaatccagaatcctggaatgtcaggattggaaaggacacaaaggtcacctggaccaaccaatgctcaaacgaccccacagcctcccagtcctgctcacacacgtggatacaaggcgctcactacctttgtcgaaccaagaggtgtctgatacaggctgattgacacctttaaaagtagctttttttcctgatcagagtaatacctgccaattattggaaagtataaaaatcacatgtgatggttgcacggtaggaatgtacttaacaccactgaaatggtgaagatggtaaattgtatgttacgtgtgttttaccacaacagaaaaagtttggtggggggtggtaatcatgtgataccaccacttagggagggctgcagtgaatagggtgctgtctccttctggtcttttcgaaactgtgtggcgtgctgagccatttaaacacatcaggagctgcgggggatgcagctggcgcctgctcttggccctcacaccacagggcagagcaagtgaagctgagctccaggaccagggtgacccgtttatcctggtgtgctggaacttcctgcctttagcattctgagaggcccttagtccagacaaacagggacaatttgtcaccctgtccaggactcctggacaacccagacccctaccacagccctggaggggccctaacagcatgtgcacatgaacctgtgattgttttttttctttttttgagatggagtcttgctctgttgcccaggctggagtacaatggtgccatctcggctcattgcaacctccgcctcccaggttcaagcaactctactgcctcggcctcccaagtagctgggactacaggcacacaccaccacgcccagctaatttttgtatttttagtagagatggggtttcaccatgttagccaggctggtctcgaactcctgacctcaggtgatccacctgccttggcctcccaacgtgctgggattacaggcgtgagccaccgcacccggcctggacctgggatttttgtaaaatttgtaaaagaaagatttttttttctgttgcttttccaaaagagggcccccaaatcatgtaagcttcagggcctcaccaacctggacccaccctggaacccaagccctctgagcccctgggtcagcctgcacagaagcagggcctccaagacctggcttgtctcttttttatttttttagagacaggatcttgctgtgttgcccaggctggtctcagactcctggactcaagtgatcctcccacctcagccttgtgagcagctgggacgatgaggcgaggcgtgggccactgcatccggcatggcttgtctcttgactaaggctttctcacctcttggtgtcatcgccccagtggcagatcagctgccactcctggcacccccaggccacagctgtgaccttcagtaagtgtcccctccccaccctctgtgcctcagtcttcccacccgaactgggctgggctgggtcagaagtgcctgatctgttgcgcggtgactgccgcctgtcagtgactcatttctttgttctaaagccagatgggaaaaaaaggagttaca

SEQ ID NO: 103751 - DNA, 1032 bp, Homo sapiens
agcaccttggggaggcaggggtctgctcgcccaggccctgcccagcggagtccactccacccccaccaccgagcactcggggcgacagcttgcggagattacgcctaatccccagtgggtcacttccaaggctgcacaacccggtgtgaggcggggtgggggaggggcctggagcctcacctgccccacccccaccttttccccagagtgagactcttcaggaagacaaggggctgcccaacacccatcatgtgtccatgcggcttcagccattttcctcacttgaccctgggggaagacaaggccctgttcctgtgaaggggggcccttggcagcctgactcatttctcaaagtgtgaccgctcccttcttccctcagcctttccccaggaggcaggatggatgcctgcaccaggacaagggcaggaaggctgggttcagcttgtggggagagggctcggcagcccccttttcagggagtgagctccctgtgcacaggggtgtgcaagcggaggtgccagccaaggacgctcaggaggggatgattctcctttctaccccccgtgctgcctggccctctctgactatcagacttgctgtctactcccctcaaagcctttcctgaccctctccctgggtctgggggagagacgtgcacccaacaactgaaccaacaaataggaaagaagttatattgtgatgttaccaagaaaattaattgaggcactggagaataccttagatctggagtctggtctggagggcttctctggggaggtgtcttttgtgttgagatgtgcgtgttgaggagccagctgaaggaagatctggagaaatacaggcatcccaggcagaggaaagagccgagtgtgaatgccctgaggcagggatgaactcaggagggcttgggaggagagtgttggggagcttcagaggaaggcaggagccctggcgtttggtgggggaaggtctttacctgggcagggggcggtgggtgagcatcaatccaagagtctagacctggggggtgac

SEQ ID NO: 103752 - DNA, 4493 bp, Homo sapiens
gttattttttcattcatcactccatctacttgccaggcctgggtaggggcctgagaccccagaccagcccacagctctgcagagggaaggagaacacaagatggggcccggcacatgccagcatctggaggagtcagcctgggggtgggggctgggcaggtccacagcccaggagggcctgtggctccttgttctttgagagtcggtccagtcccaggatatcttggtgtcagggcccaggaagacctttaggacctggctgaggggtgttggaaggggccacatctatggtcagagagtcctcagtgcctgtggctgaggaaggaagtgattgacccccacctggtgctatgtgacccacataagttaccctccctctctggggatccccctctgaaatgcctgcttaacccgggtcttgtagctcacggagggccaggcagcaggcgagggtggcagcctccccgtcccctgggtggtgtgaggcaggggtctgcccaggtctaaggtgtggccccacccccgacagctgttctccatagtggtgttcggctccatcgtgaacgagggctacctcaacagcgcctccgagggggaggagttctgcatctacaaccgcaaccccaacgcctgcagctatggcgtggccgtgggcgtgctcgccttcctcacctgcctgctgtacctggccctggacgtgtacttcccgcagatcagcagcgtcaaggaccgcaagaaagccgtcctgtccgacatcggtgtctcgggtgagccccacccagcaggtaccccctgcacagagtctacagagggctgtcccggccataggaggcggctgccacccttcttcccatgtttcagatgaggaaatgaggtgcaggcgggtgaagggatggactcagggtcacatggctggcagcaggaaggatgggaccaggacagggcctgggaccccaaaataacccatgctgcccacaggcaggggagcgtggatgggattctagttccttctagtctaagggacccatggatggcactgggcatgtgccagcccccatgggttggcccgtgtttcagtggcctcttctgtgccacctccctggggcagcctcatgaggactaagcaaggcggtgactgggtgcccagtgcacagcaggggccctggagcctcagcctccccacgcctcccagccagaccttggcaggaccagggcctggacctgtggagccaacctgacctgctgccctttgcccttcagaagcagcctttggcagaggcaccctgacctctgctccgtgacttccaggaatctgattggtggatgctctcagtcaggggtccgaacccgaggcttcagcctcgctgttctgaggcttgggtccccggactgggaccaacccctagttctaagcctggagctctcaggataagccaggctgaaggcaggtcatgaggtctagttttagaaggaactagaactaaatgaatggttctcaaacttccacagagcctcagggttccctggcagtgcctctgggaggtgggctgggccccaggtgggcaccccacctgcttggcagatgcacgccttgtcctgagcaggtctgggcttctctggggagaccttggcactcacaggagattgcgtggctatgaggctcccactgctgacgcccccaggctcggctctcagtgggcccctcgctaaacctggggctctgtggggtcgcagcacgttagaagtcgaagcccagacccacccagccaagctgccatccttgccccagcctcgtcctccttcccatacctcatttgtctggcagcctgagggttggggtcttcctgcctgcagagttgcaggcatcaggggtggaccgggggggcccacgtcagcggtgtggctggacatgggggtttggcagaggctgcagaaatgcggcctgagttgattaccttctttctctgtctctccctccatcctcccctctcactgcccgtggctctcctctgactggccctgaccctgccctgtctgtggcctcctcccccctgcatctggctggcttccctcttctcgcctgcatcttctcttggctcccctctctcttcccctaccccctttgcctgtccctttgggggtgggggagcatgggagatgcactcttgaatgtccctctgttcctcggcttccccattttctccccactcaccctctcccccatgtgtggcactgcctattctgcccggtcctgggaccccccagccttctgggctttcctctggttcgtgggattctgctacctggccaaccagtggcaggtctccaagcccaaggacaacccactgaacgaagggacggacgcagcccgggccgccatcgccttctcctttttctccatcttcacctgggtgagtacagccaccgcgcaccagcccacactcgtcccctttccccactgagcccctggatgggtggcctttcgctagcctgggacccgctctgcctctgggagcccacactaccctcgctccctcttctgcctgcctgtctgcggcgctcacagtggtgctgcctccctcagcaaggaggctacagccctcgggggtagcatggtcactggagatggcagaccctcactgtggtgcagagcagccttcctgggggtcacggaccaccccccccccaaaccactctgggtaaatggtgtttattatcccctttcacagatgagaaagcagaggcctagacaggaaggtgaggcttacagggtttgaggctgggaagcagccctgcctaggagtcaggagacctgcttccgatcggggctgcctctgattttcctagcctctgtcttcccatccataaaatgagagggtaggatctgggggacacaggtgtcgacatcagatgcacatgggccaggcagggcctgagagccgtgagcaggccgggtgacacatgcgtgcctatcctaagtcctaagagggtacctctgctcggctgccaagcaggaatagggacctagagaaggcagaagtctgaatttttacatgaaatctgatcttgatatgttggaagtttattcaggtttaaacaatatattgtgtgtgtcaaacaaagtatgtctctgggcccagcaggccctgggctggcagctcggctggcccctctttcccactggtctgggtcatgtctgtttcttctctcctaatcacccttctgcagagatctggggccacatcacctccatagccccatcccaagagccctccccataacccacagctgcctcccctctggaccggcgagcacttctgggcccagcctcctgcaaggagactcttgaggctacatacaggccgccagccgtccctgtttcccccatccttctggtttgccccgggttgacgtctttttctttttgagggcccctggatatccatttttgaggggtacacccatctccccaacaatattagaagatagcatttggagggggagacccgtggttcaggccctagtgggccagccttggctgctccacccctcagtgtcctcaagactgggtaggaagaaccaggtgaccccaggggatctcagtccagagaaggtgccccagaagtggggaccacccagcctacagggaggagtttaggggcggggctcacagaggagtagtggatgatttctagccatgggtctgaagtacctgaccaacaggtgcctgcccggccccctgaagccagcctccctcctggcacctctgcagctcttccccactggcctcacccctactctctcctggcagagcctgaccgcagccctggccgtgcggagattcaaggacctaagcttccaggaggagtacagcacactgttccctgcctcggcacagccgtaggcctccccggcttgcagaggccggcagccctgtatcacccctggcagtgaggtggcaggagcagcctagtgccagaaatgtccaagatgccagggcatgcagggcagtggaaggctggcttgaggaaccaattcaggttctccactgactcattcattccttcaccgcctccttcattgattcttcatgcgttcattcattcagtaaacatttattgagcagctgttttgtgcctagtgatgaattaggtggggtccttggctccaggagcccacaggctggggaggagaaaacaaacacatcaatatctcttccaaatggacagccgtggacagttaccaggtaggtagcggccccatacatgggctgcctagaggcgttcatggtccccattgctgagctgtgggtgcagagcaatagcctctcccttcacagcggtgtgaagagtgacctcactgtccttagggttagcatcctggccgaggatgtcacagggctcctggtctggctctgtcctcatgtgctatgtgaccctgacaaacccgtgcacctctctcagcctcagtccacttacctgaactgaggggtg

SEQ ID NO: 103753 - DNA, 1051 bp, Homo sapiens
agcatgctcaataaatgtaagctcttttgttcattcattcattcattcattcattcttctctccagagagtcaggggcacctccagaatctctactttaagagtaattctcatgtgatgaatccttgttcctccaaaggattttggtctctggttctacacaggtttcctgcttgaggcccccagctgcctgggcaggaactcacccattcctccactctctgctggagttgaggaggctggtggagcacagacagttcccccaaagcaatgcctcaaccctgcgagggcctgagcacatcgagagtgagcttcctggcactggaggcatcccagtgcagatgcagactgcctgctgcacgctggagatgctgcagagagagcacctacactgagaaagtggggccaggggaccaccaggtccctgggctctcagtagaactcccatcctccctctgcagcccaggccagcgggggcccaggcctctcctttgctcctgtcttgtggccccttaaactggttgcccaaatgaagctttgacttagtgagggcagagagctgaacacagagacagtatgagtgcctacagccagaggcatctccctagaaggatcagtaggggtcatctgctccagccctctgcctctgtacaggaaaccagcctggatagtagagccagggagctcggggagaaccgcgtctacagacattgctctcaaggttcattcagtcagttcctgtgggctggccagggctcaagtgtaccctcagggggctcttcacctcccctgcttcttcaggctccggcgtctgagcccccagcagccaggacctcatgctaacatagtgggaaaccccagagggctacaccttatcccttagcccaatttctttagacctagtctgcctttcccaaggtgctggcactttgctttaaatacccacctcccagaaagtgcttcccctcagaactttggtcaatgagtacaatcaaaaggtaatgccctagctgggcatggtggctcatgcctgtgatcccagcactttggga

SEQ ID NO: 103754 - DNA, 1356 bp, Homo sapiens
gattctcctgcttgcacctcccgagtagctgggattacaggtgatgccaccatgcccagctaatttttttaattttcagtagagatggggtttcaccatgttggccaggctggtctcaaactcctgacctcaagtaatctgcccatcttggcctctcaaagtgctgggattgcaagcatgagttgtcgcgcctggcctctcctgctttcaagaagaagatcagattgttattgtgcctgctgtttttcaagtgcctttaactcaacatagtcaatatgccagaggtgcatattttagcccaggctggtcttgatctcctggcctcaagcaatccttccaccttggcctatcaaagttgtgggattacaggcatgagccgcggtgcatggcccccaggcatctttcattcctacagacttggctcatggtctttgtggtcccttttggcaattagagctccagccatcacatctgtgttccaggcatcaggtcagagggtgggacagagaacatgagggtaccccattggccaaaacgtagtcacatggccatgcctagctgcaagagagacaaaagaatgactcttaggagatgctaacagtcctttgtcccgctgagaagctttttttaagaaggctgttgtgagcctttgagccatcttaacactccataatggagatctagaacttttggtagcccagactgacctctgggattgggagacaggggcaggtgatttctggggtactttctggctggatgatatggttctgggcatttccgggggtggctgcgagaacagccttccttctccacagccaagcttggtctcatgtttggtgctttgaggatctttaaccctctcctgcctgtgtcctgtgaactaaccaccactaacccagtgctcttgtctgtctctcccctaaccaccccctcccgcctgtccttgtcctcgccggcctttgtccccaggcgggccaggctgtgctggccttccagcggtaccagattggcgccgactcggccctcttctcccaggactacatggaccccagccaggactccagcatgccttacgcgccctacgtggagcccactgggccggatcccgccggtatgggcggcacctaccagcagccggccaacaccttcgacaccgagccccagggctaccagtcgcagggctactgagccacagtgaccgcctgcccccgcccctccccatctgtcccctctctccacacccagcccctgctcctgcccaggctgccctgcccagcgcctcatcagcctctgccttgtcccactgaggtccagggtagctcggggcaggggtggggcagtccagtgttgggg

SEQ ID NO: 103755 - DNA, 1084 bp, Homo sapiens
cctgaggaggtcataatctcttctgagtgggggcaggtcgattcttgcacaaggtgggctcttcactgagccataagggacagggaggtatgggagagcgctgggggcccatccccctgtccacccagtgtccactggcctgtccttcagggagcagagcagagcaggtggtggacgggcccagtgctgggtgttttcaccaccatccccccatcccccatctaagaatcctaagaggcaggcgatccctcacctgcttactcactcagcagttacccggcccctgtgctggagataccaagggcatgggtggtccctgcttcgatggccccaaagctgggccagagttaagggaaagaggaggaagtcctaagcagagaagtagcaccattatccccatttaacagaagggaaactgaggctcggcaagcataggcgagttggcagtggaacacggatctaaactcaggtgtgtccaagtcctcccaaaggacagcagtgatggagaggaccccagccagctgtgtgacagctggttgttgctgacttcattttccaatccggagaaggggctctgtccacagtcccccgccgccaggtggcccacatgggaccagcatgggggcaggttatctgttggcctgaagagtgaaacctgtaccaggccaaaggtgagggcgtgagtgagggcaggagtgtttatggcagagtgaagttctgtgcccaccacaagaggctgtgagatgttctgaccctcacccactgtccaccaaaagcctctcctgctgatgggcactaggagacctcagggtactgcccatctgtttctcctcgggtgccagccagctgctggtgatcctcagccggagggcagggtaccaggtaagcttaactccatcttgggtgtttgtgacaggccctgcctgccaccctaggcagggaaagctgtcaagactcctgccaggaatggggggtgctgagtcatctcacgaagaatccctcactcttcccgggttcagcccagaagcccttccaggcatgatcttccccatcaggctgggctctggcagggacctgcccagga

SEQ ID NO: 103756 - DNA, 1005 bp, Homo sapiens
actgtcctgcctgcacggctcctatccacctgggggtgtcgcagttgaggggctaattcccaggggactgacgttagttccctactccatccttccctggtgattcttgatcttcaaagcctcggggatcccaggtttccccatgtaactgagacaccctgcctgttagccctgggagacccctaaccttggcccaagacccctttgattctctaaggagcacgaaagggggaatgcccctcccaggagtttatgggagaagggactgggccggctgcctcccagcgatgcacttgacctgacactccccatgtcctggtgcgcacagcccttgtcggtgccccggcccctcccgcagcgttactgcctgtgtatagtataaatatatatattttctatatataagatgtataatataaggctccacaaatatatctgtgtgtgtgtgtgcgtgtgtgtgcggtgaagggcggtccccatcctgggcccccactctagacccccccaccacctggttaagtctcgagtgaatccagtggccccgtggcaccctcctttatgacatccatccatctgtggtgaaccaagtgaaggtggtgacttctggtgacatagtaataaagtgaagactcagaacccaccagcgattgcaagtgtgtcaccgtgtttctttgttcttcattctgcgtttggcttggatgctccatcccgtttgtctccttagacaggccatgtcttacttggttattattgtttgttaatttttcattacacaatgaacctatgaatatattatctttttaaaaagtaaaattggccgactgcagtggctcatgcctgtaatcccaacactttgggaggccaaggtgggtggatcacctgaggttaggagttcgagaccagcctgaccgacatggtgaaaacctgtctctactaaaaatacaaaaaaaaaaaaaaattagccgggtgtggtggcagacgcctgtaatcccagctactcgggag

SEQ ID NO: 103757 - DNA, 1749 bp, Homo sapiens
ggtccagtgctcgcccttggcgtcacagaggtgagtagacattggctcagggataacctggaaccagagccttgaaattattctcccaggagcacagttcccaggcctccccagtggggattgctgtcttcccctccacacctttactactcctttattttattactgctgggcacgtctgtcttgttaccgagttggcattgattttagacggctggccctctgctttgtaagttcccagagggcaaggtccctgtataactgtccccactctagttagcatttgggaaacgctggttggattgtgacattgggagggaaaattgtaaatggtgcaggctgagttggcttgctgagaagagagcagccacctgggtcatgtagagtaggtggctgccagcttctccccttcctagatgtgatggaaccaaagggaattgtgttaggcagaaggccagctctactagccccagaatgtgtttctccaggtggtggtggccttttttaaagcaagaatagttagctttaaacacattgcatcttggtgcgtggcaaagggatggcagggatgtcatcagaaggcccctccgccctcatgatgatcaggacatccctctcacaggttgtatggatgtccaggtggtgtgtagggcttgctgatgtcacatccactgtctcaagtctggggagaacaactcagctcagacacctgcattcagagatggctgtgagggctgctggtctgtggctactgggcaaatatgaatgaggcgtggtgcccaccctcactgcgtttgtagatcagcttgggaggagcatatgccactgatacaatacctggggcactgtcttgttattgtagacctgtgtcaagagccctgggcagacagcagagaattttagaggctttaaaggatgagaggagtttgccaagcagaggagaggagggccattccaggaggatgtgtatgtgtgttttcttgacacgtgtgtttttgttttcatttttcttcctagagatggggtttcgccatgttgcccaggctggtctagaatcctgggttcaagcaatcctcctgccttcgcctcccaaagtgctgggattacaggcatgagccaccgcatctggctaaggacaggtgtttaaatatgtgtgcatgtgtttgttaagcttttcacaagttaagtacaattagtactacaagtctatgtgttgaggggctgcagagtggcctgattggtctgggtcagtggaggtttgcaggaatggcatttgcaagggtatgctggggccacttggtagatcacttggtgggagcatcattgcaggcactgtggtaccttgaaaggtcttttgaagcaaaaagcttttttgtgggtgtatggggaagacaggatctcactgtcacccagactggagtgaagcggtgtgatctcggctcactgcaacctctgcttcgtgggttcaagtgattcttgtgcctcagcctcccaagtagctgggattacaggtgtgcaccaccacaccagctaactttcatatttttagtagagacagggtttcaccacgttgcctaggctggtcatgaactcctggcctcaagcaatccgcctgcctgggcctcccaaagtgctaggattacaggtgtgagccactgtgcccggccacaaagaggttctaaggagagcttgatgtgttcaaaaggacccagacctttcagccggataaaacagtgttagtctcatact

SEQ ID NO: 103758 - DNA, 1067 bp, Homo sapiens
aaaaaaatggacctaaacctccttcctaccttacacagaaattaattcaaaatggatcacagatctaaatgtaaaatataaaactataaaacttttagaaaaaaacataggtgctctttgtaacttgggactggacagagagttcttaaacatgactccaaaagcatgaaccatgaaagagaaaaaatggattaaatggacttcatctaaactaaaacctttgctctgcaaaagacactactgagtgaaatgctaagttacaaataaaaagaactctcagaacacaatagttaagaaaataacctaatttaaaaataggcaaaaaacttgcacttcaccaaagaggatgagttggtgccaaataaacacgtgaaagatactcagtgtcgttagccgttaggaagtgcagattaaagtcacgatgagctaccactacccacctcttagaatatctaaattcagaaaaagacaataccacatggtggcaaggacgtggagcagccggaactcaacattggaaatgcaaatggttcagctgctctggaaaacagtttggcaggttcttataaagttaaacatatacttaccatatgagccagccctgtcactcctaggtatttaccctggataaatgaaaagttacattcatacaaaaacctgtacatgaatgtttatagcatatttcttcatagttataagaaacgaaacagcccaaatgtccttcagtggatgaatggataaacaaactttactacatccgaacaatggtatattactctatgaaagagagagagagactgttgatgcacacaggctaacaacttggatgagtcttagagacataatgttgagtgaaagaagccagtctcaggaggtcatgtttactgcatcatttcatttatgtgacattgtgtgacattgttttgttttgttttgttttgtttggagacagagtctcactccgtcgcccaggctggagtgcagtggtgtgcaatctcggctcatggcaacctctgcctctcaggttcaggtgattctcgtgcctcagcctcttgagtagctggaat

SEQ ID NO: 103759 - DNA, 1047 bp, Homo sapiens
agtgtgcatttggagccagtgcagtaagaggtggggtccccagagtttcctgccaagagtctgcgacatttgtgtgtgtttcactaggtttcataacggctcactcctggaggtcattgctgcgccttacatttgggaatggtggagtctcagttttcctgggaaacaagtttgtagactagccataaaaacagcaaacccttctgcaggtgtctgttcatacaaacattattgttttccagaaggaagtggaaccctctgtgtagggctgcgggcctgctaggtttttgttgcagaaggaataggtgaagtggggactaccctgcagacgcggtggcgtctcacggcttcctggtgtccttccccaggagcagcagccaagctggacagatgacctgcctctctgccacctctctggggttggctcagcctccaaccgcagctactctgctgatggcaagggcactgagagccacccgccagaggacagctggctcaagttcaggtgtgtgtgccagcatttctgtgttgggcccggggagttggttggtttgcaagcaaggaaagacaccgaccttgcagctttctcgtatgggcttgccagtgacatgtggcccgtgagaggtggcctctgctgctgtcttgccaagggcctgctctgatggggtagcgtgagcatggggaggagggtatcccagaatgtcatagccagagtgaaatgatggctaaagcagggggacccaggagggcccctgaagctgcagctgctgtcgctttagtctcccccaattcctttccctttctccctccacctccgtgagaccctggtctcaggcctccctctgccctctccctcttccaggagtgagaacaactgcttcctgtatggggtcttcaacggctatgatggcaaccgagtgaccaacttcgtggcccagcggctgtccgcagagctcctgctgggccagctgaatgccgagcacgccgaggccgatgtgcggcgtgtgctgctgcaggtaatggtgccggggccaacagtgacccagc

SEQ ID NO: 103760 - DNA, 1073 bp, Homo sapiens
gggagacaggtgtcctggcctttagtccctattctgcttcttaactcattctggacgagtcgtatcccattctgggtggccttgggggccgctgcttctggaagaggttacctggccatgaataaccaaccagtatccccatgaacagctgcgagatggggctaggtgacagggacattggggtttgtgagaagaccagacaggtgcaggtttcagtagaaaggactctgtagagacccttctgatgatgctgcctttttttaatactccagtggaaaattttccacaatatagaacaatagagtgactgatatttaatgaacattcatgcgcccatccccaatcccagcagttatcaactgtggccagccttctttgtccccacgttctctattttgaagcaaatgccagacactgtatcatgttatctgtaaatatttcagtctgtatctctagagaagaggtctgttttattaagatcataatcctatgattacactgaaaaagttaaacccaattctttcgtatcaccagctgtccctaactggtgactcaccccgttggtctgagcctgttttgcccatttcaggtatttccatgtgtgaaatgcctgccttttccctctctgccttcccggtatgccctatttctctctgtgtgtagtctttgcttagctgttcacattctgccacaggtacaaaccgtgcacttttatgcaaatcgacagtggatgggttgcaggtgacacagctgaacgtggaccacaccacagagaacgaggatgagctcttccgtctttcgcagctgggtgagtggggagagtgggagcggaagctgatccccatgggctcacccttcgcctgcctttggtggtggggtagagaggcgtgtggtagaggggctgtgatcttgggctccccagccagcctgcctggggttcattcccagcactgccgcttactggttggtgattggaacttaagttttctgtgcctcagatcccccgctgtgtaatgaggataatagtaacctacctcgggatgctaggaggattcagttagtgcatgtgaaat

SEQ ID NO: 103761 - DNA, 1073 bp, Homo sapiens
tatcctgaataccttgaaaggctcagattgcaaacttggctggcaggcatttccttcacctgctgggctgttgaccactgaatctcctgattttaggctccaagattatggcccatgccccccaggccgcacctcgttccttaccaggttcttcctaccccctcccccaggagattgctgcgatgattgacactgagtttgccaagcagacctccctggacgcagtggcccaggccgtcgtggaccgggtgaagcgcatccacagcgacaccttcgccagtggtggggagcgtgccaggttctgcccccggcacgaggacatgaccctgctagtgaggaactttggctacccgctgggcgaaatgagccagcccacaccgagcccagccccaggtacgtgtgctgtgcagacaggcagtgcctggggatgccatctgggggccagaggtgggtgcagagcccccgaggctgcttgaaacggagatggagtcaggaggcctggctctgagtggctctaattcaggttctctgatttttagcctctctgagctgagtgttgatttttgctcttttgtctgtaaaatgaggttaataccacctgccccggcaacctcccagaacctgagtgccccagcaagcaattcacagagccctgaagccacataatagagatgatggccaccactgattgagtgcctcccttgtgccaggcacacagcctgccttattcccttcagtcctcatgggcaaccctaaagacaggtggtacccctgttttccagagagggaaactgaggctgaagaatgaagggacctggaagagattaggcatgtggacagatggtcaggccccaaggcctgtctgtccctgggctgcactggagcagggcagggagaaggacgttttgctttttacctatgtcattcttcaaccaagttctcaggaaaagaggtggctgctctttcccgtgctccccccagtgctgctcagcactaagaccttcggttcctgagggctgcatttctttttctttgctttaaacaagcaaatcttagataaagctcaggcatcc

SEQ ID NO: 103762 - DNA, 1037 bp, Homo sapiens
cttattttcatcttttctataaaaataaaattgaaacaatggaaatcattcacacacctaattaccgtattgtttatgaacttatttggctcaaaactttggttcttaccgaagtgggaatcccttgagaggggtgggtgagggccaggccagggagacagacctgtgcacgtgccaggacctcagagcctgctctccggctgccctctctgggcaggccaggaacttcccagaaggaacagcccagagacagggttctaagtgagggaggccggcccgagtgggttctgggactctggctggcaggcctggtggtggatggctcccatggttgtcctccccaccttggcctccgggtcatcataatttgctgctctttatcaagcacttcctatgtgctgggcccagggccaaccaaccactttctatgcattctcccagagatgtctctaacttgctgagaggcaagcactattatcatccctgtttggcactttgagggtacccagagttgggggtccacagctgggaagtggcagggctgggattgtgtccagcctataggaccctcagagagcagcctccctcggtcacccagacctgttccttctctcccgtgggctcccagcagggcctgttccctgaggcttggagccctgagacagccatcacttagcctcttggcctccaggcttccccttcaaggccctccttctgccactgtcctgggccctgtctctggaacgcctgctcaatgtcacctgggcggcctgcgtaaagtacctgtttgccagaccctagccagccctgctgagtgagcatctcacaacgggagggctggaagcccacagtttaaaaaatactgacttggactcccaaagtaatcctagtactttgggaggctgaggcaggaggattcattgagtccaggagtccgagaccagcctgggcaacatagtgggaccctgtctctacaaaaaattaaaaaaaaaattaggcaggtatggtggcaaacgcctatagcctcatctacttgg

SEQ ID NO: 103763 - DNA, 1012 bp, Homo sapiens
gggcaggcacacgcactccacccacttgcgccgggcgcctcggccccccgtgcgctcccgggcgctcaggaggtaccggggtggccgccgggccgaggagccgttggccccctcaggcttctcctccggccgtcccgggggcggcctctccagcatcttggtgccgggtttgaagcagacgccgccggccttggtgcgcacgaaatactcggtggtgtcctcgggcagcaccaagtccacccggtggagctcctcggccgccttgctgggcggcagcggctgcagcaggggcgagtgggagtagagtggggtacgcagcaggtcagggcctcctggctcggggctggcctggggcgtgaccggggcattgttccagaaaaagctggacaccaggttagggctgagggaggccagttctcgggggaaggtgacataggacagggtcttgaagaagtgcaggaaggagatgaggcacaggccggccatacagaacatgagaaagagcttgtagcgtctcatcttcatcctgcgggagagagagagacaggagactcatcagggcagcccaggctcctttcctaggaaggggacctaggaggcctctgctgccaccttgctggacaatgtggtggccagcacctgctgcccctgcatggagtgacctcctgcccccaagagtcaactcgcggtaccaaggcccctgaaagccccagcactgaggacaccgccgtgctcccatagcccttccctgagatccccaggccaccaccctgccccctctgcagcctgcttctccgcctggcccaccccaccctgactgtgcggctgcactgctaggcttggctccaggagtaacatgcgccttgggaaaagctcaactcgcagtacagactccgccccaggacagaacggggagagcaggctgtaggctgccctcctgggtcctgtccctcccctcctatcttcttttttatggacatactgacaaaccttttgaatattttttcactga

SEQ ID NO: 103764 - DNA, 1025 bp, Homo sapiens
ggccctgacctgctgcgtaccccactctactcccactcgcccctgctgcagccgctgccgcccagcaaggcggccgaggagctccaccgggtggacttggtgctgcccgaggacaccaccgagtatttcgtgcgcaccaaggccggcggcgtctgcttcaaacccggcaccaagatgctggagaggccgcccccgggacggccggaggagaagcctgagggggccaacggctcctcggcccggcggccaccccggtacctcctgagcgcccgggagcgcacggggggccgaggcgcccggcgcaagtgggtggagtgcgtgtgcctgcccggctggcacggacccagctgcggcgtgcccactgtggtgcagtactccaacctgcccaccaaggagcggctggtgcccagggaggtgccgcgccgcgtcatcaacgccatcaacgtcaaccacgagttcgacctgctggacgtgcgcttccacgagctgggcgacgtggtggacgcctttgtggtgtgcgagtccaacttcacggcttatggggagccgcggccgctcaagttccgggagatgctgaccaatggcaccttcgagtacatccgccacaaggtgctctatgtcttcctggaccacttcccgcccggcggccggcaggacggctggatcgccgacgactacctgcgcaccttcctcacccaggacggcgtctcgcggctgcgcaacctgcggcccgacgacgtcttcatcattgacgatgcggacgagatcccggcccgtgacggcgtccttttcctcaagctctacgatggctggaccgagcccttcgccttccacatgcgcaagtcgctctacggcttcttctggaagcagccgggcaccctggaggtggtgtcaggctgcacggtggacatgctgcaggcagtgtatgggctggacggcatccgcctgcgccgccgccagtactacaccatgcccaacttcagacagtatgagaaccgcaccggccacatcctggtgcagtggtc

SEQ ID NO: 103765 - DNA, 1190 bp, Homo sapiens
gtccatgccaagcatccgggaagcatggctggccttatccacccatgggtcacgtcggttcccaggggcagcatgggagatctttgggggcaacagggagagtctgggtggggagacgggacttgtccaagcagaaggcaggaccctgggaaatgcataatgtaaggacatcaataatagtattattttttttgtaagggaaaatcaatatgtacattctgaaatcattttctctgtaaatggttggatttcatttcacccttaaagggatgcttaaaggagaagataatattaataataaaaacagctacaaagtctgaattgtgtgcatgtgtggccggtttgtgggtgctctggggcagggaggggtgggaacaggtggctctggtcttgctaaagacacccttacttctggatccatggggtgcaagaacttcccaaggactggatggccagtggggagagggggctgcagggagcaccttcacttagggatgacgtgtcccccagccgcaggtggaagcagctgggaagtggaggatgctgggctgaggtctggtggaaggaagcagaagtgaaccaggctcctaggaccaggggcacccaccctcctgcaggtgggcagggacccttttggggatctggatgaaggctttggtgcctctgcagagagggggtggttctacaattctgctctggggcatcaaaataagtgctcctgcctcagtagtttttcctgtcaggttctaaatgcctcatccaaggtcacagccttgtagattctggacctggactctcagcaccggactctctggactcccaggagcaggtatctccctcccatgtagccaaccttgaacttgtgcttggacagcacctggagccttgggatgtcagggcttccaaggagcttcctctgggccgggtgggcactggagttgtcctgggggtcccctgtgtgtgtcctaaagacagtctcaggcggtgggaacagacacttttttttttttttgagacagagtctcactctgttgcccaggctagagcgcagtggcgcgatctcagctcctgcaatctccacctcctgggttcaagcgattctcctgtctccaagcgattctcctgtgtcagcctcctgagtagctgggattacaggcatgtgccaccaggcctggctaatttctctatgt

SEQ ID NO: 103766 - DNA, 1062 bp, Homo sapiens
ctagtctcgtacatactcaagcaagataggtttataaaaaggcctatggctttttcaattaaaataagttggaactttcacacttctgtgctgtcatcctaggaagccgcaaggcctccattattcatcatccttaactatattagggtgatgagcatttctgttcccatttttgtatctagcgagacaggttaaataacttgcctgaaatattggcagagctgaaattctccatccctagttctgcccaccaggtctgtgttccttctttgttttttattttaaccatcttaaccattttaaagtgtacagttcagtagtagtaagtatattcacattgttgggtaacagagccccagaacccttttcatctggcacatctgaaactctgtacccattaagcaatggggttccttcatgacagtcccgattggaggtggagttcttacctgctagtaggctgtaagcttatgcagcagaacctgagtggagagcgtgtcatggagaagcagtttaaactggaacaagttgaattaacttttcaagtaaggtccgtgtctgtctgttgagcttgtggatgccgtcttctgttccaggtcaccaggtctgtgatgtcagtccgtccttggatggtgggcggggggtgcctattgcactacagtaggaaaagcctttttttcttgagatggagtcttgctctgtcacccaggctggagtgcagtgggtgcaatcttggctcactgcaacctctgcctcccgacttcaagcgattctcctgcctcggcctcccgagtagctgggactacaggcgcctgccaccacacctggctaattttttgtgtttttagtagagacagaggttcaccgtgttagccaggatggtctcgatctcctgacctcgtgatctgcccaccttggcctcccaaagtgttgggattacaggcgtgagccaccgtacccggccgaaaaggcttaacaagctggcccaacttaatagttttgatctcagctgttggctcacgcctgtaatcccagcactttgagaggccagggtgggcagat

SEQ ID NO: 103767 - DNA, 1026 bp, Homo sapiens
tgctgcagacgtagggcaggtgaaggccaaagcgggtgttggtggtcaggccctggattctccgttagatacacttggctacctagttggtgcctcacagggttcctgctgcctggtgtcttgctgatcatcaccctggtcacttcatgctgattagaatgacatctctttcgtctcctattttgttacccaactcttcctatttttgttaccaatcactgtgctctctgccgccccctggctccaggctaatttttctggaatgaattgagaaggtggcgtgctggcctgagctgatggaccacttggtgttttgcgttttggcccatgtttgctgcctctatctggtctgccttgcccgtttgcctgttcctattcagtgtcttttctattttttcctctctcgttcatgccttctgttttgctcttgtccctggagcatatctgcctaattaagatgttgccttttagttgaatgccactgaagagctgtgatagcatgtttcaaagctgaactctacagagcgagtgctgagacagtatttagggtttctgggagtgaggctggtagaagagttggcctttgaccacggttcctggagtagaagtccatcctccccccaacctcctgacccattcataaatgctgagaatgtctctcatgggaacactgttaatgacccacacaggataagctgaatgcaaagttatttgcaggttgaatttcttggtggctattagcagaagtgcagagtagggaaccagagctggttaagggcctagtgaagggtttgtgtgcccagtgtctgctcgtcatctgtggctgcaggggtcagacagacaaggatggggactgccagggcaccacttcatcatgaatgctggttttcacaccttttccttattttattgccaatcaggacaaggccttgaaggaacgcagccttagacatcaggtgaggatgatggaggtagacagtcgactgaatgtcagctggaaaatccagtcactagttggggtttggt

SEQ ID NO: 103768 - DNA, 1003 bp, Homo sapiens
agcaagaacagacccaacagccagcccttcatcctccagcgtctgccataggaatgtgagaggggtgtttgctgagcgctccgggcacggccagagggcaagtgagcatgcacggacctcttccccctgtcctgtttctcacccagcacctggggagatcggtgctaccaaggaagagagcacacagataagacagaggggaggaggtgggcatttcctacattcctccttgtttgccgctgctgagattgcagtatttattgcaatgtaaatgtatcctgaaggtggggaggaatgtttaatctaccatgtccgtgtgtcatcttggtttgtgtttttccctgtttgtagcaagactctgatgataattctgtttctcatctgcccattcagtattttgttttccttccgtcaagttgtcttattttttcaatgactacctctccatcattgaggttctggtgaagctctctgcagctgtctcattccttcccaacgatagtaacaggaaatgactctttagcatcgatacctcaacatcaatttagggtagagattcctgcccctcttttgtcacagattaggaaattgagaactagggttaaccttgactatatttagaggtctttttgcctcttttccccttaacaaggatttcttatggtggtttcagtttcatttgcataaaggtattgagagggaacaaaaaacataaagctgagaatcttgagagagctcatctaccctgtctgttggtcagactcaaatgagagttaaaaaaaaaaaaaaaaatctgtatgcctgagtaccatcctggatgaatctagaaggtatggggtagagcttgacagggttcctgtgtacccactgggtatccgttagaggtaagggagaggagaggattgatagagtgttgcaaaagtatagattattcattgagataaaggatttggtttccctgccatgagtattaaaaaaatttaagttttcccaagcttgcatc

SEQ ID NO: 103769 - DNA, 1614 bp, Homo sapiens
tgaactctcagcgctggtcctggtgggtttgctgaccatgactgggcaagccgttctttttgctgccatcttcctcatcataaagtgtggaacataggcaattgctttgagattcttggatagaagaggacaacattctgcacctgcccccttttttaaatctttggggaaagatgagtaactttccccactactctgccttcctgttcagtaactcttacttttgcctgaagtaacagcatcttctacttctccatctagagatttttgtgtgtgtgccatcaaggttagcaaactttatacgtagcctaacacttaaaaaatgcactcattatcttaaacctaataaattccagagtttattttggttctcctctgttgcccttcctaaaaaatgagctgaagatgacagtatttttctttacatgcttggttatgacttttaaagttttatttaaataaatgttgaagctcaagtttaaagaagcgttgcagaggcccacggtctcctgggtcccggccacctgtccatattccacatttgctgactgtgctccctgcactccactcaagttgagagttcaaatagtcttgaaggggaatcagcttcaggatggaaggacccaggagaggccccgaggtgggagggttctgtaaatacagactactgcgagtgtccagagctctctgccatgatacttccttgggactgacttggctgagaacgtgttctgtcagaggatttgttagaactctgcccttttgtctgaaactcaaggccaaggagaatgataggagacttaggacagagctgacccttgcaccaggctgggaggctgcagcccttttagatgccacttactgtaagtggccagaataccagagaggtgggttccatggtcaaatgcacagtaggtgtttacctttacatttggatcaccttgtagtctttaaattcttggtccctgaggccaagtccacaacttgccttctagtcacttgcctgcccgcagtggtggtggatgtgttagctggtagatttggaatcagtcaccagtctttctgtactgtcttggttagctctatataagtaggggcagcttagccctgaggcccagagacctgctgtcctttttctccttgagggaggaaataaaactgcggaatacaatgtccttccatagcatgggaagaagaaaataaacatctcctttccaacagctgtgacttgtgtgtgtcgtatagaacattttcctgtgggagtggtactgggtctccattttcagctaggggaacctttgaagtgtttgagctaggtctctataaaagaatggatgggacaggctgccatgggagtcattcttttatgaccttttcagtgtcaaaattggggcagtgttactttaatactcaaccatttgcacagtcatctgtcaggaggtactgtctatagcaaaaggagaacacgtcctgtgggtccctagttctgcctttggaagacatggctaatggctcaggtattcttactgcctttgcatggaaaggctagaaaactcctgtattttttttttttttaaagacagggtcttgctctgttgcccaggctgagttgca

SEQ ID NO: 103770 - DNA, 2961 bp, Homo sapiens
caataagagctcgagatatatatgattcaccgggcctgggccaatcaccttgacgcgcgctcttcgccagcacctcgcgcgataacctggcgtcctcggccttcacaataaaaactcttcgccggaaaacgacctttccccgcccactgcgctgacaccggaagcgaggcgtgtctgggagatcactccgcgctccggcggcgaaggaaagaacggactctgatcatagaagcctagtaaagtagtacacctctctcctttcgtgaggccataagaacaaactccttttctcgtcacagctacgccctgggcataaacggttggggcgtcaaagggagggagggaagggagcgggcgggaggagacggtcacgtggtcgcggcggaaggatgcgtctgtgctgcgtccccatagagacgaagtctataaagggccggcgggcggccacggcagccatttctactttgcccgcccacagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgtgagtaccggggcgggtcgtccagctgtgctcctggggccggcgcgggttttggattggtggggtgcggcctggggccagggcggtgccgccaagggggaagcgatttaacgagcgcccgggacgcgtggtctttgcttgggtgtccccgagacgctcgcgtgcctgggatcgggaaagcgtagtcgggtgcccggactgcttccccaggagccctacagccctcggaccccgagccccgcaagggtcccaggggtcttggctgttgccccacgaaacgtggcaggaaccaagatggcggcggcagggcggcggcgcgggcgtgagtcaagggcgggcggtgggcggggcgcggccgccctggccgtatttggacgtggggacggagcgctttcctcttggcggccggtggaagaatcccctggtctccgtgagcgtccattttgtggaacctgagttgcaagcagggaggggcaaatacaactgccctgttcccgattctctagatggccgatctagagaagtcccgcctcataagtggaaggatgaaattctcagaacagctaacctctaatgggagttggcttctgattctcattcaggcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaagggtgagtgggccaccaccacatcgtcctggtgggatctagggttaggggcctcctacctttgtatctgactcacttggccccatcactcaaatgttttgcagaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtagggaaagtacttgtgcgtttgaattcctttcctggcaaagtaaccgagtgaagcgccacccacccaccccaagctggtcttaacatttcctgtgagatctgggggaggaggcagtccaaggctgaagatcggttcccagagtgggatttgctcatccctgctcggtgtaggccacgatggctgattcatggggccctggagccgtatagttggccatttatagtaagctgggtcctttgcccagagctgagtgctggttgtgtagggggaggaggctggagatctctgggagattcagagggagggacagcctgggcctccacctgtttattcaagagggcttcatgccaacagctgtcgcataaaaccctgaataaggttgcacggtctt

SEQ ID NO: 103771 - DNA, 1051 bp, Homo sapiens
cctccagtttccgccccttcttccgctcaagtgtaaacccctaacgcatgcgtcctaagaaagatgggcacttccgcccatccccctccggatccctctgttcgggctcgggtttccgccgagacgacagggactgccaggtcggaagtagtgtgaggctcgtgggcggagccaagcgccgccatgtccgccgccctgctgcggcggggcctggagctgctggcggcgtccgagggtgaggagggctggccaggggacgtccggcgcgggcaggaggatggtagtggctgcgggcgggagccctggatggaaaacaatccaggccgggcttagccccagtggcatgggaacgctgcgcgccctctgacctgggtctcttcctctctcttcccctacagccccccgggaccctccaggtcaggccaagccgagaggggctccggtgaaacggccccggaagacgaaggcaattcaggcccagaaactgcggaactcggccaagggaaaggtgcccaagtcggcactgggtaagttcgggaaggggctgaaagtgctgcctccggtgctgggacctgcgccccagaggaggtggcgcttgaggcagggcttgaagcgttcgcccggtattgctagacctactgtgtgccaggcgcggagcggggccctggacatacgaaggtgacagaacacgccaccgtcctggtcctcgtggactacggccctagtggggagagaagcatcaaagaatatcaaacccagtgtgtcattgctaagtgcattgaagcctatgaattaaaagactacggtactctgatggggacttaggccaagtcagccttctctgaggaagcgacatttcagccgagagctgaaggatgtataagagtgagctaggtgaaaagtaggagaatattctaggaagaatagtatgtgcaaaggtcctgagtcagaaaggaggttgttgcctttgagaatttgaaaaaataaaggctggtaaaggtgacctagtgaatgaggatcaaagatggagcatttaaacacattcactaac

SEQ ID NO: 103772 - DNA, 1051 bp, Homo sapiens
accgccttcaggaatagtgcctttgcccatgccagtccctctgctggccaaggcttcgcatcctggagtccagctcagcaaatgtgcccggagcggccccactccccagacacagtcctttggctcaacacttggtcccctgtccccttgctgccaggctgtgagctctgtgtgtgtgtggggggagggttgggggggtaaaaaatgggtcttgtttgtctttggattccccatgtgcccaacgccatgcctggcatgcagctggcatttactatgtgtttcatgaatgaatgagtgagtgaatgaatgaatgaatgaatgaacgatggggcaccagaaaggcctgcagttggcctacttgagtcagggaatccatttggatggattatgagggcacccattctatttctcccttccctctgctgtacacgcctcgcttccctgcttgggggtgtagggtggtggggagctgagcctcaccctggcctgctctcggtggggtgaagcagcctgcaggcaagctccactgtctttcctgagaggaggctgacctagttttgtggagagggaagatggggtgggccttaattattgattggaaatcactgcacacagagtttgtgacgcaaattccaaataattatcctcattaataagcacctcaggctcacccctagcatacacaaccatctggacagggccactgttctacttgtcaccatccttccatcttcctctctccaatcttccactccctccccatgacttatcacatcattcattcatgagtagtcattgaacaaatgttaggtgagcctgtcttctgggccaggacctgctgggttctgggaatactgaggtgacttagacaagggccctgcccccagaaccttatagcctagtggaagagataggaaagtaaacagacaactatacattagggctagaataagacgagatattgatatggatggaacctcctaggttgtgcagtatacaacctgcacaactgtacgtggcagcctaggctaggtcagaggtgctgagattg

SEQ ID NO: 103773 - DNA, 1050 bp, Homo sapiens
gtagcctgtatggcttgcatctgaggggacatcagaaggcttcctggaggaggaggcctttgtgctgggctctggaggcaggtggcattccagtaggcacatcaggggctgtgaagaggaggagcctggtgcaggggcagggagcagcctgagggaaggcctggggcagaagcagagggtactaggcagcgtggtatcctcctgacaggctcagggatctgggctgggtaagcctcgagtgccagggaaaggtgggtgacctcgtggtgtgggtgtatggtcagaggaggcagcgccaggtgggcaccctgagcaggtgtagagtcggcacctggccagaggagaggataggggttgcttcctcgaggccagcgtggtctgcactgctgcctgggccctctgccttccttctggccagggtgggaggcagctgacgctcaggcagcccccgcccaccctgcccaggttccgggtcctgtgtcagaccattattgcccacaaactcttcgactacgtcgtcctggccttcatctttctcaactgcatcaccatcgccctggagcggcctcagatcgaggccggcagcaccgtgagtggctgtagcctttgggcagggcaggcgccaggccaagggacagctcgccagggctgagcagggcagggagacctcaccgaggtggggaggcaggacaggaagtttgcctttggggcggggaaagcctccgtgaactgagaggtggcagcctctcctctacgaaccttggccaaagcagcggctggccagtggccgggcagctctgggagcccctgagcctatggtatctcccgatgctttcaggaacgcatctttctcaccgtgtccaactacatcttcacggccatcttcgtgggcgagatgacattgaaggtagctcccggtttcacccgggacccctgctagccccagctcgggcccctggccctgggtcagcccctgcctcagcttgtcactcgcctgccatcggcttcatttcactcgtagccccatggcccacccctctgggtgccagc

SEQ ID NO: 103774 - DNA, 2110 bp, Homo sapiens
tcaaaatcagtttctacaaataatttattgtctcagcaagaagttttagaagactcaacctatgtgattcaaactatgactgtcttaatgaaaaaaatttaattttatcctctttgaaaatctccaaattgctggaagccaagtaaaccagatcaataccaatttttaaaagattcaaaggcttttaagcctatgacttctcaggaagtcataattgcttagaaaaattattcaaagtatgtgttcagcttttaattatattaacatgcaagaaaaaaacatctgtacatctaattatcatcagtagccagttgattgctggatcttccaaaaccagagacaagtcttcttaagaatcaaggcttttcagacctctccactaatacattgcagtatgcagactttgtttaacttcgtttaacagaagagaagatcctttgaagtgtagtggaagacaggctgacatatttctgtggtctctccttctaagtgtagacacagcttttgttgctgataccttggtcaacagcctttgtgcttatcagttcttccttagttcactgtccttctgactgagaaatgtgatgtccaaatgttgaagtttctggacaagaaaatggagaaggctcctaagatctattttctttctcaaatgaatcatctttttgaaatgcaaatttctgcttaagtgcatgagacgttaaagacatcggatcccaatatgaattttttattttcctcttatgaatggatctgccaccaggtgactgttcaattgcacagagcttcactttatttatgtcctctagaacatccaacatgtttagaacatctttatttctgtggctttttggatgatgactatactagcacctgggtgctgtttgttcatttcagtagctggattatctgagtcacaaatattattagatcctagttgtatgggaagaaaacatggaagctagagagaagaaaactgaggaggaagtggtagtggaggaggagaagaaagcattgaacttggaaactgatttttattatgttaaggcttattatacactctacaaaggaacagagtataaatgtagtaaagaacaaatatatatgtgtgactccccactcagctgaacagcccgtgatgatggcatttgtcccaaactaatgggcccatcattcaagccaaaggaactagaatttgtactgtttttcagttcctgcatttccaaaattgcaggaatctgagagtgaagaaaagttagctcatcttcaagggcacctattttttttttaattgcagcttcatttacaagcagatcatttttcactggtttgttgtgttttagagcagatgacactggatcccaaactagttgcaaaggatggacacattgcattttctcttcatttttccatatactattttgaaatctgagaaaactggcttcctcgacatttgccacacacaaaatatcagcaaaagacaaaacaacagattcagaattatcagagtctacagagttcaagaactggatcaactcaaaattgtgccttcaacaaggttctaacagaagcattttctcattaatatgaacagtattcctagttgatccatagtctttattttcccaaatcagcaaaacctgatctataggaacaccagaatattcactatgagagacactgatgaagcaaatacagaagccaattcaaggaagcattgtcagtttcctggtacctttctctaaaagctggccttccggcaactaccagaatggcaaatggaggacattatgaatcctgtctcggaatcctccattgaagaggcactgatcctggtccaggagtacgcagacatcaacctggtgtctgctcgcacaccttagcttgcaggccacaggcagtaacgatgacctcactgaggggtgtgagatcaacccagtgcccagccctggaacccttcgctcagccagggtaactccctaggcggcatggttgcctcctcctgttcccagctaacctatcaccggtcccgaggacaggacccctcagtgttacattttaaaccatgggacaaaatcagaatattttaatttgtatatagttaacttga

SEQ ID NO: 103775 - DNA, 1035 bp, Homo sapiens
ctgtgcaattgaacagtcacctggtggcagatccattcataagaggaaaataaaaaattcatattgggatccgatgtctttaacgtctcatgcacttaagcagaaatttgcatttcaaaaagatgattcatttgagaaagaaaatagatcttaggagccttctccattttcttgtccagaaacttcaacatttggacatcacatttctcagtcagaaggacagtgaactaaggaagaactgataagcacaaaggctgttgaccaaggtatcagcaacaaaagctgtgtctacacttagaaggagagaccacagaaatatgtcagcctgtcttccactacacttcaaaggatcttctcttctgttaaacgaagttaaacaaagtctgcatactgcaatgtattagtggagaggtctgaaaagccttgattcttaagaagacttgtctctggttttggaagatccagcaatcaactggctactgatgataattagatgtacagatgtttttttcttgcatgttaatataattaaaagctgaacacatactttgaataatttttctaagcaattatgacttcctgagaagtcataggcttaaaagcctttgaatcttttaaaaattggtattgatctggtttacttggcttccagcaatttggagattttcaaagaggataaaattaaatttttttcattaagacagtcatagtttgaatcacataggttgagtcttctaaaacttcttgctgagacaataaattatttgtagaaactgattttgactgttaaatgttaaaagtagaagtatttaaagaatcttgacaagttttgtccatacttgctatgtaaatgtgtatgtctgtcatttttgtttcctttgtcctttactacatttatactctgttcttttgtagagtgtataatacatgagccttaaaaaagaaaaatttaacattttacacaaatgtttgtggcagaattatttgtaatagccaaaagcatatctatttctctatctctatagaagagagaaa

SEQ ID NO: 103776 - DNA, 1006 bp, Homo sapiens
acactgcctggttaaatatagctgccaagggacagccttgggacagtgtttacagaatagtctttccagcccctcaggcctcaagttacagatgatagcaagccttccctccttatcagctgcaaacagagatgcccccaaaagtggtgtcaggccaggatgatgaaaggagaagggaaaggctgcggatggccttcatttcctgctcctggcatctggggattccgagaatgatcccaggacctagatcctatagattccggcagctcttcctgcaaacacaagcccttgttgtgtgcctgagccttgctctccggcctggagacatccatctgcccactctcctaggaactgctgattaccaggaagcaccatcggctctgctgccctccccctggcagagaggcacaatgaccacattatttctcttccagcttcacgttacagcatggaagctgttgccaagtttgatttcactgcttcaggtgaggatgaactgagctttcacactggagatgttttgaaggtaggtgacctggggccccaggggagcagtagggagtttcagttactcagtaatctgacagtccctgcctttgtctcttaagaactgcatgtggttccttttaaaaagagaagttcaccttgattccctttgtgcacccttataccagacaccaaccaggccgggtgatggaaatacagtcggcataagccaccatccttgtcctgggaggttcgtagtctggagaggggaacacatccacccaaagggctgttacagatgttcttggctaagttctcagggagcacaggtgagggaacaagtgattccatcttgaaagatgggggttgtaggagtgtgtgcaatgtgaacgtcaggaatgcactgaaggtgacttgggcttttagctaaagctcagagatgtgcaagcccatgctgaatgcagggagcagcgccaggctcagcagagctggaactcaggaggagaggttgtgggtggag

SEQ ID NO: 103777 - DNA, 2076 bp, Homo sapiens
cagcccttgggaggcaggcagggcaggtgtgggaggcgactcggccccaggcgcacatgggtaggtaatcagtgggaaagtgtccctagctgcttcccttccttccccaggataagtgactgtcaccaaaaggcccccccgagatcagcaagcttggcctgtggccttttgctttttcacacccacagaaggggtgaagctggggctctttgcaggcaacagcagccgcacccgcccgagtcctgagctccacgtcagcagggcaaggggacggatggtgttgtctttctctggccatgcatctcagtttgcatcctgctgtgcaggatgaattggagggcagaggtgagtaggagagagcagttaggaagctcatcaaagcatggtaggaaaggaggagagtccgagctggggcggtaccagtggggacagaaaggattaaccctgagaaggtgcccggggtggggcctgctggattcagtgactgatgggatttggtcggtggggaggaggaggaggcctgggcttctggccagagtgactaggaggatgttgatctggggagtgcctgtgtggctgagggacacgtccaagctgcagtcggctctgtggttgtggacacctggcagagccatgccttctctagtctgggtcatccaaacacacgtggggtgcaggggccaggtggagccctcttgtcgtttttgttatctaacggtaattacggagtccagaaagagaattggaaatgccggcagtttaattaaagctgaatggcaggagaggggcatttggaggctccctccctgccttcactccccgtcctgccgcccaggcaggatgtcagatgaggagacgttgagctcatcaaacacccaatgagaagtcttacaacatcagaagctgtctgccaatgcgcctgcgacagcttatagaaactgctgccgcctcgaatcaacctctctccccaggcattgcacgtcagtaggtaaccaggtaaaggacgccgggggtgggcagccagctggagggggcgtgatttcctcccccaacaaaatcggcttccctgggttctgagcccatgatatcatgtttttaaacccgattttccatctacactgggagctttgaagttcgctcggtgtggggaatcacgtgctcagtgaaagacccaagcggagagactggggagctggttcccctgggcctgacactgcggagctgaatgtcaaagcagggccctcagagaccaaagcggagggtaattatcacttctccacaactagattgcaggagtcagccagcaattgatttttttttctacttcagatatttcattgtttaattggtagtgacacagatggctggctcgcatcagggcgtcacagtccgactcgcgaaagccaggctgtggggactgctgcctctcctgacatccttaggcaggtggggctaggacaggccagcttccctgcttaatttttcaaccacaaagcaaaagtaagcttgtgaacctgagacatgcttctgcaaaccggtcaagctgtcctcagcgacatgagtccactctaaactggacaccttggagtgttcagaaatgagaggacagtgaactcttgcctagacagctcgtgggagataaactatcagcactaggagatggcgatcaagtatcagagccctggaaactgcattgctggtggaatgaagccagaactctgtacattgtgttcaaaccctccgtatccagcccgtgtaccttcacccttatacctaccccatacctgccctgaactgtgccagcccagctggaggactcgaaggtggttttggtttggttggttggctattttggaccccaggtgcaaagagctgattgtgcactttagttcacggcacaatgccaccagagagccttgaaaggcctcatactttacctttctccttccctcccactcctttctccttccacaggcagccacccttatgtgttcagcatatgtcctcagacatctttgtatccttgaaaagtatgcagtgttatgttatgcagtgtgcttttttgttttgttttgt

SEQ ID NO: 103778 - DNA, 1054 bp, Homo sapiens
ttctcctgcctcagcctcccgagtagctgggactacaggcgcccgccaccacgcccggctaatttttttgtatttttagtagagacggcgtttcaccatgttagccaggatggtctcgatctcctgacttcatgatccgcccgcctcggcctcccaaagtgctgggattacaggcgtgagccaccgcgcccggccttaaaaatgttttcaagtcggagcaataccacttgttgaaatggcagtaataatattagctaacatttattgtatgcttactctatgccagccttttgacatcttttcccctaattcttagcccaagcctgtggggtaggtatcgttactatactatgaatgagaaaagggatctccaggagccacacagctatgcagttccagggcataggtttagtctcaacgtctgtctggtttgagagcctacgcgtgtttcattttgcctcctccttgaattatcagagggagaaagggcactgaaaagtagagaggaatagaaaaggagaataccactgatgattaggttgcccatacctaacttaagaatttaaattaggctgggcgcgatggctcacgcctgtaatcccagcactttgggagaccgaggcaggtggatcacttgaggtcaggagttggagaccagcgtggccaacatggtgaaaccccgtctctactaaaaatacaaaaaattagccgggcgtggtggtgggcgcctgtaatcccagctacttaggaaaccgaggcaggagaatcgcttgaacccgggaggcggaggttgcagtgagccgagattgtgccattgcactccaatctgggcaacaagagcgaaattcagtctccaagaaaaaaaaaaagtttacattaagctcattcttggcttttagaaattaataacatttttgcaaaagtacatcttatttcttccctgtttaatttttataaagattgtaaaaatacattttagctcaagagttcaaggctttcagagccctttgtgcagattgctgctccagtcccgggctattgtgtattgtgataa

SEQ ID NO: 103779 - DNA, 1187 bp, Homo sapiens
aataaaatattgtaactaataatacagttatatctttatagatattcaaagtagaatattttaagtttgaggaaaagaattagttcaaattaatttacaggtattttaagaaaaaaatggtatatttcaggaaggttgacaggatcattttaataaaaactcatttttaggttcacaattccttatcagaaactcttaagggccagatgtattttatagctcagatttttttttttttgaaaactaataagatgcacttaccatatgttatacaatgcccctgcagggtcagaggcagcacttcagagtcaaatacattagtatttcagcagccaaagctatgactaaagtctaaagtgggtagactataaatagtttcatgtcagttcaggtcagaccttgccaccaattaaattcccatcaggtttcaccaccaatgaattccagaaaagttttggttttcagaagtttttggattttggaattgtgggtaagggactgtagactatttactttcttagctctaatgtttgctagcatttgttactctctgaaaatggaacccactttcctttttttttctgctacaggatgtaagattaaatctgttctttctctataggccagttaatagaaattaggacacctcttcacaaagctcaataccttaggcagttgccactgtcccctgatacctccactagatacttcctactccttgctggctttatatgaaggatctcatagttcccctcttctcctctctcctttcggaggtacctcgtgttaataaatgctaagtaaaagagatttaaaatgtacagtacctcatgtaatatctatcctatctcaaatagaaatgtttcagaaggtgcaacatgctttctctggaccgacttttcctattaccagcgaatgtggaagcttaaaaagtaacgtatacttgtgtgtcatttggactttggtattaccataagggaatatatacttatgataacatgaaactccaaatggtacagaagtataaaggaaaagcagaagttttctcttgccctactgcgcccctcactcctccagcttctgaccacaaggtttggacccttttaaaataatttttttctttagctcagacattccaggggacagtttggggaattctgattaggcattataaccccacttggatt

SEQ ID NO: 103780 - DNA, 1037 bp, Homo sapiens
acatatgatgctccaggaactgtttttacagtgcgcaagatgcacaggaacagaatagcaaactcacatgattgttggcaaggaaaacctggctacgtggctgatgttaaatttgctttttaagacagccagatcaagaaatgtctgaagactttgagactgcagcagggagatgattttgcagttagtaaacacagccctgggaagccatggcaaggcagttctggtaagccatttacagcttctcttctagcaggagagcacagtggaggctctggagaggaaaacctgacgtggcctctagagaatgttgcccagggcagtagagcctccctggtggcactgctgtcagcaccaccctgcacagcccggcagaaccctgccttgccctggccatctctgtctctgagattcaccacggaggttagcttggttataggtgagctgttaagagtaggggtttgtgttcttggaagttagggcttaggagccacacatttccttcttgcccagctcttgcttgcttagaccattttctttatctttttcaatgaacacttgtcaaagtgtgctccttcctcccatccaagaccctttcagaaggtcacaactattttaataatactaagatgctgtatgccttttaaattcattctcccatgagtgcacattggagtttttccagacatgtgatactgcaaaagattgaatgcaaaagtatatatttgggtgcagctgttgttgctcaagctagacattaaagaaatttgcaaagatgtaaaacagtgccactgtcctcaaatttttaatcctttgaaataccatttttaatttaaaaagcaatagtttattatttctaagtttcagggtacatgtgcaggatgtgcaggtttgttacataggtaaacatgtgccatggtggtttgctgcactgtgaacccatcacctaaatattaagcccagcatacattagctatttttcctgatgtctccctccccccgccacccacccccagccaacaggcccagtgtgtgtt

SEQ ID NO: 103781 - DNA, 1675 bp, Homo sapiens
tttttttttggtagagacagagtcttgctgtgttgcccaggctggtctcgaacttctgggctcaagtgattctcctgccgcagtctcccaaagtgctggaattataggtgtaagccactgcgcctggccttcaataaataattattaagcacgtgttatcatgggatacaacagtgaaccaaaaatacatggttcctactctcaaggcggtttcattttagtgggagacatgaataaatataaataaagataataattataaatgatggtaagtactatgaaaaaaataaagccatgtcatgcagggcagctgggaggaagagcgtagctagtcaaggaaggtctctctgagacggggacatttcagctgaagctaatgggcaagggagccagctgtgtggagagctgaagcaacagtgttctagacacaggaaacagctgcaaaagcccttggcctcttctaagaactctcagaaacctgtgggccaagtgtgacaggaggttagagagagagacagagaccttgcaagacctcagaggccacagtgtgcaacgtggacctattctccatgcctagggcagccattgaaggctgttcactcgaggagtgatgtgatgtgtaggatttgcattttaagaggtggctctgtctgctgtctggacagtggattggaaagaggtaagagtggaagcagggagcctggtgagaaggcacgtgcagctgttcgggtaggactacattcatgggtgttactggaagtggaggaaagacagacttgaggtgtattttggcgccaaaactgatgtgactcgaggatggattgagatccttttgcatcatagaaatcaaaaggggaatttcaagagaaaggctcactcagtaacttcagatgctgccaagaatcaaggaggttgacaagtgagaaaagacacctggatttgtttaagaactaattaaagagaaaggatatgagaaaactttctagggggtgatggagatgttctgtgtctgataggggtgcaattgtttataattacaataaaaatggttacagtgtaggtatgttttatgtggtgaaactgacaatcaaatggagtggagaatacatggaagtatagatgaagcaggaatggcagaatgttggcaactattgaagtgttgtgatgggtacataggagtttatttgtatttactttgtacatgttttaaattttctatgatagtttctaaaaagaacttactggtgttcaagggtgccatttaattggagtaggaggtgcagaaaccaaattttatgggttaaagagaaattaaatgatttttaaaaatgagttatgactatagtccaccacccaattttaggacatttggaaataaatggaagagagaacaatgaggaggaggattaagttcaagtgaaagattttttttaaatggaagaggactatgcatgtttgagaaaagagggaagaaatgggttgaggaaggcagagtgcagttagaaaaaggtttctcagattcccaggcttaacgggcctcgtactgcagtaatgcctgagctcaggcccaaatcctgctcttctgactcttgtttaatggcggagggagttttggaggaggaaagaaagaaaggaagtgggttcagcttttctttgtattgccttcgaaagagaa

SEQ ID NO: 103782 - DNA, 1015 bp, Homo sapiens
aatggactatgctgccacgaggccagattcattaaaggaaaatggctcgtcttgtatttgttgtgaatggaaaccaggatattttcacagctggtttaatttgctaaccaggcaattttaaaaatagctcacaatataaatcctagctttgctgtattctatcaaatgcacttacattttgcatgggctgatggaatcaattcatctttagcaaattagaatgccagacatctagtcccagtagaatgacaagagaaacacttcaggtgcttttctccgtgtccactgcacagccctccacccccacactctggtcaaaggtctgtcatataaaaattataactccatttgtcgagggttttctgtgcacaaggtactttgcttaaatatgttttactctgtcatttccactcattacaccatttcatctccatttcactcagagatcagggtaggtaacttgcccatggtaatgcagcttgaaatgcaatttagatttgaacccagatcttaccgactctctcacaccctttgccatccttggaagctatgctcttgaaaaatactgttgttagtaaaactgcagttgtcaaaatcaaagtctcatgaataagagggagtaggccaggcgtggtgtggctcactgtaatcccagcactttgggaggccaaggcgagtggatcacttgaggttgggagttcaagaccagcctgaccaacgtggtgaaaccctgtctctagtaaaaaaatacaaaattagccaggcgtggtggcacacgcctgtaatcccagctacttaggaggctgaggcaggagaattgcttgaacccaggaggcagaggttgcagtgagctgagatcacaccattgcactccagcctgggcaacaagagcgaaactccatcttcaataaataaataaataaataaataaataaataaataaataaataaataaagagggagttgagggagacaatgaaaatggcataagcctatttttaaaaaaacaggtgga

SEQ ID NO: 103783 - DNA, 1096 bp, Homo sapiens
gcgcagtgcctcatgcctgtaatctcagcactttgggaggctgacgtgggcagatcacgaggtcaggagttcgagaccagcctggccaacatggtgaaaccctgtctctattaaaaatacaaaaattatctgggcatggtggcatgtgtctgtaatcccagctactcaggaggctgagacaggagaatcgcttgaacccaggaggtggaggttcctgtgagccgataccatgccactgcactccagcctgggtgacagagcaagactctgtctcaaaatatatatatatatgttttcagcatattatttgaaattagaaccaatattttatttaaaatatgtttgttctgtttccaaacttttcatgcagtttgctatttaacacttacaaggcaacacatataaatatttgtatacaataatattctacactggggaatggagacttagcaaagttcagtttcataaagaaagcatgtccatcacaaattaaaacaaggtggatgttcagtctccacacatttttacaaatcgagccagctacaagcaagtaggctttcagtaactcatctggaaggtattggaaggataaaaatagactaaataatcagaatttccattctagtagtttcctgctttttcctgcatctcaattgtcagtgcagggcctggctatttcactcagtgctaggcaaagacagtggaagcttgttaagccacagctattcaggctaccagattgtccaggcattggcctttgcctgccatgaaacagctcctttcctgtcgtcatatctgagtggaaagagcaaaggcgggagactgtataaagacccagaagccaggatgacaacaagtgttgtgggattttacaagcattcgtaggttccttttcaaggaaagccgggtttctagaatccatcagttgtctgctggctggcatggcagcctagtttatgggagaagcacactagggaatcctcccttttctggcttatagagataggtggagtcgatagtcacagggcattctcatgcactttttttttttttttttttgagatggagtttcactcttgctgcccagtctggagtg

SEQ ID NO: 103784 - DNA, 3385 bp, Homo sapiens
tcggcattttagaaatggaaaagacgtggtaaaatatttagattttgaagtgatttaattgcacttttaatgtatatgcagattttcatcatcgtttctatcttgcaataaatgaagctgcgagtaattggaaatttgctatttagaaagaggtttttaaaaaacacagacctccccctccccccttaaatctgctgcaaaaatttgcataaatataaatgggtttgcattctttcggctgctaaggccgacaaaggatctgggagggcaagccctagaacgggaaagcctttttctatctttttattttttaaactgggccctccttcctagagagatgtaaaacctaaagtaagacctaatacattttaaacatcaggttgggggcgggtgaacaccaggaggtttggggtttgtagattcccctgcttgaaaacctcccaagcaatatgtggctcacccctctcctttctgcgcgcgctcatttgcactgggtctctgtgtgtgttctcaaatgtgcagccagatgcgcttttattttgatcctggattcaaccaaagggtaggactatgttgtaaacatggtgttttaaagatatgaacagctattcaccgcgattagaaattatttctttatcagttctccctgtgtattagccttcttcattcctcacgaaataaaatttttgtttaattttacacagatgcaaaactgagtttttcagcataaattcatcgtgtgagtgtgtggttgcctgtttcggccatgtatccactgcgaagtggtcatttagggtcacatgtataagtagcagtctatgtgattgttagtaacccctgaagctgtgcagtgcctgaagttaaattccattactcctaatgcaggattctggaagcctgagagcagggaggaaagaaagctgaaaacttgctttctcagagcctcctccccctatcattgtgagagtgtgatgtaatgcttctcggtctggtgggctgaaaggattgtagtttgtgatgtggcgggtaaattgcccccacccctgggtaaattactccacccccctgagcacatccctggctctgagaggccttgttttcttttctctttttttcctaatttgtatcctcctgatttatgctgtggcatattggcatgagaaagagactgttcttctaaatctgttacaaagtatagtttagaaaaggcatttaaaatatgcaaatgggttgaattgtcatatccccatcattaaatatgtagacgtggattaaagctaattaagcataaatggaataattttgatcagaagggagcagtgttttttgttgtttcctttttaattaatctaattatgagatgcttactgggcctgaaagtgttaaaaaagataaagtggaaaaaatgctggaccattttgaaaatttgacagtctggaagagggtgtgtggtgctttcaaaagctttattcactcttaaaatggattggcctcttgtgctgaaaatggcctgtttctttgggccaattgtgtgtagatgaagggactttcacgctaatttaacaaaaagactttccatttgaatacataagataattaaagccctctgtctctaacaagcaaggattttattattttaaaaaattaatgttgttatgttagtaatggtaataaatacagaagtgactgtttagattcactgtaaattttttgatgatataaattcagcttttgtgtaagaaggattggaaacattacattaaagaggtagtctggaacaaagttgtctctaaatttttttacggcttgaatttaaagggaaaagatagagaaattaccttagtgatagagaatgttgcattgtggtagacctaaaggaaaatcagctctgatttttgttgctgtttttctgaaaatgaaagcacttttttggggctttgcttgttatatgattcattttacacctatttcctaaagttggtcttactgaagaggagataaaacctaggctttccatgttttgccattatcttgtttttgtggctgtgtaaacatatgaatggcaggttaattcagtttgcagagaggaggaaccagagcagggtacctgctgtcttaggcagaacagagaatgatacaatgaatgccatttgattctttgaaatgttttttataaatattcttttcccctggataattaaaaggtgagataaataagacctggcttcacgtatgggaagcattatggctctggtgagttgatagctcgactgccattttggatctcagatcctgcagagccaatccttctggctcaccaacacgatggtcatccagaaggaaatgaaaatgagtaatcaattaagtgtgcagatggatagtatttaatttgtgccttctgttgaagttttctttctgtgagtactgtgaattgaagctttaaaaactttaaagatgtggccgatgttatgaagagcaatatccaggggtgctggaacttgcacgttgtagttttactttttaaaaatgagatggcatatgcagaggaagtttcttattggagaaagtgaatataatccctattaactgccaccccccccaccaatctatatttcctaatgctggatcaactagtgataatatcacaacattactctgtctcagaaaaaaatgtcacaggttcatgactgaaagatcacaaaaattggtagcgttcatcagaagtggtatctcaattttaaagtgcttttcagtcattccatctggttcccagaaaggaagctttggcatctttgatatatggtgcaaactcagctctgttcttcagctgtgaatggccatttgttattctgtgtggccactcggatggtcctttaaaaataaacttccgaacattgaagcagagacttctaaggcttctccagctcttcagctctacaagagacactagaagagtgttatgcgatgatgagaccttcaggttctgcagagcaggctgagcagctctggctattgaggaccaccctgaggaataagggtggtcctcaccctacccagctgctcctcaccctacccagctgctccatgactgaaaagtttggaaagattttaatttttataactcagatcatataatcattgatcatctgcagtttaagctggacacagccctgaggcaatgcagatagatgaatgtactttgtccctttcctcaaggagtaccaggtcagcattattggtaaacagatcgtcacaacttggcagtttatgtgcaatattcagagcaagttcctggttacagaagtatctgagtatctgcattaggagggtccttgttttaaaatttcttaaagaagccaaataggccagtcgtggtggctcacgc

SEQ ID NO: 103785 - DNA, 1039 bp, Homo sapiens
agcgattctcctgtctcagcctcccgagtagctgggattacaggcatgtgccaccacggccagctaatttttgtatttttagtagagacgaggtttcaccatgttggccaaaatggtcttgttctctttaccttgtgatccacccacctcggcctcccaaagtgctgggattacaggtgtgagccaccacacctggcaagattttcctttttaagttgatttctttggtaaggtgtccaaagatggcatacctgtactatgcagtgcaaggtgctgttcagtgctattaagggaatactgtactattttataaagataaggccatatactctcattaccataatgattattagaagtaccaaaggagtttgagggaggagagacactgattttaactgtgttgatcagagaaagctttgttgaggactttgtatttgagtggaaccctacagattgggcagaatggtggtgagtagactcatggcaggctgtattagctagagtaaggtggaggaggactaggtgtgtccagggaggattgaggggaggttgcacacgtgtacaggagctgagtgcctgctgagtagtttgtattgctatggtagacggtggggacctgttgaaaatttgatggcagtgcagtgagaattttgatatggcagtggtgcagaggaggacttggtgggggggcactgattaaaggaagaattgagagacaggcaggccaattaggggataaaaggactgttatgaaaggtcctgctataaggctatggccatgcaactagggaccaggtttttaaggtgaatgatgggaatcttcaaccaaaaggaagatgacgcattccaggtcagacttactgaattggagaatttggtgggacttggcaatggaactggttagcaggcagctggcagtgtggatctgcagcttgagaaagaggtcagaagtggagataaagacttggaaggcttccacgtggaagtgatagtcgaaggtaagggagaggatgaggtcaccatgggactgtaaagaata

SEQ ID NO: 103786 - DNA, 1041 bp, Homo sapiens
ataaaaagaaataagtgaaattaatttcagtaatatcgactttatttatgtaaaatattgttaattcaacatattattgattttaaaatgttaacgcaacattttacgttttttttgtaccaagactttgaaacctggtgtgtatcttaggcttacaacacatttcagttcaaacataaaattttcattggaaatacttgatttgcttttagatttcataaaacttactactttttcatggaaaagtaggttcacatacccacgtttttccaaacataaaaaagttttccagcaatggaaatgtcagtttttaaatttaaattaattaaaatacagttaaaaattcagtttgagtggcactagtctcattgcaagtgcacagtagccacgtgcggctactctgttggacagcacagggagggttatgcgaagtaaaataggctactgtacagcggatgtgcactctgaaaatacccaaaatggtttagcaccatcgcaaagcatttcacaggattagtgtttcttagaatacatgttggcttatcctagtggaatttttagaatttagaagggtcaaatctctaattttgaatgtgaggagacaaactttttatgaaaatacacagattccaaaatttgaaatagtgtttgggctacagtcagcagaatggtacattggtagaagttcctaaacataccggtttgtgccatgtttctgaaatgcttggtgcagaggcttacacttaaaaacagatccagcaggaggggtgggagcgttcctgttactgtttgtgagtttcttttgcactccctggagtcagtgaggtggtggcttcaggtggggggatgaagttaggattgctttaagtcagtgtcccagcgtccctgtgtggtggaggtgtgaggtgggagagggtgccaccaggctaattatgttgtgcttgtctctcacttttcttatctcacttttctccgtttagccccgtttagtcattgtgtactttttgccgacctgggccaattgaacgcatatttactaaa

SEQ ID NO: 103787 - DNA, 1049 bp, Homo sapiens
cagtgatctgtggctgtgcaggggttttttttccccagcaagggaaggtgaagaacacagttagttggggttggggtttgtctgaggttgcgtgaggataggcttagaaaggtagtgtgggataaccagggggcaaggtctttggagaatgctggtgaatatgcatgacagtgcgtgttaggttgagaataaaagaaccaggggcaggcaaatggtctgaagaaaaggaaaagaagaaggagtctgggttggaggaggtgggaatttacatcttggaagggcttaagatagcacttcctggggtaaaccccgggcagagcattcctgtgtgctttacctgtgctaactcatttcatcttcatgaagaccctgtgagctggtgcggagagactgtgttgcccgaggctacacaggtaggaagtgaccccgatggcctcggctgctgagcttctgtgcttgggcattatggtattctgccctaggaagaaaccagacaaaatacttctcccaggccaggtagcattgcagtagcttcctgaagttgctgggccagctttccttccagaagaaatatttggcgtggtgtggaagggggctgtgaactgtctcctcccttttagaagaaatatctgtatttcaggtagcagtgtccttgatacagaactcttagttttccccacctgctttgcacatgcttgaatgtcctttaataggaaacaaagatgcctaacatctcacaattgggaaaggctttaaatgcaatcagcctgtgaattctctgagctgtagcagcttctgtgtttacttgtcctccccccaccaatagagaagaaaagccagagtggctggtccctccaccagcttggggaaggggagggggagacttttaggcactgtggtccctaaaaggaggcgaactggtgtttcctgctacagaacactggtgcatctgcagtggtttggggaggacgtctgagtcctgtgatgtatcactcagggtctaggccctttgtaaacccaggggagacctgctttaaattttgctggga

SEQ ID NO: 103788 - DNA, 1092 bp, Homo sapiens
ttcaggaaccactgaatattctagccccatctttctaagggttcggtgatgtagaatgctaaaagggttcgggctgttagtcagagagggaggagggtgtccagcatcggcgtgggcctctagttgttcttttattgccctttatgatgtgtctattttgctttttctttcctccttcagttttccttctctccatctccccacccaaatagcatcaccttcctcagccctctacttttcatccctattcgcttcttaataaataaaagcgaatcaaaaagacagcaaagagaaaggagaaacattttataatgcagagttttgagcaaaatacttaactctgtgtctttatatgccaccacatctctttaatttttagaggatatgaatattttgtcgtttgtatttcataagccatctgtactgtgttcagactctgtgggttctttgttgtttaattataggaaaaggaggtatagggcaggaactttttacatacttgtgaattttggtcagtcctgtgaaatgtaagcctctggcatttattcacggaccattgggataaaccaggcatgtaggttcaattttttttgcctttgttgggatgctgtggccagtagccagggccagtcattccagattcatcccctgccactctagtccccagggactaacagagtccagacagtgtacattttcctggctacgggcttgaccttctgcttcctctgtcccactgcattccaaaaatgctaacaagtgactagcgagcgtaaattttatgtgttgcaaaagcagttgtggaacttgggtttcaatgtttgcaccactatttgtaagcaggatgttatctctaaatgatacatgtgtaactgacccaggggggctgcctggcctccttgatgctcttctgtgagaataattgactctggtagtgacagagctgcctgcggctactaagaagctctgctgtacttaggccacctgccattgttctgtctctgctgctgctgctgctttttctatttttaataagttgccaattacttggtttttatagtgataccaacagttcactaaaatgggcatagg

SEQ ID NO: 103789 - DNA, 1081 bp, Homo sapiens
cctgttaaatgagattttatgtcttctcgtgtataacttctgatattctccttcctttcttttatggaaaacttttctgtattaagacttaaactcctgccacacctggagtaataaacttgtgggaaaactgaataaagtactaatgccactgaactgtacagttaaacacagttaaaatggtaagttttatgttatatatattttaccataatggaaagtcaaagagcacatggtgaagggacacaaagcctgcagtgagaggccatcagggaggctttcccagaggaggcggcaccctcagtctgagaagtattgatacgagcagtgaccccgggaaaagagatgacaagtgggttctaacttggacctgaaggggctggagaacaagtggggtcaggccctggtgtggcagaccgaggagatgagacttggcccatccagtcacgggaagccactgagggattttaagcaagcaaatgacaagtttggattccatttcaagaaagatcactctggctgctctgtagaaaatgtatcagagggtggcagaactgcatcaagggagacataatcaggctaataacaatcacagtgataataatagcagctagcatcccgtggtgcagtggttcaggaggaaatgatgagtgcctgggaggctgcatagagtgcagtgatcgcacagctagtaaatgatgggctttggaaagatgccaagatttctgcttttgggggaagtctttactcattttgcagtgcactactgtataggaatagctaatccaaagtcaactgataactcttcaaatatggaaaaagaactcgggttcatatgacaaataatgagagaataatatgtaagctctcttccttaaaaaaataatgtagacaggtaccgaggagaaagatgcctgtggctataaataaaggggtagcaggctgggcacggtggctcacgcttgtaatcccagcactttgggaggccaaggcaggcggatcacgaggtcaggagtttgaagccagcctggccaacatggtgaaaccccatctctactaaaaaatataaaaactagccggg

SEQ ID NO: 103790 - DNA, 1151 bp, Homo sapiens
gattggtctcaaactcttggcctcaagcgatcctcccaccttggcctcccaaagtgctgagattacaggcatgaaccaccacacccagccttgtgttgtatttcttacaactgcatgtgtatctacaattatctcaaaaagttaaaagcaaacaaaaaaattgaataaagcaggtctcccttggtgctcctagttttcaatattttttacttacccagatgtttcttctgtaataattttctgtgcaatgatttgttttgatcaagtttgacaccttactaaagaatacttagctttcttttttttttaaccttttaacatctttcaaataaggatgtatcttaacaattcatggagacttagcattgaatcactttaattggtgtcactttttcttagtggcacatgaaatattgatgtatcttacaatcactggtgtcctagatccgatacatatgattagtgagtcattcagccatgttggaaaagcacagtagctggtgacagttttgctagctacatttttcatgtgtgatttatcagttaagtgtgtgtttctcagccccaagcccccattctctgtgtgtgcttttaaagctgggatcctgccagccacatttctcattgccatctggctcttccttaggcagtgccaacggggcaggagagggtgactgcatggccggagaaggaagaaggaacttgctgcttcctgttcccatgagggcacttgagcaatgcttttttgccccacagcagcagcagttccttcctgtagatgcacctgaatccattttgcagttttcccaatacttggaggtccatcttcgctgcatcctcaggggtgttgacactggcccaaagctccatggaagcctcttccctttgttcccccagccctggggcagctcccacctctatagtaccttagtgttctctctctccccttttcagtgactagttaataactttatgtctagttaacaattttttatattctttgtatgacaatctgtatgttaagatgatgagtgtgatttctgtctcctatgtggacctcgactaatacctcgtgaacagagccaccagctcagcatgggctgcatctcagcttctccttcatacatgctctgttctctgtagccagtgac

SEQ ID NO: 103791 - DNA, 1038 bp, Homo sapiens
tgtgccaccacacctggctaatttttgtatttttagtggagacggggtttcaccttattggtcaggctggacttgaactcttgacctcgtgatccgcctgccttgacctcccaaagtgctgggattacaggcgtgagccactgtgcccggccagttttttgttttgtttcaaggaatctctgttcacatataaaaaattgcgtaaaagccccccttttcttacgtacatgatatcatcaagtacacattttttgcatcttgcttttaaaacttaacaccttatcttgaagacttatcttccttagtacaaaaagaactgcttgttataattgcatagtattctcttgtgtggataaggtataataacgtatttaaccagtcccctaattgatggactgtttctgatcttttgccgttacaaacatattttgcagtgaatatcctttgcatatataatttgccacatgtgtaattcttttcctgtgatacatacttaaaaataggatagctgggtcaaagactgtacactttcattttgataggtagctgccaaattgtcccgtacagagattgcacccgtttatattctcatcagcaatggtatatgtgaatgcctttttctgtgttaccttggacacaaggtaactgtgtgttaccaccaaattttgtctttgccagtttggtcagtgaaaagcggtatcttggtgtactttggtgttgttttgttttgttttttttgagaccgagtcttactctgttgcccaggctggagtgcagtggtgtgaactcagcttactgcagcctccacctcccaggttcaagtgattctcgtgcctcagcctctcgtagctgggactacaggcatgagccaccatgcccggctaatttttgtatttttaatagagacggggtttcaacatgttggccaggctggtctcgaactcctgacctcaggtaatgtgcctgtctcagcctcccaaagtgttgggattataggcgtgaaccaccatgcctagcctgtcttcgtatactttgaat

SEQ ID NO: 103792 - DNA, 1051 bp, Homo sapiens
caggagttcacgaccaggctagccaacatggtgaaaacccatctctgctaaaaaaatttttaaaataaaataaaacttagccaggtgtggcggcgtgtgcctgtaaccccagctacgcgggaggctgaggcaggagaatcgcttgaacttgggaggcagaggttgcagtgagccaaaatcgtgccactccactccagcctgagcgacagagtgagactccgtctcaaaaaaaaaaaaaaaaaaaaaaaaagaaggagaagaacatagttgggatagctgttactcagattgtctattaaagattacaggggtagatcattcacagaacatttcccctgggttacctaagtagaaattaggtgttgaactgtgtgtatagagacttggatgtcattttaaatggaactgggcatcctgtaactgatcctgaagagttaaacacaggtaaatgttggcttagttgttatcaaaatgctgtatgtaaatcactttttagatttgaagtcattttctcactggtgtataattttagttgaagaattgggtcatgtaagttcacaagtcagctttactctatagtttttgattactattaaacatgcttatctttcagaaatatacattttcgtcaaggtaattcaattattcagcttgctaaatttaaatgacaactgctggcacacaagaacacgactttccatttttactattctgaaaatagagcacaaattaagagcattgagaagtagggtacgactgtcacctgtggagtcttgaattcagagttgattttcttgtctgccgatttttttcaataccaagataagtgtcacaaatagcaccctttctcagaggatttccaggattcgaataacagacacaaacttaataaaatgacagtagtgcagcataatcaggaagcccacctgccgtcagatcacttgtttgcagtagataccgtgtgatctcaggagcagagtccacatctcttccatttattttctaacataaaattcttggttttttcttaaagcgtagatctggaaaggtg

SEQ ID NO: 103793 - DNA, 1013 bp, Homo sapiens
gtatttttgtaatagaggtgaggtttcaccatgttggccaggctggtcttgaactccttacctcaagtgatctgcccagctcggcctcccaaagtgttgggattacaggtgtgagccactgcacctggtcctaaaattaccttttaatggaatttcaatttactgtgattttgatgttgaactgctagcaatctgatttcaaaggtcagttattatttattctttcaatagaaaagaaaaactgtgtcgaaccatatgtggaggaaagcagataaaaaaaatgcaacatgaaaaggaaaacacctgaatgtttagaagagctgtcccaccagttactgttataagttctcagtttttctcctgaataatatgtgcctcagagctgtggattctggttgataaacttattttctctcctgtttaggagccatatttcatcacttttctgtagagaatagttctttccaaggccatagctaagaccgctattcctcatcttctttttagtttcttcgctgtcaagtgctgacggtagagtgctgctctggcttttgtgggttggtctggcccttaaggtgtaaacatagtttttagcagttccagattataaatattagagtatgtgagccaggagtggtggctcatgcctgtaatcctagcactttgggaggccgaggcaggcggatcgcctgatgttaggagattgagaccagcctggccaacatggtgaaaccccgtctctactaaaaatactaaaaaattagccaggtgtggtgctgggcacctgtaatcccagctactcaggaggctgaggcaggagaatcgcttgaacccgggaggcggaggttgcagtgagccgagattgtgccatcgcactccagcctgggcaacaagagcaaaattccgtctcaaaaataaaataaaacaaaaataaataaataaacaaatagataaatgtatgtatgttagagtatgtggtataagccctcgttgagaagctgtttctttttttt

SEQ ID NO: 103794 - DNA, 1006 bp, Homo sapiens
aggcgtgagaatcacttgaacctgggaggcggaggttgcagtgtgctgagattgcgccacggcactgcagcgtgggtgacagagcaagactccatctcaaaaagaaaagaaaagtgcctggctcatattagacaataaatgtttgttaaaggaatgagtcagttcctggacatcctagtagaagagagccaagtcagtctgtgccttccggtctgtgcctgttaccaccctggtaaaagcagccatgccgcagaaagtcacttcaggtgctctgatgctgccagtaccggtgtcatctgccttgagaccttgagggccaaacaagagacggggcaatagttgtggggtctgcagaagaaggcaagtttctctagagttggagttactggggatggtgctgttgaagcaagtggatattgagctaggacttgccactagggtaaggtgtgatgggcattaaagaggatggtttttgtcaggcgtgcagaatgaggaaaatgtaaaagctagaactgtactatgaatggctttgaatgccaattacagatgcttcaagctcttagctttccctttgcatggtctcggaccattggagggttcagttctgggatgtagccggttcctagggatctcagcatcgttgctttttggtgttctgaacttgcatgcggggcagtcttgttatgcctcagcttaagtgaatattgtgaatattgggtattttctttttttgtttttctttcttttttttgagaccgagtctcgctttgtctcccaggctggagtgcagtggcgcgatctcagctcactgcaacttctgcctcccaggttcaaatgactctcctgcctcagcctcccaagcagctgggtagcccgccaccatgcccagctaatttttttgtatttttagtagagatggggtttcgccatgttggctaggctgatctcaaactcctgacctcatgatttgcccgcctcagcctccgaaagtgctgggattacaggc

SEQ ID NO: 103795 - DNA, 1027 bp, Homo sapiens
gccttgccaacatgaaaaccccgtctctaccaacaaaaatacaaaaaaaattagccgagtgtggtggtgcacacctgtggtcccagctactttggaagctgaggtagcaggatcacttgagcccaggagggggaggttgcattgagtggagattgcaccactgcaccccagcctgggtgacagagtgagatcttgtgtctagaaaaaaaaaaaaaaaccatagaagtcagataacccagagatgtttttgtactttcctttgcgtccgtggccacatgccctgtcactgaggttgcagtatgcaggtccaccagctgtgggtgtttgtagcattgcccctgtggtttctgggttcttgtcgccgtgcctcgcacacattgcaccctccacctccaactggagggatgtgagattaaacctcagtgaaagttttctttccttaggacactcacacatttcctctactaagttgatacaaaaatcggattttgcagtctatggagatgagtgattaataggctgggtaccaaggtacttgagcaaaggctgttaacaagaggatgccaaacagagtgatttagagagtatatattcctcttcatttttaacatacataacagtgttttcttaaactacaaatatcaatacctaaaatgattaataaaatatgcctctgtaatatgcctttgattggattccacaaagaaaaatgatttaaaataaagatggtgtgaatgtacttgagagtgaatgagattatttatgcagagaatgtagtttatgtagctggacagtctctcctatgtgccttcatctgcattaagaactgatgaagaagtgatagcaaaggggaaaattaccgtaaataaaatttttaagtgattaattttatgaacaataaaaattctatcgtttttgctcaaaaatgttccagatcagcttgacatagaatctaggctgacgcaggctgatgcgtggcctttgatcttgttttattatactgaaccattgcataatttcagaatta

SEQ ID NO: 103796 - DNA, 1079 bp, Homo sapiens
ttgtagagacatcacctcagctaggagccataaaatgtgctatgatgcaaagaatcgtggagaacgtgccagagatctatcatgtggtcagtggttcattcattcggtccgcaaacatttgtggtgcctcttctaagggcttccacatctctcatgctgctttccccagtgctttttgaccacctctttgtgtccatcttcactgttagactgactgtaagtttcttggttttattcgtatttgtatggccagtaactagggcagtgcctggtgcaggataatcactcagaaattgtttaataagtgaatggtcaagaatgaaggtggaaacataattttcttgaagaattgacacttacttaaagctaaaactaaattacctccacacagaaattaagcatgagccttttccagtgttcattggttgtagcagttggctcttcctggagccatcactgagtaaactggtagatacccattcatgagagaggtgtcaaagaagggttccattcacattcatttaggctgatgctgctaaaggagcattgtttagcgttggcagaacacatgctttgatcatccagcttctcgccgtctgggggacagcttttaacagaacccacatgataaaacatatttgacattatttgggcttgttgcttacaatgggaaggcactgacttcctgtataactgatcttcaaaatggcattctaagaaatagttacaatgatataaaacctaaattgccttcgggaattggtatgtggctgcattgtcattcattcttggataagtaaagatgtagaaaaattacacaagaatattttcagtagaattgagctctgtaacagtactgggaaacattcatttttaagatgctggattccacaaattcactgtaatagaattagcttgtcatttaacacaggaatgtaggaaacacaccaggaagttctacaggcggatcctttaactcttatttagagtctgatggtgtgctgggatccattgcgaggtgggctggtcagctacaggaccttccttccagggatgattgtgtttttgtgaacccccat

SEQ ID NO: 103797 - DNA, 3082 bp, Homo sapiens
gactcatttaacagattaagttccttggggttgtgaactctgcctaattcatactcatgtgacacccctgccaccctgggcacctagctcagtggctcagtgggtattcatcattcagcagatgcttactccgcagcattgtgctggctgctgtgtggaattctaacgttagcaagttagggtctctgcctaaaagacgctaacatggggaaggaaagttgtgaacatggtgccacagcactgagcaaaatggctctagacagggaaagattattttcaggtgatgagcttgaaaacagcttcgcagatgaaatgacacttgaattgggcccagaaggatgagtaaatttcactgtgtgaattcagcaggaaaacacagtaggtgccaacgtgaaatggtgccagagtgagaaggcacaagttgtggaatgtcaagtagtatcgaatattgacatctacataggaggtagtagaagataagactagaaaagttggttggtcccaggtcatggaacatcttgatgacattcgaggccaaggagttcagctttattcttgtgcactaaggaactgttgaaggttctccatacagcagtgatataatcaaaagtgtgctttagaaagattgctccagccaggggtgtttagagtaggttgaagatacagagcaagtttagagtgccattgctattgccttgtcccaagatacaagaaggcccttctctgtcaataggaatggcaaaggacgtagctttgagagagatgaagttagacttaaccggtgtaacacaaggcaaatgaaaaaaaagagatgactaagacagttgtgatacaagcaactgggttgagagaaactggcatgtgatcagctctcctaagggcagagctcaaaggagagcccctttgagggattaatgggtaatgaatgcatttgaagctgtgattaataagatgatctgttccccagactcaacccttggaggtgctgctgcttcaaattatgcaaattccacttggggctcgggagcctcctccaacaacggcacctcccccaacccaattcacatctgggacaaggtgattgtagacgggtctgacatggaagagtggccttgtattgccagcaaagacactgaatcttcttccgaaaacaccaccgataacaacagtgcctcgaaccctggctctgagaagagcactctgccaggaagcaccactagtaacaaaggaaaagggagccagtgccagtctgcaagttctgggaacgaatgtaatcttggggtctggaaatctgaccctaaggctaaatctgttcaatcttccaactctactacagagaacaacaatggactaggaaattggaggaatgtgagtggtcaggatagaattggacctggctctggcttcagcaactttaacccaaatagcaacccatctgcctggccagcactggtccaagaaggaacttctaggaaaggggcattggaaacagataatagtaattccagtgcacaggttagcacagtaggtcagacatccagggaacagcagtcaaagatggaaaatgcgggtgttaattttgttgtctctggcagagaacaggctcaaattcataacactgatggaccaaaaaatggaaacactaactccttgaacttaagttcaccaaaccccatggagaataagggaatgccctttggaatgggcttggggaacacctccaggagcactgatgccccttcacaaagcactggagatcgaaagactgggagtgttggatcttggggtgcagctagggggccttctggaactgacacagtctctggacaaagcaattctggaaacaatgggaacaatggaaaagagagagaggactcctggaaaggagcttctgttcagaaatcaactgggtcaaaaaatgactcttgggacaacaataacaggtctacgggtgggtcctggaactttggcccccaggactctaatgacaacaaatggggtgaagggaacaaaatgacatctggggtctctcagggagaatggaaacagccgactgggtctgatgagttgaaaattggagaatggagtggtccaaaccaaccaaattctagcactggagcatgggacaatcaaaagggccaccccctccctgaaaaccaaggcaatgcccaggctccctgttggggaagatcttccagctccacaggaagtgaagttggaggtcaaagcactggaagcaaccacaaagcaggaagtagtgacagtcataactctggccgtcggtcgtacaggcccacacatcctgattgtcaggctgtcttgcagactcttttgagccgaactgatttggaccccagggtgctctcaaacactggctggggccaaactcaaattaagcaggacacagtgtgggacattgaagaggtgccaaggcctgaggggaaatctgacaaaggaactgaggggtgggagagcgctgccacacagaccaagaactcagggggctggggagatgcacccagccaaagcaatcaaatgaagtctggatggggggagctctcagcctctacagagtggaaagaccccaagaacacaggaggctggaatgactacaagaacaacaactcttccaactggggaggaggacgacctgatgaaaagacaccttcctcttggaatgagaatcccagcaaggatcaggggtggggaggtggacgccagcccaatcaaggatggtcttctggaaagaatggttggggggaggaagtcgatcagacaaaaaacagcaattgggaaagttctgcaagtaaacctgtgtctgggtggggtgaaggagggcagaatgaaatcgggacttggggtaatggtggcaatgcaagcctagcttcaaaaggtgggtgggaggattgcaaaagatccccagcatggaatgagacgggccgacagcccaattcctggaataaacaacaccaacagcagcagcccccacagcagccgccgccaccacaaccagaggcttctggttcgtggggaggcccacccccaccacctccaggcaacgttcgaccttccaattccagct

SEQ ID NO: 103798 - DNA, 1631 bp, Homo sapiens
tagacagttgtcctttatcatacctcgtatttatagtgtccattgtatataaagtacatactgaatggaggataaaaccagggctacagtaaaccatgttcattaagaggaacagatttatcttaattgagatgtgaaatttcttgccaggaatgttgtgataagttcttttcagttttgaaattcctgtccaactttgtgcaagggaaaaagcattgatccataaatcaggaggccttgattctatggtttgttaactttctgtgtatcattgaagctttatggattttagtttcctgctctctaaaaaatgagtaataatatttgtcttgccatggagatggagtagataaaattacaaagacacgtaaatgctgcatctgcaaggaattattattctgatgattgttttatatagctgttgcaaagagttaattcattctttccttaaagattccaaatctatgcaagacggctggggggagagtgacgggccagtcacaggagctcgccatcccagctgggaagaggaggaggatggaggagtctggaacaccactggctctcagggcagtgcttcctcccacaactcagcaagctggggacaaggaggaaagaaacaaatgaaggtagcctgcttagaaatgttcgcacttgctcattcgctctgagaaggcagaactgaggttttgttttgtttgtttttgttttgagacaagttctccctctgtcacccagactggagtgcagtgggacagtcacgactcgctgagcaacctcctgggctcaagcagtcctcccacctcagccttcttagtagccggaactatcaccatgcctggctaaattttgtattttttaatagagacagggtttcgccctgttgccaggatggtctcaaactcctgggctcaatcctcctgccttgtccttccaaagtgctgggattacaggtgggagctaccatgcctagccagaactgaggatttttaaatgaaaggtgtgaggcaactggggtcctcaaggtcctaagtaaggggaaaaatattttcttggaaacaaataactacttcccttttacccttcgtcttgctttcccatgaccttgaaaccttgaactataaaactgttgctgtgggtaaaatgaagttttcaaagatacgagatatttttcatttttagtttccacattataataatcttttggaggctctcaaggcatactttataaatgcttttgcattctaaagccagagaagtccttccagtaaatccccatagatatgtaggagggaatccagaggaagataatgctggcttctcccgcggcaatcagcacgtcttgattttatctgatttgggaaattccaagacccagaacccttctcccgacaaatgaaataccagtgagtacttgtgtgctatagcagctaaatgattaatgatatctcttttttttttttttttgagacggagtcttgctctgtcgcccaggctggactgcagtggtgcagtctcagctcactgcaagctctgcctcccaggttcacaccattctcctgcctcagcctcccgagtagctgggactacaggcagctgccaccacgcccggctaattttttgtattttta

SEQ ID NO: 103799 - DNA, 1059 bp, Homo sapiens
gatgactctttcttttatagcataagaatacagtctgtttctgtttagagatgttttgcttaagcagtcacttacgggttttcttctattaagagcttttatttcttcagtcacagaaggaattattcagcaaacttttcagcattccttgcactcttaggttgtctagtgtgattttggctttcttttggttatttacaaattaacaatgagactaaattaactgattgaaagggactaataaatacctctctaggttgacaaccaagatttaattaagttaattgggaattgactctttcagccccagtaccagtgattctgactttatataccgagggcgttttttttaaaaattgtgataaaatacatataacatataatttaccatagcgtacatttttaagtgtacagttcagtggcaataagtatattcacatacttatgttgccatttaccaccatctatccgcagaactctttctatcttacaaaactgaactctgtacctattaaacagtaactccccattcccccctccctctagtgagggcttttttgaccttaaaacctgtactagctggctgcggtggctcatgcctgtaatcccaacactttgggaggctgaggcaggtgaatcacctgaggtcaagagttcaagaccagcctggccaacatggcaaaaccccgtctctactaaacctacaaaaattagctgggtgtggtggcaggcagctgcaatcccagctacttgggaggatgaggcaggagaattgcttgaacccaggaggtagaggttgcagtgagccgagatcgcgccattgcactccagcctgggtgacaagagcgaaactcagtctcaaaaaaaaaaaccgccccccacacacacaccaaaaaaacctgtactaaacttaagtacttcgtcactttcaaggataataaaattgatttgatgactaccatcacgggctgggcacggtggctcacacctgtaatcccagcactttgggagaccgaggcaagcggatcacgaggtgaggagatggagaccatcctggct

SEQ ID NO: 103800 - DNA, 1079 bp, Homo sapiens
aaactagtttgtcccattaaaaaattaaaacctacctctgccctactttgcccaggagatcagcaatggtgtcttccactaggtctctttaccaccaggaccaatgtcttttatgctgtgaaacaaacagaggaagcactatgagttccttataatgcccagtttaaataggctcctttccaaatgacacgcactgacatcaaactgttttctcctaacataaaccagtttgggttacgaggagagcagcctaatgaaagtgaaagtagtcgtgtgcaaaacttctattttagaaaatcatatcagacttctttctatttgaaaagcaaaagtaccagctgagcatgtatttttccagttacttctggttcagtgtggtgaattttataaaaatgaaaacatagatataactagggcttattaatcatttaaactaacataaaatatcaacataattttagttaaagagaaataggacttaaaaaggtaaactcaagtctacattttcagtctgtattaataaaactcaggaggctgaaataaattatttggttctgaggttccgtgtttcatttctgtagtgctcactcaaaggaggaaacaatgattcatggatgaatcctcttgccaaacagttttcaaatatgggattgctggtaagttttatttttttcaaatgtataacgtatcccaacttttaggtttaatattaataccaattttaagacaactgccacatatagtacaaaattaaagatttaaaaactagttaagcaatgttcttgaccttttgagttaagtaatatttctcttctattcttattaatgacatactccaacatttaaaggttatggcttttaaatgtgtagtcattttgtccttttccttaggaggatagagaagaaagaggcattaaaaatttatacaattgtttccaaccgcattactgtactagttttcatattatgattttttaaaaaggcaacgataacgaaactagaaaaactatactgggactaattacatagggaattcttgtagaatttctgatttctttatctctcggcaacgttgtggg

SEQ ID NO: 103801 - DNA, 3571 bp, Homo sapiens
tgtcagaactaattcgggtctcttaaaatgctctatggggccaaacaaattgtgtgccagatgtggccctcaagttgccagtcctgtctgtaccaggatgcttcgttattgacaaactctcacattgcaactggagtggaaacggtgttagccactagtctgtggggttttcatagtaatgctcttgatcaccctgaggaacttgaaaagaatcaaactaagaagaaatgaaaataattctgggtagtaaaggaagtaggtagtctttgatctatgatatttctaaatatgagaataattaaaacataagtttcctggggcagcactggttatatcagcagacgacagcacatttatagagttgtgaaagaaaagtggtatagttatggcacctgggaaattgcaccgtgtaggtaatgtggacacatcttctgtgttcagctcttaagttctaaattttagggcaaccactgtgcctctttgatctttttattccttgtaactatgtttcacccagaccatttatctagatgatgctaaaatagcaaaaacagacaacttctctccctgaggacatttgaatttatgagcaagatgtgttcatcagacacatcagtatccagtctaaatgttttcttagcgagatttttgccaggttatccctaaggctctttcagtcttccatggaaaacaaactacaacagatacatgttttgttttgttttttaaaataaataaataaataaaaaggacccatgtgtgttccagggacaaacaccagcagcctggaccaatgagagtttgtctcgtcttatccccagaaatagaaatattaatagcttatacccagcacccccatgaggatagtggggcaggtcactcttggttcatgggggaaacattgattctggaaattttcactctgtgtatgctacttttcaggaagcctttcagataaaaaatttgatgtggacaagcgagcgatgaatctcggggattttaatgatatcatgaggaaggatcgatctgggttccgtccacctaattccaaagacatgggaaccacagatagtgggccttattttgagaaggtgagttgaatcctttgtttaagataataattcatgagaaccgctttggttcccatttgtcttttgataactgattctagaggaagcatagaattactgaactagatgagcaaaacacaaacatcacctgcattaacgtggtgacctgaaaaccattgatgtcaacaggtgatcaggcaagagcaagaaccatctgtctttagcatgtgtgtattagaaaatctgagttttgagaaattcatgaagtgtggaaattttagagataaacttactctgcattcttttttccgctgctgtgcagctacaaaataaattttgggattttgtgcaaatattccatgtctcctaaggccttgccttcttctagttttgagataactctgttgttatctttccccagttcctagcgatctgtgtttagttacaatggtatacttttcaaattctcatctacctaatttaaccaagcagtttctacctattggttttgatgtttaacatttctaatggtgggaattatatcttgatccagaataccaatttgctgtgttcctgatcttcagaaagcagttaaaaccaaaatttttaaatctggcacgttttgacactgttgttgctggtccagacagcaacatattcacaagattggcctggcttctgtttcagcagccacattgctagagtaatcaatattagatgcgtaaaaataaagtgtctggcaatttttattgtaatgcaatggacagaacgtgttactaacttagaggaaaagaaaaatctatatcaaagaagatgacagatggtgtctgttgggccaagtgtaaagattattatcagatccaaattccatccttggttattgctaatacactctaactttgtttattgctagtgtttctctcttttcccttcttgcattctgttgcttcactaaccaacactcgttgtgattggctaactcctactacttttcagctgactttgcctttctccaatcaagatgggtgccttggggatgaggctccctgctctcccttctccccttctcccagctacaagctgtctccctctggttccacactacccaacgtcagccttggagcaatcggcacagggctcaacccccaaaacttcgctgctagacaagtaaggaggcctctcaaatttataactgcttggctatggcctcgccttggtcctggtctgcagtttattgcatcatttgtctgtcttgggaaatttgttgattactgaatgcacagaatgatattaagtgtaggttctagatctttcagcccatagaacccatctctcttcatgtttttcaacacggattttattttaaacctgtatttttttttttgtctcctcatttttgatcataagttcatatttaataagtaataactgactaaggaaaatgttaaagaggctacgtaagtaccttagacaatctaacttaatgcatttgccattttaaacattagattggatatgtaatactttggagatcttttcaatttaataaacctgctaatttaaaaataggaaaactagtatgattaagtatttgtgggttatggcatcttgaaatctagtgtctttaagtgtaaaatatagtaattacccggagaagggtaactttaaatagtaaacggtgaagctttgggaagaatgggtattgctgagacacagcagtgtttcattgcacctggggttggatctggcaaccctccagggaagggctgtgcagtagaaacaagacaggcaggcctgggaggatcatgcctcctcaccttgccaggcctgagggtgcacagcatgaccctgcctgccttcccacaatagctctgttgtagtttttgtggagaaaaccaggactttggagtcacaattcctttgcaacaataaccccagcagtgatagccatacttctgtgaccacttacttgtcactgtgaccttcacctcaggacgttgtgggaggacgttaattatacaacttgtaattattagttgcatccacatgatgcatacatgatgatgttctgtctccatatgataacttccacatacacgttacagggtgatgtgaagcaatacctctgacaccagttaagttgcacataggtctcttatatgctttctaattgctgccttagcacattttaaaaaatggattatactatatccatgtgttcagttggttatttctggattgggagttacaactgattttttattttcttcctttatatttcatcattttccttactgcttccacagaggacatggatatatactgtttatataaatggaagaaattattatattgatgttttgggggttcttttattttgaatcgaggtatagaaaacatgaaataggcataacattcacagttaatggtgattgtaaatgtggtggatcacatgattatcaaatgctgttagtacataaattagtatagtagaccagcca

SEQ ID NO: 103802 - DNA, 1229 bp, Homo sapiens
aggtgatcagggtggcgaagctactgactaccacgatctgaggaaagttagggctgtgtgttggtaagacagcagcagcagagatttagagtttctagaattaaaggtcttctcatgtttcaacaacccttggggagacataaaattcgtgatgaatctttgatttatgagatacacagattttaattgccatttcgactttatgtttagaatcatttttattttcaatgcttttaagttcactaatttccctacagcagtcccttaatctattttttaatcattaagccatcacagtatttttagtgttgtaggttttaatgaagccattacaaaattctttaaaattaccttaatccatgtgattccagggttatgataatggtggtgatttcaattcagggtatatgtataatactcagtataagcagtgatgcagctgtctttgctgaaggtattcagtgggacattttccggtgtgtggaattggtgggtcatggatatttacagatgatatattcatcctacagactggggatttattgagttctgggaatacgaagagggaaagatttaacagtagaaagacagaatggaaaataactatagtgtggtttgatgagttttaaagcgttttgagattggagaggtgggcccagttaatctgaatgtgaaatcaggaagatgttttggggaagacttccttgatgaggatgacctccaagctgggccttgaagaggtcaagtgaagatggtatcagaaagaacctcaggcagagagaacacagtgttgcattattatcaaatatggtttcttcgctgaaggacttttctcagctagaaaccagtcagaaaggaagggccaccatataacccaactctcttagttatctcattggaatagtgtagaagtgctccagtgagttgggcctccagaaaggagggagttccgcttatttttaactagactgatatgtgtttgaatgagaagttacaggtgagtaatgtttattttggtgtccctgtaatggtttttactttctccctttcttccttttctatctcactgggtaattgagtcacatttcctcatctgtcaaagaaaggattgagcagatccaggacaaggaagggtgctaggctcactcttggacggcagagaaatcacatcataatgttttataaatacaactgataactattcataaggctgcatttttactcaggtg

SEQ ID NO: 103803 - DNA, 1010 bp, Homo sapiens
cccatgagtcaatctgagtaattgccccaagccttctaagataaggaacttctcagttacaaaattctgttattccatcgaacacagcctgtgattcttctgagggatctaaaagaccagaactgtttcttacttgcattttcttatgttaacaaaaagccttactgctgcttttctgtttacagggcggtagtcatggtttgtttggaaacagcacagcacaatcgagaggtctgcacacacccgtgcagccactaaattcttctcccagtctccgggcgcaagtgcctccccagtttatttccccccaggtaagcaattttacgttcctgtgattcaaaatgaaagaccatttcacatcattaccagttgttaactgatttttgtgggcataaaaagaatgatagtaagtagcataaaatatgaaaaagccatcttttcttgaccttttggctaagatcaagtagagtaaaatatgaaatatctagctgccaaagatgaagacttttagaacaaaatctcaaatctcattttttatttcatcatgcataccaacaaagtagatatttttgcatgaaaagcttattattctattccttttagatctcctatttttctaactatattttttgaaactgcatataattaaaactgctttataagttctgatgtgtcaatgttcagaggctggttgccctcaaggattcacccaaagataaaaagagaattcagcctggcacagtggctcatgcctgtaatcccagcactttgggaggccaaggtgcttgaggccaggatcacttgagtcccggagtttgagaccagcctggccaacatggcgaaaccctgtttctgccaaaaaacacaaattagccaggcataaagaacaaaacaaaaattagctgggcatggtggcacatgcctgtaatcctagctactcaagaggctgagacagtagaatcgcttgtacccaggaggcagaggttacagtgaaccgagatgatgccact

SEQ ID NO: 103804 - DNA, 1050 bp, Homo sapiens
cactttgggagaccaagatgggcagattgcttgagcccaggagttcaagaccagcctgggcaatatggcaaaacctgtctctaacagaaatacaaaaaattagccgggcatggtggtgcatgctgtagtcccagctacttgggaggctgaggtgagaggatgacctgagcccaggaggttgaggctgcagtgagccatggtgacaccgctgcaatccagcctgggtgacagtgatatcctgtcttaaaaaaaaaaatgaaaaagacaagataaccacacacagtttggatagcggagaaacaaattcttaaagaaacctccaacccaaatacaatgacaggaattatttttactaattccctattcagacactattcatatacagggatgcttttcacattattgcactcagggtcactagaacctgatgttaacattgtgtccttgaattttctgctgttgctatgtagcattcacggtgatcataatgatgtttcatcaggtagatttaccttgatttacttaacattcccttcccccactgttgagtattaaattgtttttaatttttccctgttacaaataatgctgcagagaaatccttatacataaacccttgcccacattttttctaaatttagttgcccaaaatgaaatttctgggtcaaagcacattaatattttaaaaggttttgataaataccagattttatattccttttgaccacattataggggcaatcagtagttaatgtaaacatagaagatactgaggccgggctcagtggcccatgcctgtaatcccagcactttgggaggccaaggcaggtggatcacctgagatcaggagtttgggaccagcctggccaacatgctgaaaccccatttctactaaaaatacaaaaacttaactgggtgtggtggcaggcgtctgtagtcccagctgctcaggaggctgaggtaggagaatggcatgaaccctggaggcggagcttgcagtgagccgagatcgtgccactgcgctccagcttgggcgacagagcaagactc

SEQ ID NO: 103805 - DNA, 1048 bp, Homo sapiens
accctttaggtgtcctcagtaaatcaatctcaggaaactttggttttctgtctttcccccttgttttgtaggcatgtcagcttctcttgcagcagcagcaacagcagcagttgttacagaaccagagaaagatttctcaagctgtacgccaacagcaagagcagcaggtacgtgggtaggcagggtccctccagtgctgtgttggaggagtacatcccggcttagcctctgatggcaaagaaccgggcacagtcttttcctgggaagttcggggccgtgcttatcacgtgtctgtctctcttggccctcagctggctcgaatggtgagtgcactgcagcagcagcagcagcagcagcagaggcagccaggcatgaagcactcgccctctcatcctgttgggcccaagccgcatctggacaacatggtacccaacgcattgaatgtggggctcccagaccttcaaaccaaagggccaatacctggatatggttctggtaagttgttggtagagaaaattacctttttagaaatctacctctctaggcctgtggtaggggttgcacctgcattaccctccttttttatgtcagctgtacaaggtaggtaaatattcttatccctggtttacagatgagacatctgaggcttcttgagtttcagtgggtttccagagctcaccacatggttactaaatagcagagccaggcctctaacttctctggctccaaagcagtcttccttttttttgtgtgtgtgtgtgtgtctggtttattttatttaacacagtaaaggctcatacatgctatagcacatatcagaattcatccctttctaaggctgggtaatactccattgtgcagatataccacagtgtgtttacccacttttctgctgaaatggataaacttggattgtttccaccttttaactacaagttgagcatcccctaatctaaaaatccaaaatgccccaaaatctgaaactttttgatcaccagcatgaagccagcagtctttcaatacgtgtgtatgaatggcaaactgctct

SEQ ID NO: 103806 - DNA, 1578 bp, Homo sapiens
ttctatggtcatttattattctccccctcccctgtttcatcattttagtcctttattttacttttttgagagtttttatgaacaggtgtcacacacattctgacccaaatggatgacggaccctgttagactccgtcatccagattctgctgtgtggcttccagctctccagctctgtgcagtgggaacacattacccaccaagactcttcccctgaagcttacctggggctcttggcaaagtgagctcagaatctcgaactacccacctactcaagctttggtgtcttcctcattgcttaaagactactttcaaatttatctttcagattctgccctgacctccacccaccccacactcaggctgccaattctcttcctaaaatacatactagttatcctcttacatgcttaaaatgttcactatcttcttatcctagagaaaaaaagatccgaactccttggcctaatatataaagaccctacatgacacaacttcatttctcctcatcccccaccactctccgcctcacttcatcccagagttagctaaccattggagtcatttgaatgtctcaccattccctaaacacacttgattatcaagagtcagagctctgtacttggtttgcttgacttccccaaatacctccctgaggccctagatcacatcttccttctgcaaaccctttcctcccccaagataccctgactacagctttgttgctgctgttgcgctacattggctggatgtcgtcttctccatctcagtttgagagtggctggccccagcctcctgtctggcacaaatgtcagctaaatgaaaaagggcgtgcaggaatgcactgagacagacctgatcgatggcagtcatacacatcttcacgccttcacagagagacatcacttatttagcgagcaagagccaagatcaaagcttggaatcaaaaatacctgtttctgagtggagaaactctgtgaattagtctttgaatgacacttgaaggcattcctggactctgcttcagaactcttgatactgatgctggagacttataaaatgtggtcttctcctttttaggcttcagctctggcggcatggactatggcatggttggtgggaaggaggctggaaccgagtctcgctttaaacagtggacctccatgatggaggggctgccctctgtagccacacaggaagccaatatgcacaaaaatggtaagagaagcactgaaagctagagcccccaacccacagcaggtcttgatgaaacatcttataagactattttgaagtacagaacttggtattcattttccttgtgaatcctatgattgcctgtggaggaaggtcagagtcatgtgtatgttgaattacaagaaatataaagtactagttctaattaaagggagcagaatttttcagccaccatgattgagggtggtagcagtgaacttgggcacccaccaaggtgaaaccctaataagttggctgagggaacagagtcagcttgttgagtttgttttgcggagcaagggatcataacaatacctatcttgttggttgtttgaaccataa

SEQ ID NO: 103807 - DNA, 1662 bp, Homo sapiens
aagtgcatgttctgttagttcaaggtaattttaagcttttaattattttcctgccccatagcatataaaatgcatgatgggggcagcgacaaaaccactgaagtgctctcaggaaaccagttacaaaggatttgctgttcttcatgtgtgaggccacggatcccagagctgcagagttcattgctggtcttgtgctggcaaagaccctaggcgggaattccatctcattgcgttggaatttaaagcaattgcagatgcttttccctccaatggactctctgtttacactgctgcttccagctaatctaagcctgatcagccagcccttaagaacctgggtggatagcatcagtagaaatttagttaaaaccttcttatgtgctacaaatggttagaattttccccatttctcactcttgagtcgttagcatagaaactagggataatggtcagattcctagtatgtgaacgtttcattaatttcataagaccatggaattttaaaactgaaaggaacattcaagcatgagaacaatcctgtgtgcctaagtgaggaactgagaggctcagagaggcgaaatgacttgttgttggtcatgctgcttagtaattctgtgctgagtctcgaatgcaacctcttattccagtgctgtttgtatatactccatcagcttcagaagactgtttgcattccagcgaataaaaaatagacaagttctattcataggagttattctggatgatttaatttcctctcttttctcaggcgctatagtggcccctggtaaaacccggggagggtcaccgtacaaccagtttgatatcatccctggtgacacactgggtggccatacgggtcctgctggtgatagctggttacctgccaaatctccaccaacaaataaaatcggaagtaaatccagcaatgccagttggcctccaggtattgtctaggaaatgcttttcccaggatagcatttgttttgtaattgtcagtttcaggttcagaatacattgcttttgtgattcatgttactaaggtacttgcttttatttttttcattcaataattgtctgttagaagcaaggcatgtgctgtgggaagatagaaaattttcattagatggggaatctggggataagtgacattgtaggtgggactttgcattcgtcccatgcataggatgccttgtaacatgggttcttttgaagtgtctgttgaattgatttgttagttcttaggcaagtgtgtattaccagttagcttctaggtatgcagtagcgattgcaatgagattatttgttaattcttttctttctgtccctcccttttgttggatatagtaatctattctcatgatagaaaaatgagaacatttaataaagcaaaaattaaaatcagtaattccataaatatatatcctcctagacctctttctgtgcatgcgtatttgtgacatgaatatgtatagtttcgttttattaaggtagaatttttttttttttttgaaagggagttttgctcttattacccaggctggagtgcagtggtgcgatcttggttcactgcaagctctgcctcccaggttcaagcgattctcctgcctcagcctcccaagtacctgggattacaggcgcctgctaccacgcctggctaatttt

SEQ ID NO: 103808 - DNA, 1040 bp, Homo sapiens
catttcttatgtcaaaaaaagtactatatcatttttttttaacgaccttccttctctaatatttgttttccttgtctcagaattccaaccaggagtgccatggaaaggtatccaaaacattgaccctgaatctgacccctatgtcaccccaggaagtgtgctggggggtacagccacatctcccattgtagatactgaccaccaactgctgcgggataacaccacaggtacttgagcaaagcatctcttatatgttcaacacccagcattttcatagttgtcagtttgtgacttcatttgtacttgctggtacctaaaagtttaaccaaaaaatgtaaaaagattgcttttcacttttatttgttagacatattttgtcctccattctattgaagtttaaacaaaatactctcaaggtttcactggttatactgacatttatcttcagtattttcttcttgttctttgttacccaagggtctaattcttccctcaacacctcgctgccttcacctggtgcctggccctacagtgcctctgacaactcctttaccaacgttcatagcacttcaggtatgagtgtgaattttttgtttccctttggttagcactttttcatcaggttcccttttataaaggaaactggcatgtatttcataagatatactcttacagaagttcagtagcataggtcagtatagatggaagcacatcttttctgtttgctatgtctttgaggaacttctagtctcaggaaggatgagccagatacagctttgggatgaggccggtagtgacataactgcagggagctggcatatccagagggctggagtcacgtcctaatgacacacatgcttctcttttaacaaggctgccaagaagtcaagggtcatgagaagaaccagtgaaggccaggttattattcctaagatagccaataatagctagcttttctctaaaaatcctcccacttatagacaaaggctaagggcagatggccaaaggaaaaaaaaaaaaggaccttgattcattttacc

SEQ ID NO: 103809 - DNA, 1054 bp, Homo sapiens
atagttgactgaaatatgaagaatcttgtatgaccatcctcaaaactatgtatacctcctattttctaagagttgtcacacaatgtgattatgttatgatgagattgagagaagcagtaagagatgcactgttttgaaagaagcctgggcaggccaatcggctgttcacttgttctatcttatgaaaaatgctggccagatgtggtggctcatgcctgtaatcccaacacttttgggaggctgaggcaggtggatcacctgaggtcaggagttccagaccagcctggccaacatggcgaaaccccatctctactaaaaagacaaaaattagccgggtatggtggtgggtgtctgtagtcccacctcagtcgggaagctgaggcaggagaatcgcttgaacccgggggtgaaggctgcagtgagctgagatcgcaccactgcactccagcctgggtaacagagcgagacgctgtttcaaagaaaaaaatgttaattatacacatacatccatataaaatgaatatgggggtggccgtgtttgggttagaactaattttaaaatgaaagcttcctaaaagcagactaatctctatcatagcttaaaaggttataagagcaagtcacctgctctccagcctgggtgacagaagagtgagaccccccccatctctgaatttaaaaaaaaaaaagcaaatcttgatacaattgtcacccccttacccatgatttcttacccttggtcaaaccatagtcaaaaaatattaagatgtttttagagaaagaccacattcacataacttacagtatgttgttataacttttcttttctttttttttttttttttttgagacagagtcttgttctgtcgctcagactggagtgtgcagtggcgcgatctccgctcactgcaagctccgcctcccgggttaatgcggttctcatgtctcagcctccaagtagctgggactacaggcgccagccacaatgcctggctaatttttttgtgtttttagtagagatgggtttcaccatgttagccaggatggtcttgat

SEQ ID NO: 103810 - DNA, 4583 bp, Homo sapiens
gaagtcagccgctttctggcacaagctcagccccctacacctgcagcaaccccaagtgcgccagctgcggggtggcagtcgctggagaccggccagaaccagtcagatcccgtgggacctgctctgaatctttttggtgggtccactgggctcgggcagtggagcagcagcgctggtggcagcagcggggccgatcttgctggcgcttcattgtgggggcccccaaactattcttctagcttatggggagtcccaacggtggaagatccccataggatgggcagccctgctcctttactacctggtgaccttctgggaggagggtcggattcaatctgaacttagaactttcaactctgacctcgtgaccttttttggaacagcagcagcactaacttgaccttttcgttttttttttcaacttgcaataaatacatttttaaaaggaaaaaagaaaacggagagaaaaaaaggtgggtcattgacagactgtctgagcacatagttgcctcccttataacttcagttttttcgtttggaatatgaatccaaaaagagaacatatcactcttgaaatacttgaatcatgaacgccaacctagaaagacaatgtgaagcaagtacacataccatttaaatttaaacacaaaaaaattaaaaaaattagtttctagtttttcacttttttcatgttatatggaagttgttgctaagaaacatatatactgaaaaaaaatagctttttaactttgtttgcactgggtgtgtttccgtccttaggtctaccatgtttgggagggagggaaattcaaaagaattgttgggggaggggggagggaagacttgacggagcctcactttaaaaacaaaaacacaaaaaacctaaaaaaaaaaaaaaggaaaaaatttgtgattggctggttgataaataccagtgtgttctggcacatgtaactgcccaggcatgctcgttctggtgtgtgtgtgcacgtgtgttcatgtgcattcgcgtgcatccttctctgtctctgtgtgtgtgcctgtgttcttcccttctcccctgccccaccctgacttctcagaaagctgcatcgctgacagtctgcaggctggctggccggcccatctgctttttattttatttttttaactatgagaacacacaggcccggagagccactgctactaaagcaactccattgggctgcattaagatgaacagagtgctttttaatgatgaaagcagggagctcctttccatttgcaacttagcctgaatgtggggtttctctggctgttcttttgacctagcagtagagtggagcactgccaagtccaaaaaactagagcaggaggtacctcttggagcaacggtgtgtttatttctgtttttttttttttttaagtgaatggccaccaggcacatctgagtatctgttaagtttcatgcaggccttttcgttagtttgaaatgggaacggaagataacttttgatgatgcgatgtctcaaaaacagagaaactttgttccctctttccttatgatcaggtttgagaaattcttcaaaaaattaggtgaagttgagttacatatttctgttggttggttctctttttcattttatgaaaacagaaaagaataagtggtgagcagcctcctgaaagcatctgcagctactccctctgctcctttctcgccgagcgttacctgtgccaggccgtggcgcgttacagcaccaggccatcactgacagaaacgtttacttaacgaatgttcttaaaccagtgtgtacttcaagcgtttccttttgtttctctgtgttgtgtatttcctgtgtatgtggttttgcttaggcaggtataacttagcgaagacttttaagtattgcacctttttttgatttttgacctcttccccccaccttgtaattttgcttttttaatttcggtatttaaatacttttttttttttttaagcatcaatgtagtagtactctgggccgaacaggggtcaacgtttaatctacagttatcaccaacatgtatgtacttatgtcggaatcaaaatgtatcaaactgcttattgtgaagagaattatagcagacctgaagggggcgaaaaaccagatagggtggggggatggatgccggtgacgtgctagcacttgtgtggacatcccagtctgcattatgctgtttaacataaagtgccgacattttgtaccagcaaatacctgcccattccaacccttggtgggagcagacctctactgtcctctgtaacttgctgctattgaggacaagggagtttttctttctttagcgtcttcagtgaaggatacaatacaacaatgcctaatgtatttgactttttagcttgtgtctgtgtgtaggtgggtgggtgggtgtgtataggaaaagcctaaaacaagttatttgcatttcagtggttttgtgagacaaagaatgggaaattctgtagcccttctggcttaccctgttgattataaacctagcctcaaaagagattgacaggcatgactcaagtgagtgttcacatatacaagcctgcatgagccctctgtgggtaggtggtcacacttggcatctgcagcattgacgtggccccgctgggtgccttgagcatgccctcttcctgctctgcaatttgaatcaccaccgtgccccttccaccactgttccccatgcaaaagctctgcttccagcagcccccactgaccgctctctgtgtggagcaaagtgctgtcgtgcggtgaccaccaggtgaagagcagcttgtattcagacatctagagaaggttaaatcttagtgtccctgggccaggagcatatcccaaggctcctgcgagccagtggcgaccctgtccactgccgctcttggttcactgctgtgtcctgccccaccctcctctcctcctgcctgttggttccttgacctgcactatgggttagttgagttccttacgatactacggtgaaagccgggtgctagagcccctcttgtttacaagacataatgagggatttgaaatatgtaaaaataaacatgagaagctaaaatgttcttccatcataagcttaaagggaaaaaaactaaaaactttaaaaaaaaaagaccaaaaagtgcgtatatatatacatataaatatatattttagatgaagactaactctgggagcatttaacagtgttttttgtttctgtttttaacatttgttttcctgctttaaaatttgcaagcattctcaggaattctagggtaggaagccagttttttgaagatggtttatttaaccatatcttatcctagagagatggctgtttctttcctgttaataaacttttacaagttcctgaaacttcagaaagtttaaacaatttttacttaaaaaaatgtaaaaagaaaagtctccaaacattattgtcatactggggatcacacattttaaaacacatagaaatattttttaaaaattatcaatttagcagcaacaggtaaattcattatcttaaaaatatgggagaaggattaagctttgtaagagctcgatcatggattcttttgaaattgtgtgtagtttaatgggagagtgtttggtgtatatagatgagaatgccatcactttgttcctttccatttgagactgaactgaaatctcccctagtaatttttatttttttaaaggaacccttctccttgtccccacaaccccagcaacaaaagaaaggaaggaaggaagaaacaacagcttaaaaaaaaaagtaatctgtaaaatagtacagttggattgctgagaatctatgtaaagagttaggaaatataggttaataatttttggaacaaattttaaatataggcattactagaggaaaattatctatggactgtcctattaatgaagaatgtctgtcttacctccgtttgttttgggaggaggagaaaatatagaagaatctaataaggaacaagtgattttacttttttagctcccagctactgttgtgctcgttttaattgctgttttgaagatctgctgcttaattatccccatcccttagccggagatgtggagtgtttcctttcagtttttggtgatgttgaattcttttgtattccctcctggggccaggggtcagaattcccaagcatgaccacagcttcttttaaacattaagcttcccagtgggaaggaaactccagctcgacaggtaaagggagtgggtggggttgctgcctgcaatttctctaaaaccgctttagtgccttcgtacatacacccagacatcctgagcaagggggacgcacatgtgtgtgtgtgtggtccagtcactccacagatgtaagatactcacccataaaggaaattggagtggttctggacaggccccaaaggcagtgggctgaatttaaaataaataaacaaacgtcaagcaagttaatatgcttatgtctcagtaatgtagaatgccaagttccttcctgtgtcgtgtgccctccattactgtgcattgattcctccaggtgtgtaattgtgacaactgcagtgatttggaaagtctct

SEQ ID NO: 103811 - DNA, 2001 bp, Homo sapiens
taagaggttagatgacttcagtatacttataaaattcagtgagagtgccttcttctcttctaccacactctggcatagatacaggcttgctggtcacctctcattacatagatttattttaaaaacattttgattatgttaatttgagctttcccttttttttttttaactactttttaaaacacttgattactagtggcttagaggtgtgtacatctcctgaacatcacaaacttggtttctacctaccacacgagtagccaaaagaaaagaagcactaatagagaaaggggtgtctcacaccagacagaggacctctgctgtcaattagatccagtatcatgacctaactttaagtgtggaaaagagttcagatctctgagacactgtgaagaaatggatggctcatgtaacatctctgatccctcagtccccaaccctggacgtgtttcatttacaacattcataggagttaacttagcagtgttgcaagttaaggttccaaaccaaattatttaatcagtgtccccccaataaatcacttatccatttattgctagttagttttatttatagcaacttgatttcctatgagtatggctcctgttgtaagaattttcccacctcttctgacatgaatgtagcataagttagcaatcggttcttccaaactcctgtgggttgaatatggtatagaaggtatgcaagaggaaaaagaaaggaaaagataaaactcctgcctgagaatttggaagcacctttattaacacatatatctcgcagaaactagaagctcataggctgttaactttttgcaactattcactcatttttaccacttttttttttgggtgagggggtgatttttgtaaggttaacagccagattccattttgacctcagatgctgtgtactttttaatttcattttttatattctgccatcttgactcttctctaaaacagaatgaaaatgtctgcatgctgagcaaaatgcttacgccaagcctgtttttctctgcagagtaaacaggatgttttcagcagacttggctctaatagccatctctaagattagggaacaattgagtctttatgtagaaaagatccattttttccccatcctcagagttaaaattcaacatttaaagctttatcggttattgttttagatttgagatttttgtttttaagtatctataagatctttagaagtgagataaatttttcgctggttaaaaaaaatcaaactttcctctgcagtgtttttgccaagttttgtcacacttcatgtgtatgcattaactatacttcttagtgttactgcaaaaaaaaaaaacaaaaacaaaacaaaaaaaagccttgttctttaattgtgtttttcctcctgtgagtggacaactaaagccgcgtgatgatgcggatgaaaatattctggtctgtgtgtatacaatgaattgtcagtcttcagacctcatggtcgttaagaaaatagggaactcacaaaccctgctgcgcactacatttacttctttatctgcaagtacagggagtccatacagtcaagaaacacacagatacacataatgctattgaggacattgtcattctgtaagaaaacagaatattatctagatttccagagttagtgcagaccctgtgataacagtctgtgggtttgtggccagcgccaaaggtgtgtgtattttcagaaatggtccctatttgtcagtgatagtgttttttttttcttaagtttgacaaagggggtggtaatatcacattctttagatttgaaataattatcagctccaagaatctgtgaacatagtaataacaataaaaattcaacatcgaccctccctaacctgctcaccatacctccccaccccatgcctctgaagaaagaggccatgaacctacgaggtggtaaagggggacacaggtcagggagtggagagctactcctccagcagctcagcacccacactgcccgcatgcg

SEQ ID NO: 103812 - DNA, 3052 bp, Homo sapiens
aaaagggaaattcctctttactgctcacagtaagctgcaaaagaaagttgtcaaggtggcttatgatgctgttgtagcagagctgtgaaaggaagtgctttgctttctctcccgccttccggaatctggcgttccttccccttcggctactgaaaggtgtgtacaactcccagaggggtggctgtaaaagttgactggaggcaaagtggagtggccttattgccaggactagccctacagaagagctttacagagaggaggacagtacatcctatgtgtgttcgccaaaaatgggaaaggtgggtatttaggcaaaacaaaataaaaacctttggaaccctttaagaagttacataccttttaaaggtagtatagtttctcaccaagtgatgcattttagcatgacacttcttgccagaaattttgggataagttggaataaatgtgtttaaaacatcatccaccgccctttttaaattttgtctaaggaattacttaagtatagtatttctgaatgtgcctttgtgagtacagagaccgtccgttctaggaagaagctatccgttggatacaaacaaacagacggtcagctttagtcattagggaagtcaaagttcctcctggaagtcccaggagcagctgttgagatttcattagcatcaatattgcacagtgtagagttgagtggaagagattctgggacttgggagaggagacaggggaaggtacccaggcgacgcagacccacgttagtccaagagcgcaggtttacacatctgcattccctagttttctccgtctgtatgtttgtgctcatgtggctttggctgttttgttttttgtttttctgtaagcactggagaattggaatatggtgatacttgtgacacattcatgcatgtaaacaaggcattttccagcttctgccgtgtgcagagcgggcagcacgcttttaccctttgagtctgtgtcctgaggcggccattacattcccacatgggcgtcacatcacgttgctgttgatgcaaacagggtattacacacaaggaaaaggggttttgaagagttaagattgaagtgtttgagaaagaaaagagaaaaatctgaaatcatattttatttcttcagagctattatagttgaacacagaaatctgcagtgtctttatttgtttttatgttttaaacaatttcacctcttctccccactcctatcttctaaagaaatatcaagcaaatgctaagggccatttccatgattcctcagagctcccccaaagaggagaacagtccctcccactcgattccttcagcttcattcaggaagacacagggaggagagatgctgcttctgcgctttgctctcattcctctctcatggccttgaaatgtattattatgcaaatgtgaattttgatactgaatttaagaagaggttgttggatttttttttttttttttttttttttcaaaaaaaaaagtcccacatgtggtcatcgtcgcttctttatgttgtaaggtgaattgtaactatgcattctgcaaagggggtggggaggagagggcagaaaggggaagggagtagcgttgcatccttgttcttcagtttctgtgtccatggtgtccccgtgtcctggaggggaaggggagtgagagacgaatgtggtaaggtcagcacagtgagatagagacctctgagtcctcttgccactgttgctggcaggtctgatggccaggtaaattccagggggcctgcagttcctgtcaaccaatgtggttcaggattcttgatcctagccgtgcagtgttaatccagtgcagcaatggaactccacaggctccagtgttctctggaaaaagtactcatcctttcctgaattcagagcccttcaagctcaggaaaccacgcttcactcgtgctgacctgaaagttaatctttaggtcgattttgaaaaactccgcctcctctctcctttttaatatttctttcttcctttttaatcatgtttaagtgaacttactcttagttataaggaactgtcctgctttgtggggaagagggctgttgcttgtcaggcaaaaaagttttctcttcctacccaccatccctctctctgcttcccttgcatttggcaggctgtatgaagccaatgagctgcgaggtgttttgacaggggaggtctgcatgcagcctcttctttgtcctaacaattcctttgttgatcttgcctgtgatgaatcatagcgcctgcattgctctggtctaggcattatttgcaacacacagtatcgtaagcgagagattgttctgcctatattcagtgttttccatgcagcaattcttcttgttgacgttcacagtactgtaacgagtaacagacttgatcacagtctcctcgtgcctgtgcagggctgcacaggcatgatcttatcagggttccaatctgttagattgcctttaaacaaaaaaaacaacaaaaaaataaaatcctgacgtttcaactgtctcacacaaaataatacctcgaggtacatttccccctgcaatgtaaacccttaactcctctctcctttctgacatcagtggattatcctttttaaaatatgaacatgtaaatagcaggataactttaaaaaacattttctttgctgtgaaagtaaccctaaaatatgttttcttcttttgtatttttttggtttttgtttttaagccatcagaagtttcagatctttactctttcatgtttaagaagaaagagcagaggaggtcgggggagccggtttgcatttgtgttggaggggtgttatctccattgcctcccacacagtgacagcagaccagtatgtaaaccctgtcttggctgggcgcggtggctcacaccagtaatcccagcactttgggaggctgaggcaggcagatcatctgaggtcaggagtttaagaccagcctggccaacatggtgaaaccccgtctctactaaaaaattagccggacgcagtggcgcgcgcctgtggtcccagctgctcgggaggctaaggcaggagaattgct

SEQ ID NO: 103813 - DNA, 1283 bp, Homo sapiens
tcgactcaaaaacataaaataaacaaaagacacacacacacacaaaaaccctgtcttaaatagctgccatctcttccagcaatctagtgccagggtaagaagtgtctgaatttctctcttccagcagatccatcccctgcagggactccagaatgttctccacacaatacctggagctctcaacctttcttggttcagacacacacatacacaccccttgagtaactcagtatcattttgtagttcacagaaggatgtagtccctggcattttggtttgcactgtagaatccatagccttgtcactttgttatgctctggaaatgtactgatttcttacttgggaggaaacttgtgtaaggagatgtgcaaaccaccctgaaagccatgtgcatcctcacctcttccattaccccctccatgagctcgaagcgacattaagtagagggaaatgcttttaacaaatgctgctcatgtggatctgtcagctattgcttgcctagatttgggcacccatgaagcagggttggaatggatcattttgaattgcttctttgcagacacccccttcgcccccatctttaagataaaccctttactagtcaagaagcccttttcagttggatctcactgatcttgtatagtgacgacttcctttgaaggaagaagcttgattataagtgcatgcatattatccacccaccttctgatttgggcactgttcaccttggaattttatttattttgtttatctggaggccctttttctatcagtctctgatccctcatgggttctgcctgcccttgtatctcttgtacaatgctcccaaagggctttgctgatctctgcacttctttcctgggacactccccccaccaccaccctttgcacacaccagtgaccaaagtgtatgcagtgatctcacagaagacatcaaaaatggtgcatgcaccgtgaatgtgctcacagagacacgtgcacaagattctgcacccttggccttaatctcagtatgacttaaggtgcaggaacatttttaacaggttttaaaaaaacaaaaaacccttctgggaggaaaaaaataaaaagcagatacaacagctcaactgttcccactcctaactctccactatgtgcttataacttcacattctatgccctccccgccacccacctcatccctgttctgcgtaaccaaaaaacagacaacaaaagcaacctgaggagaggtttctggactattttatctgtctccatttagatggagatataaatgctgcttt

SEQ ID NO: 103814 - DNA, 1016 bp, Homo sapiens
agaaacaaaacctgtaaaaatgactaatcagctgcacatattgatgctctctgcaagttacctttaagtgttttttttttcttatacttgaagttgcttttacgatattattttggtggctttcttttctctctttgatgggcaatagaggaagtagataatgggatttaaggacgcctgggggagaaaagggaggatgtggcattgtctttttttttttttttttttttttttttagcatagaggtttaatcaaactcccatatgttgaaattgctcctcatattactggttttacatggacacagaaactaggcactttagaggtgcacttgcatggcaggctgggcccccttttctatattttattttcctttttagtatagtggtacttaaaatcactggttcacttaaaaaaacaaacaataaaatgttaaactctactaatgtacaaataagctgaaaagttgcattttatgtgtattttttgccatagcaggtactgtatttctcatgctggatttcaaaaaaaaaaaaaaaagtatcaaaaacaaaaaaaactaaagggtggtgttttattggattgtgacaggttgagtaataaggaattaagtcgtcgtcatttcattaaaactgagagatgatgtaatgcatatataagagttttctgaagggttttttttgggcttttaaacagcttatttttgtttttgtttagtttttttattttattttattttggaaagatatgattgtattatgtgcaactcagttgcttacattataactacaaaatatttttgggttcctggaaaaaaaagaaaaaagactaataaatgtgtttggctgctaagcatttactattgtggtttcctgttttattctgccagtttaatttgctcatttgttgaatgtttatatattttttcttattcttctctccctgctccacatgtaaaagctgtcagaaattcaacatttgaatttgggccgcaactctgtctaccttgtcttgtc

SEQ ID NO: 103815 - DNA, 1046 bp, Homo sapiens
tcctgcctcagcctcccgaacagctgggactactggcacccgccactacgcccagctattttttttgtatttttagtagagacggggtttcaccgtgttagccaggatgatctggatcttctgacctcgtgatccgcccgtcttggcctcacaaagtgctgggattacaggcatgagccaccgcgcccggcccaagcataggcttttaaacgaagagagtgcaaccaaaggcatgttgctgggatatgtgggtcaggattatgattttgttctgtttttctgccgtggtcttaaaatagttcatgacattttaggtagtcaactcagttttcaaattttggttactgtgaactcttccaggcactttagggtacaaagatggaaggatatggctgctgcctttcatgagttagcggtctaattttatacaaaattatctgaaagttttgttcctaattatgtaatgaacacaacctgaattcaacctctttctatcacatgatctttcttgtagcttgccagagtgatctctcggcttgccgactttgctaaggaacgagccagtctacccacattaggtttcacacatttccagtaagtgataagattacttcttgtttatgtgcatatggctttcagctgcttcttgagttctctgttttccacagtaaccttgaggtgaagaatctgaaaacatgatttaaatataagtaatttgggatgcttataaggaatgagcctgatatccactgagagagtaaatctaacagttcatttgggaaacattgggaaatacatatcaagagccttgaaaaatattctttatgatagtaaacattagaaacaatctaaatgggccgggtgtggtggctcatgcctgtaaacccaccattttgggaggtcaaggtgggcagatcccttgaggttaggagttcaccaccagcctggccaatgtggtgaaacgctgtctctactaaaaatacaaacattagccagatttggtagcatgcctgtaatcccagctactcaggaggctgaggcaggag

SEQ ID NO: 103816 - DNA, 1640 bp, Homo sapiens
tgaacaaaagggacattgtccctgcccttataataaattgtctcttgccgtgcatcacagtggttcatgcctgtaatcccaacactttggaaggctgaagtaggtggatcgcttgagacatagagtttgagaccagcctgagcaacaaagtgagaccccgtcactacaaaaaatttaaaaattagccaggcatggtattgcatgcctgtggtcccagctacatggaaggctgaggcagaaggatcacttgagctccagaggtcgaggctacagtcagctatgttcatgccactgcacttcagcttgggcaacagagcaagacccagtctagaaataataataatttaaaaattgcctcttgatgaagaaagtactatgctaatcgccttttagtttcatactccttgactatttgtaaatgacattgaatctccgtaacgattatttggttaaacattttatctcttgttttatctttaccagttactccctctcttacttaaattgttctccctccaaggggtaatggtggttattaaaagaagcaatgaaaccttgatgatttaaggtctcggtctgagactttcgtgtgttctctttgggttttcaggcctgcacagctgaccacagttgggaaacgttgctgtctttggattcaggatctttgcatggatctccagaacttgaagcgtgtccgagatgacctgcgcttccggggagtaaagggtaccactggcactcaggccagtttcctgcagctctttgagggagatgaccataaggtattctgaaagtgacctgcaggacacagaaactcaatggtggagcctaagagacaaggctgcctttgaggatgataggagagattgactgtgggatgggtggggtctttcgactagaaggaagttgtgggggttagggagcgagacctgggtaggatgacaggttgaggcattctcacactggacacatggattattataaggatgtgtcttttctttccaaggtagagcagcttgacaagatggtgacagaaaaggcaggatttaagaggtaggtaaatgggaatgtgttggcctccctgttaagttgatggaagtcctatattcagtatacctgcagatttgaccttacaatttttgcctttttcttcctttgttcttctacccatttttttttttcctgtctctatcctgggttttactttcttactatctggattctttttttttttttttttttttcgcctaatcgtcttgctgacatattttctggatttcattttattttattattgtttttgagacagggtcttactctgtcacccaggctggagtgcagcggtgtgatctcggctcacggcagcctccgcctcccagtttcaagcagtccttccacctaagccccctgtgactacaggcatgcctggctaatttttgtattgtttttgtataatttttgtattgttttgtagagaccatgttgcccaggctggtctccaactcctgagatcaagcgatccacctgcctcagcctcaaagtgctaggattataggcatgagccaccatgcctgacctgcattctctttttgtataatctataggaaaaaagaaaatgatttacttctggtttctttaga

SEQ ID NO: 103817 - DNA, 1033 bp, Homo sapiens
aagttgagagtgcacgtttggtcctgctctcttctccgtgaaggagagcagatgaaggtgtttatgtcattaccttcagtcacagtaatggtacagagcagtggccataatctgccatctatggagggtgattttggtgaactgaatttgttaaagtgaattacttaatcacttgtaggaaaagtccactcctagtgaaggaatgaggtctgacattctgtaggaaatgagcaggaaacgagcaaatgattcatgaggctttacagaagagggccagagcaaggtgggcatccatttcaggcttgtcctaagatgtgggcagagagttgagaagaccctggtacagatagacacaggaaccacctcagcctagaggggttttgtgtagagctgtgtagactgcatggatgggaagtatctgatgactttttaaaagtgttcaaacgccctgttagtagggaactgacaatacttcactgtcttcccaggattgccatgagaaaatcagagtgctttctcagcaggcagcttctgtggttaagcaggaagggggtgacaatgacctcatagagcgtatccaggttgatgcctacttcagtcccattcactcccagttggatcatttactggatccttcttctttcactggtcgtgcctcccagcaggtaagcttccaagaagcctcttttctgctgggctgcagaacctggggtactctctttgatgtttttgctttataggaggtatggtgggaatgggctagttagaagaaaatcagagcaggttgctggctaaaacttagatatttcggttttgtttctgttttgttttgtttttttgagacagagtctctcatccaggctggagtgcagtggtgctgagtgcagtggtgctgggattataggcatgagcccccacaactgaccaagataccgctgttttgagctgcctttatttctttgtgtagattttttggaattatcttttggtcttgagaatgtggtataatggacaaagaattaggttttattgt

SEQ ID NO: 103818 - DNA, 1005 bp, Homo sapiens
tggaccttttggtcctgagtgggctattgggaagtccatctgccaggccagaactgtggctaggacattttaattgactgcaactaatcaccttcaggtcactcacgtttccaattctgacaaaagttttccttgttcttctgattcgtaggcaggtatttgcaggttaaaggtttgggttgagaaggacacagggaacttgctggtatgatggaagtatctgtgtttggctgggtcagtggagtcagagtgttcactgttacaccttggaactgagactgcttgatgcggacaatgttcagacatttgtttatgcaccaaaatgtacacctaacatttgtgcattttactgtaggtaaagtcattaaagttggtgtctttgaaagctgggctgagggattggcttttgggtgaataaggacgaggctgtctgtggagctcacccaggggttgctgggctgccacaggagagcttgacctcattcattcaacagatatctcatggacccaactgtgggtggtgcagtctccacagctgcatccctgcaggcccccgaacaaaactgaaggtggtctcagctgcatggagttctcattttagtgagggagacaggcagtaaacaagcatgtaatattctggagcaagaagggctggaaaaatacttccagggatagagaagaggggcagtaaatcatatataaaaaggtcctgaagtggccctttcagaccatgtcattggagtggagagagcaagaggaaaatggcagggggtgaggacagagtgggcacggcccagaggaagcagctgagggagcgctggaaagcccttggctttaagtctcagctctgagcagagtgacatgatctgacttgcattttggaagggtcactgtggctgctgaggggaacagcctttgggaggtgagggtagcaacagggaggtcagcaggagggccactgcagtgatctggatgaaggaccatggcttggacaagggccatggt

SEQ ID NO: 103819 - DNA, 1035 bp, Homo sapiens
tcaggagggtctgagcttcatggctctaggccagctctctcccaccatatccagattcccatagctaatggctttctgacagctccaggtgagcctctaacatgtaccccatgaggagcaaagctcttcaccttctcctcaaagccactcctaccatagtactacccggatccagaaatgacacctccattctcccgatgctcagcctaaacctcggagtcacctctggctcctccctcgcccagaccccacactcagtccatcagcaaacccacaggattcctttacgtctcaccacccctgaccatggcccttgtccaagccatggtccttcatccagatcactgcagtggccctcctgctgacctccctgttgctaccctcacctcccaaaggctgttcccctcagcagccacagtgacccttccaaaatgcaagtcagatcatgtcactctgctcagagctgagacttaaagccaagggctttccagcgctccctcagctgcttcctctgggccgtgcccactctgtcctcaccccctgccattttcctcttgctctctccactccaatgacatggtctgaaagggccacttcaggacctttttatatatgatttactgcccctcttctctatccctggaagtatttttccagcccttcttgctccagaatattacatgcttgtttactgcctgtctccctcactaaaatgagaactccatgcagctgagaccaccttcagttttgttcgggggcctgcagggatgcagctgtggagactgcaccacccacagttgggtccatgagatatctgttgaatgaatgaggtcaagctctcctgtggcagcccagcaacccctgggtgagctccacagacagcctcgtccttattcacccaaaagccaatccctcagcccagctttcaaagacaccaactttaatgactttacctacagtaaaatgcacaaatgttaggtgtacattttggtgcataaacaaatgtctgaacattgtccgcatcaagcagtctca

SEQ ID NO: 103820 - DNA, 1102 bp, Homo sapiens
gggctgcgcagagtaaggtctctctcctgggccacgggatgcctcctgctctggcacagggaagccagggggatgctaccctagttgcttaggtgctggctgcttgagctccccggtggtgggagatgtgggcagtggcccctctccagcagccagaggtcaggtggaggacgacgctggccatggctgccttgcagtgggattgcaaacgtcactggcccagtctgtattcatttatttggagcagcctgtttttcttgagtatattcagttctgtgaccttttcattgccttctctctttcctagctcctccttgctcctgccaccctgggggttgctcttctcctcctccggtctctgcccaccatttgccctctgacaatggtggcgtctgaggaccctgtgtagggtcagggcaggctgggcacaccctacctggaggtggccatgtcctcacttccctttttccctctcaggttgtgtctcaacttccgatgggccgggattccagagaaatgcttttcctggcagagcagcctcctctgcctcccccacctctgctgcctcccagcctcaccaatggaaccactatccccactgccaagtccacccccacactcattaaggtacatttctgccagtgattgtaccctccccttccctgtgccctttggagtcctgctgtgacttcattccagctgtggggacagctgtagagggtgtggtgcgtgtcttctcccattggtctgggagtttcttcccgttctgtctgctgtccatcatgacactggctgttgcaatcatagccaccaattattcgtggctatgggctggccttgggcattccaggtcctcactcctgctctcatccatgaagtcattcccacacattatgtcttgttcactcaacaactccgcaaggcagaaatagagccctgtgctacaagagaggagctgagaagtgaagtgacgcggccagagtcatgcaggaggtgccactgagtggtgttcccctccttcaaggcctggcctgaaatgcctgcaggaggcgggggttaccactgtcggtgtgggggacctgtgctgggcattgctggcctc

SEQ ID NO: 103821 - DNA, 1019 bp, Homo sapiens
agttgagtaggagagaaggaggtggtgatggcaaatgtagctcatttgctcaatagttctgtggagaaggaaagcagaggcaggtgctggcttaaggagggattttcaggctggatgcaatggagcaggtttttgggctgagaggaaagagtcaaggagatgagaggatgggcaccttcagaggaagaggagggaggaggacgaggaaatggaaccctggctgaggtggaggtttggctcaggagaggcaaagctgggaaggaagtttggctcagatgagtgggaaggaagcgggcagtgggagaagggggagcggaccgttctgaggcctgagaaaagggctgatgggggttggggtcttccccacacatctaagctccccatcccacccttcctccaggcccctcagttatcgtcaaggttcactttaagtcctgtcctccaggaagacttctctgagtctctcctcagtgtgcccttagcttctgtgttttctctctagcagagcattcactgggctccaaggcaactggaccataaactcctggagggcagggaccccatctttgttcccaggatgtgactgtgagtggagagagaaatagtctgtagtgaccctggcctgtaccagccctgggttttccacagtacggccagcagcttccttgggttggactaatctgggggaagctacagttcctccacccttgctcaccgttgtcagtactggctgccatggggctgctgtcccaaatcagatgccgttgccggaagtaggagattgtgggggaaatctagccgtgtgtctggcatgaagtacacatggtcagcaagccctgttctgtgtgttgcatacttgcccctgctgggacagatgaggggacagaggagcaagccaccaccacagtcgccagtaaggaagaagctcagatgcatccttcccaggtcctgagggaggagagagcctcaggtcctggccctggccctggagggcaagagctcctaggagagccactgca

SEQ ID NO: 103822 - DNA, 1557 bp, Homo sapiens
aagacttgcggcacctgctctaccaatctctgctgcagctgaggcagtacttctgcccactgcacgtggggtgatagagccagagcccacagtcactttaaaccatctcctggattgctcagcctcccctgggctggcacagagctgcccagccagaacaacaaggcagcagatggctaggtgaggacaagtctttttttttttttctttttcttcatttttttccagtctttacctttactatatataatgtcctctgaggcttcattgcctagtgtcctttggcttgtcttatcctatgctggtcttgatccactaatgttctgtggtttgaaaatgttggtgcagaggttaagagcacagactctatagagtcaggtccaggggaatatatatatattataattagccccgtttggtgggatggctctgtgactgttgagggactggtttagtttgcccagagtctcataaatgcagaaattaggacattggactttgaggaactagagctttgctaccatgtgtcaaaattcatattccatttggcagccattcaaaatgaatggaaaatgcccatgagatcatgcagtgttacaggtttttggggtttttttttggtttttggttttttttgtttgttttttgagacggagtttcgctcttgttgcccaggctggagtgcagtggcgcagtcttggctcactgcagcctccacctcacgagttcaagtgattctcctgcttcagcctcccaagtagctgggattacaggcgccagccaccacatctggctaatttttgtatttttagtagagacagggtttcaccacattggccaggctggtctcaaactcctgacctcaggtgatccacccaccttggcctcccaaagtgctgggattacaggcttgagccaccgtgcctggcccaatgttacatttcttaaagcaggatataaaatcatattcagtgtgattacagcgctgcaaagttaagcctattttctgcatggaagaataactagaaacagatatcccagaatactaagagtggctgattaaagtttattttattttatttttctttctagttttctaaatgttttttgctggacatatattacttttatggtagtagaagtaatagttttttaatagatatattgtcagtccagcctcagagacacagatggtcttgaaggatggtgcccttccttggcaggtgcagttggattttggtgtgctctccccaggcctactcttgcctccgaaccctgcagtcaccaagttaaggttgtgggaactgcagaggtggtcagcagctaccatggccaaggctgctgttgtgatcctgtccatgccataagcctgtgacctggatttgagagtttcttggtgtgttttttctgtagacagaggactatctcaaacggaagattcgttcccggccggagagatcggagctggtcaggatgcacattttggaaggtgtggagattggaattgcttttccatctagatccagttctcactgtgtgtactcactactgcactac

SEQ ID NO: 103823 - DNA, 1061 bp, Homo sapiens
ggcctgtaagtgaatcaagccagtgattcaaccaaattacagcatttggtgacagcaacacctgaatatatcgacacatataccatttggttcagggcactctcactggtgtttcttccttacaagggttctgagaggtgggcagattctcactctggaagaaaattagacccagaaagcagtcaaaacccatgtcacccagcagtaattggtagcactcagtactagaacacagatcccttgactgtctatccagaacttctgtgaggtttcgaacccggttgagaaccagaattctggctgtttagatgaaagtttagagctctgccgcagaatcctcctgtcctcctgtcactagtcaccttgtgtccgtttcttacagaatactcactaattcatcgagtgaataattattgagggtatactgtgtgcctggtattctaggcacttggggaatgctgtgagtgactaaaaaaatagacaaaacccttgctgtgctctgatggggacatgttgtaaatgtaaacgtgggagactgagagtaaacaagaaaagtatgtagtattccgccttttttttttttttttgagacggagtcttgctctgtctcccaggctggagtgcagtggcactatcttggcgcactgcaacctctgcctcctgagttcaagtgattctcctgcctcagtctcctgagtagctgggattacaggcaccctctaccatgcctgtacaaaaatgtttgtatttttagtagagacggggtttcaccatgttggccaggctcgtctcgaactccttacctcatgatctgcccacctcggcttcccaaagtgctgggattgcaggcgtgagccaccatgcccagccagatacgtagtatttatataaagactgtcaagacagtgatgagtgctgcggagaaaaatgaggcagaaaaggaagctggggtggggtggacagtgtccgttttctcttgattctttgtacttactgtctcatgcatgtgctaagctttccaagagccaaggttacgtgtgatgcatcacacccgggttcct

SEQ ID NO: 103824 - DNA, 1070 bp, Homo sapiens
aggaaaagattgagcatcctgcgtctccacttcttacattcattcttgggagttggtcttcctgctggtttgggtgggggtgatagccggtgccaaaacgggtggtggcaagcgtgcataccaaaacaggatgtgtatgaagaaccctttatgactgctagtttggatcgttgcttgccccagaatatgcagtcccttctccacaccccgccacccaaatgctttcattgattcacatgaacttaattttggtgctcatttatcatggtcagtctctcgaactgttgacaactctttggttgatggtctttgttaaaggatttttgtaggcatttttagtgtgtcagctaaaaacagaaagacaaaaaatggaagtcaagcccggtccaattagctctcagcatttgactccatatacctgctgtttcttccagaatggtaataaaggaaaaaagctacatcagtaacagcccttaaacttaacatagcttctagcagatggcaaagcactttcattttaatgctaataattacccagtgcagcagttagtataattgccattttgcagatgaggctactgagcctcagaggggtcatgggacttgctgtaggttacacgggcactgaaagataggcagacccaatccgggttttctggctacaaaccctgtgctaattcctgaaagtcacagtttatactggttcttgtccacattggaatttttgtgatgacagcctgctatgctttcgccaaaatttcaactttaaaaaatctttgaaaattgaggaggctgggtgtggtggctcaagcctgtaatcccagcactttgggagattgaggtgggtggatcacttgaggtcaggtggttgagaccagcctggccaatgtgatgaaaccctgtttctactttaaaaaaaaaaaaattagccagctgtggtggcaggcgcctgtaatcccagctacttgggaggctgaggcaggagaatcacttgaatctgggagatggaggctgcagtgagcccagattgcaccactgcactccaggctgggcgacagagttagactcca

SEQ ID NO: 103825 - DNA, 1041 bp, Homo sapiens
gagccctcaagccgagggaatgggcacgttagttatggctgtattttgtctcatcatttctggttgatatcttttatcaaattcttctcctttgaattttgctgcctccaggaaggaaaaaaacccatctacctcatcttccagaacacttgcacatagttaccacgtaggactggctgtcagtcctgacatcgtcatatctgtaggacacagtgtgcttcagtggttcccttcccttcagggttgttctgtttctatatgtcattcagtgttggggtctgacctttccataaagttgaagggattaaagaatcccctaattcctatatacctctctgtactgcttgatatgctctgatcatagcatctcaactgtgagatacagaagttggtttctgatgtgctattaaacagaatcattttgcagtattctttattctcatcatgtaaacataagtttcaaatttaacgtcacttaactctaccaaatacagagtgccagatagcagaggcttgtatggtctaggccctaaattttcactaatgatgtctcgcacatatcttgagggataggacagatggcagagatagggagctggtcttgaaatccaaagattaagaccaggaatgccactgtatccaggatgaagactcacagaagaaactggtcatatttggtacactttgttctcaaagcttcccctgaagcctttctctttgatgtttaaaggtgtacaaggtcataaggttaaggtgaaaatttaagaaaaacgttctggcatgagagctgttgcagaggataacctttcaaaggaaaacatggaagtttttctgacctagacaaatcagaaaagggtctcctcctgtattctttctggatgtgagagaagcttgtttgtctcttgtcagtcttttataattgagaatccttgaaataaagcatatagtaccatgtttctaatgctacagttaaccctcaacttactattttcccatgtgccagtagtagaaaaaccttgaataacacgtgaggaaataatt

SEQ ID NO: 103826 - DNA, 1018 bp, Homo sapiens
gcctgccaggttgaaaagctaccactggggaggcatggctgtgctctagcaagaacaagaacatgcatttcatgtagcatttggtccttcccagttgagggagatgccttaggactacgttaatctctgagtccacttagggcttgggatgtattctcacagcccttgctcctcctccatcttagagtttatttttaccatcattgcaacctcctctaagtgattcttccagacccatagttagcctttgagattccgcagttctcctccctactcttccccaccatgtcttcattgagacccacatttttaggtttgactaaaccttccatctaggaataggtaggaggctaagcaatttaggccgcattcatgtatcctgtcatttgcttcactgcatcttcttggctgtggtaaaggaaatttaggtgtgatacactccttaggcttccctgccctgcccccctttccttttgcccttttgattttttttaatctgatactcaggctctcctcccgccttcacacaccattggagtctcctaagctatttctgtcagtttaatgatccccagctgttgccacagttcaggctgttttcatgcccaggagaagcatcgaagaggcagaggaaaaggggtcttgtttgttgtctgtcccacagtgtgtaaaacaaatcaaattcatttttctgaaactactagtgagattccttagggatggatgttaatactgggatgatttgaaaatcaggaggaggaaaagtacatggtagtatcagggacatttttaaaataagcattctgctgataggtgtggcactctgcatcactcagaattatgctagaaaattgaggtatgtggtatggaggaattatttgatcactttgcattcttttagattttttttttttttttgagacggagtctcactatgttgccaggctggagtgcagtggcgcaatctcctctcactgcaacctcctactcccagatgcaagcgattctcctgcctcag

SEQ ID NO: 103827 - DNA, 1039 bp, Homo sapiens
ttttgtagagatggggttttgccattttggccatgctggtcttgaaccccagccttaagcgatcctcccgcctcatcctcccaaagtgctgggattacaggtgtgagccaccgtgctcggcttctttcatagtcttatactgcaggaaaagaaaatcctttgggagtagaatggacacatttgagttatttagaaaagttcacttttaaatttgaggaaaattcttttagaagagttctaggttatgaaaaaaacgacaataggagctttatccaaatcctgtcaaatatgaataaaagagaattgtcaatattttcttctcctatcttggaaaccctaattatctactatcagaatttatatacaatgtataataattatgtaaatgctacttttctaaacacttagacatttcttttgagttttccagatttctttgggattttaataattttaacaggatgatttgagcctgtggagtcagcaatgaatggacacatcgaagacgagatggagtgattatcagtgcccagtttgcagagagaatattttttttcttcttttcttttcttttttttttttttgagatggaatctcactctgtcgcccaggctggagtgcagtggcgcaatccctgctcactgcaagctccgcctcctgggttaataccattctcctgcttcagcctcccgagtagctgggactacaggtacccaccaccatgcccaggtagttttttgtatttttagcagagacagggtttcacgtattagccaggatggtcttgatctcctgacctcatgatccgccggccttggcctcccaaagtgctaggattacaggcgtgagccatcgcgcccagctgagaatagttttaagaattggttgagaggcagttgctttttctttgaatatctagaactgttctggactaacgtcaaagaaacaccatggcaacattaaagggaagattatttgagaggcgggggatagtatggcttaggacttgggctgctacctttgactttgtaattcaaaa

SEQ ID NO: 103828 - DNA, 1092 bp, Homo sapiens
tttgttactttaagctttctaaattgtctgtgttacctagaaatttcttttcatagcaaaatagttacataaaataaaatttagagaatttatagtttaacaaatgttcataactaatcatgataaagatggatcagttaaagtttacaaattacttttaagatgcacattgcgaagtggtggtgttatgggtatgaatttcttagcttttcaggatgtcatccttttagccctgtagctaaaactcaagaggctacatgttcaaccataaaacattagcctctgccaacattacatcagctccacaaaacctcactggctaattatcccttgggactaggacatggatttggcagcttgtgaaagctgctttttccaatttctcccttactggctgtgacatatcccaaaggaatgaagttgagaaataatcatctttcgaaagctctcaacctctcattcccacagtggttctcatggttagggatagatgatcctttcttccacttgaggaatccctttagcttatgatgtattctttcagtagtaaccaaggtaccctgagtggaaggatgatggcaaggatcctcattaggtatgtttctaggtgattgtctataaggaatttaatgcttctgttaggatcttctttatattaccaaaattgaagaagctggaagaccagcattgggacccatgtgtggttatcatctgtgtccattgacatttgctgtaagaattagtattgctcatttaacatctccttttgatgagcacctgtaaaacaacttttttgaggacactcttggatagcaaaaagaactgtatgatcttaatctcttttagcctcagtttatttatcctaaaataaagatatggtacttggccttattttcctcacaagggaccgtaaggatggaaggagatgacacatatgaactaatttcatagtgacctactagtcaccctatatagtgggcccattctaggcctcatctcacctgttctatgttccctcctcgttctgtactactcaggatttttcacataatcttggttcacctaagcataaaataaatatattggaaaagt

SEQ ID NO: 103829 - DNA, 1114 bp, Homo sapiens
tcgatcttctgactttgtgatccgcccacctcggcctcccaaagtgctggcattacaggcgtgagccaccgtgcctggcctgttttgtttttttctgtactctactactcctttcaacactccacctctgatgacatcagatgtgtaggttttgtttttttttttccctcaccaacaaccaattctccaaccatctggtcaccaactggatattctacaatttaactcaattatgacattaattccctggagttagtgcagacccccacaggttaagggctcaggcccacaagatttccctgaacttcagatgccgatcgatagtggtgggtcctcaggttatccacaacttctgtctgagttggctacaaatcagaggtttccacaagcctctcctcaggttggatcatttgctagaacgactcacagaacttatgaaggccctttacttaaatttgtcaatttattataaaggataaaactcaggaacagccaaatgggagagaagcatagggtgagctatgagggggttatgtgatgctcccatgccttctctgggcatacgacccccagagcaccatctgggtttatcagtctggaagctctccaaaccctgtcctttttggtttctatggagtcttcatcatgtaggcatgattaatgacatcattggccattgatgagtaggtcaatctccagcccctcttgcatccccagaagtcagagtatggtggggctgcaagttctaatcctctaacacatgattgttttccctggcagccagccctcatccataagggctttccaaagtcagctcattaacataaactcaggtttggttgaaagggacctgttatgaataacaaaagacgactccttttacctttgttattcttaggaaatttcaaggtccaattttaggacctcggtgccaggagtgaagacaaagaccaaatatatatttattataaatcacaacattgcagtgtggcagaccgtgtaccaagctccttacgtatattaactcttattctttgcaacaactatgtgagatgggtgctcttatcccattttacggctaagattgtacccagctggcctgggttaagaatct

SEQ ID NO: 103830 - DNA, 1010 bp, Homo sapiens
tgaattttatagtatgtgaattgtatctcaattttttaaattgtgtgaggaaaaaaattcaggtttctctagagtgacagcagatcagtgattgcctggggctggaagtggaaggagaaattgaatacaaagggacacaagaaaaccctagggatgaaaatatatctctttattgtcgtggttatacaggcatatgcaattgtcagaacgctttgaattgtacactaggtgaagtttattgtgtctgaattgaagttcaataaagttagtttttaaaacttataataaaattatctctagttgttgtaagcttaaaatgacctttaggttaaaattatcttatctcttattaattataaggccaacaactattgcaaaaattacctcatagagtctgacttccgttgctagtttctatccagtttccaaagtgaaactagattgatcactttcactcagactttgctcttaggcgtttgtactagcctgactccattattgtgcttttcagaacccatgagtgggtgtgattgttataacattttttttaagtttatggaacattctattgcttttatttcttttttgcttttatgtacaacagaaaaatgtctcaaattgggtataacaaatcagcgtgattgcctttcacctccactttggagtgctttgagccagtttggacacaaggaggttggagttaaaatgactcctgaaggaagtaagcaagcatgagaagagagggcagcactggtaggtaacgctaaaacaacatcgccttcatctctcaaccctgatctctttccaagaagtgagctgactaaatgaaatattacacaaaaccctccaaggtttgagaagagttctagagggtagtctctaagtgagaaggaccatctctataggtggccctgagttttatcctcaaatttccttctacgccatgtacccatcctcactcatttttcgggtcccaccaagcctaaactcaggggtagttttccatttaa

SEQ ID NO: 103831 - DNA, 2184 bp, Homo sapiens
tcttctgtgcaggaatcttaaagtttatatttattttcctgtaaataccgaactgtgaaaacttgtttcatttgaaaaccctcattactagagagacaaagtaaatttaacaaagaccaggtgtggtggttcaggcctgtaatcccaacactttgggtagctgaggcagggggatcacttgagcttaggagttcgagaccagcctgggcaacatggtgaaaccccatctttactaaaaatacaaaagttagctgggtgtggtggcatatgcctgtagtcccagctacttgggaggctgaggtaggaggatcgcttgaacttgggaggttgaggctgcagtgacctgagatcatgccattgtactcagtctgggggacagagtgagacctagtctcaaaaagaaaaaaaaaaaaaaaaagaaaaaacctctcacacagcaaattatacagcccacataaggaccaaggaatgactcaatcttctcaaccttttagggatgcttttcccttagttgctaacctttgaccagactgtcatgtagactcaaagttgaaatttacccgtttttcctaagtcagtttgaaaatttggttgccagaaggggccagtgagatgcttctgctttcccagagcagcatttagcccacactggctgctactcattgcctgttgagtcattcccacagttctatatagagcttttctggcttttcttttaaacatgatgttcttggagtgagaaaggaaggaagtttttctctcttgtactgagtctccctcaccccaaatttgcattgcttctctttactaataacaaaatattgccttcagtcattctgagactattttctctcttaaggtctcctactgcttttatttaccatttgtttactatgtaagcattaaggtattcgctgggctattggcagcagccagctttcacatacaggctgatagttaacgagaaagattgaagaattctagataaacacaccaaacatggattcttagtttccaactttaaaaaattcagtcagatagactgaaagtaatcttaatatcattgttatgaatatcagttaatgaaaggtgctgtggggagcagtggctcatgcctgtaatcccagcactttgtgaggctaaggtgggcagatcgcttgagcctaggagtttgagaccagctactcaggaggctgaggtgggaggagcacttgagcctggaaggtcgaggttgcagtaagccacatttgcaccactgcattccagtctgggcaacggagtgagaccctgtctcaaacatacaaaaaaagtaaatgaaatcaaataacatcagtatactgtctattcacagaccgtatgtctaatataggcacaagtaagaggctcttttaggggactgacagatctgaaagacagattacagctctggaatgtattcagatgactttttgaaacagatattttaattggagtgggggtggagaaatagttgagcttctgtagttaaatgttcaacttccttagcctgttatctataaataccacatataaaaaagccgttggaattctttttcagaaaatttatggagcttacattttgtatatatgtgtttatatgtgtttaatcttcttccccacctctcatcaatgggtcagtaattggactgcttctttcatgagcttgagttgtttggattgtgtttaatctgttccactaaactgcattaacagcagtctcttatagtgggattttgaacaaaacctcatcttctcttcttgagaggaaaaaagcagttgatctgttttctgaaagtctctttatatatgtctctcccctcccccagagacgaatagcaaggggaggagcttgctcactgttctaaccacacttagtatgtcttaactggagagctttttggtttcctgtcggcagtaattcaaatctgtgtcatcttgactcgcctgaagggtggataaattggtaactgcactgagaaggggatattctcacagtctgatttgagcataaggcatcagattgaatttgtgaaagctttcaagacagcttttctcctgtgactttgactttcttcattatatttgtggatttttgtttctggaagaatccgtcatgactctactggaacctgagatgttaatgatggcagtacagtcaggtaattc

SEQ ID NO: 103832 - DNA, 1088 bp, Homo sapiens
gaagaactgatatttttataatattatactgtaaatacatattttccacatttatttagatcttttgtaaggcctcccaatgggtttttaaaatttttctctgtgatgatcttacacatctttagttagatttgtttttagacactttgtgtgttttaatgagattgtaaatgttgccttttacaaaaattttattttctaaatgttgttgttgatctcagatattgttctgagagatgtaaaggtgcagttctatgtgtgtctgtaatctgaggtgctggataggattggaagagctatgtaaagaaaagtaagcaggaaaatgggagtgaaaagggcctttcctctttcacagtggtttttctcctcctttatgtaagatttaagaagtaccagtttgttttcacatgtgcagcctgtggaataaaggacagatcatgtatttttttctgtaagggtacgaactgtatcctttcatgccacaatgttgcacaagaggttctaattaattgctgggagaagtaaaaattttgagtgggcagtttctgatccaaattacagtatttcttggggaaaggaaagagttttgttaattatattcctcagaaagcatggttttcaaggattttctagattaggtcgcccagttgaaaatcctccaatcttaggcatgtcaattgattaaatgattctgtttataatgtgacttagagaatttcatgacctacttcattccagtacttagagataatcaatttctcattcttacttattcatcacatgttatgctaggcccctggagaatagataccagatagagttcctgctctaacacaaaacaaaacaaaagcaaaagcccaaattctaatggatctcatctcccagagaaaatcactgttagtatatggtttatatccctctagtgttcttgcaaatgtgtgtttttaaaataactgagctaatactacagacccaattctgtgtcctgcttttttcatattactgaaatatttttataagtagccttttttaatggggtacataacattctgttctgtgccatcatttatttactttctccttagttg

SEQ ID NO: 103833 - DNA, 1088 bp, Homo sapiens
cctggcaataaatatttattgaatgaatcaatgaatggtttacatgtttgttccactacaggtaagaactctgttttctcagtggagtagaaggcagctgttgctgttggacccaaggtgtttgtgtatcttcggcctttttctctgaagtgtttccacttagcatataaattaactgaaatctttcccagcaactctaactttcccttagtgtttaagctcctgaaagaatagtttacagtcattgctttctctactttctcatatcccagagactcaactgctttatggcttctgtcactacctgtcttcagaaactgccattgccacagtaatttgtgttctttttgttgcagatcaaataagccctctttagtctttatgctacttgacctctttgcatcatttgacatggttggcttctccctcagacttgaaacttttcctccacggatatctacgacttacctttttccggctttttaaactctacctttccagcgactccctttgccattcagagcttttgctatctttctctgcctacctcttaaattttgttactctccagcattcagctctggaggaaagaggctggtaagaagattgttgtattttacagtaggtttttgcatggtcatttgtttgggaggtaatgataggagcagaaatgaaaaatctttgagaagattgtgaaattggaaagtgtggagttctagaacagaataaattctagagttagaggaggtgctttttcatgaatgggtgtaccgtgtgttgagagagtggagtgagaaatgtacttctttgatctgtttcacatagaagcatgtatcatatagaaattcagtggtggccgggtacggcggctcacgcctgtaatcccagcactttgggaggccgaggtgggtggaacacttgaggtcaggagctcaagaccagcctggccaacatggtgaaacccctcctctactaaaaaattagctgggcgtgatggcgggtgcctgtaatcccagctacttgggaggctgaggcaggagaatcgcttgaactggggagagggaggttgcagtgagctgagatcacac

SEQ ID NO: 103834 - DNA, 1012 bp, Homo sapiens
cccccaaactactgcctgtctttatgctaggtgaggtttgtctcaacaagtttttcattccaaagttaatattttcaaaaatagttttttttatattattcatacctgaacagaattattattgtagattttctgtgtggtagattttcttactgtggcaggttttccgtggcctggcaacatttcaggttgtctaggctgattgctgcatggagttttgatgtaagagtagaatcgactgaagaattcctaacttgaaaattgtctcataacagattacataattttgtaggtgaatacacaaaatatgtgcagatgatcatatttaaatttattcaggtctcttatacgtagcgtgtggacttctaaatatccgtcactcagtctcttagagaagaactctagaagacaaatagaattccacctttaaaaattggaacacatttgaacaccatagaaaaaggattgagaatcataaggaaagcatacctgtagtgtttgtgggcatgaataaagttcaaggaatgtaatgaagtcatcttgtcaaaatagtgctttaattttcaagcagcctttttggaggtgggggaggagtttaaggcaaattgtcaaatttctgttaaatgtttgcaagaaaatattaccttgtagttaatgtctctacttttcagagtaccttcttataagacccttcatgataggacagataataataacaaatgtttattcagagcgacttactcaaggtcacatcaccaaactcagtgatatattaagacacaggtcaaaacaacattattacattttcattaggggccaggcagaatagtaaattataccaaactcagagtcaggtggcacgctaaggtgaacagctcccttgtcattctttctctacacacctgccaaaatgattatttatttatttttatttattttttgagacggagtcttgctctgttgcccaagcgagggtgcagtggtgtgatgtcggctcactgcaacctccgcc

SEQ ID NO: 103835 - DNA, 1099 bp, Homo sapiens
ttggcaaaaaaataattgcagttttgctattgaaagtaaaaaaccacaattacttttgcaccaacctaataacctatggtcatataccctggtagtaagtggtggtgttggcttgtaaaatcagatgctttgactaaaataatggtgctgttcatcaccatattggctgaagaaaagtcaccatggattgtttatatcacctaaatttcaaatagttgagctatggagatatacaggttgtgaaagccttttgattcaaagatgtggaacagtgtgtcttttaacatataccatttcactttttactgctactcacctggaaagcaaataattttttaaatatttgactcattttataaaagatttttttaatttaaaatttaatctgagtataatatttttctgagaaatgcctgagcatatctcaatattttatatctaaatctagcatttatattttatcttagaactttgacttttgtagatctctgtgaggtactaattaaattctacaaatatttactgagcgtttgagtatcttctctatgcaaggggctgaacgagctggttgagaacaaaacagggaaaggagttaacatctattgaacacctgttaaattttagatcttcatctcatttaatctgtatagtaaatttgttagtaggtacgatcctcattttataccacaggaaacttaggcatggaggagttaagctctcatcacctaaatggcagttctggaatttgaacctaagcccatgctacttttctaacacacaatactgcctcgtgtgtaaatataaattggattcctatttctagcttatagtctagtccaggagttcacaaagtggagtctgcagatggactgctggtggtccctgatttcacttttggttatcacaagttcacaactgtagtcgttcatcagtattcatggaggattggttccagtacccctgctgtgggtaccaaaatccatggagctgaagtcccttatataaaaaggtgtagtatttgcatataatttacatcctcccatatacttcacatcatctctagattatttataataactaatacaagccaggcatggtg

SEQ ID NO: 103836 - DNA, 1717 bp, Homo sapiens
tgggcgacagagcaagactctgtctcaaaaagaaaaaaaaaaaaaagaaactaacagcttttactcaggtagattatggagatcactggttccaagaatcactttgttctttatctgttttccaagttcaccagatcatgacattagtaaaatttattttgaaatctttattatggaacatttgaaacacatataaaaacaaggagaataatgcaatgaaccaccaccatgggcctgtcacccagtttcaacagtattcaggggctgggtgccgtggcttatgcctataatcccagcactatggaaggccaaggtgggaggatcacttgagcccaggagttcaaggaccagcctgggcaacctagtgagacctcatctctataaattaaaaaaaaaaaaagtaaaaaaaaaattttttttttcaacatgtgaccaatcttgtttaatattactccacacctcctccttcatattttaaaataaaattcagacattttgccatttcatctgtaagtaattcagaataatatagtcgatttaaacactagttaactcttggaaaaaccagaagcaaaaattccgtttgtctccttgaatctcagtgtagatgccggctggtgaatttccatgtgctaagccactcccaagacctgactcactatcaaaagcatatactctattgtaattgctgaaatagcagcagtttgttagaatatgttatggtagttaagtatgtttctattggatagagagaggttaccaataagaaaaaactcctatgtcagagataagtttttccatttggagatctgatactttttgatgttgtaaattacaggcctttaagatttgtctggaaaatgaaaatgaaatgtggtttgtggattaatagggtaaattcctgtagttctttatgggtgaattcctgagagtcataattagcagtaaaatgaagagctgaagtgtcagaagcctcggagctagaaagacttctctaagcctagggaggtagacagtttagagcttcggccagagggaaagtcacatggcattagtagtgattatagttagttttattctggaagttaaagttgtaacctagacctctgtaaatagcctagtgtgtacataaaattttctggaggaagggaaggcactattttttcagcaaatattttaaaggattaagtactgtcttgtaaaaattagagattggcactgagtgaatggttggactagaactgtgctttcttgtgatgccagttttttgtgaagaagaaatgaagggggacagaaatgatcataatcacctttaactattgttttttgagatggagtctcgctctgtcacccaggctggagtgcaatagtgtgatcttggctcgctgcaacctccacctcctgggttcaagtgaatgtcctgcctcagcctcctgagtaactgggattacaggcacatgccaccacgcctcgctaattttttttttttttttttttaagtggagatggggtttcaccatgttggccaggctggtcttgaactcttgacctcaggtgatccaactaccttggcctcccaaagttctgggattacaggggtgcctttaactattttttaaaccaaccacataggagagcaagaccttgattctaggaggctacaagtcctagccctgctgtgactgcagccttactttctctttatcctgaatcacca

SEQ ID NO: 103837 - DNA, 1027 bp, Homo sapiens
tcatcagtaaagtggaaatatacttaatcttgttggggtgtggtcaagataaagtgaaatatatgtaaagctcatgagtatttaacagatgtaggcattgtttcctgttactccttccattctgtttttcaaatgactgagtaaaatctctttgagcataactaactttattaagtttctttattaagattatttggccacatgccccagagattgatggtgaaatttattttcctttccttatcaattacaaacactactagaaatttattcttgttcagactttggaatgagaattttttttttttcagagagaattaaatgagtttgctttaggcagctttctgagagctggcagatttggataggagtattagaattgctttcatagtggagtccccacctggaacatagttggcaggaggaagaaaggttatataatcacattccttatcagattttccgtagagtttattgtctcctgaaacactcaaggaagtcccttactcctttcctttcaatcaagaagctgattgtggaataggagatgaataaatgaaaattaatctgactttagcaatttgagaatgaaaagaatgctaaccaccaggcatgtgggcctgttttagcttcccaggaacctcctcagagggcatgacatgttggttgtaagcattaaaacaaacaatcccaacccaaactgtagatgaagcctggactaagtaaggcaatttaaaagattttaggttggtaatggaatatagagatgattttccctggccaaaatcagttttgatgttttgattttactcatttaaaattcttcttggtaaaaaattattctcgatcaatccattctttccagagtaacaagaatgatcttcttaaaaacataaatggaatcacatcacttctctgctcaaaactcttacctgcggtggtttttccattgtgcttagaataatatccagatttcatcccatgacctacaaggtgcacacatactgtatctttgctgatctcacca

SEQ ID NO: 103838 - DNA, 1049 bp, Homo sapiens
attcctaccaacaacgtaaagggttccagtttctccacatctttaccaaaacttgtttatttgataacagtcattctaatgggtgcgatgtggtaatcttacatttttagtattttcatatataagggataacatagtgctgcccctgtggttattatcacattactgtgttccccctgccaacaaaaaagtacctcatattgaagtacttttatttttattatgcagaagagcagggaccttgtccatcttcatcactagtatccctagggctcagacagtacctgacacattatacttgcttagcaagtatttgaatgaatgaatgaatggaaagtagggaggcatggtgtagtggttaagaccaaagactttggcatcaaacagacctgaggttgagtcctggtttcctcatttgtaaaatggatttgatagtgcctccctcataggattgtggtgggattaaatgaggtcacatctacagcacctggtgcactgtaattatcccataagtggcagctattatttaaaaaggtcacctggccaaaggggcatcagtagacttgaagtttaaaatttttcatctgtcactaatcagctacgtaatactgaacaaattgtctaacctctctgggtctgagttgtttcctctgtaaaattaggaccttaagttagatgacaggccgggcatggtggctcatgcctgtaatcccagaactgttgggagggctaggcaggtggatcacctgaggtcgggagtttgagaccagcctggccaacatggtgaaacaccgtcccgtccctactaaaaataaaaaagtagccgggtgtgtagtcccaactactcgggagtctgaggcaggagagtcgcttgaacccaggaggcggaggttgcagtgagcagagattgtgccactgcactccagcctgggcgacagagtgagattccgtctcaaagaaaaaaacaaaaagatgacccctgatggcctgtctatgattttcatttgatccttacagttgttactgtattaactgaaggaattattacc

SEQ ID NO: 103839 - DNA, 1094 bp, Homo sapiens
acctcgtgatctacctgcctcagcctcccaaagtgctgggattacaggcgtgagccaccgcgcccggccccaaaattcttaatttaatcatgcctgcaaagactcctagccctttttgctgtaaaaggtaacattcacagattcccggtattaggctatggatatcttttgggccatttttcagcctatcatagtctcttctctgctcgtctgttccacaggcaaaatacacccatctcattccaacatccccaaaagtctcaacccattgcaacatcaactcaagcccgagatctcttctgtcaccaactctgaagtttaaagtctcattatctaaatcatctgttatctgttcccaaaatacactggtcagacatgtatagtgtaacagttatagataattccggtttcagaagggagaaaatgcaaggaataaatgggttactggtactaagtaatttcaaaatccagcagggaaaatttttattatgtttcaaagcctgtgagtaattttcttttactcgagactctgccctctgagtctctggctctagcttctgctttcatagttatccttcctttttcttgaagagaagcatatatttgcaactgagtagagtttttgcccacggtgtttaaaaattgtgttaaaatttaccatcgtaaccatttttaagtgtactgtccagtggtgttaagtacattcatattgtgaaaccatcaccgccgttcatctccagaactctttttatcttgcaaaactgaagctctatacccattaaacaatgactccctgttctcctctccccagcccctgtgaaccaccattcccttttctgtctctatggttttgattactcttaagtacttcatacaagtggaaccatacaatatttgtcttttgtgactagcttatgtcacttagtataatgtcctcaagagtcatccatgttgtagcatgtatcagaattttctttctttttacggctgaaagagtaaagagtatttttattagcctgattgctgcatgtagaattttggtagtccaacatctttcagtcttcttcttcttttttttttttttttaaagacag

SEQ ID NO: 103840 - DNA, 1045 bp, Homo sapiens
ccctgccaggccttatttatttatttatttatttatttatttatttatttatttatttagagagagggccttgctatgttgcctgggctggttgtgaacttctggcctcaagcagtctacctgccttggcttcccaaagtgttgggattacaggtttgagccaacacacccctcctatttttattttttttttagggacaggtgtctcactctgttgcctaggctgatcttgatctcctgggctcaagtgatcctcccatcttggcctcttaaaatgttgggattacaggcatgagccactgagccttttattctattttatagattcattgaactatttaacattatcttgttgatacttcctttccgttcagatgtttttttggggggttaggagtcctggaatgggaacagggaaccaagaacataatgtatcatatgctagtcatttgagataaatttaaagatttcttttacccagtagaagttcataggatgttatggttcatttgtgtgatatctgtcatgagtctttatataccctgagtcagtggattaatcattttcctagatcagacactctgtagcatgaatgaccctttttaaaaagttaatgttttgacctttacctgaaagctgattcttaaagtgtatctggcaggatcaatatatatggaaaccaggcatgacttatacaatttggacaagctaatcatgacattttattttcaacatgtctaatagcctgttggcttcccaaataacgctgagttaattatagtgtaaccttttattctatttggagagtgtcaagggattttttgaatgccttccaaaattcactttcatgaggtgagcttagaaagcttagaaaacgctttctagagcagggattctcaaaactttaccttcatgatccaccctgcctcttctgggtacttatttggtttccctactgtttagagatagtagtgatggggttgaatgcacctgtttttaatcctggctctattgctcactagctcagtgatcttagacaacaagg

SEQ ID NO: 103841 - DNA, 1134 bp, Homo sapiens
tatcattttactacatctattgcaagttactttctgtgaaatgtttcatatttgatttagtcactaaggcgatataataaataaagcttatctttataagctttatatatggcaatataataaataaaggctatctttatttatatattttatacttataaatttggtgatatttcctaaaaagtatggcctgtgggaacattcagtaaaaatggagtacattgatatatacagattccatatgaagcactttactaactttgttaaacaggtataaactttctttgagagtgcagcttaaatacttatttaagtgtatttaaaaaacgatttgtagatttacagccatttaatttacaaagggaaatttagaatttttaagttgtattaacaaagatcgttgtattatatttcgagaaaacactgtggcaagctcatatactactgtaagctccccaggggtgaggatatttgtttttcttcccagcttcaaaggcagttcttgggacatagcaggtgctcagtaaatatttcttgaatataagatgaacatgaacaaatatatatttactccgtgttcttgtgtgtgtatatatattcacataaatgctagggttgatagttgcaattgacaaacataagaaacatttctttactgagaaaaagctttggtcaggaggttatatttcaggtttttgaaagagaaaagagaaaacattgatgggttatggatgaagtggtataggcttggggagtagttttttataaatgaatacattttggaagaagggggacattgaacaaagagaatgacccactgacacaattcagcaaatatgggcgctgtttatgtctaaggctttaatagagttttgagaatcaaggaaatagtctccgctctcaaggaaattagagttttggagagcgggtgtgttaactgtcttcctgtgtaacagattacctcgaaagttagtgtttaagacaacatttcttatttttcacagtttctgtgagtcaggaatttggaatcagcttggctgagtgattcaaactcaggtctctcaaaaaattgcaataatggctgggcacggtggctcacacatgtattctcagcattttgggaggctgaggcag

SEQ ID NO: 103842 - DNA, 1133 bp, Homo sapiens
gtatagcaaacctgaatgctgccaggtgtacagggctctgcaaatctgaaacttgatggccaagaactttacctcctaagaaagcgtctgtcaggacgctgatgcagtccaccctccccgcttcgggtacctttgatactccatagtgcctagggctggaccttttgagtcgactcccaaacctgccacttgctagctgtgtaatcttgtgccttggtttcctcgtctgaaaaatgaggataatagcaccaatcgcatacggttgtttgttgtaagtgtcgaatgaaataattcacgtgaagcgtttgacacagtgcttggcccatagtaagggcccaagaaatgtttgcttttgggatgttgagaatgcctggtttgcctgtgtgcctttaagcactagcccagcttggcattgtcaagatttctctctgttgtctccctgttatgcagcataacgaaagggcagttgaatggttaacttgcttgccagcctctgtttggcatgaagtgtgtgtatatacaggaatgtggaatacatcacttaaatataataatggaattaccccatgcttcgtatgtttttacatagttttaaactcataagacgtctggaatgtccccgagttgcaagtttttgagatcttttcagggtcctttctacatcaagccgaagcctgtaacgttaagacttattgtcagtaagaagttagacctacatgttttacttcagaagacccccaaaactccaaatgtcacttacgcagttttactgttgaaaagcagtcatctcccgggggtgaggtggtacagccagctggcccacagccctatgactgcagggtggggaacctttggctggaagttattaaactaagttttgcttaatgtcgtttgcatttttcatagcgaaccaaagggctttatgttactgtttcttattgaaatgatttagaaagaagcaatccattactgcgttctttaaaaacacctgcaaagaaaaaaatatctgtagtttagctctagtgtttgtttcagtttttggccaataactattaagaagagcccgtttttaagaaggcttccaaaagtcacatccacttgaataagttatttagagtcaaatcaagagaggt

SEQ ID NO: 103843 - DNA, 1265 bp, Homo sapiens
aagtactttgacaacagaagtctgtgttgaaatctaaaacctctattgcttgttcttatcaaagtagctatctaggtagcatgttctctgatgcaggagctgacttctgttttttcaaacctctttccctttagacgttttggaataatgggactctacaaaggccttgaagccaaactgctgcagacagtcctcactgctgctctcatgttccttgtttatgagaaactgacagctgccaccttcacagttatggggctgaagcgtgcacaccaacactgagacgccttcccatgaaaaattccgaagatgctcaagagggaggtttcctcctgagtgaagagaagtgattctcccttgactctggctcctgccaccacaaatgttaccctcattggcttgaaaagcatccaagggtgcacagggagtatggccaactggacctgttgtcaccttaattgtcatgctggctggttggattttggggtggcagttggactaatgtgaaaaaaacattgctgaaaacctaaaaatgaaagtttgtgagtgtttattggttttcttaagagaaatggactattttgctctcatgtgtaatgttttctatttaaatctttcttaaatataccagctgttctctttccctgaactctcccccaggttctaggacaaatttaataacatgtaattctcctcaaatacttttgtatgtctcagtgttggtgttttcctccctaaaactaacattagggctgtgccacgggcatgactttatttttgttgggcttttttttccctgcttaaggagaggtgtcttttttggatatgagctatttattttgtgaaatgaaaattgttcacccaaatgattctcttataaactatttgtaaatgtcacttattcattagtgtttgacataatttttagaatatttattttgaatcaatcctttcattacgaaagacttgaagttttgtgtccattcttacaagccctggtcagtcaagtcccaataaatggtcagcacaaaaaagatattcttgaaaattgctctttattaaggtattacgttgagtttgcaaccagatgggaaaaatcacaaaaatgagaaggggagcagatatcttgttgaggtctggatattatctccctttataaacttggtgtaggccgtatattttgaaaataaacatctggttgaggttatttcatttggaaaccttccttagagtcctgttgctcagtgtggtccatcagacggtag

SEQ ID NO: 103844 - DNA, 1986 bp, Homo sapiens
acccaggaggcggaggttgcagtgagcggagatcgagccactgcactccagcctgggagatagagcgagactccatctccaaaaaagaaaaaaagaggtaccattttagatagtatggtgttaagtcaagttaaagctgtctctacatattttaacttcagtgctgggaatggtaaaaaattaaaaataaattagccggcatgtgcctgtaatcccagctacttgggaggctaaggagggaggatcacttaagcccaggagtaggaggctgcagcaagaccatgtctcaaaaaaacaaaataaaataaaataaataattgtaacagctaatggaataaaacaggtgtgaaagtgaattcctgtgttttgaaattgtaaagaataaaaggaataatcacttggtgattggattagattagtggttctccactgaggctgattttgacccacagggtcaaatgtggcatctagtgggtagaggccagggagactgctaatcatcctacacaagagcccacatacacacacaacaaataattttccaccccaaaatattagtactgtcacagttgggagactctgggttaaagaattttacaatcctttgttaattgtgagattctctgattgtaggtcttctctttttctgaaggttgagagttccttgaaaattacttttgtgagttttaaacttctcttcataacaagtttttatatcttaatatgtacatatttttataataattataacagctttcttcctgctgtgagtattataatcactgtagaaatgagttgtatcatctctaaggagaactaggaacagcgttgttgctcttcaaattcttcttgaaacttagaaatttattatttattgtattttcccagaaaaacaagcctataaagcttcatatcttggggaataatgtgggaacagaaccttaacagataaatgaagagacacttatttttatgaaattggaatttttagcaataactcttactgaatgccaaaggtattatcattgttgtgatagttcaaaatgtatttcctgccctctggccttaaatctggcaagacaggtttgttcctgttgtgtgtaaagtttcattccttcctacggagtcaagtgagatttgttagatttgtgcctttgttttgccattttcttatatccatggtcattgcacatattttccagaagtgcatacccaattagcctacttcgtttgtgttttctctccgtaacaaaggagactcactgctgataaaactaattgttttcaagatttcaggagtaaatagctgtgttctaattgttccttgatttagtgaataattttagtgtgttcaattactgttattcatctcttaattttggtttattctttcttgtaaatgatttgttacataaaagaaagaaagaaaatagaattatagacattagaattagaaaaaaaacagtcttctgccctttggtaggtaaagtattaatttgtatttctactttagagcggaagtagcatccacagcttggaactggcggaagagttgttgttgttgttgttgttgttgttgttttgagatggggtctcgctctgacacccgggctggagtgcagtagtgcgatctcggctcactgcaacctccaccttctgggttcaagcgattctccttcctcagcctcctgagtagctgggactacaggcgcccgccaccgtgcctggctaatttttgtattcttagtagaaacagggtttcgccgtgttggccaggctggtctctaactcctgaccttgtgatccacccgcctcagcctcccaaagtgctgggattccaggcgtgagcaaccgcacccggccggaactggcagaagagttacacgggcttacaaaaaagcagacaattttctttatcctttgggcctgtcaggagttggaattggtactcacgaatggtttgtggcatgcttctctcagtggaat

SEQ ID NO: 103845 - DNA, 3838 bp, Homo sapiens
aggtaagacttggaagaaaaactttggactttgtatcattaaggcaattctttcataattctgtgtggagacaaaggttactctcatagctattttttatttatcacagttaccaaatagctaattatgcaagagtgacatttattttctttatgcagagtgagtaacttaaatttttaaaactaggaaatacttagcaatcggcaattatatccagttgtccttttctttgtatcaaaattgtgcttttttcatcatacagttcaaatgacttaattcagcttgattttgatacttcaagcactcatctaaaccccatttaacttaactatcaccaaattacaggtctaaataagagatggaatttaggataataaacttactgacccagtaggacactttttaaatactaatgaaccctttcttttcaggatccagaagttatggtggctttccaggatgtggctcagaacccagcaaatatgtcaaaataccagagcaacccaaaggttatgaatctcatcagtaaattgtcagccaaatttggaggtcaagcgtaatgtccttctgataaataaagcccttgctgaaggaaaagcaacctagatcaccttatggatgtcgcaataatacaaaccagtgtacctctgaccttctcatcaagagagctggggtgctttgaagataatccctacccctctcccccaaatgcagctgaagcattttacagtggtttgccattagggtattcattcagataatgttttcctactaggaattacaaactttaaacactttttaaatcttcaaaatatttaaaacaaatttaaagggcctgttaattcttatatttttctttactaatcattttggatttttttctttgaattattggcagggaatatacttatgtatggaagattactgctctgagtgaaataaaagttattagtgcgaggcaaacataactcatttgaggataaagtttgtgttggatatgtggttcctgatgcattttgacttgtctttttaaatgctttatctttttctttaaagatttatttcaataaaactaattgggaccacccgtatttcagtaggacctgggtagggattggaagtacttggcagggcagcagcaatcttgctgtgtttgatataacatgcatccttgggcaggttgcccttaaatcttacactgtggtgaagggatgttttttttgtaatgctgcagtagagttggagtacttagttctcttgttgtccagtatatctaataagtgtttttcatattatttccacgtaagggaaataaggtagtacttttctttttatatttctatgcttaaaattctctttcctagtcaaaaattgcccaaatctgtgtttgctttctgcttgctacatttgtctcccttacttttcttgagctaaagacaggctttttccaccggcatcatcactgctatcatcattaacagcgtaattatacaagcatatttaatgctgagtttaatttaatatgtaatacatatggtaattgtagggtaatacccacaacaactgtagtttcttacttggccaagagaatgcttatttaagtgttagacttccattctggcaaaatcttgccttatcagaagacattggaaagagggattccctttggtgtttggtcttctacttagaaaaacctattgcagttagtttatcttgtagtattcatctttgtattctgaagataaggtttgaattaaattgatacacacagaggggaaccgattttttttatccaatgtgaattataaatgagataatccacagttattcattgtggagttgttgagactatgaaagactcattgtctttgtattcagctcttaaatagtgtaactatatccccacctctgcttgctttctttccctcccctccaatgataaagaaaatgataaattttctgttgtgcattcaattcttattttaaataagactaagtataggcattgtacctgacattgctacgtttctaccagtgtttcaatttaaagtgctagtgtttaaaaacattttcaagggataaggccttctgtactttgcttatttgaagaatcagtggtaggagcagtgaagtaaattctatggagtacatttctaaaataccacatttctgaaatcataaataagtttattcaggttctaaccctttgctgtacacaagcagacagaaatgcatctgttacataaatgagaaaaagctattatgctgatggagcatgctttttaaatcctttaaaaacactcaccatataaacttgcatttgagcttgtgtgttcttttgttaatgtgtagagttctcctttctcgaaattgccagtgtgtacttggcttaactcaagaacagtttcttctggattccttatttgatttatttaacctaattatattctaatattgcaaatattaccataagtgggtaaaagtaaaattcctcttctgaaaatgtgtcctgtgcttttagatttttaaattccataatatacattcttaattttcaactcaatattctaaaccagaaatgttttcttgtactgatgctatcagaaggaagttttttctgcttaaaaatatagttatatttctagctgtctttaaaatacggtttcaaactagatattgggcaggtgcggtggctcacgcctgtaataccaacacttttgggaggccgaggcgggcagatcgtctgaggtgaggagttcaagaccagcctggccaacatggcgaaatcccgtctctactaaaaatacaaaaactagccaggcatggtgttgggcacctgtaattccagctactcgggaggctgagtcaggagaatcacttgaacctgggaggcagaggttgcagtgagctgagatcacgaaacacagtctcaaaaaacaaaaactagtttttaatttccccccccacccccgactttttgtagcatatgttctattttatgtctctggtactcaggttatttactaggtatattaggctgcagactattaagtgctgcaaacaagaacccctaaaaaacatgtactttattttgggtagctgttcagaggcaggcattctgccatacttagaaggtagcttccatttctagtccaaagttgcttgctctggtgctcattctccaattgaggaaataggagaagggggctctgggaaacacgctgagatactgaagataatatatgatgttaacattttattacttctaatatcccattggtcagtttgtgtgttcaggctatgtttagctgcagggaaagccagtttgtcatccataactgtgtgatcacatgctcaagaaaaaacttaagagtagaaacaggaaagacgacttggggtgacacctagcagtctaccatactaggaaatactagtttgataagataaaggagaaacaatttcattttagagatttgctgatgactaaaattaatgcacctgagtaggcacaggtaagtagtgtttgtgccaagccctgttataatcagtttgcaagtattggatcaattctgataatgaccataagggtagatactgttagcaccactttacaattttatagataaggaaactgaagcacttaataagtaaattgcccaggataacacagctgattatttgtaaagctgagattcttgaatacagaggtttgtggcttcaaagggctttctcccaaactctgtactgtgctgcctctgtgtacaaggttgattcttgcagaattgtttaaggaactgaaaactaaaatgtacatttgaataaggttggttaaataagg

SEQ ID NO: 103846 - DNA, 1424 bp, Homo sapiens
aagtagaacattccagcttttaaggatgatttttatctaaaattgttggttaaaataattttaatgtgtttacatggtaaatccttcattttgtgggaagttcagctgtcaagaatttactctcagagattttaagatagtgggaattgtattgaatttaattatttactgccagagagttcatttggttttctgttttcttcttaaaatagggcaaagttgtaactttgtcagcaaagtgtaaacaagctaaagtgacagttgaatatgaatctcttaaatgtattttattctctgaggaaataacatccagagcatttatttgatactagtgtctggtatacatatttacatttttccctcttaatccctatagcaatttgataatattaaatatttcttcctctcccattttatggatacagaaacttaaatatactgtggcatatacttggggtatgagttcccagtctctgccttcccacggcagacatccgtaataatactcttcctactgaattcagctgtccgtctgaaacctaaacactgtgtatctgatagaaactagcaggcaagaattgtcatgcacttagaaacctgtttgttaatctttgagcttaattgtttgagattataacatttctaacttcaaatcccaggcccctttactctgttttacagtgcctcatgcagttgaggttggttttcttaaaggcttagcttgtgttaggtctttttgtacaagacaaatctgtcatttttctgaactgcatgttgaattaaacatctctctacaaagaatatttgtgttgatgttattcagcttttggagcaagcttattttgctatggctcttttttctaggcacagaaaattgcagaacatcggagaaagtatgagcgaaaacgtgaagagcgagagatcaaagaaagaatagaacgagttaagaaggctcgagaagagcatgagagagcccagagggtaaatttcctatagctaagccatgaaaggaaaatacggcaaattatgtagaggcattaggacactaaaattttaattcctggctcttttatttaatgctggctacagttctatagagtaatgatattacttatggggagtctcctttcactgtatctaatttgggggacatttttagtcttaaattattcagtgagcttttatttcaccattttatattcttgtttgtgtttttataaaatcagttgtttttccaggtcaagtaattgaaatgtgacagtattattgtttgatcttttgaggatgcttcgccagattaattaaatttatgattcctcctctcttccaacagtggatgtgttgctatttaaaaatgattctagcagggcaaggtggcaagtgcctatagtcccagctcttgggaggctgtggtgggaggttca

SEQ ID NO: 103847 - DNA, 1222 bp, Homo sapiens
gccacacagcttcttatttctgtttgtattcaggtttaggatttgctttatttccatttttctgattttattttttgagtatgtaaagcatttaaatgttcgaagagttacacctgagttaaaaggtatacccagtgaattctcagttttcgttgctgtctcctctgccccattctcacctactgtcaccaacctttagtttctggtttacttgttctgagtttttcgtaaagcctgtacacatgtattattttctcttctgtcttacatagaaggtagctaaaagctaacacattatgttagtcctggtttgggcgagttgaaagttactggtctacatacttagaaaattacgatattctgaattaagaaagattttgtttgttttttagcttttagtagaaaagcagctttaaatagaggaaatttaaatgttttcaggtttttatagagttaactaaaatgggatatagtaattgaattggttagtgaaagtttatagttaatatttaacttaagcctgttttagaacaatccttttttgtaaggaagaaagatatcatgccacataggtgaatatgtataaaaggctcctaaaatgagtgtaaatctgtttcagacttctaggccactgggaagaagcagcccatgatcttgcccttgcctgtaaattggattatgatgaagatgctagtgcaatgctgaaagaagttcaacctagggtatgtcaaagtagagaaagggaaagtcattagttaaatactccatcgctgtagtgcttagcccccgacagctgtaattcatctgaaaaacaggcaaagaaacaaaccattggaagatataatctgtaattgctgaagtttgtgctcgactctggagatctcattaggttttcatgctttcatttctcatgcattattagagcaaactctgttactttgtttggaagcctgcagtggaattataaccagaaaattagaaaagggggtatcaggtttacaacaaggaaacaaatagaaaatctataattagcattacccaggattgaatctgatgtgtccttatttatcataggtgtgtacaaccactttataaagcaagaagaccttgtggaagttaagaagtttcaggctttccggccaggcgcggtggctcatgcctgtaatcccagcactttgggaggccgaggcaggtggatcatgaggtcaggagttcaagacca

SEQ ID NO: 103848 - DNA, 1056 bp, Homo sapiens
cgcccagctaattttttgtattttttagtagagatggagtttcaccgtgttagccaggatggtctcgatctcctgacctcatgatttgcctgccttggcctcccaaagtgctgggattacaggcgtgagccaccgtgcccgtctactttttccttaaacaagatcaatatgggtcatactaagaatgtgctattctattgttagttaggggcttacgtactcagaaattgtcttacctcgtgagttacagtataggtgtggtaagatttgctttcaagagccagttttagtataacttagttgtcttttttatttttacttgattaaaagaaaaatgtaaaagacttaactggataacagatcaaaactttttattaatatttttatcctctgaatatttctcgataacttttgtttcactttaggtgaactccagaaagccattgacttattcacagatgccatcaagctgaatcctcgcttggccattttgtatgccaagagggccaggtgagaactctaaacagaaaagcatcccctggcaaataatttctgcacatttgtttaaatagagttgcttctgtgttgatcccaaaacttttactgaaatgaatactttttaataacacacttatttttcagtgtcttcgtcaaattacagaagccaaatgctgccatccgagactgtgacagagccattgaaataaatcctgattcagctcagccttacaagtggcgggggaaagcacacaggtaaataattgaatttaattattttcagaactctttacatttaaatctgatgttttaagatgctttgtttaaacaaaaacacaaaagttcctaatgacttaattttcaaattagtgtgtacttagtatcaagaagtgagatagcttgtagacagctgcttaaaaggtaaaagaaaaaaaaaagaaatttaaaagaagaagtgagaatataggaaggaagaaataaaaagtattttcatttttttcattcaaataaagctactcttaccagtttttgactacatatggccaaatataaggaaag

SEQ ID NO: 103849 - DNA, 1009 bp, Homo sapiens
ccaaagtgctgggataacaggcatgaaccactgcgcccagcctctttttttatatatatttatttttttaactctccaaggtaacaataggttattatttttttcttttttctgtttttcagttgtattttattttattttttatttttgagacagagtcgtgctttgtcgtccaggctggaatgcagtggcgtgatctcggctctctgcaacctccaccccaagtcgagcaattctcctgcctcagcctccctagtagctgggattacaggcgtgtgctaccatctccagctaatttttgtatttttagtagagacggggtttcactatgttggccaggctggtctcaaattcctgacctcgagtgatgtgcccgcctctgcctcccaaagtgctgggattgcagacgcgaaccactgcgcccggcccatggtagtattaagtgtaatgtttgatcggttataatttgtaagaacaaatcatgtataaacttgggtactgtggctgcttgagtaatatttcactctttataacagtgatagtgtgtcacaatgccatagttgactagatgctattgtatagtgctcatgtgcatttggacttcattattagatttagaagatgattgaagttatttttagaatgagttcagtattgatgttccgagttagtatatattttaaacattttgtgattctaccacctgattaatttagctccttaaaacatgtttatactgttttatactgcagttgccttaatagtttaccttcctgaaaaatttattcctttattgctttctgtttactttccctaggttattcttagagctgttttttattctactcttgcttgtaacctgtgattaacttttgcatatatatttaagatcttcatcagaggattatagacctgccagactaagatcctgtattttacttctccaatcttgttttctccagtcagactttactgttctagaattttttttttttttttatttatgcta

SEQ ID NO: 103850 - DNA, 1228 bp, Homo sapiens
tcacccaggctagagtacagtgacacaatcaagactcactacagccttgacttcctgagctcaagcgagcctcctaactcagcctcctgagtagctgggaccagatgcatgtgccaccatgcccagcttgtttttttttttttttttcttttttttggagagatgggatcgccctctgttgcccagatgcacatgtttttgttcttaactaatctttatactgtcagcatcttgtacagtgtttggtctatctatatagcataggtgctcaatagttgtttgtgggaacaaaggaatgagacctttctcttctgaggatttaaacctaaaaggagctagttatctttttgtgaggagattgggtttaatatttatggatagctaggtaggagctggtatgctttggttgggacggaaggttaagcaaaggttatgtctcgggcagagtgtaggagtgaaatttgtttagtataaaaggttaaaactcgtatgtaatttctcactaatgagttatcataattgtctctttgttctctggagactacagaagaatgaatgaaaatgggtattgtgactgcgcctcatccctaagaaagtatgaattgcttccttctctctctctctactaattctaagatgatttttattttcttcctagataacggaggagatgatggatcaggcaaatgataaaaaagtggctgctattgaagccctaaatgatggtgagtaatctttttgctacatttctatggtagtcagaatatttattgcagtaacttaaatagtggtaaagtagaagagaagttacatgtacctgtcctatactggagaagatagtgtcctattatccagtcaccccttcctcattgataaaagaggctgaaatcacttctctctgcaaggacagatccttatttgattcagtgtctctgatttcctgaccctatcgtggtgtttttctgctgagaagaggctttaaagaggtgaaaggctttaaaaaaaaaaaaaaaaagtagtagtagaacagtgacccttaactttttacatactaatacccttgacagatgatgttcataggcataccaatcttcgtcctagtcagagcatgttagattctcttgagtaaatcccctcagagtgagaaagtggtgatagtattcggttttgttttttgtttgtttgtttggttggtttttttgagacggattctcactctgttgcccag

SEQ ID NO: 103851 - DNA, 1019 bp, Homo sapiens
ttatttgtaagtcttttgctctttactcattttcagaatttacttttattaaacacattaaattccttgttgaactcttcgctggtcttactcttatttttcatggctcttgctcattaaggtaccttgtttactttatgatgtgtttgtgtgttgtgtgtgatattttgaaaatgtgttctttggaacttcacctgtagaaaaattttgaggcctaggtaagaaggtgattgcttccatgaagtctctgaattggtgctaccaactcaaggaccccttgaaagtctcagcatggtgtttttttgtttgttccaattactttggtaatacagaattccagatgaaaggctggctgtggctctgaattttcaggggaagttcttttaatctcactactcaactgtccgtttctgtaggacaggtttataccattatgcttgccggtattagcatttggagttgcagatttattttggaaggtgtctggttagaccacatacattctcttcctctgaatatagactttgtatcctgtgtcctgcattaccttcaaaataaaattgcagccaggagtggcggcttatgcttctaatcccagaactttgggagagtgaggcaggcaactcacttgagtccaagagttctagaccagcctgggcagcatgatgaaaacccgtctctataaaaaaaaaaaagcaaaacatttagtaggttgcgagcatgtagttccagctacacttgaggggaggctgagcccaggagatggaggttgcagtgaaccgtgattgcaccactgcaccggagcttgggtgacagaggtagaccctgtctttaaataaaacattatttttatatttaatatttattttttctttttattttttgtagagacgaagtttcgccatattgcccaggttggtcttgaactcctgggctcaagggatctacctgcctcagcctcccaaagtgctgagattataggcatgagttgtatatttttttcctgtggttaaagatct

SEQ ID NO: 103852 - DNA, 1180 bp, Homo sapiens
ttggacaacatagtaagatcctgtgccccccccaaaattattttaattttaaaaaaggaaagtaatgaatgtaattatattaaaatattttgatttacgttgaagtatcactgtagcttacctgcatatttttgaaaaacatagtacatcagtgtgtagaaaaaaattatttgaactaaatcagtttgttgacaatggtgtatttatatacaatgactaaatcagtggtgtatttatgtgtaatactagaaactgcacatgtcaacaaccccactacaacctgataataaatatcttacatgatgtgacagttaacgtaaagtgtagtcttaccaaagtaacgaaatgtttaatgggaacatattttaaaatgcatcaatacttaaaataattaattgtagtagtcatagtatgtcagtttttaataatcttgggagtggctactatattgtacggtgcaggtcttattgtcattttctcgactttggcagaaattgataaagaaggtgtgattgaaccagacactgatgctcctcaagaaatgggagatgaaaatgcggaggtaagttcggtgacttgatttcctgcttgttctaagaaatgtgaaaggtcctgctgttgcaatgattttatgacacgattcttccaggaaaagcgcatagtaaatctttctctgacttcaggcgttttaggcaagcattgtattttactacttaaaatactaatgaaaataaatactgttactttctgttttatctgttttttaagtttgcatctggtgtgactgcttgcactgtaacgcagaattcacttaaaatacatacctattagtggagttgctcttgatggaatatctaatgccaaattgtattacagaatggtttgtcataacaggccctcaagggagtgaaaattggttcttgggaggagggcttaaaaaaaattctatatattacaatggttagtggtcctccaaagactcatagaatattaatatgtagtgtatctgtggtattaaaattggggatatggaaatgaggaaaagatgtctaaaaaggctccttagtgtctgataaaaatttgagaaacactctaatatagtaatagcagttttaaaagattggtttttatcctcaaaacttgatattatcagatttcatctttgccaagtattgtggga

SEQ ID NO: 103853 - DNA, 1053 bp, Homo sapiens
ttgtaaagatttttactaaatttggcaataaaatataatgtgagtggacatgaggctatttataatctctaaactgtttattgtcaatgttcaaactttattttgaacagttgtttttttatttttgagacacagtcttgctctgtcgcccaggctggagtgcagtggcatgatctcagctcactgccacctccgcctcccaggttcaagtgattgtcctgcctcagcctcccaagtggctgggattacaagcgggcaccaccacgtccggctaatttgtatttttagtagagatggtttcaccgtgttggccaggctagtcttgaactcctaacctcaaatgatccacccaccccagcctcccaaagtgctggaattccaggcatgagccgccatgcctggccatatttgacagtttatacatagatttgtagaaattagtataaatattcggtatgttattaaatactgatagtactgtttgtcttccctttgctaggaagaaaaacctgatagtaagaaggtggaggaagacttaaaggcagacgaaccatcaagtgaggaaagtgatctaggtgaggagacggtagttagtttgtatttgaaaacctatgatgtgatactttgttgatttttattaaagtgacttaaatcagcactgtgtaatagaaatataatggcacatatgaaacttagaatgttctagtagtcacattttagaaagtaaaaggaaacatgaaataaattcagatattaatggcatattggttgaaatattgacatgtgtaatcaatatttttttttgtttttttgttctttttgagatggagtcgtgctcttgtcacccagactggagtgcactggcacaatctcggctcactgcaacctccacctcccaggtttaagccattctcctgcctgagcctcccgagtaactgggattagaggaacctgccaccacactcggctaatttttataattttagtaaagacgggctttcaccatgttggcaaggctggcctcgaactcctgacctcgtgatccacccacct

SEQ ID NO: 103854 - DNA, 1142 bp, Homo sapiens
gccccgagctgggaccgaccctccggctccacgcccttttttttttttttttttaggtcccgggcgttgagctctactcagtgcacgcagccacacaatatgctcttggacgtcgccccctggaggggatgttatctcccgcctccttgaagtcgcccatttctggggttgccccatccagggagctggttcctagttaagaatatgagaatgtatgcgcagggaggcaggcaacagcacgaacagccacgcttctagaagattctagggagcgcgcaggagcagcgcagagggagtaggaatgagcaggcggaggacccgaggtcacgagaccgttgggtgggaggagccagcggccggggaggttctagtctgttctgtcttgcggcagccgcccccttctgcgcggtcacgccgagccagcgcctgggcctggaaccgggccgtagcccccccagtttcgcccaccacctccctaccatggacccccgcaaagtgaacgagcttcgggcctttgtgaaaatgtgtaagcaggatccgagcgttctgcacaccgaggaaatgcgcttcctgagggagtgggtggagaggtgagacccaggcctgaggaccgttgggggcgggggaagcacggccccaggggggagccaggctggacctggctcggtccggcgggcgaggcggggtcgctgccccttctttgcccgggaaagggaggcaacttcgaggggtcatggaagatcgcgagccttgggtagtacaggagccgcggggagcaggaggcagagctgggttcctcgcaccctgaggttgcccaggggtgtatcttgggcgaaatacaaaaacaggactgcggatgcgtggacactggagacgcgaggagtgaaaactgcaagacttagattttgcgtggggttgtttttctttcagtcttgtgtgccctgctcaggtctcattggtacatagcagttcctttacgcactattcctttacgtcgtgttataataatataacactagtaagttaaaagttacaaaactagtaagaataaaaatgataactgtaaaaatgattgtttttaccttacagcgtttgtagctgcgtaggattaattatcttgagaatcacttattatacctccg

SEQ ID NO: 103855 - DNA, 1046 bp, Homo sapiens
cattcaaaaaaactactaaccaaatgtccacaatcctgctaaaagtgttgaaaagctcttagtatagtattaagtgttatctacaaaatttgtgattaaccaaaacacacacaattgtgttcaaatgttatatatttgaagagtcaatttaacaattccttttggtagacttcttttgcacctctttacgcttcttttttttcctcttaccaccctctttgactcctgctgagaaaatagggggatctctgttgctggtaacccaagatatacctccctcatcattgtccacgaaagtatattgagatacatgtttggagctgtgagaatttggtgaatagttgttgaatgactgtgttctccagctgcattcttttgcaaagccctcttcattggccacactatttacaagaaaaaatgtcaactctccattatcttcagcttctctttcttgatcactttcaataattttctttgtattaatatttctgccattaacgattttgtctgaagttgtaacagatatgtagttgtccatcccactattatcaaaagccagggaagagaaagaagtaaggccttcatgccccaatgaaccctgtgatgtatatcctgtatcatatgaagaaaatttctcaaaaattggatattcactggcagtggagaaaaagtatcctgcatctctgtttctgtttccataggagcttcctggacgatttaacaggtcctcaagcgagtcttcaaagaagtgaaaagaaaatggatccctttcatgaaaaatttctttaaaaacatcatctggcttatggaatgtgaagccgtactcacattcatcatcaaaatgacttccacctccgtttaatccttctgtgccatatttatcataaatgtcccgtttctcatcatttgataatacctcgtatgcctcagctacttctttgaattttctctctgcttcttctttattttctggatttttatcagggtgccatttaagtgccactttatgataagcttttttaatgtcctcaggtgaagcatatctt

SEQ ID NO: 103856 - DNA, 1080 bp, Homo sapiens
gactttctagatctattgtttcatttcattctctttattcttcattcaggatgtatgttgtgttcacagcgaaggtactcccttcagcctgtcccagaaaggaggattccaaaccgatacttaggccagcccagcccctttacacacccacacctcctcagaccaggtaaggccttttaactgtgctatctccccatttaggttctgtctagagcaatgctatgcaatagaacttcttgcagtaagctctggatctgtgctgttccataaggtagccactaacctcacatggccattttacactaataaggttgctagtacagctgaggagctgaactttttattttatttaattttaattaatttaaatttaagcttaactacatgtgggtactggtgctttattgacaatactagtctagaacaaggtttaaatatgatagaccttataattcagaataattaatgaaaggtatgtatttcaggatgtttttaaagcaaagttctatttctaagtcagcttttagaattgtatactattgtgaattactgtgttaaagacattttagaaaacatgttttttcttgaaattatcaaatatttactttaaaattataacctatttctatatagattaagcaagatttccagatttgtttgtcacagatttgagaggtagtatcccagttgataaaggtgatgcaaaaaaatgataaaggtttgttttactaatttttttttctgctataagatcccagcgttgctgccagaagatgtcttataactattgctcaaatttagacctaaaggttttttgttttgatttcttgcacttaaggggtgaactatgactaatgaatatctcagagaggaaggtagggtaaaagcaaacacattgtagaaaaagcaatcaggttttcaaggaaaattaattgttctttctgccataagaaattaaatatgtatttgccatataagcatatatattactaatggaaatttacctttagaaatatgttcctttttcactatccccactcagtgaatgataccagtatgtttctcagtgagggcttcctt

SEQ ID NO: 103857 - DNA, 1050 bp, Homo sapiens
attatctcatttaatcctcacagctttactaggtaggtaccataaagatccagtattacagaggaaggaattttaacccagaggttaacttacttgccccaaaccacccagttactatcattcctgaacagcatgttcttctttctacttcacaggcatttatattccagaggatgacaaagatgccccagagaagtttcggggtcttggtgtacgaattgaggatgatgtagtggtgactcaggactcacctctcatcctttctgcagactgtcccaaagagatgaatgacattgaacagatatgcagccaggcttcttgaccttcactgcggcccacatgcacctcaggttcaaaatgggtgtcttctggcagccctgcacgtgtgctttctgagtgtctctgtgtgtgcattaatatatgcattccatttgggagcatagcagctgtgtgaatgtatgtaattgtgtgtggggggttttttgttttaagtagttagaagtctgggaaaatgaatttttgaatagtatgttactgcagctttggtaacattaattctatagaattaatgatcagagcaagtttaatttttaaacataaaggtcttggttacacatgtccatgcattccagttaacacatttaaacatatagaaaattcacttcttctttcaagtccttccctttctatacttttgctgagatcaacccaatatcataagaagtttgtgtgatgcctgtatttttagctaattaccaaggtctctgcctatgcaaaaattcatctttcggtgattgtgggcggccaatacataccttctgtaactcctccctacctattctagatcctgcatatctactggagccatatgagccctcaggggcactggtgtcctgcagtcttactagtcagccacagtccaggttccagcaacactagctacctaccaaacaaaacacttctgagcttttcttgccatttggttgcctgggacctggaaagtgtttagattcttgataaagatggaaatggaagagaaagaaaattata

SEQ ID NO: 103858 - DNA, 1058 bp, Homo sapiens
aaaaaaaataaaactataaaacaatatagaggggtatggtgtgtgtgtgttactttagaatctagagtttacggtctatttagtataaacagtataaacgtgagaccatctggttttacaaaataatttacaaagtattcattagctgctgtcacaaaatcatgatagcaaacttgaaatgattttatcagtcttatagaggaagaatctggtggatttgatccagcctattaaaaggttggcacaaaactgactgaaaggtctccagaaagtccccataacactcaagactgtaaactgtagccatgcacattttatgaaggatgaattttgtggggaaataggatcaagttgcaaaattatgaatatttgacctttgtcaaccatataatgaatcgtaagtgtagccatctctctctccctgttaggaaccatctttaaaatctgagactgtctatgaggagtacctttaacatttctcacgttctggcaggcacaaaaagatactttgtatggcacaatggaacaaatttgagggggctgagtggtaagtacatatgacttgtagaaaaaaaattattatacatcctttaactatgataagaaaaatatgtacagtgagccaccatggctgaccaacaaacatgaaatttcttataatgggaatggatttctaatccagttgaaatattttatatcaaatatttcaaaataagctataatttgcagcatatacatgtattgttagaacagtcaccctgctcacagactccactaagaagtacttcatccacaaaagtcgtaagtatccagcatatgtaaagcagagatctgggctgtctgaggctgcatctggaagcagccctggcccagtcttgagcccccatgacacctatggctagcagcccttacacatctgaaacaccaaccactctagctaaattccatgacatccttgtctttcatgtgacactgtgctcaacagctgccactgaagtagatgaccaaatggtaacacctctccttctccatatttcagtgagctcttgaaaaataat

SEQ ID NO: 103859 - DNA, 1989 bp, Homo sapiens
tcctctcacttggagggatcctcgctgaaccgaggcctcacactgcctggttagagtctggagtgtaatgcttggctcttctgagacgtctgttggcttttcacacaaccaccccactcttgggttctctgtcacgtccagaatctcccccttccaaaataataataaaaagcatggtggaacttgttaagaaaatccgagcccaaatcctgtggcagttagggagggttgagtactagtcgcgaacgacttggtaagcgtgggaaagcaaaaatggaacgtgtctttttgcatgaaatgccttttagtggtttgccacagtttgggagaacagtatcgattctcacctaacatgaaagctgttcaaaatggagattctaaaatagggaagatattcctagaacatctggctaaacactgacaatatcccccgtcctagtgctttttggtgtctcattgtggccactgctgctcagttacagccagcagccatattgaaaaataatagaagtaggggcttttcctccaccttgaagctgtgatgtgaaaagtggtaaagaagttactaggcactgagaatggggtttgaaagcgaagaaggtttgggagtatttgtaattgaggaagccagagttgaatgaatgaaattctgttaaactcttactggaattattatcttaatagaagagtctaaacatataaaagttgagaacatcagtttattttatggtaagaatcaaaattctagtgaattgtagaatttgttatgaagtaatctaagatttaagtgatgaccttgttctgtgtactgacacgggtatttaattatccagcttatcccatgattacccattttatgatccagtcattatcttagttcattctgttctctagctttcacttcattgctcatgcttccagagctgtgtagagcagatacttattcagattttgagctcttctgcaactgccaccaaaacctgcacagaaattcaagtttgtgccctttttttttttttttttttttttttgagatggagtctcactctgtcgcccaggctggagtgcagtggcacgatcttggctcactgcaacctccgtcccccagattcaagcgattctcctgcctcagcttcccaaacagctggtattatagacacccgccaccaggcctggctaatttttgtatttttagtaaagataggattttgccatgttggccaggctggtcttgaactcctgacctcagtgatcggcccgcctcggcctcccaaaatgctaggactataggcgtgagccactgcacccggccagactaaattattttaaactataggaaacaaattaaaagatgacattaatttctgtgttcatatactcagccttttggagaatagaacatacgtgtagtctactgttgtctttggtataataagattaacgtaatatccaaaaacttttgtttggtggttccctgtggccaaagagatgataactgcagctgcagcctgaggtcctaaagagtatgtgtgtgtgttacaagcagaatgcactgttccctctttttgtctttgcagtggaatgcagtagccctctgggcctgggatattgtggttgataactgtgccatctgcaggaaccacattatggatctttgtaagtaattggaggaggatgggaggaagttgagaaggttgcagagattgtggctatcttgatgtgactgattttcttcttcacacgaggagatagcaagcctactctgagcactcggtcttctgtatctagtctgttggtgtgtttgaaatagagtagtttttttatgatgtcctggaggcatacccagctctcagaataaatctactcaatctaaagatggcagggacacatttagaattaattgtggacgacaggcactgttgatttttcctgcatatcttccatcttgtacctagactcaaaggtagaaatagtgaaaggaggaaaata

SEQ ID NO: 103860 - DNA, 1101 bp, Homo sapiens
acgtaaggaagcatctttacctgtcagcatggcttgtaaacatatttccacttttcctgctttgctagtcttgaaaataactagggaaaaaaatgactagtccacctttctcccaaaaggtatacaaatagtaaaaaagattttaaatcataatactattcacctgttacagggtaaaaattacagttactgcaaagaggcacttatttgtcttaattataaagtggacccaattttgttagcagtattttggggcttcatctatgggaattgccttcaaaacctacatgcaccctttggaatattctcgtggtagaactttgtacctttgaaacaggcttttttaaagaccaggtgtctaatggaactaagtttgatgagtaaattgagtgttgaagtctctgtgtatgtgtgttttaagtgtggcgtatgtactgagataagattattttttaacatggcttatgccagaaatgttttgtgtagctttattggactgaatggccttccaagagtgtgacagctgtgaaggataacaaatatcaaatatgttagttctagcatgtgttaaaaattcattctttaagctgtaaagtcccagtcacatgagctaaaattgtcttgtcagggcctcctgtgtcatggggacagaatactcacagttcccagcatgacacagggataagagattctagagtcagaccaccattccctgtctttgtgacttacttgctaagtgacgttaggcaaggcatttaacgtctccaatcctgggttccctcataaaatggggctgatagtggaccacataaaattgtaatccggattagatgatttatgttaaaatgtgattaaacaactcccggcacatagtaagcacaagtgcttgttaaaaaaaatctaaataggccggacgcggtggctcacgcctgtaatcccagcactctgggaggccgaggcgggtgcatcatgaggtcagcagatggagacatcctggctaacacagtgaaaccccgtctctactaaaaatacaaaaaattagccgggtgtggtggcaggcgcctgtagtcccagctactcgggaggctgaggcaggagaat

SEQ ID NO: 103861 - DNA, 1065 bp, Homo sapiens
gggaaaggggaatcacagcgacagccaagctagtgtcagtgtcgtcacctaatcctggagcacactgtgatcacttaggttctaactaaagttgcttatgtgtttaagcaggttttatgtctcaaacaggaaattatcttggaattaatcagagtaatttactttgtctttcaggtatgggcactaggaaaagacttcttccatcaagcttaattgttttgttattcatttaatgactttccctgctgttacctaattacaaattggatggaactgtgtttttttctgctttgttttttcagtttgctgtttctgtagccatattgtattctgtgtcaaataaagtccagttggattctggaacggatgctctctcttgtgtatgtgaacaaagtgaacataaatgaagagtctccccttccaaggctgaaaactcagcttttgaaagtgaaatgtttgttcatcggggccagagcagggttgtcctctgagcgcatcacttagtgacgaggaatccaacagctcaaggcagagtgtggatcaccggctcccgaaaacagcagtcagcccttctttctcctgtgtgacagcagtgggcagctgaaagagggaagaatgtgggattcagtcatcaaacccagttctgagtcctggttccacagcttgggtactgatggcaatcttggccaagttgtctctctactctgaactttcctcctctgtactgtgggcttctgaggactaagtggcatcatgtgggcacagagagaagctttgtaaaatgtaaaaccgctatacaaatgtgacctttggttgtgtatgacagcagtccccaacctttttgccaccagggattggtttcatggaagacgatttttccatggaccgggggtggggcgggggtgtgcttggggatggttttggaactgttccacctgagatcatgaggcagtagatggaccgcgcaacctagatccctcacatgcacggttcgccaatagggttgaagctcctatgagaatctaacgctgccgctgatgtgacaggcagagctcaggcggtaat

SEQ ID NO: 103862 - DNA, 1311 bp, Homo sapiens
aaagattttggttaaaggatataaaatttcagttagacagcagcacacagtacaagagatctattgtaaaacatgtaactatagttaataacaatatgttgtatacttgaaaattgtgaagagtagattttaaatgttcttttcacaaaaaagatgtgtgtgagttaatggatatgttaattagcttaacgagcttgatttagccattccacaatgtatgcatatatcaaaacatgggcccggctcagtggctcatgcttgtaatcccagcactttgcggggccgaggcagaaggatcacttgagcccaggagtttgaaatcagcctgggcaaccaagtaagaccctgtaactataaaaaatttaaaaattgctctttctcagtgaccgggttctaggcttaggcgcagacgggttaggggagccaacatgccagtggcccggagctgggtttgtcgcaaaacttacgtgaccccgcggagatcctttgagaaatctcgtctcgaccaagagctgaagctgatcgaagagtatgggctccggaataaacgtgaggtctggagggtcaaatttaccctggccaagatccgcaaggccgcccgggaactgctgacgcttgatcagaaggacccacggcgtctgttcgaaggcaatgccctgctgtggcggctggtctgcattggggtgctggatgagggcaagatgaagctggattacatcctgggcctgaagatagaggatttcttagagagacgcctacagacccaggtcttcaagctgggcttggccaagtccatccaccacgctcgcgtgctgatccgccagcgccatttcagggtccgcaagcaggtggtgaacatcccgtccttcattgtccgcctggattcccagaagcacatcgacttctctctgtgctctccctatgggggtggccgcccgggccgcgtgaagaggaagaatgccaagaagggccagggtggggctggggctggagaccacaaggaggaggattaagcccacctgtccctcctgggctgctgcattgtctagttttcctgccaaataaacaggatcagcgctttaaaaaaaaaaaaatttttttttttttttttttttttgagacggagtcttgctctgtcgcccaggctggagtgcagtggcgcgatctcggctcactgcaagctccacctccggggttcacgccattctcctgcctcagcctcccgagtagctgggactacaggtgcccgccaccacgcccgactaatttttttgtatttttagtagagacgaggtttcaccggattagcca

SEQ ID NO: 103863 - DNA, 3039 bp, Homo sapiens
tggtgaattcgaccggggttttgggggacccgccacccaagggccgaagagcagggccgccctacgggcgctcccatttggccacctgagtggcgacttggcgccttcctcggagcagctccggggttccgtcgtcccggttcccactggtcccttacgcagagaccaaaggcaggaaccttccctcgtaactatccaccgactgaaaatagattctgagtccgcccccgcccctccccccttaaaatcctccccactcttaaaatcctcccctttaaagggagccacagggtgacgccgggggagtttgcggaagcgctaaccgcgttggggcctagggcggatcccgtgattgggacaggccccgcccccggctccacttcccccattgtgtgagcggctcgggcctaggccccgcccccctccggaggcccggccactccccttttccacccccccttggctcatttccggccgccgccgctaccgctagcctgtaaggaggattcggcagagggaagaaacaacagccgccatcttgtttgtgtgctaggctgggggggagagagggcgagagagagcgggcgagagtgggcaagcaggacgccgggctgagtgctaactgcgggagccagagagtgcggaggggagtcgggtcggagagaggcggcaggggccgagacagtggcagggggcccggggcgcacgggctgaggcgacccccagccccctcccgtccgcacacacccccaccgcggtccagcagccgggccggcgtcgacgcctaggggggaccattacataaccccgcgccccgcggcgtcttctcccgccgccgcgggcggccccgaacggagccccggggggcgggcgctcccagcacctggccgccggcggtgggggccgtagcagcggccgtatttatttattttccgcgggaaaggaaggcgaaggaggggagcgcggcgcgaggaggggccgcctgcgccgccgccggagcggggcctcctcggtgggctccgcgtcggcgcgggcgtgcgggcggcgctgctcggcccggccccctcggccctctggtccggccagctccgctcccggcgtccttgccgcgcctccgccggccgccgcgcgatgtgaggcggcggcgccagcctggctctcggctcgggcgagttctctgcggccattaggggccggtgcggcggcggcggcgcggagcgcggcggcaggaggagggttcggagggtgggggcgcaggcccgggagggggcaccgggaggaggtgagtgtctcttgtcgcctcctcctctccccccttttcgcccccgcctccttgtggcgatgagaaggaggaggacagcgccgaggaggaagaggttgatggcggcggcggagctccgagagacctcggctgggcaggggccggccgtggcgggccggggactgcgcctctagagccgcgagttctcgggaattcgccgcagcggacgcgctcggcgaatttgtgctcttgtgccctcctccgggcttgggcccaggcccggcccctcgcacttgcccttaccttttctatcgagtccgcatccctctccagccactgcgacccggcgaagagaaaaaggaacttcccccaccccctcgggtgccgtcggagccccccagcccacccctgggtgcggcgcggggaccccgggccgaagaagagatttcctgaggattctggttttcctcgcttgtatctccgaaagaattaaaaatggccgagaatgtggtggaaccggggccgccttcagccaagcggcctaaactctcatctccggccctctcggcgtccgccagcgatggcacaggttagtttcggcagccccggccttccacgttccctttaatcttttctactcggtgcgcctttattcttccattttttttttcttcctctctctctagttccctgccccttaattaattttaaaggtatttgaatgagctggtcgaagacgtccagtagcccaaccattttctttgcctcctaatacattgattgcaacactatgtcatatcggtgtgtgttctggaattagagctcgtaagtgggtgctatatagaaatggcctgtattgttgctctcatgcaatttaatttgggaaatgccaatgcatttgtgtgtaagagctcctatgcaatttaagtttcattttttttgttcttggcaaatgaatttcgaatcctttctctttactgtacttactgtgtttcctctactttccactcttcgaaattttctctcctttgcagaatattttctgttgaggaatagggtgtaaaaaaatcttgattttgtgtgtgcgaggtccaagatttcaggttagaggtgaagtttaacaattcttttatcttacctaccattcttagcttttttttcctttttcttcttatttgctttaagaatcaatatggagcgcagttcatttcacatctcccagttctttggtgtgagaccaaaatgtctgaaactctgggtttttaggttgggagaacaggggcatgttctttgcagtttgcagtcactttctcattttaggggaaataagataaacaattttgtggagttacgtacctggaaatcaaggttagaagttgaaagagttccaatcatgaactacaaacgtgaactgattgtacaaaagtttaaaatgtgcattaggtttggtgtttgtgtgtgtctttgtctttttacacttttaaacatacttggagatcaagattttcgtttaaaagctttacgaccagttcattcagttgtggactagctcctttgtcaggagaagttcagggagacttcttccatcatcccttcattcttttcttacagttagtttaatggtgttatcctgatgggtaaggaccttttctttgctgggataatgaagatgaagaatggctggccatctgacagtccacaagatgttcccctttactacggagcatctctttaactccctgagagcaggctcagcgtcatccctccatctgccagtg

SEQ ID NO: 103864 - DNA, 1014 bp, Homo sapiens
actttcccagaagcgcttaagaggataaataataattgaggtgttaagcctcttctgagcaatttggatataatttgtttttagatctagattcttttttataaatgtcccaaagcaattagaagtgattgttttttttgagacggagtctcgctctgtcgcccaggctggagtgcagtggcgcgatctcgggtcactgcaagctccgcctcccgggttcaagccattctcctgcctcagcctcccgagtagctgggactacaggcgcccgccaccacacccggctaattttttgtatttttagtagagacggggtttcaccgtgttagcaaggatggtctccatacactgacctcgtgatccgcccacctcagcctcccaaagtgctgggattacaggcgtgagccatagcacctggccctagaagtaattttgttgagagagagagagtaaaactaaaagtactgaaaagagtaagagagtagctaagagaatgagtattggagtcagactgctagagttcatagcccaggcttgtatttattaactgtgaactttgggccaaatacttaacctggctcaacctcctcacatttattcctaaccacagccctgtaaggtgggtgcgcaccttataggaatccaccttacttacccaccttacaggattgtggttaggaataaatgagaattctctttatcagatgcttaggactatgcttgcttctgtgtagtatgtgttcattgttaactgtttttaactttactgctaaatatatcagaaggaaagcagtggtagatggtttgggggttgtttttgtttttttgatttgcaacgaagtcttgctctgttgcccaagctggagtacagtggcgtgatctcggcctatgacaacctccgtctcccggcttcaagcgattctcctgctcagcctccggagtagctaggactacagctgcgcagcaccatgcccggctaatttttgtatttttagtagagacagggagtcctga

SEQ ID NO: 103865 - DNA, 1044 bp, Homo sapiens
tttttatgacccactgttggcttttgagccataatttgaagaatactggcgtagaagagttgacaagatggcagttattctgtattaggccaacattttctgtatgccaggaacttatcctctgtacattgttccttctttccttcctggagtttatagataagggaagaagactggcattcacggagtctggtgtgatcagcattgtatttgggaagtacgtatatagtgggaggaacaggagaacctaacccagtagttatcctggtggctgtctttgaggaattgtgtctgattttgggatctcacagatagagataggattagtaaaaatgagcccaggctagaaaggagactgtgtgaggccaggtatatcctgttctgggaacctgtgagtgctgtctgactggtagaatagccaaaaacttgactgtagaggtgagcaagggggccaatcatggagggcttataatacaggaatttagactttccattttacccatttaatggatggggcagaattgtgctttaggcagttaagtaaaaggaggaatagtttgggaagaacagggaaaaacaggaggcagggagaccagtgaaacagctgttttagggttccagccacccttaccacagaagatggaaagaagtggaaagatttgagggaagatggatgatcagcagaacttggtgactgattagaagttaggtagtaagatggacaaatcaaggataattccccagtttaaagtttgagcaacttgttgggtgatgatttatttattatttatttatttattttgagacaatctctgacccaggttggagtgcagtggtgtgatctcagctcactgcaacctccgccttccgggttcaagcgattctcatgcctcagcctcccaagtagctgggactaaaggtatccaccaccacgcctggctaatttttgtatttttagtagagatggggtttcaccatgttgatcaggctggtctcgaactctggcctcaagtgatctgctcgccttggcctcccaaaagtgct

SEQ ID NO: 103866 - DNA, 1005 bp, Homo sapiens
acccacaacaaagaattatcacatagctcaaaatgttaatagtgccagggttgagaaaccctgcattaatctatacttagcacccagttttgtttgttcttttttgagacaggatcttgctctgtcacccaggctggagtgcagttgtgcagttaaagctcactacaacctcaaattcctggactcaagtaatcctcccaccttagcctcctgagtggctaggagtatagcctagtgccaccacacccagccgactttattgtttgtagagacagggtcttgctgtgttgacctgggctgaagaattcctcctgccttggccttctaaagtactgagattacaggtgtgagctaccagggctggtcttgcaccctgtttttggtaggggtggtttgtatggtgaaggagccagaggcatggtgttgtaccctattctggctagactttggttaaggaaagctattctgtaggctacaggtcaaaaactccgcctgttaaaggcctactttgaggcaggtactatataggaacttggtaaaaaatggtggatagccctctgcttaactggagcacacactgagtgttccacaaatgacaggtcttttgtatcagttgtgtgtctttatgtattacaatatttaaaatgttttctttccatcctgagtttagtttgtgtgtagatattttaactgttcttctaaggaacttgggaatattaatacagcttaattgcatttcttttttccatgactgtggatacaaacctttagctagcaactcatgtaataatgggtgttgcactttttttttaacaaaaaataaaattttatttcaactattatgctaattctataacattatttagaatgtttttctttttttaattatcctttaagttttgggatacatgtgcagaacgtgcaggtttgttacataggtatacatgtgccatggtggtttgccgcacccatcaatccgtcatctacattaggtatttgtcctaa

SEQ ID NO: 103867 - DNA, 1262 bp, Homo sapiens
caacatggcaagctccgcctctactaaaaatacaaaatttagctcggtgtggtggtgcgcacttgtagtcacagctacttgggaggctgagatggtagaatcacttgaacctgtggatagaggttacagtaagccaagatcgcgcaccactgcactccagcctgtgcaacagagtaagaccctgtctcaaataaatagaaaaacatggagtgaggttgggaaatgacatttaatgcttattgagaacaatatagagcagttttttattttggttttgtcatactttgacctttgtcttttccctttgcttttagattttggctctctatttgacttggagcacgacttaccagatgaattaatcaactctacagaattgggactaaccaatggtggtgatattaatcagcttcagacaagtcttggcatggtacaagatgcagcttctaaacataaacagctgtcagaattgctgcgatctggtagttcccctaacctcaatatgggagttggtggcccaggtcaagtcatggccagccaggcccaacagagcagtcctggattaggtttgataaatagcatggtcaaaagcccaatgacacaggcaggcttgacttctcccaacatggggatgggcactagtggaccaaatcagggtcctacgcagtcaacaggtatgatgaacagtccagtaaatcagcctgccatgggaatgaacacagggatgaatgcgggcatgaatcctggaatgttggctgcaggcaatggacaagggataatgcctaatcaagtcatgaacggttcaattggagcaggccgagggcgacagaatatgcagtacccaaacccaggcatgggaagtgctggcaacttactgactgagcctcttcagcagggctctccccagatgggaggacaaacaggattgagaggcccccagcctcttaaggtaagtacagttttggtttgtgtgcacaatcggcatgcatgtgagtattgtcatgatggatggagggtttgccttacattgtatagcagtttccactattacacgccaggaatttactgtgctgtcataagttttaagaagtgcctgtatttaagtaaaacgtttattttacagctggtattctataacttcatacttccaaatgattgctggctaatgctggttctctctggcacaagtattggaatgtttttatctcatttccaagtccagtttagccttgtagcctccttataaaattacagttttgaga

SEQ ID NO: 103868 - DNA, 1461 bp, Homo sapiens
gggttttcaccatgttccccaggctgttgtcaaactcctgacctcaagaaaccctcctgccttggcctcgcaaagtggtgggattacaggtatgagtcgccaggcccggccacttggttttttgccatcatggctccctacaacctctacctcccaggcttcactgataatcccactttagccttccaattagctgggactataggcttgcgccaccatgtccagatttttgtattttttagtagagatggggttttgtcacgttgcccaagctgtagtgtcttttctaatagaagctgagaatttcctttgaaactgtctttgtgaacttggaagtgaaatcagaaaaggaataataatgtcttaaattttattgcttattttgttttcttttgtttcttactcttagatgggaatgatgaacaaccccaatccttatggttcaccatatactcagaatcctggacagcagattggagccagtggccttggtctccagattcagacaaaaactgtactatcaaataacttatctccatttgctatggacaaaaaggcagttcctggtggaggaatgcccaacatggtgagtactaatccattacagacttgttttcaaactggcattttgacaaaagaattgtgttaaactttcacccttctgttatatatgctgggatttgtacccactaggagcctaaattgatatgtacttgatgatccctgtgaggaggcttgtgcttcctttccatttctctgttttttttgttccatgtggttattgatcagtgagcatgttgatccaaacaggagtaagtgaactgctacaatgaagttttaggggcctgccattcagcaacttggtcttgtgagcgtttccatacgatacgaaagcggaacctttcacttttgggggaaggaatctctggcaaaggatccgaactctcagtgaccatatttaccaatattatttgattctactacacccaagtaaattccctctcaaaagtaatgtattgttttaaacagcaatttttgttaaataaaattttcaggaacttctagtgttatttttgtacagtcaaactactagtagtaaatgtgtctgcattcaactttggaaaaacattgtctgaaaaaatcctctttcagatgttttagttttgtcctttgtgtcattatgtttatggactgcctatatttgagatactctgccaagtactggagttatacagatgaatgaaacatgtcatctctgtcccgagaaatgttcacttttttttttttttttttttttttttttttttgagacggagtttagctcttgttgcccaggctggagtgcagtggtacgatctcggctcactgcaacttctccctcctggtttcaagcaactctcctgcctcagccttctgagtagctgggattacaggcatgtgccatcatgcccggctaacttt

SEQ ID NO: 103869 - DNA, 1048 bp, Homo sapiens
tgctgccgggtgttggcagttgaatggctccaaagcattcatacagtgttggtcggaacattaataaagccctttgggaaggctattgggcattcagaatcaaaagccttttataccagtggtcccctttaccaatcagttctgcatctagaaatttcttccaggaaataatggaagacaagatccacatactcagatgtttcataatcacgtaacaataattttgtggggttttttattagacatgttagtcttttttttctcaccagcattaatttgtaatactatatcttttgtcttctctagcaattttgactggagcacccgttggacttggaaatcctagctctctaggggtgggtcaacagtctgcccccaacctaagcactgttagtcagattgatcccagctccatagaaagagcctatgcagctcttggactaccctatcaagtaaatcagatgccgacacaaccccaggtgcaagcaaagaaccagcagaatcagcagcctgggcagtctccccaaggcatgcggcccatgagcaacatgagtaagtttgtgtcatcctaataacatggtattggttgtgtcagtaaatgacatctataaacacagtgttgttagctcctttttattttttctgctacatgattttttaagtaattttttaaagattacagtgtaaaaggtcccttacagttcatctacgagaggtaactgccactggtttgtatcttccttgatccttttttgcattatatgagttcagatttgcagaaatgagatcccatatgttattccacaacaaactttgattaatactgtgtagacgggccgggcatggtggctaacacctgtaatcccagcacattgggaggccaaggtgggtggatcacaaggtcaggagtttgagaccagcctgaccaacatagtgaaaccccgtctctactaaaaatacaaaaattagtagggtgtggtggtgcgtgcctgtaatcctagctacacgagaggctgagacaggagaatggcttgaacctgggaggcag

SEQ ID NO: 103870 - DNA, 1940 bp, Homo sapiens
ttttataagcctttgtcagaacagttcaagtttttgatgttttaacattttagagtggttactgaattttatttcagtaagctaaataataaatttagaagagcagatggaactctgaaggctacttgatactatgacaaggcctgttttcctcactgtctttagtatgtaacccaaagtaatattttgctttatgtctagagtaacagggaccaaagagtattttttatagagtcatttcttatattgtgaacggaaatatagacaaaaattcttttgtttatcacaaaaagataatttcatttcagtaagtaatatatatcaccttgccattattttttcttttcctctatgtgttcagtgtataaaaatcagaaaaatactaattaaatgctgacatgatattacagtggtaggattttctttttccagcgtccaagccatatttcctacgccggatcctgctgctttaaaagacagacggatggaaaacctagttgcatatgctcggaaagttgaaggggacatgtatgaatctgcaaacaatcgagtgagtgtctggtttttttctattaatagccaagattgaacctgttgtggttattttattcctctttagcatgtacaagtagtacatatgcttcagacgggggacacgctgtagctatcccgtcttattgtccccaagcatagttaggataccaaagcagtttcttaagtgtatgtcatcaagaatcttatgtttttcctcctaatacagtgcactcatgtggcactttatctggttgtcctgtcaacctaaaaagtggctgagctggccgagtgcagtggctcggtgcctgtaatcccagcagtttgaaagtctgaggtgggcggatcacttgagcctaggagttggagaccagcccgggcaacatagcaaaaccccatctctacaaaaaattagccaggcatggtggcacgtgcctgttgtcccagctgctcaaaaggctgaggtgggggaatcaccagagccttggaagtcaagctgcagtgattcgggattgcgctgctggtgacagagggagaccttgtctctctcaaaaacaggagtggggtggtgctgagctgttaccagctgtgttctcttttcactagaatataatgaagtagcgacttaactgttgttcacggtagttcagattctctacataagttgaactttcctttctaaattggcaccagttcttaatgcagcatataaaatgaaactaatatctattctcagtttattttttctgttacctggtggtagttccttttttcctcatctcccttattttacttcaacaattcaaaaggcggaatactaccaccttctagctgagaaaatctataagatccagaaagaactagaagaaaaacgaaggaccagactacagaagcagaacatgctaccaaatgctgcaggcatggttccagtttccatgaatccagggcctaacatgggacagccgcaaccaggaatgacttctagtaagtggtttttgttatatttctgtttgagagaaattgataataaaatagtttctatctaaagtcattaatttctgtaagcttgtgtaactattctagagttttttaaataaccatttgcctttgcaaagaaaataactcatctactagtaaaaacagaagcagaacaagtatatttaagatgtctgggcatggtacttaacataccttgataatctggaattgtttttagagcccaaggtgtaaacttctctaatagtgacatctagaaagcaatagcctacatacagatgttcacagatttctctgagactggcttgtgtggtaagtagccagtaaatgtttgtaggctgaccaggttcaggagccctgtaacacacataatatcatattacactgtcacactttctacttgacataaaata

SEQ ID NO: 103871 - DNA, 1026 bp, Homo sapiens
attctgattgtatcgttggcagactctgcgtgtgtctcacctacttcccttttttttctgcccagctttcccagccagctgtaagcattgaaggacaggtatcaaatcctccatctactagtagcacagaagtgaattctcaggccattgctgagaagcagccttcccaggaagtgaagatggaggccaaaatggaagtggatcaaccagaaccagcagatactcagccggaggatatttcagaggtgagagtagggcaattactgtttgatttggttaggacctcagtataggaacccaagttttaaaaaatattgcagaaaaatattttgataattagatctcatggcatagattttgcatgagaaagggtgttcagattactgattcccaactagatatctttggaatactaaaaattcttacgttttcttttagtctaaagtggaagactgtaaaatggaatctaccgaaacagaagagagaagcactgagttaaaaactgaaataaaagaggaggaagaccagccaagtacttcagctacccagtcatctccggctccaggacagtcaaagaaaaagagtgagtctctgaagccattcgttctggaggtagctgaagaaaccaaagacccagggcagaattgcggtcatgcctcttgggcctcagaagttgccattattgtgatttcattaacctggaagccctgggcctggtctcttcattgttactaataatttttctttcttttttttttttttaatattcacttgcagcaaccaatgagttaagtcattcccctcatttcttcagggttccctgtgttagtacaccctaaaaattgtctcatttttcaggagagagaaatgtttgtaaatagccttgactaaaatgcaggaaagaatagcaatagtaatagcatttgtcattcacctgctgtgtgctaagtatccacattgtctcatttaataatttctttctttctttttcttttcttttttgtttggaatcggattctcactttt

SEQ ID NO: 103872 - DNA, 1030 bp, Homo sapiens
gacgaggtttcaccatgttggccaggctgaaacttctgacctcaaagtgatctgcccacctcagcctccaccgtgcctggtcccatggactcttatttggcaaagtctcttcataaatttttagaagcctttggattctgcttctaattgaccgagtctgtcttcactgactttgtgactgaaaagttaagctgagggtgaagagtgttttaaggtgataagacacaatgttttttaggagctgtctgaaacaaagcggggcttagaatctagaatcagtgattgagcctgtagtgatatttccatggggacagagtggttaattttgttattgattcttgagatgcttttagagcttcaggctgaatgattttttaaagttcttctgcttaattggtaactaatttcaaatgcactttttttttttaagttttcaaaccagaagaactacgacaggcactgatgccaactttggaggcactttaccgtcaggatccagaatcccttccctttcgtcaacctgtggaccctcagcttttaggaatccctgtaagtatttggtggtacttttgattttattttttaatttgataacagctttattgagagataattcacattccaaacagtatagccactcatttcaaatttgtaattcagtgattttttttttttccccctgagacagggtcttattctggttgcctaggctggagtgcagtggcacgatcgtggctcactactgtctccacctcccgggctcaggtgattctcccacctcagcatcctgagtagctgggataactacattcatgtgccacctcacctggctagttttttgtattttttagtagagacggggtttcgccatgttgcccaggctggtcttgaacgcctggactcaagcaataggcccatctcagcctcccagagtgctggaattacaggtgtgagccactgggcctggcctaattcagggagttttagtatattcacagagttgtgcatgacactttcattttcatcatct

SEQ ID NO: 103873 - DNA, 1219 bp, Homo sapiens
aacatggtgaaaccccatctctactaaaaatataaaaagtaactgggcgtggtggtgcacgcctgtaatcctggctacttgggaggctgaggcaggtgaatagtttgaacgaccctgggaggcagaggttgcactgagccaagattgcaccactgcactccagcctgggcaacatgttgacagagactccatctcaaaggtcaagtgcttccaggggcaaaagccttttaggacttttcctctcttgtatcttgctgtgatttcagatggaacattttaagttctgtgggcttagtttcctcattgtacaccccttctagtactaaaattttaaatgtctttgactttactgatctcacatgtactttcataaagaacctgaagttgcttcagtagaatatcagcctgatgtctagaaagtccatagtagttctgtttctctgccctttgagtagtttaatatctctgtaaactaatatttaaagaagtgatggacatcagtcacctcttggggaatatagacaggccagaaactaaaacactgcctggaaaattaacaatgataatggatgatactccatctcccgtaaaaatagtgagacttgagtaatgtttgatgtcacttgtctttctaggattactttgatattgtgaagagccccatggatctttctaccattaagaggaagttagacactggacagtatcaggagccctggcagtatgtcgatgatatttggcttatgttcaataatgcctggttatataaccggaaaacatcacgggtatacaaatactgctccaagctctctgaggtctttgaacaagaaattgacccagtgatgcaaagccttggatactgttgtggcagaaaggtaagaaatgtgtttcagatttgactttaacttttctgggatacctagaataatatagtggtgactgggataagagaatatcctgcttctggctttgacatggcttttttttttttttttttttttcctttttgacagggtcttattctcccaggctggagtgcagtggtgaggtcatagctcactgcagcttcaacctcctgggctcaagcaattctcccacctcagcctcctgagcagctgggactacagccgtacgccaccatgcctggctgattttttaaatttgttttgtagaaacagggtctcatgatgttgctcaggctagtcttgaactcctgggc

SEQ ID NO: 103874 - DNA, 1048 bp, Homo sapiens
tacagtcatgagccacctctcccagccaacacagtctttctcttactgtgtgccacagtagtaatatctcttaatatgaaatgggctttctttaaaggcattttttcagagtggcaattgtatggaaaagttgactaattaaataatcaacagactgttaactcatctggagtaggggcattcttatattcacctgtgggtgcagattcctcagcatgtgctggctttcctgtacataccaattcacattattggttttttgtttttaaaataagactatggtcttgctgtgttgcctaagctggtctggaactcttgggctcacgcagtcttcccacctcagcttctgagcactgcaggcatgtgccaccctgcccagctattcctgttaggttctttggtaaagtgatggaaggatatgactgctaagcctacctcagcgttttgaaataatgtggtagtaaactgagaatgattttcaggaactgaattagcccatcattattaacataaatgagaactaagacaccactgacttctgtttctgacttgccattcttactgttctagcttgtccttaaggcctctgtgctttttaacaaatggtttcttttgcagttggagttctctccacagacactgtgttgctacggcaaacagttgtgcacaatacctcgtgatgccacttattacagttaccagaacaggtaagcttggccaggtgtggaccatggtccatgtgtccacatgtccagggagtgcatgcggatgggccagcacacatacagtcatggttcatgtgtatcttgcttgaagacagctgtatagcacaagttctgttttttgccttctgcctttgtttgcagaacaataaaattttctatcagagtagccttgcatcagttacctgggttcctcccaagagcttgagaagttaagcaactttgtgagttgttggcctagatgggtctatatcccaggccccacttctctttctactgtgtgtttgttgatcaccacagcctgaggcaaaactgagaagattttt

SEQ ID NO: 103875 - DNA, 1050 bp, Homo sapiens
gctggtctcgatctcctgacctcagatgatccaccctctcagccttccaaagtgctaggattataggtatgagccaccacgcctggcaatggttgttttagattattgttttctgcagttgtatctatagtgggcttttggggtggggggtgggggtctgtggttttttgttttgtaagtgggaagaggtgtgattcctgtatttaggtaatgagtagcagttcttctctccctggtatatttatccttcttcctccttttgattatttacatcacatagcgttaattgctgaaatgaaaggatatgggtctgtgtaattgaaacatttgcttttatttgcagtaatcatttgctacttgtgatcccatttgagatatttaatgctaatctgtgctttgccttggctttctgctttgtgttgttctgtcttgcttttatgttttttgttgtcttgcaatccctcatttcttcgtttgttttgtgtttttttttctccctcatgcttgtcgttgtctgcacttggctttgattgcaaaaaaaaaaacaaaaaaaaacaaaaaaacaaacaaaaaaaccaaaacccaaactgtggggcccatatatctgcatcattgaatgtccttgtcgccgttgatgacctgctctctgctcccgtccccctccttggcctgctgtgattggtggcttcgttgcttggcttgggctgtgttgtgtgaacggaacagttcaccccagtatggccttcttgccgacaggtatcatttctgtgagaagtgtttcaatgagatccaaggggagagcgtttctttgggggatgacccttcccagcctcaaacgtaagtaactgcattattttgaaaagtgctaattagtttgttgtccagtgattatgcacagcttatttctaaatgaacttaagctatgctgttgaatatggtagccattagccacatgttgctatttaaatgcatattaatttaaataaaaattgtttatcacatggaatactcacatttcaactgttcagtagctatctgtgtctggtggct

SEQ ID NO: 103876 - DNA, 1089 bp, Homo sapiens
gaatgaatctctaggccataactagtataagaaacggttttcaatgtggacatgtcctcatttttgtaaggaagtataacagaagtccaagttggtccccctaatgttgattctagttggagaatgtggatcctagttggagaatggtaagactgttagcttttgtatgtagtgaggctatgagcagtgtgttatgctgggtttcaggatgggaagccatgatacctaacaccaagaatagtaacagacaagattttaaaaggaaaagaagaaacagtatttctagttcttcctgggttctccatttctgataagaggaaatttatttactatgaagtcctatagaatattcctttacataaacatgcattttgtgtgagccaagaatacacctatttaaatgtgtattcttaaaaaacctgaatctctatatagggtgaagtttgttcctttggttagaacagcagtcagattgctcatctctatcactttttctcattgtgtcccttttctctccttagtacaataaataaagaacaattttccaagagaaaaaatgacacactggatcctgaactgtaagtacgatccccttgaatagtcagtacgctttggcttttctttttccctttcattctcttgaagtttgcatgaccaatcagatgatcctatattcttgggctaaatctacataacatacatctaatggatagtaaaaccatggaaaacactgaagtactaaggaacattatttcttaatgttaattttaatgttcttaatgttgaatgtgaaacattaaagatctaaacttctagtttgcagtgaggccttttagatcatggaggactgacatgtatgtcttctagatgttcctaaaatggatgggatggtatttggatttatttggaattttcagcaccaggaatctgtcttaaaaattagccaggttttggccgggcacggtggctcacgcctgtaatcccagcactttgggaggccgaggcgggcagatcacgaggtcaggagatcgagaccatcccggctaaaacggtgaaaccccgtctctactaaaaatacaaaaaattagc

SEQ ID NO: 103877 - DNA, 1038 bp, Homo sapiens
ttctggagatacttcttacctttagagtatgtatgtcattggaaacattcactccctcatcttgaagtctgtttctctgaacagtgtgccttttaatttagctcttgttaaatgggtccattttcctttgcagtgtaatcttcatttggtcttaacatgcagacttagggtttttggatccagggctaagtcacccacttcgtggctgagattcgcaacatcccaccatggcctccaaaaataagtaggcaatatgagatccattgttactactgtgagttatgcctaattttggcctcacaatgttaatctcattctgggttatatatacactgtgttatcttgggaaaaattattggtatctatatcaactccaacttgtggtttaaaatgtagccttctagaatagattatctcttttccttaatgttctttctctttgtattgttagttacacaacagggcatatttgggcatgtccaccaagtgagggagatgattatatcttccattgccatcctcctgaccagaagatacccaagcccaagcgactgcaggaatggtacaaaaaaatgcttgacaaggctgtatcagagcgtattgtccatgactacaaggtcagttgggacataggggccaggtgctgacaatagatctggaaatgcactaatgttgctgctctttgttctgtcatttaacttttttttttttttttttttttttttgagacggagtctcgctctgtcacgcaggctggagtgcagtgacacgattttggctcacttcaagctccgcctcctgggttcatgccattctcctgcctcagcctcctgagtagctgggactacaggctcctgccatcacacccggctaaatttttttgtatttttagtagagacggggtttcaccgtgttagccaggatggtctcgatctcctgaccttgtgatccgcccgccttggcctcccaaagtgctgggattacaggcatgagccaccgtgcccagccttttttttttttttttaaacaaaagtcttg

SEQ ID NO: 103878 - DNA, 1020 bp, Homo sapiens
taaataaagaagttttcctaagcagcccagcaaatcattctgcagcagatactatttccagtatttgtagttttggtcattttgaacaaagctgtcagtaaaagctgctgaaattccaaggatgggtgtgaggagggcatgcttcataccacatattctgtgataaggagtggtaggggccatggcatgcatgatggtgctaccaccctgacgttgatcctggcaggataattgccacttggttatataaaggcagataagctccctgtttttgtgggtagaagaaatagaaaaccggaaatattgactttaggccaggccttttcactatttatttttctaaatactccctggcttacggcttaggtataaagtctctgccagctttcaagacattttaagctttcatgtttcttgtcagccatgattattctgtataatcaatgctttaaaagaacatagaaattcctatatgtacatgcatgttttcacaggatatttttaaacaagctactgaagatagattaacaagtgcaaaggaattgccttatttcgagggtgatttctggcccaatgttctggaagaaagcattaaggaactggaacaggaggaagaagagagaaaacgagaggaaaacaccagcaatgaaagcacagatgtaagggcattgagtttcctttgaaacttctatcatgattctaatatttaatccagaagtgcacttaaactttcaattgggttttaaagctttcaggtgtaaaagagctctttaagttggacaagaaatattggcttagagaggttattagggttctgtttcagtggtattaaacttttaaagcatcagagccccttttaaaatggcatctcagactttgagtaatgtgaaatgataaaagaaactgaaggaaatcctgaaaaactgatagaagattacttatctgaaggactaggttatgaatattataggccttgtgggtcacatatctctggcatattttctgtcttttaaaaacaca

SEQ ID NO: 103879 - DNA, 2187 bp, Homo sapiens
gttccagcaaccccaaggagttggctacccaccacagcagcagcagcggatgcagcatcacatgcaacagatgcaacaaggaaatatgggacagataggccagcttccccaggccttgggagcagaggcaggtgccagtctacaggcctatcagcagcgactccttcagcaacagatggggtcccctgttcagcccaaccccatgagcccccagcagcatatgctcccaaatcaggcccagtccccacacctacaaggccagcagatccctaattctctctccaatcaagtgcgctctccccagcctgtcccttctccacggccacagtcccagcccccccactccagtccttccccaaggatgcagcctcagccttctccacaccacgtttccccacagacaagttccccacatcctggactggtagctgcccaggccaaccccatggaacaagggcattttgccagcccggaccagaattcaatgctttctcagcttgctagcaatccaggcatggcaaacctccatggtgcaagcgccacggacctgggactcagcaccgataactcagacttgaattcaaacctctcacagagtacactagacatacactagagacaccttgtagtattttgggagcaaaaaaattattttctcttaacaagactttttgtactgaaaacaatttttttgaatctttcgtagcctaaaagacaattttccttggaacacataagaactgtgcagtagccgtttgtggtttaaagcaaacatgcaagatgaacctgagggatgatagaatacaaagaatatatttttgttatggctggttaccaccagcctttcttcccctttgtgtgtgtggttcaagtgtgcactgggaggaggctgaggcctgtgaagccaaacaatatgctcctgccttgcacctccaataggttttattattttttttaaattaatgaacatatgtaatattaatagttattatttactggtgcagatggttgacatttttccctattttcctcactttatggaagagttaaaacatttctaaaccagaggacaaaaggggttaatgttactttaaaattacattctatatatatataaatatatataaatatatattaaaataccagttttttttctctgggtgcaaagatgttcattcttttaaaaaatgtttaaaaaaaaaaaaaaactgcctttcttcccctcaagtcaacttttgtgctccagaaaattttctattctgtaagtctgagcgtaaaacttcaagtattaaaataatttgtacatgtagagagaaaaatgactttttcaaaaatatacaggggcagctgccaaattgatgtattatatattgtggtttctgtttcttgaaagaatttttttcgttatttttacatctaacaaagtaaaaaaattaaaaagagggtaagaaacgattccggtgggatgattttaacatgcaaaatgtccctgggggtttcttctttgcttgctttcttcctccttaccctaccccccactcacacacacacacacacacacacacacacacacacacacacactttctataaaacttgaaaatagcaaaaaccctcaactgttgtaaatcatgcaattaaagttgattacttataaatatgaactttggatcactgtatagactgttaaatttgatttcttattacctattgttaaataaactgtgtgagacagacaccctgactttgtttcacttgataacacatctttgtcttggagtacacccgttttaagtgcctaatgcttaggattcagaggaaaaagtgaaagcattagcttatagcctctttaatctactacgtataatgtattcacaagtagatcttggtgaatttatccaaagttctgggaaaaagtactgcaggtaccagctaacagtcaaggtggaagtgataacctacttaacaccttgatacaggaccccttaaggatgacctcatggtcttccaatcaccttcatcttacagggatgagaaggaggacctaagaagacggatcatatctgcctaagtcccaagtaacttcttggaaaaaacaagacttgccaggcatggtggctcacgcctataatcccaacattttgggaggccaaggcaggcagatcacgaggtcaggagttcaagacca

SEQ ID NO: 103880 - DNA, 1045 bp, Homo sapiens
atcatttgtaaatccacagaggagcctggtgaattcctaacacatattttctgtcttgttaagctgttgaattgcatcatggtggagaaatgtgtaaatagaagtaatgatcttggtgtttgtaaaaggggtatttgaaaggttcccgaaagtgtgagggggctgatagcagatctgcagcttctccccccgtgcactaaagccaatcataattctttctacctggtttgtgtcatcctccattaggagaccccatcttcagaaccaatggaggaagaggaagatgacgacttggagctgtttggtggctatgatagtttccggagttataacagcagtgtgggcagtgagagcagctcctatctggaggagtcaagtgaagcagaaaatgaggatcgggaagcaggggaactgccgacctccccgctgcatttgctcagccctgggactcctcgctccttggatggcagtggttctgagccaggtgccttcagagtgtcccctgaggatggagaggagatagaagattatagaggaagaggggggtggatataggctatatgggcagagccatccagatgtaaaaggctattaactctgatttctaagggatcagatgtgtaaggacctgtaagggagacagaagcaccccaagtagccactgtgttaacttcctttgctgaagtctaatttctttttttttttttttttttttttgagacttgagtgtcgccctgttgctcaggatggagtacagtggcatgatctcggctcactgcaacttccacctcctgagttcaagtgattctcatgcctcagccttccaagtagctgggactacaggcacccaccaccacatccagctaacttttgtatttttttgtttgtttgtttgtttgagacggagtctcgctctgttgcctaggctggagtgcagtggcgcgatctcggctcactgcaagctctgcctcccgggttcacaccattctcctgcctcagcctcctgagtagctgggactacaggcgcccgccatgacgcccggct

SEQ ID NO: 103881 - DNA, 1014 bp, Homo sapiens
ttcaacactcacctgttcccccagtcgtcctcatggatttccattagcccctctgttgacatctgtagccaagggaggccaagcagcagcacttcattcaggtagattcaggatatacacaccagtacctcccattcctcctcttattccattagcctttgtgggggcaggggctcacctggttaatgcagtgccccaggttttgaagggcccatcactttgtttgctttgaggtggtcatatcgggtgagtcatgtgctaagttctcttcccagctgtctgtgagatgtgtggtatcgtgggtacaagggaagccttcttctccaagaccaagaggttctgcagcgtctcctgctccaggagctactcctccaactccaagaaagccagtatcttggctaggttacaggtgagaggcaatcacttggatccttcccggtgcctttggtgctgagacaggaaccaccaagtgactgaaggccagggccaggaaagtttgaaaaggtccttgcttgtggccagctggtatttattatgttctcaaacttcagaggacagtagaatccatttgtggagctttttaaattataggttcctgaagctacgctccattacctaccatcatcccccagagtctggtgtattcagtacattttaaacaagaactatgggggagtctgacacccttggtcttcaccccacacttttataaatcctttcaaaggaagttgggaaacaggcccaaggttcaccagccacggtggcttcaggaagaccatgcctcctcggactccatgtcacaggcagctacctagaaagtcttgccaattttctaaattactgatatttatagaatctttagagatggaaagattcttggatgtggtgttgaacccacacatttattgataagtatactgaggtccaaggaggtagaatgacatacctagtgtggctctgtaggaggagaatggcggaattgaggctggaacctcatctcaggggcctcatctt

SEQ ID NO: 103882 - DNA, 1150 bp, Homo sapiens
attggcaggaaagtgaggattaggtactgggaaggcaactgaaacagtccagtgctgtcctggggcactttattttattttatttattttttcgatatgggagtttcactcttgttgcccagagctggagtgcaatggcactatctcagctcacagcagcctccccctcccaggttcaagcgattctcctgcctcagcctccggagtagctgggattacaggcatgtgccaccaccacgcccggctaattttgtatttttagtagagacatggattctccatgttggtcaggctggtctcgaactcccagcctcaggtgatccgcccgtctcggcctcccaaagtgctgggattacaggcgtgagccaccatgcctggccccctggagcatttcagtaggaggggaggtagagagtaaacttgcaggtggatggctgtgtgtaaacaagggggtcataatgcccacagcccaggtttgtatgatgattgaaggaaagtatatttgtgctaatatcagcgccctgccattgctcgggctggcacagggacgaagggatcgaggctcaccaaggcatcatgtgcccaaaatgatacagtaagaaaccagtcctataaagattttaggactcggttctgtctgactctgggtctctagccatcaccctgcatcccaccacctccacctctactcccggcttagctcttcaaggacaggagacctcatctctttatctctagtagctggttctgcacacagtgggtgatgtgaaaagttgaggtgcaaacgaggacttgactgaggccgtgaggcagtctgtctcccctgctagcacagttagctcactctctcggtacactctcatcgccacacaggtcccactctatgaccagtgggaggatgtgatgaaagggatgaaggtggaggtgctcaacagtgatgctgtgctccccagccgggtgtactggatcgcctctgtcatccagacagcaggtgagtgtttggccagggcagggccagggatgtgtctgcagagtgacatctctagatgggtgaacagtgttgtaggcaggagttggcttcataaaacaaaaatcccacccactggaatttttgccccacttctaaggattcttttaccggagaagggaa

SEQ ID NO: 103883 - DNA, 1126 bp, Homo sapiens
cttccccaagctaggcccggtggctcacgcctgtaatcccagcactttgggaggccgaggagggcagatcacgaggtcgggagatcgagaccatcctggctaacacggtgaaaccccgtctctatttaaaatacaaaaaaaaatcagccgggcgtggtggcaggcgcctgtagttccagctactctggaggtggagcttgcagtgagctgagatggcgccactgcactccagcctgggcgacagagcaagacttcgtctcagaaaaaaaaaaaaaaaacagaacataccttccccagctcaccctccctcacaggtgccctttcctttcctttcagggtatcgggtgctgcttcggtatgaaggctttgaaaatgacgccagccatgacttctggtgcaacctgggaacagtggatgtccaccccattggctggtgtgccatcaacagcaagatcctagtgcccccacggagtgagttgatgagaacatttcctctcttgttcccgtagggcccctggtagagggagagtcctctgcttgtgttaggtagaatgggagtcctctgtcttgttagaacagaatccacttgccccctggcttcctgccctccccatcccagaggcctgggggcagatccacgtgtggaatctgatgttctcagatgaagtcattgctggcctgaagaggcagctattttcagtccccactgctgaggggtccccactctgggtcggcgctagcgcccctgtcagtggaggtttgtcagtctgtgtaaccaggattctgctggtgcctccacagccatccatgccaagttcaccgactggaagggctacctcatgaaacggctggtgggctccaggacgcttcccgtggatttccacatcaaggtcggcagtgagcccttaactgatgtgcctccttccgctcttccatttttctgcatcctgcatgccactcactggagcatgttacctaagaccccttgcctgatgatcttcagcagctccacattttgcaaggctagagacaaatgctgctgctacgtggttgccatctgcctttctagcctggcgtcggccactgccccacccagactctgctcctactgctccagtcatgctgc

SEQ ID NO: 103884 - DNA, 1707 bp, Homo sapiens
gtcagagtaggcccctccctgtcacctcactggggccttcttgctgtgtgccatctcctttgagcgctggcctaggcaagagccacagctggggtcaccttgctccaaacctcatcgcctcctcctgagcagcacccccacccctccttggccctcctggaggaggctgctgactcgtcctcgccgcggatccgctccatgccgggcgcgtgtgctcacccaagaacacggtccaacaggatggacgcggcccctgctggcgtggtgtttgctgtctagtggggaagagaaagaatcccacgcgtatgcatcacagaagtactgtgtgccccagagaggctcaggtgtcctccaggagggccatgccctagatccgtttggatccatttgcctcgtgtccctattggggtgcggtaccaacccaggatggggtgcagttcatgatatgatctgtctgcctgctccccccaccccccaggttctcctggatggatacctgatgatctgtgtggacggggggccctccacagatggcttggactggttctgctaccatgcctcttcccacgccatcttcccggccaccttctgtcagaagaatgacattgagctcacaccgccaaaaggtaagactagagaggccaccacctgctgtccttgccatcagaaggggcagggtgtccaggcgcggtggctcccgcctgtaatcctagcactttgggaggccgaggcaggtggatgacctgaggtcaggagtttgagaccagcctggccaacatgacaaaacctcgtctctactaaaaatacaaaaattagccaggcatggtgacaggtgcctataatcccagccactcgggagtctgaggcaggagaattgcttgaacccaggaggtggaggttacagtgagccgagatcatgccattgcactccagcctgggcgacagagcaagactctgtcttcaaaacaaaacagaaggggcagggtgtggccacaagcccagattcctggtcaagtcaggccccagaagtgtagcatttcagggtgtatgggaaaggtgacagagcccaccaccagcccttaactgctgggctgaccctaccccatggccagtgtatggttgatgaacagagctcccacttatcccattggtcagtgaacaacctatacaacaggactgtggtgctagagcaggtactaccctgaggggatgagaagaaggctgctggggagactccatgctgggtcctgaccaagctgcagagcttcttcagccatgtgtcctttcctcctgcccacttcctgcttccccctctccctctgcatctgagctttctgctcctccaggttatgaggcacagactttcaactgggagaactacttggagaagaccaagtcgaaagccgctccatcgagactctttaacatggtgaggagactgaagtggagcaaggggcctgcggtggcctcaggacaggccctgcctgctgctgtcagtggtggcagttcctactctttctctcgaatctctactgctgacatcagccactttcagggggaagtccccagctatggcctgggcactccagtccctcttccatggagggcggtactgggagaggtgcagtgggttattgtctagaggaagctgccccagcagccattccagtccccgcccctccctgccagttcttcaagtgcctccgg

SEQ ID NO: 103885 - DNA, 1831 bp, Homo sapiens
ccagtcctatgtggccactggcagccagtaaggattccctggcctatgtctgctggaagggcccttggagagcctggctgagggggccttcattctggccagctctgggctgtgtggcgttgggtgcctggctctctgagcctctcgcacctcccatccccacccacggtgtgcagaaggcagagggctaatgtctctcttgctgagtcgttgtgcaaattaacaaaaatgagtctggcaccaaaatggcccccacacttggaaaacaggccaagaggcatccaccgacctgctgacccctctttccccgcaggcccaacagcgccctggaatcctgctccttcgcccgccacagtctgctgcagacgctgtacaaggtctagactcaaagcctctcccatcccttggcctggaccagtgagctggggagggactcggatgaactgaggcgcagcctacgccattgccttggacaggactctggccacaggcagggcgggtctgtgtcccatgtgtcctgtcagtcccctgagtatgtgtgtgggtgtggcgcatgtgcaggtctgtgcctcctgtcgggatttgggttttaacgtcttctgctggcccagccctgctctgttgtggggagttggcccccaggggaaagggctgtgagctgctccgccattaaactcacctccacctgagggcgctctgctgatctccgcctgggccctgatggccgtccccacccacctgccttccggcccggctccctggcggagccagaacccagggagttgcccgcgtgctgtccttcccctctgtgttgtgattgggttgtttcctgccctgcctggggctgcttctcgtcaccaagccctggtcctgcggcagctgtcacccctaccatccataccactgtgctgaccgctcagcctgaagagcagagaatgccatgggtgggactgtgggggtcggatcgtggggttgttggcagagggcaaccctgggccccacaccgtgtggacaggcagacaccagattgtccaggagcaggagctgctgggactgcgctggccccggacctagtgggccttctcctggctgctgagatgtcgtctgtgactggcctggctggagggggagtgttgacaacccaaagctgttctccagtctggggagggagaggcagggtccccaatgtccgagctgcatctggacgctgctcttaaaggacctcctggggcaggggagcggtagggtctggactgggcagatgctgtatgacctccctgagcacccgtgactgccccatgctttcccctttgtgctctgtgtgtgtctgggctgtgcccgggggcttcacaaataaagtcgtgtggcagcttcagagactcagaaactctcactgaaagcgggatagtctcgggggccgttgtacgtggagtcccacctcggcagagcatgcggccccgcagcagtctgtggggcagtcagccctgcagaagggcccggcctcggcctcaggccactacctgggaagtggcagtcctgagtgggggcccattttcctgcctggccacacctcacccagcaccctgcctttgggctgcagctcgcttggcttctgcgttgctccttcactatggaagccacctcccttgggatcctttgctccactgccacatatgtgaggacagcccagccaaccttccttacctcctaccctacaccatgtatgtgctttgggagcccatgtcccccacaaacggcctccaagaagtccctccaaggtttcttagagggcaatattttctcattggcagtcggccacgtaggtgaccag

SEQ ID NO: 103886 - DNA, 1032 bp, Homo sapiens
tttctgagacaatgttttgctttgtgactccggctggagtgcagtggtgcaatcatggctcagtgcaacctcgacctcctgggctcaagcagtcctcctgcctcagcctcccaagtagctgagactataggcacacaccaccaaccttggctaatttttttcctttttgttgacatggggtcttgctatgttgcctaggctggtctcagacttttcgcctcaagccatcctcccacctcagcctcccaaagtgctggggttacaggcatgagccgccacacccggctgggatgatttttcatccttgttcattcactcattcattccctctctatgctgcatatgtgcttgctgcaggccaaatccaagccagactctgaagggacagcatggggtaaggcaggacctgttcttgcccgccaggggcctttgtactgcccaggcctctcctagctagcgtcagagcccaggtacctctccaccacgtgccacaggccaaccattgtctcttttgtcctcagactgacacgtctgaccccgagaaggtggtctctgccttcctaaaggtgtcatctgtgttcaaggacgaagctactgtgaggatggcagtgcaggatgcagtaggtaatgtgggctgggtgagacctgggtgccctctgtcccttgatgctcgtgggccccaggtatccttcgtggttgccgtaactcgtcagccccagcgctctcatgggaactgctctttggccacctgagtttttcctccgtcagggtcctgccgtggagccagctggctgctcttctccctgtttttcaccactgagaaactgaggcctttcccaaatccacacagccatgtacagttagaacccatagcccgctctaggaagtccagatagtcacatctgcaagcccaatggacgcaggtctatcgggaggagggatggtgagagccaagcccttgtccacaccttggagcttctgtgctcacgtccactctacctggaggttccttgcacagaggacacctttccc

SEQ ID NO: 103887 - DNA, 1528 bp, Homo sapiens
caacctctgcctcccgggttcaagtgattcttatgcctcagcctcccaaacagctgggattacagatgcttgccaccacgcctggctaatttttgtatctttagtagagccggggtttcgccatattggccaggctggtcttgaacttctgacctcaggtgatccaccctcctcgacctcccaaagtgctgggattacaggcattgagccaccgggcccagccatagttacctatatttctatttaccccaatataaatgtctatttacaggtagcagtgctgctgcattatgtatattataagatatgcataagggtttctgaaagaataaacaaataagcataaatagaaattctgattttttttttccccacccaccagaggattgtcttggtgacccttaggaaccactcccccattcctgggatggtggctgggccatgacctggcttgggcacttggtgtcccttgtctggcccggggctgcatcagggctgccacacctccagttcattcatttgcattccctgtcaggttcctaagtaaagctcctggagaacttggctctggacaaggactccccatgcttacgctgaattgggctgcttctctggtttatggaatcaattaaacaaatggctaggttcgcctcaattcagtttttcctctgggcacctctggtgctagcagggcttacccaggctggactgtagttctacggggacccactttagcccccatgtgcctccgtagtcatttctggggcactgcatgtcatgacgaggatccacttggccgtagcaggttttttgagtcccagggaggtagcttccccctcaccccaaaggctcctggaccaagagccatccagggccagcatctctgggtgatattgatagatgggaaatgcagctgagtgggaggaagaattctagactttgagcctagatgggctggagtgaagggtggatgtgctgggtgtggggatgggcacagctgtgtcggggagtctggggtccggaattctccagagcctctgtgcccctacttcccaggagccagctcccgtgctgtcctccccacctcctgcagacgtctccaccttcctggcttttccctctccagagaagctgctgcgcctagggcccaagagctccgtgctgatagcccagcaggtaataaccacccctcgacccccacgctgtacgtgctgtggcttctggagctgttagagaaaagggacgaacagctcagagacctgggggtgcgacgctgtcagctgggggcagggaggcttggcctgccactgttacaacacgcgcaaatgtccagggtatttataagcctccaggggttgcaaatgttccctccccactcagcctacagaaagtacagcccgccagttcccatgctgactggggttagggaatttccttaagagccttgcatgtgcccaccccctccttggcttctctctgcgtgttccgtcagcccagctgcttcgagaacaactctgttgcccagggc

SEQ ID NO: 103888 - DNA, 1053 bp, Homo sapiens
ccagcctggccaacatggtgaaacctccatctctactaaaaatacaaaattagtcgggtgtggtggcgcacgcctgtaatctcagctactcaggaggctgaggcaggagaatcacttgaacctgggaggcagaggttgcgatgagccaagatcatgccatcacactccagcctgggcgacggaacgagactccgtctcaaaaaaggaaaaaaaaagaaaaaagaaaaagaaaataaggaggcagagagaatgggtatcaaaaggccaggctgtgatagggctgcatgggccagggaacaccctcctcatccctagagaaggacgccatgtcgaaggggttatgttgtgtaggtgggtgggctaggagggcccctaagaaagaaaggtcacatggagctatgtcatccagagaaggggcatgagtgcctgcccaccacagccagggtccccactgtgctgaggacaccagactgagaacaagaaatcgacctgctggatctagagctctgtgaccctgggcaagtcacttcgcctctttgatccctagtcttttctctggtggggatcctatcccaggcagtaggcctccctcaggaggttgtggaaagagttagatgcagccatgccccaaaatcccacagacaggcccctgccctgtgctggcggcagcccattcctgtgcctgctgtgtggaattgctctcctgcctgctggatgtcacctggcactcggggccccctccactctctgcctcctcttcacaggtcatcgggaccctggaggaggtccacatgccacagaatgggatcaaccaccctggcatcactgccctggcccaggctttcgctgtcaaccccctgctgcgggtcatcaacctgaatgacaacaccttcactgagaagggcgccgtggccatggccgaggtgaggcgagtgtggcagagccagttgggccccgccagatagaggctggctgctgtctttccagggaagctggggctccgtttagcagggactcctctaccccctgcctgccccctgggtgtgtgcccca

SEQ ID NO: 103889 - DNA, 1121 bp, Homo sapiens
tccatatccctcagccacctcaaagcccactgctctcaggctgaggctcacagtccttggcctggcattcaaggctcttgcctgatctgacccctcacttcccttccacccaaagcccatgccacggcttcttctggagcctacccacagctttcctccaggctcacagcctgctgcttcatgcttatgtctctctgctcctgttttttcagctgcctggagtcttttcatgttgactagctgattctcatccagactaagtccaaatgccacctcttacaaggagccttcccgggccactccaggcatacgcatcccccactctccagctgttaggagccctttgcagggtttccagtcttaagaatactgaaatggtttgtgtctgtgttggttctgcaccagccggggtgtccttggaaggcagagctgggcctggcacagaagcagcacccagcacagaagctgggtgtctatgaaactgacacgagcttcctctgtgcccagatctcactaggggaaggactcatcacagctggggctcagctggtggagctggacttaagcgacaacgcattcgggcccgacggtgtgcaaggcttcgaggccctgctcaagagctcagcctgcttcaccctgcaggaactcaagctcaacaactgtggcatgggcattggcggcggcaaggtgggtgtggcagccccctccccgcagagtcccctggtccatccacatccgtctgacatatgtgccctggcccttggccaccaccatctgggatggtcagccgttgttttcaaaagagaaaggcctcaaaggcaacagcctgtggccggagggtagaggcgtccatgagggtggggttgccaagcaaccatccccagttcttgggttggcttggcaacgcagagggagtgccactgcatacctgctccagcctgctggctctgcaaaactcagggcttggggcatccctatactcactgtacccgcagagcagctggtagagcctggcacataggcagagggagtctgaaaagaggagcatatgctcagggggggcaccgtcacagctcacctttattcctagacagggccttgcccagggaggtgtcctcagg

SEQ ID NO: 103890 - DNA, 1046 bp, Homo sapiens
acatgcctggttttaacactcattacagagaaatcatctgcatagctctgtactctggaccatgagcctgtctgattctctgtaagccaaggctcattgcatggtaggtgcaccatagactgttgagtggcaaggtggttgccaacctctctcctatcttagctgtttgtgattccaaaagcctaaggttctgctctttggtccctggcagctaaagatgtgattaaagagattgaagactttgacagcttggaggctctgcgtctggaaggcaacacagtgggcgtggaagcagccagggtcatcgccaaggccttagagaagaagtcggagttgaaggtgagcagagtggggcgagtaggcccaggctggtttgaacaagcttctgttcacacttccacaacccctgcctgtgtccagtctcttccaggcccctgcctgtgtggctgtaccccaagcagctcctcttcctctggcctccccagggcacacagcattggctagggaccctctccctgtagtcagcagaccttgagagggtgttggggtgcaggaggattattggcatgacacctgtgaaagacaaagtagggagagccttctcataatgcagagctgtcacatgtgaggtgggaaggttgcagaaataaccagcaggagcctctgactgtgaggctgctctgacagacccaccctctgggagtttcagagcaaagattgcccatttaaaggaatctcatgttgggcagaagtggccaggcctcagctcaaatgccgcagcaataggaaggtgctgtagctggagactgccagctccctacactcctcgcagcagaggcaagttctctttttttgttttttgagacggagtctcactctgtcgtccaggctggagttcagtggcgcaatctcagctcactgcaatctccgcctcctgggttcaagcgattctcctgcctcagcctcctgagtagctgggattacaggctcccaccaccactcccggctaatttttttttgtatttttagtagagatggggtttcac

SEQ ID NO: 103891 - DNA, 1044 bp, Homo sapiens
ataacaggcgtgagccactgtgtctggccttcagcctatttttgtgtttgtatttttattattattattttttttgagacggagtctcgctctgttacccaggctggagtgcactggcatgatgttggctcactgcaggctccgcctcctgggttcatgtcattctcccacctcatcctcctgagtagctgggactacaggcgcccgccaccacgcccggctaatttttttgtatttttagtagagacggggtttcaccgtgttagttagccaagatggtctcgatctcctgacctcatgatcctctcacctcggcctcccaaagtgttgggattacaggcgtgagccaccgtgcccggccccttatttttgtatttttagtagagacggggttttgccatgttggccaggctggttttgaattcttgacctcaggtgatccgcccactttgacctcgtttatcacttttgatgcttgcgtcacccttgtgggagatagattggaatgttgctgttttataaatgagaaaaaggaatttaggagactttaagtaacttgaccaaggtcacacatttgataaatagcagagctaggattttcacagaggttcagtgaaatccctattcctgtgcttctaattagacattgagctccgtttaggaaacagagatttgatggcaaatgccatttattgaacaccgtgtcagataagggtattaagtgccagataaatagtatctcagtttatcttcacaaaatcctttgagatagattgcatttccattttgcagattggaaaactgaggtttagggaggtggtatgacatgcctaagggcacagctttaatgagtagagctgggattagaactcaagtttgggccaggtgcggtggctcacgcctgtaatcccagcactttgggaggccgaggtgggcagatcacctgaggtcaggaattccagaccagcctggccaacatggagaaaccctgtctttactacaaatacaaaaattagccgggcgtggtggtggacacctgtaatc

SEQ ID NO: 103892 - DNA, 1944 bp, Homo sapiens
ggggcattctctgggatgaatgatctggatcccatagccatctgtgtcctgtttgaggaatgggaccctcaaacagagaacagccaagatgctcaagcaggtgtgtgcttgggccagactctgcagcctttggtttgggacttgactgccattcactgaaggggcccaggaaatgggcagctcacatggtgttgctgggtgtccagctgcggcagtttagcagaggaggacttgtaatgagatggtagcttcttataggctaagacatgatttttctgttcttttactacctcctgcaccttctagaactgttccttctctgatgctgttttcctttcttccagtgatttatctctagggtctccatagcaggggaggtagggtcagactcctgagatggctgatgtcctaccctgcccccaaccaggggccccaggagactcctttttcttactgcaactttggcctcctcagtctgcagatctccaggggagcccaccagcctagtcaacatggcctcggaagacattgccaagctggcagagacacttgccaagactcaggtggccgggggacagctgagtttcaaaggcaagagcctcaaactcaacactgcagaagatggtgagtttctggaagttgtgcactggtgtgtccaggggaggagagggagtgtactgaactcttactggttgtcaggctctttctgctacattgtctccattatttgtcccagcagctctgtgaggtatcattgggcctattctaacaatgaggctcagagatcatttgcccaggagcaagctcccctgcactttccatgtttgtattgggcatccctttgtgccctgccctttctttctcaggaggggatgataggtaatgaggggccacagttagtgccagtcccaagatacagcctctgactctgacttaatatccggtgttgtccccacccttgcccttaacccccatgatcccaggcaggcctgggaatagctgcagctttccccagagctgaggctctggtggagctgcattaaaacaacctgggccctcttgggagatgctggttcatgcaaccagatgtacctgggagagggatggctgtctgtgtgtatacaggtattgcaaccacagaaaactaggaaccagagagcagaccctgtcttttcatcccttgtcaaggcttggctgccactgaccaaccctgaatcacctggcacctgcaagtgaaggcacctgcatcaagtgaggcctcctgggattctggcccaaccaggggaactggtctggacatgcctggttgtcatgttgtgtaggcagccttgttctcctctccaggtcggaggctgcttgagtccttgggtagctgggagcgtgctgatgcatgttcctaacatctccataaggtctaacgtttatagacttcctccctgtgcatttatcactttttttttttgagatggagtctctgtcacccaggctagagtgcagtggcacgatctcagctcactgcaaacctctgcctcacgggttcgagcagttctcctgcctcagcctcctgagtagctgggattacaggcgcccaccaccacacccggctaatttttgtatttttagtagagatagggttttgccatattggtcaggatgctctcgaactcctcatctcaggtgatctgcccaccttggcctcccaaagtgttcggattacaggcgtgagccactgtgcccggcttttttttttttttttgagatgagtctcactctgccacccaggctggagtgtagtggtgcgatgttggctcattgcaacttctgtctcccaggttcaagcgattctcctgcctcagcctcccaaatagctgggactgcaggctcacaccatcacgcctggctaatttttttttttgagacatagtcttgctctgttgcccaggc

SEQ ID NO: 103893 - DNA, 1055 bp, Homo sapiens
cccctacaagagccattgcatttgctattccctttgcaggaatcatgttcccccagatgtgtgcatggcccaatccctgatatctttatttaactatttcctaataatgcctttttgttgttgttgttaatgcctttttgttgttgttgttgttatttgtttgttttgagttggagtcttgctctgtcgccaggctggaatgcaatggcgcgatcttggctcactgcaacctccgcctcccgggttcaagcaattctcctgcctcaacctcccgagtagctgggactaaaggcgtgtgccaccacgcccagctaatttttgtatttttagtagagacggggtttcaccatgttggcctggctggtcttgaactcctgacctcgtgatccacctgcctcggtctcccaaagtgctgagattacagccgtgaaccaccactcccggccccccaaccccccccttttttttttaaatcacatactaaatgtgtcatttagaacatatgcttcaagaggtcagggtttatgcttcctttactgctatactgctgacctggaacaacatccagcacacagtagtaatcaatgtgtttttgaatgaatgagtggacaccttacccaggataataattcatgcttattgataaaggcagacaaaccagggttataagttagaacccagaggaagcctaggggtgggaggattcagggtatcacaactgtatctgagaatgaggaggttgtaggaggaggcctttcggatagcaccccctagttctgcccctcatatctgcttccttggtctctcctgattacttgctgtttcttttctttttttggagcatctcacagatacgtttattcataccacaaagtaaacactattcaggtatgtagtgatgttccacgttcctgtctaatatagctggcttcaatttataggcagtacacattgagacatttaatctcacatgtactccaagtaaagctggagtaccatgagcaggcgcaggagttctcaaagctttacttgttttaaaaattttcatttattgg

SEQ ID NO: 103894 - DNA, 1079 bp, Homo sapiens
ccccaggaggtgtcttgaaattttcgtggggcctctctcttcggcgtccggagcttctggggtgtccagatgctttgccgaccccgcgcagggggtctcgggggctggcaggggcgtcgctggcagggccccccttccttttgtgttgtccttggccccgcagcacccggagttggaggggccgcggcgagggccggggagcggggccgcccgacgggccgcccctttcggctgcggcggccacgcgagcccggggatccggggcctgcagccgggcccgcgggaagggggcggcaggaaaggggggcgcggtctgggcctgctgggcaggggggcgtttccggtcgcaggatcagtctctggacttcgaggcctgtgggaggcccgcggccgtccagggagtgctagggggctgcggaccccggctctggcgcctggggacgggggcgccctgacggggctgggggcctgggagccgccgactccggcctcatacccccatcctgcccgctgcgaacctcagggcccccctccgggtttgctccctcctcctttcccctcctttctcctcaactctgtctgttttaggcgtttataaggcgcctggttggggggactttcacagacaaagccgtcttcccaggggggaaaataatcatataaaaacagctcactctgatagaacctgatggctgtattgccaacagggcattgacggggaagactagggggctagggccctgcgtggggagtctgggggctctaaaagggggctgggcctgagtggggagctggtgatcagcggttttatttctcgggttgctagctttggcatcagactttgaaccccaacttcttgccatattcctcagcatctgcagttcagcctgatgaaaatagcagaatgcagatccttgaattttcacacaaatgagataattatagtacatgtagcaactgtgttggacacaaaatgctggcagaatctttagttctactaccaatacttcctctacacacatacagccatcccctccgtggtggtcttctttccccgtgtccacctcccacagaagttg

SEQ ID NO: 103895 - DNA, 1009 bp, Homo sapiens
tcttgatctcctgacctcgtgatccagccacttcggcctcccaaagtgctgggattacaggcgtgagccaccatgcccagccttctttttattttttgagacaaggtctcactctgtcacccaggctggagtacagtagcacaattgtagctcagtctgccaggctcaggcaatcctcctgccttggcctcccaaagggatagggttacaggcatgagccaccacacctggctgctgcaagtttctttctttctttctttctttttttttgacagagtctcactctgttacccaggctggagtgcagtggcatgatcttaggtcactgcaacctctgcctcccgggttcaagtgattcctgggctcaacatatctgaattcaagtgaactcctgggctcaacatatctacccacctcggcctcccaaagtgctgggattacaggcgtgagccacctcatgcctgtctgcaagttacttttcaagtgcctcttgtgagatgctgtggggcaggtttgcaattgactttgtcatttattatctggctggaaagagaaagttgattctagtgaaccaatgagaacacaagaattctggggtcagtgcagtgggagtggagagaagacagctcaaggctacctggaaaagttagagaaggcttcttctaggaagtagaatttgaacttcaaagaatggggaggcttgccagggtggagaagaagggaatttctgggttagccacaattgcttctgtgctgggaagttgacttacattctctcgaattgttatagtagctccgtgaggggtgggcattataatctccatttcacagatgaagaaattgaggaacacgggatttgtgtgcccagcccaaggtcaatctgcaggatttgaatccaggccttcttgactcttgagtgtgctcctgccctctgcaccaccttcctctcagatacgtaagcaagaacagggactgtcctataatcccagcactttgggaagccaaggcg

SEQ ID NO: 103896 - DNA, 1036 bp, Homo sapiens
tcgcagctacttgggaggctgaggcaggagaattgcttgaacccaggaggcggagcttgcagtgagccgagcgctccactgcactccagcctgggcgacagagcaagactctgtctcaaaaaaaaaaaaaaaaaattagctgggcatgctggtgggtgcctgtaatcctagctactcaggaggctgaggcaggagaatctcttgaacctggggggtggaggttgcaatgagccaagatcacgccactgcactccagcctgggcaacagagtgaaactctgtctcaaaaaaacaaaaatggagactggatggtctgaattagcaaatgaaactggggtagcattgtcaacaggctccccaagaccaaggagttctcctaaactggctctgtatcccagggccccgaggggctggaccagtgaaagcactctcagtaggtttctaactgcagaaagcagaatggcagtagaaggaggaccggtccctgagcgtggggatctgagcaagtttggttccttagtgcctgctgggtgccggcccagcaccctggaggagcttagagcttgggatgagatagatatggaccattaatctgagcttcccaaggacaggaactgggtctgattcaccctctgtgcctccagccccagaggcggtgccaggatgacacactcagccattgtgttgtcaaattgaattatgccccaatgtagaggaggaaggtttattttgcccaagagtagaagatcttcctagaagtgccatttgaacatctgaaagataggttgaaaagccagagaaagggtgttctaagcagaggcattgagatggacaaaggcagggatgtataaagaagaacaggtcacctggtacagccacagtctagtgggcagatacatgacattgggttcaagtcaggctctgccgtcatgatcctttcgattctctgggcctcagtttccccttctgaaaaggagccctgagatttgatgatatttaatgataacccatgcttggggatcaggataagaaactca

SEQ ID NO: 103897 - DNA, 1005 bp, Homo sapiens
gtcgccctggttcagctatgctcttgttccctggagcatctctgtgtcatccctctccctccacaggctgaggaacgcagggcagggagcccaaagtcctgagtttcattcccaactcctgttcatgctggctgtatgatggaggcattattattttgtcattcttggcttctgtctccttttctgtgaaacggccgtactgatcctgtcgaatctgcatcaggggttgtagttatgatcatttaatagccttcagaatattcctgaatcttcttcactgtctgccttgatccaggcctgaaccactgcagtagcctcctaaccaatctcccagtatcctctcttgtcatacgtcctccctgcagtagccaaaaggatcttcttgcgaaataaataagctcctgtcactcttctgctgaaaactctcctgcagtttcctgacacacgcaaaacacagccctggctcccggcatggcctgtgagtggttctgagaccagcctcgcctgccccttgcactttgcctcccacgtggcttgcccttgcttgggtgttgcagccacggtggccttctgagttttcctggaacattatcagcttgttcccacctcagggccattgcctgtgccctgtcccctgctaggtaggtgccctcttaccccacctcctatcttccatggctggctacctatctctcttaaatgtcagcttcctcctaagggccttccctaaactcccagtctgctttttttttttttttttttttgagacggagtttcgctctgtcgcccaggctggagtgcagtggcgcgatctcgactcactgcaagctccgcctcccgggttcatgccattctcctgcctcagcctcccgtgtagctgggactacaggcgtgcgccaccatgcccggctaatttttgtatttttagtagagacggggtttcaccgtgttagccaggatggtctcgatctcctgacctcgtgatccgcccatctcggcctccca

SEQ ID NO: 103898 - DNA, 1036 bp, Homo sapiens
gggtggtagcgagcgcctgtagtcccagctactctgaaggctgaggcaggagaatggtgtgaacccaggaggcgggacttgcagtgagcagagatcgtgccactgcactccagcctgggcaacagagcgagactctgcctcaaaaaaaaaaaaaaaaaaaaagagagagcaaatgggccgggtgcagtggttcatgcctataatcgtagtactttgggaggccgaggtgggcaggttgcttgagctcaggagttcaagaccagcctgggcaacatggcgaaaccgtatctctacaaaaagtacaaaaattagcctggtgtggtggtgcatgcctgtagtctcagctacttgggaggctgaggtgggaggatcacatgaaccccagaggtcaaggctgcagagagccgagattgcatccagcctaggggacaaagtgagactctgtctcagaaaaaatttaaaaattaacaaataaaaaaatagaatgtttgagatggtgcctagcatggtgcctgacacacagtagaggtgtgcagggaggtcctctgcccaggtcaaggttggaagaagaaaaccccagaatctgacccagagagacagagcagttgatttccggcaggcctggggacagggactctcgggggcgctgcagaccccagctgcttgtgtcagggcctctttgctgccccagctaaggggaccttgagcatcttttcagaatctttacctctgcccacctctctccaatctctggcaggaattggaaaccttttctctgctcagtaacggcactgcggctggcgtggcagatcaggtaggatcggggctgaaccaacctgtctcagtttatccattatgagaggtttggattcactctctccgggtataaatgacctcaggcagtgggtccaggggcctccgcctccctaggaggtacctcccgtgtccacgggggcaggatgtggggacaggccatggctgctgttggcagggagtggtcattgccggggagccgccgggggcagcctcactcttg

SEQ ID NO: 103899 - DNA, 1049 bp, Homo sapiens
ggcttccagaaaaggttgccttttaagagtgtcccctggagagggcattgcttaccccagaagaaggaggcagcagtggtggacatttaggcattgagcctgggccaaggattgacatcataggactgagggcccctccctgctctggggctgtggccttccttgaccaccccctgagcatctgccagtgggatcagccgatggggaaggcagggctcctggcaagagctgaaagaagaagggaaagtgttggatgagcatcacggggcccgggacgcctcctccaccctcaccaagcagtgctccccttcggctcttgcccaccccatccgcagactgctacgtggaccctcgaggctccccagcccttctcccctccacgcccacgatgcccctgttccctcacgttctggacctgctggcccccctggacagcagcaggaccctccccagcaccgacagcctggatgacttctcagacggggatgtctttggcccagagctggacaccctcctggactcgctggtgagccacaccaccctccttgtgctcccctgatcccctctccccgctgtgtccccattgtcccaggggtggagggaaggccccaatgctcatgtcatgtgtctcaggaggaggcctcagtagggacttgtttggtacagaaatgaagctgcacactgggcacggtggctcacgcctgtaatcccaatactttgggaggccaaggcagcggattacttgaggtcaggaattcgagaccagcctggccaacgtggtgaaaccccctctctactaaaaatacaaaaattagccgggcatggtggcacatgcctgtggtctcagctcctcaggaggctgaggccggagaatcgcttgaacccgggaggcggaggttgcagtgagccgagatcacaccactgcactccagcctgggcagtggagcaagactccgtctcaaaaaaaaaaaaagaaatgaagctgcacaatgtctggccagaagggaccatagtgagccctgctcccacatgggacaggatgaagccag

SEQ ID NO: 103900 - DNA, 1033 bp, Homo sapiens
agaatggcatgaacccgggaggcagagtttgcagtgagccgagatcgcgccactgcattccagcctgggcgacagagcgagactccgtctcaaaaaaaagaaaataataataaaagaacatctgatgaggggccaggcgtggtggctcatgcctataatcccagcactttgggaggccgaggtgtgcagatcacaaggtcaggagttcgagaccagcctggccaacatggtgataccccgtctctattaaaaatacaaaaattagctgggtgtagtggcggacacctgtaatcccaggtactcaggaggctgaggcaggagaatcgcttgaacctgggaggtggaggttgcggtgagctgagagcacgccattgcactctagcctgggcaacaagagcaaaactccatctcaaaaaaaaaaaaaaaagagcttgctacactctgacctacactagctgtgtggtcctggggaatttccctaacctctctgagtcttgccttcctccccatctgctgatgacttgggggattgggggagggcatgagcacaggctgcaatcacggcccctcccatttctatgctttcacattcaacttgccttcaaagaaaggctcagagccaagacccaggtcacccactagcctgggaccatatgctgggaccaaggtggtcctgatattttagactcttggaccacattacaaagaactcccctggctgggagggtggaggaagaggaagggtcctgggctgtggttttgctcttgggtaggataggggggtcatagagcactccccacttctggtgccctggctggccccagtggcctcagccatcatccagtgcccacaatggcctccttcctcctgtcacagccagagccctgcatgcccaacactgccttgctcatcaagaaccccttggctgccacccacgagttcaagcaggcctgccagctctgctaccccaagacaggtaaactttcacctgtagactccacccctctgcccagagaactgggaatctcagga

SEQ ID NO: 103901 - DNA, 1084 bp, Homo sapiens
gtaatcccagcattttgtgaggctgaggcaggcagatcacttgaggtcaggagtttgagatcagcctggccaacatggtgaaatcctgtctctactaaaaatacaaaaagtagccaggcttggtggtgctcgcttatagtcccagctactcgggaggctgaggcaggagaattgcttgaacccggaaggcagaggttgcagtgagttgggatcacactactgcactccagcctgggtgactgagtgagactctgtctcaaaaaaaaggaggggggatgggtgccaagaatgggctccttcgaggggcttcccccagcacagtcccccggtctccagggagcaagtagccaggaagggtgtggtgggagctggcaggaggccctcagaggggaggtaggtatataaggagggggccgattcctacccaccgcatgggcctgccagccatcactcttcaattctgcttccggaattatcatgtgtgtccaccctgcccataggcccccgggctggcgactacacctaccgtgagggccttgagcacaagtgcaagcgggacatcctgctcggccggctccggagctcggaggaccagacctggaagcggatccggccccggcccactaagaccagcttcgtgggctcctactacctgtgcaaaggtgggtgggctgcagcggggcaggcagcacagctggggcccagcccctccacccccagccgctgctctactccccatcacaggtagacagaacaggggtgggcctcacagctgcacgggaggagaaagccacggcctaggctcctggggcccgtgcaggatgaattccacatcagaatgagcgtcttcttcccttagcagcttccagaggcaggtgggacacatttgggacattcagctggagaccgagcccgtcactggcctgtgctctggagtgtcaggagcctacatgactcatagggggctggcttctcttaccactgtagggccctgaggggccgcggggcagtgtgcccagcagccacatgaagcatttaggactggcgcatggtgagggctccatccacttgagctctctgtcac

SEQ ID NO: 103902 - DNA, 1033 bp, Homo sapiens
aaatcgtgccattgcactccagcatgggcaacaagagcaaaactccatctcaaaaaaaaaatcccttctatttatttagagacttgtatacttctacaaaagcaatcctgtggggtgagtggggtaggagtgattactgtactctgcaggtgtggagtgcagaagcgggccttgtatttggaaaggaattttcagccctgccaagtcctggcagcagggggtgcagcagaccctgcctcacctgcgttggggtgcagaagggggcctggtatttggaaaggacttcccagctctgccaagtcctggcagggggtgcagcagcccctggctcacctagctgtgttggggtggagcgaagccctgcctggctcatggggccagagccccacaggccgcagcggggtggcgagggtgctgcgggctgctatccccgcctggcggaacgtgtgtcctgttgcctctttgcagacatgattaacaagcaggactgtaagtacggggataactgcaccttcgcctaccatcaggaggagatcgacgtgtggaccgaggagcggaagggcaccctcaaccgcgacctgctcttcgacccgctggggggtgttaagcgcggcagcctcaccatcgccaagctcctgaaggagcaccagggcatcttcaccttcctctgcgaggtactgcccacccacccactgccaccccataggccatggcacagacagggctggggatgctccctggcacggaccaccataggaagtcagccctggaacccgtgggctgtggaggcctggtcttagaaccagtaggtcctggagggtcagtaagtctgggccctaggatcctatcttgctagaggccagatctgatccagccccctcattttgcagaggcagaaactgaggctggaaagaaaaatcataaccctcacacctgctcttttctgacagccagtcataggcagggcttggcacgtggttgttttcgtttctcattcctagcctgatgcagtggctcacgcctgtaatcccag

SEQ ID NO: 103903 - DNA, 2000 bp, Homo sapiens
tcatccctggcaccaccagcccttcccctagctcttccaggtcgggacttgtgccaaccccccacagggagcattggcctgggaatcatagttcatagccaggtgacagcctgtagttcataaagaacttgccattcctttttatcttttttttgacatgaagtaaccccctgcctcaggcattgggagtggtgggatcagagggagggaggagggtgaggaagggagccaaagcccaggtcacctgtgagctggaagcagagaggcaagaccacagaccctgggattcccttcctcactcctctgacccagggcagggcttgcagggacccagctgtccttccccagctagctgtgtggggtcccagctcacccccttcccaggtggccatgccaggtcccagcccttcccctccctgggcagatctgctttgacagtaaaccccggatcatcagcaaaggcaccaaggactctccgtctgtctgctccaacctggctgccaagcacagcttctacaacaacaagtgagtgggaccctcagcccaggctgaggcctaggggccagtggagagtcccctcaggcagctcagatggctgaggaaaggctgaactgaaagggtggatgtagggtgcaaggaaaggggcagaatttgggaatcaaatccagcctccacctggaaaggatgagaatcacatttgtcgaacatctactatattccaagcgtcatcttgggtatgttaattatcttagcaatcctgtgagggaggagttactggccctgttgtacagaacaaaaagctgaggcttggaagtagcttacttagcttactcagcttactcagcagacagcaagcggggggcctcgtctctgactgtagcccagcaccctccaatgtcatgacatcagtgtcaggcagtgaggggaggcctgggtcaggtctggcaccacccctttctccctcttgttccccttggttctgccatggtgtgcatatggagcccagggcctgcagtcagacagacctgggtccaattcctgggccagtcctgtcttacgtccaagcctgggtttcctcgtctgtaaagctgatgatgctctaggctcctggggctgcagtgagggtaattaagactcctggcccagaggacatgcttggttagtgttcctcaggatgcaggaccggctctgcagaatcaagctggaaacctgagggcggtgccctttgcttgttggcagctccatctttgaaccctgggggagggacaggagtaaagcagcgctgggacccaggcccaggggtgcctgagcataggagccctgtttctgccctcctgtgtcatccatggcctggatttggtacatagatcagggggtgcccagggagagcctggcactgggaaggtggccctaccaggagagaaggtcagaggggctgcggactgcatcgtgcccctcctgcctgcccgcccgccaggtgcctggtgcacatcgtccgctccacctccctcaagtactccaagatccgccagttccaggagcacttccagttcgacgtgtgccgccatgaggtgcgctacggctgcctgcgggaggacagctgccacttcgcccacagcttcatcgagctcaaggtctggctgctgcagcagtactcaggtgaggggcaggcggtgcaggtggagggcaggtgactcaggtgaggggtaggcggcgcaggtgaagggagcgcaggactgactggggtgacaggccagggccccatggtcgctggagggggcttcgggagagttcaggagaggtggctgcggggtgggctctctgtgtgtcccaggcaccacagaggagagaagctctgctctcagggcgcttccaggctcggagatctgggtttttcccttcgtaggcaccgtccagggagcacggagaggggagaggagcacctgggctcctgcagcaggacctctgcttgctccctgggtggtcggcagcaagtcccc

SEQ ID NO: 103904 - DNA, 1001 bp, Homo sapiens
tgggaaagacgtgagaaagatggagagcgctgaaaagagggcaggcttcatggaagagttgtgagctggatctccaaggtcgggctcagtggcaacagtctgaggctggcggggagacagactggagagtccatgccaccaggctggggtatttgccctttggggactggcagtaaagagccgtggtaccacagtgaaccggtgagccaggctgggcaggcatggagccctaagtgccagtgaggccaggggctgccaagcaggcactaggcttgcagccctgttgagggagatgggggtcagggaagggtgctgagtcaccggcccaagagacagggtcactggcatgggagcagaggactccctaccacagtacagagccaatatctttctactgcattttcccactcttggctgcatttaattctttcacttccagtgaggctcggagcaggtctttgttcccattttgcagatggacaaagtggttcccttgtaccccatgtcttactgtggctgggctgagaatagggctcctccagctgggcctcgggggtccctggcacctcgtggaccccctgcctccctccttgctgagcaccttgaaagatgcctgtgtctgcccccaccctccccaggcatgacccacgaagacatcgttcaggagtctaagaagtactggcagcagatggaggcgcatgcggggaaggccagcagcagcatggtaaggccttctgatactatgccattattcagattttgtgaattgtccccaaattacaaacaggaaggctctaattttacaatagagaaatgtttacaatggaggcacctcgaataagttatgaaagtaacttggataatgtacacattcagctgttgtgtctcattttattttattttattttattttattttgagacagggtcttgctctgtcacccagcctggagtgcagtggtatgatcatggcccactgcagcttccacctcctggtctcag

SEQ ID NO: 103905 - DNA, 1072 bp, Homo sapiens
atgtcgcccccgtgatgcatatatacacaggtattaaatatatcgctctatataatattatatatgtgtgtggtatccaaggaatcacttttatgagggctaaagataaagaatttggccagaaaatgcagccatccttgtgtgattaggagggtttcaggggccactggactatttgcaaggtgacagggactggagccatggctcagaggtgattcgggcagccagggacaggagccaccctccccaggcccaactctgctagcttcccagaccacccccatcgagtgcggagagagtgggagtgctcagggaaagaaggtgatttgtatttgtctccccgctgaaaagaacaggattcaagtccagagttttcatcttcagcctgtgatctgtccagggacccttgggatctggggcttcctggcctggccagagctggagcccccacagggtaaggaagagagagtgggaggcagagtgtgatggggaggagggacaggaagacccttttaatgatgagggtaactatttcagttgtgagccttctagggccccaggctgggaggctcagaggactgaatctgggacctgtgttccccccggcaggcagggacaagatggcatggcaagcatgggggcggggtgggtggggagggatgctgcatttctcagctgggcagtaatcaatttaatggtcctttaaaatgtctgtgtattaaaaatttaagaataccacactttaatattaaatattcataaggtctagtatcttgataataatgtagatgttttaataacaatttttgtccttcttaaaataaaatgaaagaaacttgcttcccttagcctttgttctagaaaataaacttgtgcactttgacctctgtccccgagatgtcactcctgttcctccccacctggtacttatatccaggggccttagctgctctgtcctcatgggacagacctggccggtactagctactctgaggaatgctaagcattccgaggggtgaggggcaggtctgtgtccctgtgtacacacggaggccagccgaccctggctccg

SEQ ID NO: 103906 - DNA, 1050 bp, Homo sapiens
aaataacttttgtttctcgtcctgcccccgaggaaagggcagtgccctcaatgtgccctggtttgtgctgctccctccctggtatccctgctttagctctggccacaccagatgagttaggggaatccaggtggtgggagtggaaaaattgggttctctcgtggggaaagacgagagactcacagagggcacttccccacaggatgaaaagtactggacaagacgcaagaagaacaacgtggcagctaaacggtcacgggatgcccggcgcctgaaagagaatcagatcaccatccgggcagccttcctggagaaggagaacacagccctgcggacggaggtggccgagctacgcaaggaggtgggcaagtgcaagaccatcgtgtccaagtatgagaccaaatacgggcccttgtaacccgtgccccccgcccgggcggggtactgcctgcacctcagacctctgcctgggggctccctgtaacccctcacacgcgtggagacttatgactcgtcgtgggcgcatggcggcgcacctgctgcaggagcggccacgtctcagcttcattataccatggcctgcgcacgtggcgacgtccctgaggggccagtctcctcactggtggggaacgcaagagaatctgcgtagatgggtgactcagccttagtttctattcttggatgtcccagttgaatcagaaggggacctctggagtacacacctctctcctgggcgctcagggtccctggactctccctcagtctccagcctgggctgccgagggctatctctgcagaatgagttgtgatcattgtcaccctatgtcttctcaggtagcagggcgcgtttccacttaaggtgtgtctgtcacgcacctcattctccccagacagtctttgagtaacatctgttcccatcttccttggaagcaggacacaccagctcctccgtcagtgtctgcatgggtagcaggctgcaggagtggggtctctgcacagcctgggatggggcttggggctggggcctgcagcagaagtgtgcccagcgtt

SEQ ID NO: 103907 - DNA, 1008 bp, Homo sapiens
tgaagaggagacagaggcgatgggcgtgcttcgtcctccgtaacactggctttatttaccgtggtggttcagagtcccaggccctgacctctaaagacttttcataacagacgttaagaccaagccgtggacctcaccccaggggaatgccacggccctttggggacctgcacacccacctctccgggggacttgacaaggggccctgaggccaagggaggtcactcctccctccaggcccctgacttttactttgtggttctctaaaaaccatgtacacactttcactctattgtaaccacacagggcaggcgcatccagcatgtcagtgtcctgccccgggcagctctccctcccgggcacgctccctctggcctggtggatcaccaagagggcggttctcattttgttattagtggaagagccttgagcttaaaagctcttcattttctttgccggaaagtatatggtttgtgtttttgcagttttatttttttaaggatggacactaaatctctggtgtccatgttccgagcccggtggctgggatggtggctcgatgtgtctcctctttatcccgccctctgcctgtttggtgccctcccttctttcccccaggcagtgggtatcgggttctttcccaaagtgcttacttggaaagagtgtggctgctggactcttttcgaaatgcccctctgagtcaggagcctggtggggacaagatggaggatgtccacagaggctgacctgtgggggaaaagaagtgctcaggtaaggttgtctcctctcctgtcctaaaaaaatccatgcttgcaggagagggttggtgcctgctcagtttctgtcgagggaatgggagtctcctcggctccctcctgggccctctgcttcttggaggccgaccgctggagactgcggctcctgtgcttggatctttgacatctgtcagtcactggaggctagagaagttgactttaccttggctttctgtgggttcccgatgggctt

SEQ ID NO: 103908 - DNA, 1100 bp, Homo sapiens
tgatggaggaacgtgtgcatttagagagagggagagttttcaaggtttatggcaactttgtggaggacctgggtaactcttacccttggccaaaggaagaggttttcctgtctggcttctgaggttggagggggcacttagcagtgaaccttaagtctgggtacatgtaaccctgctgaggggctgtgcaggccgctcctacggtcctttggcctgaggcagggcgggaggcatgcaagccagtgggggaaaacccctctgaagctgggcagccctctacctgggccccgggagccgtgctccttggaacgcaaagggccgaggagcatctggttttcatggcaaagctctactccagagctcctttaacatctgctaattaagtgcaataaatttttctagaaaatggcaaagatgacttccaggtggatattgctctcttacggtgttggggatgccagaacaccacttggttttatttttctaagtgcatgtgatgtgatagagtgtgtggggctctgtgtccttccctgggagctggcattccagcgggcccctctctttacctttgttgggggaaggaggcaagagagaaattccttcttcccagccagagagggcagaagcagaccgtagcccattggccttatgtgcgtgtgtgcgtgcgagtgtgtcactgctggtgggccggagtgatgtggtgggagggaagccgggaatgtatccttttcagacaaaattaaatattttgaaatgagaatgttgggattgtcttttctgtccttctccccacccccaaccctgagtttcctctcttgagtgttggcctaggagctggagagtcaagctggaaaacttttatctcattagaatccaccccagacacccccttcatcacagtccagacactcttagcatctgaccccaaccactctgcctcagtttcctcatctatcagatggaagtgattctcgccttgcttatattgaggagggacaaatattagaccaaaagcagtttgaacaggtaaaggtgctacacaactagaagacagggaactgcttatgacaagtgttctcgaatagagaatgcgtgatggc

SEQ ID NO: 103909 - DNA, 1039 bp, Homo sapiens
ctcccacacaggtgacagacccagcagatagcttctctctgggaaaggttggatgctgccttacatccccttctagccctcctcccatccacacacacaggcacccacccacaccaggtcggcttgtttctcacatgtagggagagaggggagaccaacccctttgtgtcttttgaaatacgaagaaaaatgtgtgttcaggagcatgactccagtgctgcgctcttgggcccagttcagtctgtcttgtctcaaatctaggcatttttgcttcaattttattttttttaagaatacaaaaacagaaatctgcactaatttacctggtttcgtaggaaaacttttttttattttttacattttttggtgtccgtttgtattgaataatttgctacatttgtaaaatgtaagaggtatataatatatgtatatttctaacgtaaaaaacataatttttttcttttcaagattttttcttaaaaagatgagagaaacatattttttcaggaaaaacaaactttaaaaaaaaaagaggagaaataaaaccttttctcccctttccccatcctctatctatccctctttcccaggaacaaatcaaaaggtggattatcttctgaagaatggaaactgttagtccagaatgatgtgtttttctcaatgcagtgagttatagattctctagttttctccctagggatgggaagggggcattgaggcaagcctggagaggagcccggggagcagggtcatgaacttttttctttagtgaaggaggaatacaatcaagggttttgtattcagaatgttgtgcaatattttggaatgggacattggtgtgtttagagattttagtttaaaaacaaaacaaaaagattgatcaaatctgtacagtttctattgttccagatttttttaagtttgtattaaaagcatgatacataatagccttctgcctgctcctggcttgcttggtttctggggtcccttttgggatggagagaatgggagtggcccagcccttacagactccaagaaa

SEQ ID NO: 103910 - DNA, 1028 bp, Homo sapiens
gggcgggtggccagcagccaccacagcagcctcgcatggcccgctcacccaccaacagcctgctgaagcacaagagcctctctctgtctatgcattcactgaacttcatcacggccaacccggcccctcagtcccagctctcacccaatgccaaggagttcgtgtacaacggtggtggctcacccagcctcttctttgatgcggccgatggccagggcagcggcaccccaggcccgtttggaggcagtggggctggcacctgcaacagcagcagctttgacatggcccaggtatttggaggtggtgccaacagcctcttcctggagaagacaccctttgtggaaggcctcagctacaacctgaacaccatgcagtatcccagccagcagttccagcccgtggtgctggccaactgaccatctacctgcccgtggggccaggagcacccaagaccacagaaaagagaaaggaaaggccaaaaaaaagaggaaaagaaaaatgtacaaaaagattttcgatcttctcactcttacttctagaaaaaagatccagcccaggcacggaatgggagggccctgcaaagcacccaagtgtgtttcactcaccccttaccgctcgcccaccggcctgtgatttatttggttggtttgggttttatatttctttttcttttttttttttcttacatgtagttttctatataacatctttaatgagtggcttcctgtgctaagaatggtccagatgtgaactgctgctccctgctcctcccttcctccttcacactcctagtttaggattgatgtgtccaagctcatagggaagaaagagctgcagctggagcctgaccctccctggaacagggagaggctggcccgtgtcactgcctctgtcacccagctatcctcgcactcaaagccatccaacctcagcaggccttctcgggccctgccacctgaataggtctgaccccagtccccactccctttcaggctgggccacagggagttgctggctggccacttgac

SEQ ID NO: 103911 - DNA, 1036 bp, Homo sapiens
cagcagaaagggagcagagcccagagcatcaccaggagtgcctgctagtgtactggcagcttgccaccccctcctctcccttcacccagacacgtggtagggatggaaaaggattcttcacagagcactctggcacaccatatcggagaaaacttgatagattagttaatggtttttcttgaattcgagaagcaaagatctgttctccatattggtatgttctccctcaaccaagatcttctaaaaagaaataatattttagtcttctgcttgaggaactgactgtgaagcgacgcccagtgaaaaacatgttcttgcagcagctctggtggcagctgtccttgaggaacctttggtgtgtggtgggaagctatcagaacaagaaatgtaggcatttcccgttttttttggggggggggtgggggggcagggctctgccctcttgaaaggcatttacttgtttaacacttgtccagctacagtggggtacagtagctggctattcacaggcatcatcatagcccactagtctcatattattttccttttgagaaattggaaactctttctgttgctattatattaataaagttggtgtttattttctggtagtcaccttccccatttaactttaactctaggaatttattttagtcacccaggaatttgtgattcaaaacagaggtagtgggattggttaagtactttgtcctcttattaccactggaaggaattcaaaaccacccatacctttcattatagatagatcaaagtcatctttagaaacgtactattttttccttcctgtccaactttaattttgaactgaagagatagcttccagttatggtggaggctgggcacagtagcccatgcctgtaatcccagcactttgggaggctcaggcaggcggatcttgagcccaggagttcaagaccggcctgggcaacatggcaaaaacccatctctatgaaaaatatgaaaactagtcaggtatagtggcatgcacctgtagtttagtcccagctactcagaa

SEQ ID NO: 103912 - DNA, 1905 bp, Homo sapiens
tcatagccacttaaatctatcattaagcactatttgggtgtatatcgtgacaaagttgaatttgggacaattcaagttgacttcagctttaagcaggtaacagatgcctttggtttaatattgcagaaatgattgtggacctgcatcgtgattttttttgtcccttgacactgtgtagtggcagtggctactttctattcaactctgagccaaatgccaggagagagagcttatagactagtgctacaggcaagatttaccccatttttttcggttagtattggcagcagggttctttgtgggagaaaactatgaatcagcttgttttcttcaaaaaacaaaaggaagtatgatacagtctcactaggttaatgatggtacctagttatctaatttaattctaattcagaataaggcaaaagatgcgtaattcttcatattcccatgagcgaagaataggtcttttatagatgttatcacaccttgttcctcacaataagtttgtgaaatagggattattattatgatgcccattttgtagttcctctgacaagcccaggctgttcaactaaaccttgtagtgtccttatttcactatgttgtccttttatttatttatttatttatttattttttgagatggagtttcactcttgttgtccaggctggagtgcagtggcgccatctcggctcaccacagcctccgcctcctgggttcaagcgattctcctgcctcagcctcccgagtagctgggactacaggtgcatgccactatgcccagctagtttttgtatttttagtagagatggggtttcactatgctggccaggttggactcaaactcctgaccttgcgatccacccatctgggcctcccgaagtgctgggattacaggcgtgagccatcacgcctggccttatgttgtccttttacaagtgtttctgggatgtgcccatggtgaaggcagtaacgccagtacctcatttcacgcacttggatcctgcctacccccagtaagtgggagagattgggccagataagaccacaccattgggccaggcacagtggctcatgcctgcaatcccagcactttgggaggttgaggcaggtggatcacctgaggtcaggagtttgagagcagcctggccaacatggtgaaaccccgtctctactaaaaatacgtggtggcacacatctgtaatcccagctacttgggaggctgaggcaggagaatcgcttgaacccaggaggcagaggttgcagtcagctgagccgagatcacaccattgcactccaatctgggcaacaagagcgaaattccttctcaaaaaaaaaaagtgagtacaccattgaatcttctgttgtttagggagatgagaaaggtcctgaagtaccaaaaacataatgatttggacctttctcttgtcctcaactctgatttgcatttaccttcaactatcaagtcacattctgctgtccgaaaatccaaatctagtctactagctagattacacttcattagaggcaggactttggtttgtctatttgcctctccttttctttaggtcatgatacagtgcctgacatgcggtgcaagcatggtacttgtattttggtgctgtccctgtaagtcatccagaggtatcccctgtagggtgtctagcacatagtaggtgtttgttaattacttctggtctataagcagtgaaagcatgataaggtaacagcagtgaagaaaagtaacaaacagttcctaaactagatacaggatatctgtttaagccatttaagacagcattttcttgaatttttgcatgggtctagctagagttcttatgtagcgtaagcttgcaaccagagaatgcttaataaatgttaattgctgtctgactcctctgaatgtg

SEQ ID NO: 103913 - DNA, 1755 bp, Homo sapiens
aacatcatcctgatttgatcttttgccgcaagcaggctggtgttggtgagactgcgccctacccctggctgtctgggcaggggtggtattaggagctggggggtcgggggttcccgtctcttccttaggggcttgcctcgcaggcgccacgtttcccgcctctcaggcgcggggtgttgtaggagcgcgcaggtttgtggcctctgatgagaagagggcgggggtgcgcgtgctgggagccccaggcaggtatcggggggtggggtctgaaccaggtccagagaaactctgagcttgcccagggcgttggaggagattcaggagggtgcttggatgtaggtttggttcatatggaaatttgtaatgataaaatggctatccgcaggtctcactcactgcagtccttactcatgtccctacccccagctcgaggatgtacttctcctctttctcaaaacctttattctaattgtactttttaccatctttcatcttgcagccatcggaagactgtgtgaaaaatgtgagtggaacacaccgtcccaacaacccacccttcccactcccagttttctgtggaaccagcaaaagtgccacaaagagggctttgagtagatgtgcctggaagtatgtgaacactgaatgctgcactttagccaaaggcccctctaactccccactgccgcttgcacatttaacgctgtatctctctagttttcaacgggaagaatcgccagagtagcatgacccctccccaacacacagcactttgccagcaattatacaggcttatcatctccgaggtgcttttctaagctcttcacatatgttaattggtaaacttttgtatgtgttgaggggcttgagatggacactggggaaaccaagttttgtgatgccaagaggagggccctaaagtcactgtcaaaaggagactagtgtatttcccaggagactagtatatttccccatggcaggagatagcagaggactgaagaacttgtgagcatgactccattctcttccttacaggtgatggcaagtgtgtgatttgtgactcctatgtgcgtccctgcactctggtgcgcatatgtgatgagtgtaactatggatcttaccaggggcgctgtgtgatctgtggaggacctggggtctctgatgcctattattgtaaggagtgcaccatccaggagaaggacgtaagtgtacagctttccatctgacctttcctccttttgtttagtaacactttgccatccactgcaatctcctatggtctatggagattactgtgttcatctagtcatctaggttataatttcttcaagttctgtgagtcaaactgggtgtagtccaataaaaggcagttattttgcatcaaggggaagaatgcaagggaagcaaatctttgtcaagaccagcaatttggagagccctctcattcatgtctctgtggttattcttattcagaaatgacatccggctgggcgtggtggcccacacctgtaatctcagcactttgggagtccaagttaggaggatcactttagtccaggagttaaagaccagcctgggccacagagcaagatcccatctcaaaaaaaaaaaaagtgttttgttttttgttttttgcttcttgttttttgtttttttgagatggggtctcttgctctgtggcccaggctggggtgcagtggcatgatcatgtgcaaggctcactgcagccttgaccccctgggctcaaacgatcctccc

SEQ ID NO: 103914 - DNA, 1081 bp, Homo sapiens
gagacggggtttcaccctgttgaccaggctggtcacaaactcctgacctcaagtaatcggcctgccttggcctcccaaagtcctgggattacaggtgtgagccaccacacctggcctcttcacgtcttttgattctctaggttaatgatgtggaaatagttgtttcttcctgtctcatgatttaagggagtcaggcaagattatttgataagataaatgattatagagttcttgaacttggaagagaagaatagtatcacaccattttgaaccgaaaaggatcttggaaagtatgagtattagactggtgtagaaggagatctgggctctctttcctgatcctgtgaccttgagtaagttacttcctgaatccattgtccattggagatgatcttcattgaacaaatgtatattcagcaagtggatgttagaaagtgatgagcaagtagaatgagtttacaaccatcacgtagactaacctcttatacaggtggaaaaatctaagaccttgagagcctgggtgacttccagtagcagagtcaggattaaaatcctggtctccttgtttgttccttcagctaagatgaatgaacaatattatgcagtttgcacactgcctcccaataaccaggctgtctcaaataaccaactaacacggtttctctgagaagcttgtatatttaccccttttgtgcttagatacatttgagaagtgatggttactaccttaatagtcatgtatgcaaaaccctatgcctgtagtcaattcattcctacctcattcaccatatatttactgagcgcccaatgcttgttctggataccgtggtaagcaaagacagtccctgttctcgtggagcttccactgtattctaatgtacctgactgcagagggccttggagatctttctcagccaaatatagtatttttctttccttggctggaccaaaggtgaaggtagataatagaatgatgggtgttactcccagcactaagagtacctaacatttatcttactgtgtatgactaatttcacatgactctgtgagatgaggcaggcctattagcctgatttataga

SEQ ID NO: 103915 - DNA, 1068 bp, Homo sapiens
atgagtaagataaataaggcttgatctcaaccctcaagaagcttatagtgcaggtagactaatagctatggtttggatagtgttttacagcttaatgagcactttcacttatggtcttatttaaccttcccagtaccccgtgtgatcaccagagctggttatatccctattttctatctcctctgggttttagtcaatgagggcttttcttacattgatacaccttacatgatagaacttgactttgatcccagcgatttttgtctataaatcccttgcacttttttcctaccccaggctgtgttccttgtggctgctttgtcatccctgtcctgcagatgaggaagctgaggctgcagttactgaacagctcttgacactttaattcctggatttttttcaccatactgagctgccctcggggatggactctcctaagtgctccattgacagtggctgtcatgtttcttcttgcagaaagctctgggtgtgcggcagtaccatgtggcctcagtcctgtgccaacgggccaaggtggcgatgagccactttgagcccaacgagtacatccattatgacctgctagagaagaacattaacattgttcgcaaacggtaaggctgcagatgggaggctgtgactgtcaagggcattgcgtctgctgcctgcccgtcaggcagagaaggaggtgttttgtgaaggatgcttggtgatagtggcagggtcaaggtattcaaggtacaaaggtttctgctgaggaaaggcattccagatcagtggtgtaacttctgtcctctctgccaagggagaatctgtgttatcaagaagcctctagatgtgaaccacagccaggtctctgagacactttggcactataacctgaacctcccaaccttttcagggcaggctgctgaccctcggcctgccctctggaagccaccaggcccagtgcctggagaatcatcttctatttcctcttcagtgcacaggcacagaggagagctcaggtctgagacccagaagataaactaagatgggacctttttaatttaattttattttatttta

SEQ ID NO: 103916 - DNA, 1027 bp, Homo sapiens
gtggggctgagggcacagagggaagtagcgaaatctagctgtgaacttggtcactctcctgagcctgtttcttggttgttgttaaatggctttcttggttgttgttgttgttaaatggcaggaatgatgagatatgcatgttgcggggacttagtaggaattacgatgctgggaaagccaggatcctttgaaaagaaccagcgctgccctcttgtgatgttgtcattcacttactcatcaagtaattgtggagcacctaacaagtgccaggtgctgcaggaggtgaggaggtggtgcagtgaacaggacccagcagtccccacccaagtggaacgttgaggtcctgagttcagactccctgtccctggccactgttgaggttgccacatggactgagagggagaggcagggcgggaggaggccgtgcagctagcaccaggccacccttctgctcttctccccacagactgaaccggccgctgacactctcggagaagattgtgtatggacacctggatgaccccgccagccaggaaattgagcgaggcaagtcgtacctgcggctgcggccggaccgtgtggccatgcaggatgcgacggcccagatggccatgctccagttcatcagcagcgggctgtccaaggtggctgtgccatccaccatccactgtgaccatctgattgaagcccaggttgggggcgagaaagacctgcgccgggccaaggtgagcagaaggtggctttgggggtgggcaagtgggcaagactgggcgagaggcctcaccctcacactggagcaaaccagggcattgcctccaaattctcacacctctttggattggtctgcttttaaaacttgattttacttgtttctctttctaaaaatagcacttgctcattatgttaaaaaatacagaggaagcctaaagaaagaaaaaatcatccttgaccttaccacactgcaggtcctttttctgtcctgttggaggatgatgtggatcctgccaggtgctctggaaggggccat

SEQ ID NO: 103917 - DNA, 1148 bp, Homo sapiens
ctggggcctcccaggacttcttcctcaggggccttgtggggctggagccagctcctggaagaaccaccaaccccgatgagaagccaggtggggatgctccacacccaggatgaggccgggcctgggcccatcacaggacagtttctctggttcttgtcacatcctggggtcatggtggtatgggtgtttggttactgtgctacaaatgaggaaactgaggcatggggcagcattcaaaggcccaagacatatagcaggaaatatcagagctattcaagagcccaggccacctgtctcccaaggctctggctcttcttggccaccctggagacggcctggattaaatggggctgctcctaccagttccatcctgggagagtggctggacgtggttgggaggccccgggtcagtggggccattttttggtattctcggctgagggcttctaaatataacatcttggattatttttcagattattctggaaaactatgcgtaccctggtgttcttctgattggcactgactcccacacccccaatggtggcggccttgggggcatctgcattggagttgggggtgccgatgctgtggatgtcatggctgggatcccctgggagctgaagtgccccaaggtgagggtggggagggactcattctgggctggctgtggggtggtggttggtggggatgaacgggagacggtgggacccaggagggaaaagggaacaagttagactcgaatcttctgggagggaggtagagaccaataagcagcaatgtgaatggcagcagggccatcctgacttcgtggctggcacaggcacacacggcctctcacagccgcctcgccccctcctgtccaggtgattggcgtgaagctgacgggctctctctccggttggtcctcacccaaagatgtgatcctgaaggtggcaggcatcctcacggtgaaaggtggcacaggtgcaatcgtggaataccacgggcctggtgtagactccatctcctgcactggtgaggaaggcggccaggcgacgtggcccctaccctgtgctgggcctgatgggtctccagttgggagtagaagcggtgaatggccttcacttgagaatctgtctgttccatttggggacttgggatagaca

SEQ ID NO: 103918 - DNA, 1032 bp, Homo sapiens
tttatggcatgaccttgaatctctctgagccagttcctcccctgccaaaaagaatagcaactgggcagtgtctggtcaggtcagcctacagtacgtggtgcctgttcaatctcttgggcgacagtcaggccccaagctcgcagctcagtgtgtgggggctgaatcttcacctgagtcctcttcattctacccagcagccaccctgagctggggccctgagctctgatccccatggcctcccctcaccggcccaggtttttacccagggcctcaagggatgagtcggcccgctgtcaccacatctctctgagtgggaggagaagcaatgcagctccctggtgtgaagatgcaggtggccgcgtagcaggtgtgtgggaccctggcccggccaccagccaatgcccggggctctgttgctccacaggcatggcgacaatctgcaacatgggtgcagaaattggggccaccacttccgtgttcccttacaaccacaggatgaagaagtacctgagcaagaccggccgggaaggtgagctggcaggggcaggcccgtgtgggtggaacagtcacatgcccgctcctccccaagacagagctatgcctttccctgtagggcaggggttcttaacccattgtctccagacaggcgtccgaggctctgagaaagccctgaagaggtgcaatatgtttctgagtagattgtctggagctctctccagcttctcaaagggcctggcatctgagttcaagatagccccacctcaggatgggcatttcattttccctggaaggtggctgaatgcccgcccttctcggcctggtccctgctgccccctacaggaaactccggaaatgacatggatcgcttctgttgataattcctgacctagcaggggaacatttggaaggagaaccactttcccagcctcccctgacaacttccctgaggctctagcctggcttctttggagctcagagggcattggcacctgtgaagggtggtgcgttgtgggagtgaacgaggagccagag

SEQ ID NO: 103919 - DNA, 1986 bp, Homo sapiens
aggctgaggcagaagaatggtgtgaacccgagaggcggaggctgccgtgagccaagatcgtgccactgcactccagcctgggcagcagagcgagactccatctcaaaaaaaaaaaaaagattccaaaagcaacatcgaatgggagataatgaacttaggaagctgacagccttgatccattccatgcctctgctgtctcctagctatgtgacttcaagcacagcatgtcacttctgagcttcagttccttcatctgcagagctgagcccagccttgcagggctggagggagcccgggagcgggtgtgtgcagagccaactgctcagttcttccctgtgatgaggtttcagtcaagagaaagtcgttggcctctctgtggggacgtggtgaggcagtgaaagaggctgtccccgcttcaaggtttcttccctcctctctttcttctccttgcatgtttgtttcttcagctgaagccacacatcaatgggcccttcacccctgacctggctcaccctgtggcagaagtgggcaaggtggcagagaaggaaggatggcctctggacatccgagtgggtgagcaccttccaccccatctgtttagcaggtctcagggccagtggctctgcccagggctgtagacaatcacctatgcctactgtgtggcactttctaaggtgggcagtttctgaaatgggtttattattgaaaaattactttttcggccagaagtggtggctcatgcttgaaatcccagcatttcaggaggccaatgcaggtggattacttgagtctaggggttcaagaccagcctgggcaacatggaaaaaccccgtctcttaaaagaaaatgcaaaaattggccaggggcagtggctcacacctgtaatcccagcactttgggaggccgagatgggtggatcatgaggtcaggagatcgagaccatcctggctaacacggtgaaaccccatctctactaaaaatacaaaaaattagccaggggtggtggcaggcacctgtagccccagctacttgggaggctgaggcaggagaatcgcttgaacccaggaggcggaggttgcaatgaaccgagattgtgtcactgcactccagcctgggtgacagagcgaggctccgtctcagaaaaaaaaaaaaaaattggccaggtgtggaggcgcatgcctatagtcctagctactcaggaggctaaggtgggaggatcacttgagtcctggaggtcaaggctacagtgagccgagatggtaccactgcattccagcctgggcaacaaaggcagactcaaaactgcagactcaagcaacagagcctgcctccaaaaaaaaaaaaaaaaaaaaaaaagaaagaaaagaaaaattactttttcttggcagaaaagaaaaatatgtttattgtagagaatattcacaatcaagaagaatttttaaaactcctaatctcaacccccagccaggagcaagctcttagagctcttggagaggtgtgctgtgtttctgtgtattgtgtgcatagattttcccgttttacattttatatcacccatgctgctttatgtgacttttcatgctttacacatgcagacgccctggcatgccagtcactggcatctgctgctgctgggtacagtgtggctgtgaagagcatggagcctggagccagatggcctgggcttgaatcctggctctgccacctaacagccactaacagctgagtgaccctgagcaaactacttcactgtctatgtgtgggttccccatctgtaaaacaggagtcatgatcgtactgacacctttgaaggtggtgttgggcctactgctgctatcaccaatgagaaaaataaataaaaaataaagttgtctggagaagtgacaatatgtgaaaagagatttctataccgtctggccgaaaataagggcaatataatgtgttcgcccttattcattgaagtaattttaagaaaaaaaatatttg

SEQ ID NO: 103920 - DNA, 4834 bp, Homo sapiens
gccagtcccaacactttgagaggctgaggcaggaggatcatttgatcccaggagttcaagagcagcctgggcaacatggtgagactttgtctctacaaaaacaatttattgaattagccaggtgtggtggtactcacctgtgggtcccagctactcaggaagttgaggcaggaggagttgcttgagccccaggagttagagactgcagtgagcaagcctcgactgtgcccttgcactccagcctgggcgacagagcaagaccccatctcaacaacaacaaaaagagactgtctagacagaaagtgcgatgttattcaggttttatagactttttaaaaagaactcttattgccctgattataaaacaatctttaaaacccagaaaatactagaaagtataaaagaagaaaattagcatctcctgtcagccccagcccatcaaggatggctgttcgtatgagccctctgacgtgcctacacgtgtacatgatattgctgtaaaaggggtcatagtcctaatgtgttcagcatcatggccaatggctacagcatctttcttcaaatgacgccacgtcatgagttagcctgtcctttattgttggatatttcggttgcttgcaactggtctctgttaaaaaagtctctggcccagcccagatggtgaactcttttggccaagtctggataatttgaagtcaggtggagacctctgctcactgtctcctcctgacccttaaccccaccacccacaatgcaccaggtctaattggtagctgcaccaattcaagctatgaagatatggggcgctcagcagctgtggccaagcaggcactggcccatggcctcaagtgcaagtcccagttcaccatcactccaggttccgagcagatccgcgccaccattgagcgggacggctatgtgagtgcccatatccccctgcccatctcccccaccccatgctgagtaatgcctccaggcggcacaagcccagaggcctgttgggccggggctggggcaggtcccagtggctgccctggggttccagtacagcacttcgtcctgcagccaccacatcaccccttcccatcagactctcacccacccttgacattctgtcttcctctctccctggcaggcacagatcttgagggatctgggtggcattgtcctggccaatgcttgtggcccctgcattggccagtgggacaggtaagaggcgtatcttttgacaagacagccccttgtgcacagggtacagagccccagaagttggagggggaattattggggtggagagaagagactccagccaaggtctctagctccagggactcttgcccattagaagcctctggcagacatgcctgggaagaggggctgggtgaggaagggccctgcagaggcactggggggcaacttggctgaagcctgggctggcaggaggaagccagcgcggcctcaccctgacggacacagcaggagccgtttgggaggaggcagtgccccaggtcaggaaactcaggccttgaccaaggccttgcctctggcttacgtgtggttgcaggctgggcccagtgatcctgaggttcccttctgctctgcgcgtggccccaggaggaggcaaccctggcagggcctcttcattttccctcggtaggagctaggctgggctgcgccacaggaacccagcttatctgtcctcgggacaggccaggtgacaaggccagatatccctaaccctgatccctctgacctggcaggaaggacatcaagaagggggagaagaacacaatcgtcacctcctacaacaggaacttcacgggccgcaacgacgcaaaccccgagacccatgcctttgtcacgtccccagaggtgagactgcccagctgcgcacaagcctgggatggcctctgggggtccctggcgggtcagaggaggaggcagaaggagatggggactggggtcatccaagtggtagccaggagctacaggccttcccagcctcaggcgcatgcttggtgcttcctgcctggggctccctgggtcatgggattatgagatatttatacagtggtttgtgcttatgagcatggaatttggaatctcactcactgcctaggacacatcccagccctgcctctaactcgctgtatgagtgtggccaagtcacttaccttctctgtgtccccgtaatcctcgggattacctgggaaagtgcgtgggacacatgcagtttccaaccccaggtaggagttccacaaaagcgaggcctttgccattgttcccgtggccagagtgagccttgcccttggcggtattcagccctggccgtgactggcacatggccaggctctcttgacttggttgtttatctgcgtgttctacaaatatgtcttgctaaatgggtgaaggaatggctccttccatgtttttagtgtcctgcgcactgagcaggtttgcatcataccagcatttctgcgccagggcccccactccctccaggatagctgtgaggagagagaacagcactgccggcccggccctgcagggatgggagaggccgcactgcccttggcttcctgagtcctctgcaggcccaaggccccgtggtcccaaagatcgtcctgcagctctggcctctgaggaacacaggggtctgggaagaacatggaaatttcctgggttcctttctcagttttggcctaggcttttggtaggtgcaggagacaggagtggcaattggtgctgaccaacaaactggccacctccatttcagattgtcacagccctggccattgcgggaaccctcaagttcaacccagagaccgactacctgacgggcacggatggcaagaagttcaggctggaggctccggatgcagatgagcttcccaaaggggtgagcgcccacgccccctgcttgctggttgctgtgtggccacgtcacttccttctcaacctcacagcacctcctgtgcaggcagggagggcgctgctagtgagaaggaagcagctctgttccctgggaggggaggtggggcccgaggaaacttgccttctgagagtctgtccttgtgggaactgaggactcagcaccccacgcatccccattccctgctgcaggagtttgacccagggcaggacacctaccagcacccacccaaggacagcagcgggcagcatgtggacgtgagccccaccagccagcgcctgcagctcctggagccttttgacaagtgggatggcaaggacctggaggacctgcagatcctcatcaaggtcagcagcatggggacggcaggacagccccaccctgccagggccccccgtcccctgagcatcgggaagggccatgaacctggaggaagtgagcacagtcaagacgcaggtgggagatggaagggaggtttggctgcagagcagagagggtatcgcaacgcagtccagcgtcccccttctctgtggccccgaactgggcagagctagatctggccagcctccgtctggggccctcagccatccagcagcagctgatcagagccacctccagtgggtgtgggcaggtgagtacagctcaggctgggctgggacagtgtgtgtgattgcacagcaggctccacacctggcacgtccacacaggctctggaagccatggacaactcctgcccccacagttgggcacccgtggatatgggatggcttgtgtttggcaccgaccaaaaacaagcctttttggtgtggccagaggcctccaatctgtgtcagatatttatttatgctgcttattaaggggtctccaggcacccctgtgacagaagagactaatcagtcatcagccaggacccaggcatgtcctgggctcctgtgtccagcatgaggtctgtggctgatcttgcagctgaggcctgaagggtgagcgaacattgacctgtcccaactttgggcggcctctgccccataagggagactgagcagccagaggcctttgaggggatgaaggcctggcctgagcccatgtggccttagggtggaagcaccaggaccacagaacacgtgtctgaagacttgcctgcctctcacccctctgtcacccctcctgggccccggggcctgctgcctgcctctggagggcttgtcatccacccctccagggccatgccctgacctctgtcctctctacttaccacccaaggtcaaagggaagtgtaccactgaccacatctcagctgctggcccctggctcaagttccgtgggcacttggataacatctccaacaacctgctcattggtgccatcaacattgaaaacggcaaggccaactccgtgcgcaatgccgtcactcaggagtttggccccgtccctgacactgcccgctactacaaggtgggtcagagttgataggggcaatgccagtggtcactcctgaaggggcctgcaaggcaggtgcagggaggacattaggggagtggaaactgggaaggaggccgaccaagcccaaaggggactgctgtggaagggaggagaggcctgcagcccctccctgtggctgagaaggcatgaggcccaggtccggtggtacagccgggtccctgcaccaggaggagttagtgagagatatcttaggatatctggccctagacaaagacaaggaagggggccgactcaggaagtcagaggccaaaagctcagagagggggctacacggggcctcacagtgagcaggcagagagggtctgaggtgattggactttttctgctttgagaaacaaacagaaccagggctgaacccaagtcctggcccagccgggtgaaaggactctggcaccccctggt

SEQ ID NO: 103921 - DNA, 1106 bp, Homo sapiens
aatgttgatggcaccaatgagcaggttgttggagatgttatccaagtgcccacggaacttgagccaggggccagcagctgagatgtggtcagtggtacacttccctttgaccttgggtggtaagtagagaggacagaggtcagggcatggccctggaggggtggatgacaagccctccagaggcaggcagcaggccccggggcccaggaggggtgacagaggggtgagaggcaggcaagtcttcagacacgtgttctgtggtcctggtgcttccaccctaaggccacatgggctcaggccaggccttcatcccctcaaaggcctctggctgctcagtctcccttatggggcagaggccgcccaaagttgggacaggtcaatgttcgctcacccttcaggcctcagctgcaagatcagccacagacctcatgctggacacaggagcccaggacatgcctgggtcctggctgatgactgattagtctcttctgtcacaggggtgcctggagaccccttaataagcagcataaataaatatctgacacagattggaggcctctggccacaccaaaaaggcttgtttttggtcggtgccaaacacaagccatcccatatccacgggtgcccaactgtgggggcaggagttgtccatggcttccagagcctgtgtggacgtgccaggtgtggagcctgctgtgcaatcacacacactgtcccagcccagcctgagctgtactcacctgcccacacccactggaggtggctctgatcagctgctgctggatggctgagggccccagacggaggctggccagatctagctctgcccagttcggggccacagagaagggggacgctggactgcgttgcgataccctctctgctctgcagccaaacctcccttccatctcccacctgcgtcttgactgtgctcacttcctccaggttcatggcccttcccgatgctcaggggacggggggccctggcagggtggggctgtcctgccgtccccatgctgctgaccttgatgaggatctgcaggtcctccaggtccttgccatcccacttgtcaaaaggctccaggagctgcaggcgctggctggtg

SEQ ID NO: 103922 - DNA, 2564 bp, Homo sapiens
tgggtggggcagagggtgctcccaggaagggggcgccttgagcttcacagatgcatcttgtgtggggcccggaggccgtccctgtctcacccaacctccctccacacacacctgcctctgccaagcaccaatgggtggcttctgtcttctttgccactgcaaacaaccacgtgcctctgtcccctcggggcctcgtttgggtctcattcacgcaggcttcacttgcccttaggcagcaggcgaggaagggcccctccagcccctttaccgggagcctcaggatgcccaggcgccaggtgggtgaggccaggcaggtagggccagacaggtgaggacggtgccctcctctgccttataaccttacccccgcttgcctgacagaaacatggcatcaggtgggtggtgatcggagacgagaactacggcgagggctcgagccgggagcatgcagctctggagcctcgccaccttgggggccgggccatcatcaccaagagctttgccaggatccacggtgagctggagtctgtacccaggccatcctcatcccatccctagtgatcaaggtcactctccctgcccgtggctgagttgggcctggttctaggctgtgtccactgcagcccacaggcccgtcagcctcttgccccttcttaggctcacacagtgcacatccgacgctcagcttcccggcttcccgcaggccctgcttccaggcttgtagatctgagccgctgagatctaggacatgtgccagggggttctttctgatcatgaatgtgcagcaggaaggcctcgcagacctcagcaccagcgcacacttgctaggggcacccctagtgaaagggagcagaccagggccccatagtcactgcccgggcattgtcccaggcagcaggattaggggcatctcccagagccccagatgggttcagaaaatgaagctctccaggctagtcaggcccccgatgaccgaatgccgcctgctttccagagaccaacctgaagaaacagggcctgctgcctctgaccttcgctgacccggctgactacaacaagattcaccctgtggacaagctgaccattcagggcctgaaggacttcacccctggcaaggttaggggcccgggtccccctgaggtggtggggtgaggggcagccaccttgtttcccctcctgcactggccccagggtagcttctcccaggaggcttcattccagctggaaaggcccccagttctccaggtggccccacagagaaagcaaagtggcttctcagagttgggggttggagtcaacccggggccctcacacctccccaacctccctttactcaccaggacctggcactcaggggacagcccacccactgcaggaccctctgggccccaggaatcccctgtaggtgccacctgggtctgacctgggccatcaggcacagactggcctaggatttggtttgcctgctgacctcttaggtccccaggcagtgccctgtctccctgacccccctgcggggccaagggcacacagtacccaccacttccacccacacccaccttctccttgcagcccctgaagtgcatcatcaagcaccccaacgggacccaggagaccatcctcctgaaccacaccttcaacgagacgcagattgagtggttccgcgctggcagtgccctcaacagaatgaaggaactgcaacagtgagggcagtgcctccccgccccgccgctggcgtcaagttcagctccacgtgtgccatcagtggatccgatccgtccagccatggcttcctattccaagatggtgtgaccagacatgcttcctgctccccgcttagcccacggagtgactgtggttgtggtgggggggttcttaaaataactttttagcccccgtcttcctattttgagtttggttcagatcttaagcagctccatgcaactgtatttatttttgatgacaagactcccatctaaagtttttctcctgcctgatcatttcattggtggctgaaggattctagagaaccttttgttcttgcaaggaaaacaagaatccaaaaccagtgactgttctgtgagtgattggtgtctgtgccgtttgttgtcaagtccagggtccaggaagggtcttttcagtcaaggtcagtggaggcccaacagccacagccacagatggatccatcactgcagtgaaggaggagcagggcctagatggtggaggagcggggcaagctggtgggcactcctggccttgcctcactgtccagctcgagacactatctccttagcatcggcctcagctgctgttgtcttcacagccggccataccaccttcccgcaggctggtagggtccactgtccagccccagggctagttgctggtccaccaggagagaaggcccaggcctggctcactgatggatccctgccagggataaagaacacgcacatttcactgacatgctggcttgaaccaacctggacaggaggtgaagggagcccagcaggcccagcacaggcaaagaagaggcggggcacacggcagccaagaggctctgg

SEQ ID NO: 103923 - DNA, 1039 bp, Homo sapiens
agacaagagcaacctgggcctcctgccacggagccccacacacccttttcatcaaagccttgtgacaggctgatgggcacccaaggacttgccgttttcaagaggacatagtgggatgggaggtcacctgcccacttggatgacaggtggtgagagaaccagccgggctgcgccaggttttctaacacatcctggagtcacatgcagacccagagccgtgctgccacccagccagggcagtcccccttggctctccatcgtccctggcagagcccacacaggggagccatgggttctctggtggcagtcccactgttgggtcctgcctctgtgccaggtcccgtgctgtgcaccgtgggtacagctgtgacatgtcagagtccttcccagtgaggagcctcagatttgtggatagccccacagaaacagacaaccccagtacagcaaggtgaggggtgggacagggacaacggaggcccaggaggaacacatcttagcccacgacccggcacacaggcaaggcctcacgtcccagggaccagtgcatgcctccagggcaagtgatctttaagatgattcctgcagggacaacctaagtgaagtgaaccggaagtgaatggtgtcccccaggacaccacagctctaatggtgtgcagtgtacaacccagacagccaagcctgatggccccgacaaagacaggcatgtgggcatcacatgactccctgcatgggaggcacagacaggctggtgcctctggagcaaaagcacaggcgaggggcaggcacagaggccagtgacatcaggttacaggccccaaaggccaccctaaggagtggggaccttcctttggagaggcctgagctccctgtgacaaaccactttaacccttggaggatacaacttggctggctgctgcagtgactctggggggatgagaatgtcatcgaagaagcctagagagactggaaggaaggaagcaggtgacggcctgagatgggggtcccagtggacgccaaacactgcggggtcttatgcttg

SEQ ID NO: 103924 - DNA, 1070 bp, Homo sapiens
tttttttttttttaagacagagtcttgctctgttgcccaggttggagtgcagaagtgtgatcttggctcactgcaacctccacctcccagcatcaagcaattctcctgcctcagcctcccgagtagctgggattataggcacgtgccaccacgcctggctaatttttgtatttttagtagagggggtttcaccatgttggtcagaatggtctcgaacgcctgacctcgtgatccgcccacctcggcctcccaaagtgctgggattacaggcgtgagccactgcccccagccccaaagactgttttaacaaggtaccaggtggttgtcacacgagctcatgttggataagccctgctgtagtccatactggtcagcctctcagcacagagatgccagaacattccagagtatgctgtgagactgcctagtgtctgtgtccagccattcagggaattaattagttcgcatggatgttaccatggtacgccgagaggccgaagaaacaggctgtctttgtacagactaggagcattttcattagcagagaaataagattgcagtgtgaaaacaaccacgagggcctctgtttacagagaaggatgccgagctgagcccagtctccgcatttggacaggggccttggttgtccaggagacaagtggtaataggtactagaacttccagaaaaacttggagaaaaaagtcaagttgcggccgggtgtggtggctcacgcttgtaatcccagaactttgggaggtaaaggcgggtgcatcacctgaggtcaggagttctagaccagcctggccaacatggcaaaacctcatctctactaaaactacaaaaaaagccaggcacgatggctcacttctgtaatcccagcactttgggaggccgaggcgggcagatcatgaggtcaggagatctcctggctaacacggtgaaaccctgtctctactaaaaatacaaaacattagccaggtgtggcggcaggcacctgtagtcccagctactcaggaggctgaggcaggagaatggagtgaacccaggaggcggagcttgcagtgaaccg

SEQ ID NO: 103925 - DNA, 1010 bp, Homo sapiens
gggggccaggccacacagccctgtaggatgtcggagttgaggtattggtctttatccgtggagcatcagaaggtgatgggctgagaaggagccagaaagaggatgcttagctggctttacgcatgagacaggtcccttcagaagaggtgaggttgatttgggggttgctagatagtgaagggaactcatggagtctttaagtggatggcttctggttactttgtgaggttgaagatgagggtctgttgggggatggaggtgtggaccttgagagagaaggtgtggaaagtccaagaagggaatatagtccctttggggtagaggtcctgttgggacaagtcttctagtatttgattagatgaatcgtttgagagggggcccacacagaaatccatggtctgacaaagggcacagatcttgtggcattatcttggtgaggtctggccacgactctgagttctctgagcttcttgctaattcttggacagttcttgcaagggttctaagtgggggtgatgacacggtggcagataaggagacactgagtagccagtcgtttgaaccacagtggtgtggggtgagggcatgggatttctgcacattcttggggcctaggtcttgtgtccctctgccagctgcagtccctgtggctgcgtctgtgtgtctgagatgttgtgagcacagtggggtttagctgtggctgtgacgctcactaaactgtgagctctggcattggctttgggatgtcggagagtgcacgtttaggcagcattcctgtcactggtcctcactagtaataacaaagatccttgatgatgatggtttccaatacacgagccaggtacaaggctaggggcttcacatctgttatctctctttattttataactctgcagcctggtatttcacatttgcagatggggagaccgaggctcagagaggtgaagtgaccctcttggcagtcacacagtgggtggtggagctggccttggaacctggacctgttttgt

SEQ ID NO: 103926 - DNA, 1031 bp, Homo sapiens
tcaggcgatgtgctctctagaagggagggtggtaggcagggggtgcacccagaggtggaggcagacagggccctccttcctggcctcctgggccaggccaccctcacccctgcctgggagtgaatggccacgaccccgggtgcacacacatcttggccccaaaaggactccaggtgacagcaacagccacacatcttcagggatggatgcaataagagccacacctcggccactggtctgttagggctttgggaagagagtttgacgtggaggccgcagggccagtctcccaggctgggggccctcctcgtgggtgccccggacgtgtgtccgtccctcgcggcatccacagcagccgtcagccgggcatggcccagagcatcagtggggcttgtgagtcagggtaaaggaggtctgcagccaagctggagagatggacccccaccctctgcaaacccctgggctcggctcagtacagcccaggggaaggagcccagcgccactgccaggctgaggaggagggactggccggcgaaatgggagccccaaaccccttccgccctcaggcccctcttcctgcctctccatggcactgagagagcagagcaggaaggaaggctggcctcggcagtgagaggcctgtgtgcctccgtgtcagtcctcctcccctgccagaggctgagaggctccccaaaagcacccatcggccaggcttctgagggaagggtccaggctgtggcgggggacctcagccaagggagggagatgtaagtagcacagagagcctggctccgggccagggactgacacgggacagctcaggggcggaggccagggagtgagcccagcgcaggctctcgcagctcagtcaccgtggggacgggtaagcaggagggcgagcgggtcctgcgtgtctgcggcagggaggggaggagagaggcagtggacagcgcgaagccaggtctggtggccttgccctccacctacctcctggccagcttgcacagtagtcacgggtcgtggggtgggtg

SEQ ID NO: 103927 - DNA, 1524 bp, Homo sapiens
atgcccagggcctgcccgtcctccccctacctctcctggcctcctccgttgctgggacgctcgttctcttccctgcctcaggggctgtactttgcgccccagccatccccactcggctcaggtcccagctcattgccacctcctcagaggtctcccctgatcaccctggccggatgagcttcccccacccacttcatggtcttgttcattctccaacctgtgtcataacttccttgaggatcctaagtctgtcccgtgtcctattcctggccctcagtaggcactcaagggttgttgaatgaatgaatgaacaagcagcccttctgttagccttgtctgcccctcccagcagggaataacagtccccacccctgcccacaggaggcatgatcagctttgacgtcttccccgagggctgggacaagcgctactgcctggatagcctggaccaggacagcttcgacaccatccacttctttgggaacgagactagccctgtgagtgtggcccaccccaggtttcccctaacgcagtggacagtgagaagccaggtctggtggcttctccaatgcaaatcacctgaggtcaaggccagaacatggggcaacacaacagacctcttagggggctcctggagaacaaccattgctcaccagccccgttacacagattggaaagctggggccccaagaggctgggcacttgttctacatcacacagcaagtcagggcaggtctgacaaggggtgagaaggtgggcttcctggcagttctgaaggggcaggaggaggggcaggtccgtagcagccaatgtggagagggactccacctaaatatccctcctctgcccatcctctgtgtgcagggtgggaacgactttgagatctttgccgacccccggactgttggccacagcgtggtgtctcctcaggacacggtgcagcgatgccgggagattttcttcccagagacagctcatgaggcgtgaccggggcccacatctgtgtgtcgtgacttctgaagagtttggcctaggcctaaagagaggtcctggtgttggatagatgccagggcccctcctctggcccaggacgcctgctgcaagcccacccagatggggccagagtctgtgtggacaaccgtccccagccagtctgctcctagtggcactggcttcgtcctcccagggcccagagtgttccccatgctccacctggtggcccaggccacagctgctgcttgtatttcggtacagaagaggtttctttctgcaccaggaggaggcgtgctcaagtatcggtacgagatctagcctgccctgcctgcctgccctgggcgatgaggtacggtggggaaggtgcctattttagagaactttgtcacagtattaaagttcccagaacaaagtaggtgtcagctgtgtctgaatggataattggccccagtcacatgctgtcacagccactactttgccgacaagtaaacagcacagagagggcagggacttggcccaggtcacaaagga

SEQ ID NO: 103928 - DNA, 3701 bp, Homo sapiens
ctcccaagtatctgggactacaggcacatgctgccacgcccggctaattttttttttttagacagagtcttgctctgtcaccaggctggagtgcagtggcacaatctcggctcactggaacccctgactcgctggttcaagcgattcttctgcctcagccttcccaagtagctaggattacatgcaccacaatgcccagctaattttttgtatttttagtagagacggggtttcaccatgttggccaggatggtctcgatcttctgacctcgtgatccgcctgcctcagcctgccaaagtgctgggattacaggcgtggccactgtgcccggcctaatattttgtattttagtagagatggggtttcaccgtgttgcccaggctggtctcgaactcctgagctcaggcaatccacccacctcaaccttccaaagtgattataggtgtgagccactgtgcccggcaagaaataccttttgaatgaatgaaatgagctgtattatctccattttataaatgaggaaaccaaggctcgatgagaagggccctgcccgaggtcacatagggagttggttgcagagcaaagatttgattttgccattggccctctggtgcctccctgagggtgcctctcagctcagtgactcctgactcccacctgtgccctgaggcttaggggaggcagtgcccacaggcacagggactttttttttttttcttgatagagtcttgctctgtcacccaggctggagtgcagtagcatgatctcagctcactgcaaccttcgctgcctaggctcaagcaattctcctgcctcagcctcctgagtagctgggattacaggcccatgccaccacacctggctaagttttttggttttggttttggttttggtttggttttgggttttttttttttttttttttttgagatggagtctcactctgtcgccaggctggagtgcagtggtgagatctcggctcgctgcaacctctgcctcccgggttcaagcgattctcctgcctcagcctcccaagtagctgggactacaagcgcctgccaccacgcccagctaatttttgtatttttagtagagacagggtttcaccatgctggctaggatggtctcgatctcttaaccttgtgatccgccctccttggccttccaaagtgctggaattacgggcatgagccaccgcgcccggcctaatttttgtattttttagtagggacagggttttgccatgttcaggctggtctcaaatccctggcctcaagtgatctgcctaccttggcctcccaaagtgctgggattatagatgtgagccgctgcgcccggccacggggactttttttttggggtagttaggattggtcttaggcaaagaacccttcccccccaatacacgtgctgagaagttatcccttcctgtccacccaggttcccagtcccagctctacccatttgccttgtaacctggaaaagcatctttactaacgtgtgcctcagtttccttatgtgtaaggtgggggtaatagcagttcccatcccatgggctgtcatgagcactggatgaggtggcacatggaccccacctggcatggagttggggagccacaccctaactccccaccccagagccttctcaagtatttttggctcttgtttgctcccttctggcactggaggagcatgaaccttcctgatctgtgcgccctgccctggcccagagctggtgtaaataaatgcttaacccagctcatcttccagaaccctgaagcggggatgagtacttcccttccttagatgaggacactgaggccagagggtgagtaaccagctcgaggtcacagtgccggtccctgctgaggctggccttgcacatggggctgtctagtgaccagccttgttctccagagaagggaggtgcagccagcctcggccatgtggaaacatttcttcagagcctggggcagtcttagtggtagccctgggcctacagagtggacgctggtggggactctggcctccctggggcccacctacctgctggaaagccaggccaaggctggcagggggctcacatcccttatctctgcttttccatgagagggaagcaggcaggggtcattcattacttctctgtcctttagtccaggaaataggctcagagaggtcaggtgacttgcccatggtcacacagctgaggagtacagtagccaagcctggctacttgccttcagatctcaggctagggggtgtctggctttatatctgacatcctccctgggccacttctccaagctccatgctgctgaccactgcctgcctttccgccccagtcctacccggctctgactacagggccataccagccaccccactcctgtgctccagaatcctcagcgcctcttggtcccccaggatgtggtcagacttcccagcccggtctcgagaccctctgtcagctgaatgtcctgctggctggtttagatgttcagctgcccctcagactgggcatagctgctcccctttgtggccctctgagatggagatcctgggggctggcggggagaatgtccccctgctccacgtttgcggagctgctgccagagttcctgctcagagggacggggccggcctgggcactacctagtccccagcccagccgcgtctttgcatgctgggtgctctgccatgcctggcatcctgctgccctctgtgaatgcccacagccacctcctcacaggtctcctgctctcagctcccatgctcatttctgagtatttgctttgttgagctggttacagataacaggatcgagccctgccctgaggtggacactgatgtgggatccagattgccccgtctcctcgcccttcctactcgtgtctctcctctgaggtctccttcagaagacccagcccacagccccattggcagccccatcccttctggatttaggccctggctctgccaccagggctaggtgaccttgaccaaggcacaacccctctctgagccttagtttgcgcatctgcacagttgggggtcctacccacctagaatgctcagcacgctcacgtggactgtgtgcccagccagggcctggcacacagcaggtcctctgagctgccatccgctccctcccctctgcagaaagagaagatccgggagaagttcgtggaagccctgaaaacagagtttgctggcaaagggctgaggttctctcgaggtacgtccaccctgcagaggacctgggaggcctggtacagggcccctcctcaaaccatctgcccctgccaagaccaggctgtggcccccagtagctttagtagcccctccccggctcagggcagagagggtggctgagcccgatgcagaaaggggttcagtgtttactggcccccagttttccccacctcatacctcagaggtaaacgccccatgcccacccagtttctcaggccaaaaaaccagagcctctcccttgaatgctctcccccaccccttcccaagtccaaactcctagaagtcacagggccccctgtctggaatcccaccggtgctcacacttccactgccagcagcttgtcccaggctccaactgaccctgacacaactgggctcccctctgccacctcacccattccccagtggccagagaggctggagctggagtcatgacatgcctctgccc

SEQ ID NO: 103929 - DNA, 1903 bp, Homo sapiens
acccactccaactgcttcgcctggcagtcagagctgaaacctccaactctcccatgcagccagccttgagaacccagtgcgatggcagctatagaacagaagggagcccctctgcagaggggcaggggagcacagagtggaaatgatgccctctgccagagagtactgcatggcttccagaggaggaagctgaatcttggaggatgagtggcagggaagccagggaagggcggttctgacagaaggacctgcatggatgcctgtgtgcagaggcccacaggtgtgactggcttctttggaagaaaaccaagctgcagagggagaaaggctggagaagcaggttgtagcctcagattgaacaaatggcctttgaatgtgaaaccaagggtgtaggcttcctctctctttacttgcccgtggggtcacagacgtggtctcacactctttcttcctcctgtcctctatgtgaccctgaagtcattgagaagtttgattatgtgtttgccgagaacgggacggtgcagtataagcacggacgactgctctccaagcaggtcagtgtcccccagggcttagccaggggcaccccacttttccatagtggagcagtccaagggggcttctgtcctgggctgggggagagacactgtgcctgtctcagggtcaggcagcccaggccacgctcagagccctgtgttccttggccagaccatccagaaccacctgggggaggagctgctgcaggacttgatcaacttctgcctcagctacatggccctgctcaggctgcccaagaagcggtgaggtcccaccagcctggtctccagaacctggggcctgagggaggagaagtgtgggtccctcagagggaacctggagatacttgggcccctgattttttgcggggagtgtggattcttgtcccctttgaagtcctaggaggctggggtcccaggtggggctagatttgaattcagggccgttctggttctctctggctccccgccctccctcaccaccagtggaaccttcatcgagttccggaatggcatgctgaacatctcgcccatcggccggagctgcaccctggaggagaggatcgagttctccgaactggacaaggtaccactagctatgcaatcttaggcctgtagggcctcagtcactcaatttatctgagcctttattttctcatcagtaaaatagactgggggatgtgttctgatttaactgataccctttcaggcacctactgtgtgccattgttgtagacacacctgcatctttacaatgctgctggtcccccttcctaggtgaccagcaccaggcagccacccactgagccaggccaacacctgggaacatcatttccaccttcccacccacatcgggtccaacaactcttatttcatcagcctctcgagtcagtgtcaaatctgttcatctgcagaactgagaccccactttctagattacccctttccccagccccaggctgccccaactttcctctctgtccctccctaccccttgcatagccctgccagcctgctctccagcaatgccactgagaacctttctttctttttctttttggagatagagtctccaaaaaaatagatagaggctggagtgcagtggcatgatctcagctcactgcaactcccacctcccgtgttcaagcgattctcctgcctcagcctcccaagtagctggaattacaggcatgcaccactacacccagctaatttttgtacttttttagtagaggcagggtttcaccacgttggccaggctggtctcgaactcctgacctaaggtgatccgcctgcctcggcctcccaaagttctgggattacaggcatgagccaccacgcacagcccattagaacctttcaaacat

SEQ ID NO: 103930 - DNA, 1050 bp, Homo sapiens
tggtggcaggcgcctgtaatcccagctactcgggaggctgaggcagaagaatcgcttgaacccgggaggcagaggttgcagtgagctgagatcacgccatcgcactccagcctgggcagaggtttcagtgagccagaatcacaccactgcactccagcctggatgacagaacaaaaattcgtctccaaaaaaattttttttttcatagagacaatgtcttcctttgctgcctaggctctagtctcaaactcctgggtcaagtgatctttctgccttggcctcgcaaagtgttgggattgcagacctgagccacagtgtccaacctgtctaatttttggtgtctaagctttgtactgcttcagatccaggtagaatgtgggcttcctgggttctcagcactaagtgagggctaagtggaggtcccagacatgttgaaagccagaatgctatgcttcccctctccccccatagaaaattgaccctgaggtggccgccttcctgcagaagctacgaagtagagtgcagatcggtgtggtgggcggctctgactactgtaagatcgctgagcagctgggtgacggggatgaaggtaggagtgaggctgggggtagagggagtggggagtttgagagattcctgggcgtcttcaaagatccagtcctgcttctgtggggcagaagaaatagagagagagcagccagatagttcccttactgatttgacaaacacttgagcacttcctattgccagggattgtgccaggcccttgagaaatggctggggcaaagcaagcagaacctgcccttatgcagtttacattctcatttctccctgctgagtcttgatttcctcatctttaaaatgggctgaaccagccggcacagtggcttacgcctgtaatcccagcactttgggaggccgaggcggatggatcacttgagatgaggagttcaagaccagcctggccaacatggtgaaaccccgtctctactaaaaatacaaaaaattagctgggtgtgttggcacgtgcctgtaatcccagctactcgg

SEQ ID NO: 103931 - DNA, 1033 bp, Homo sapiens
ctagctagtcgggaggctgaggcaggagaatcacttgaacccgagaggcagaagttgcagtgagccgagaatgtgccattgcactacagcctgggcgacagagggagactcagtctcaaaacaaaacaaaacaaaaagtagatgggcgtggtgtcgtgtgcctgtagtcccagctactggggaggcagaggcaggagaatcgattgaacccaggaggtggaggttgcagtgagccaagattgtgccattgcactccagcctgggcaacaagagtgaaactccgtctcaaacaaacaaataaatgaataaaagaactggaacaaaagtggcagggcctaggcacagttctgactcctccctctgaccttttgctccacaaacataacaacctgaataagaacagcctattaatttgtctacgggccagcctctgtgcttagtgccttttgaaagttaatttttaatcgtacacattttcatgagcacactctcctggtaaagaatggaaacgtaacagagaagggtaaagtccactctgaccgcacttggggagcctggccggctccccaagttaatgtggttactgtggtgtggcttccctccaggcctttatctggatctatttgcccagagcaaatattaagcattgttttgtgaggctatttttgttattgttctttggctcctcaaaaatcaacttgattgtgatgctattttgttgttgttgttgttagagaccggggtctcactctgtcactcagtctggagtgcagtggcgctatcacagctcactgcagcctcgaactcctgggctcaagtgattctcccgcctcagcttctggagtagctggtagctgggactacaggcaagtgccaccatgcctggctaatatctttttttttttttttttttggagatgaaatctcattcttgtcccccaggctggagtgcgatggcatgatctcggttcactgcaacctccacctcccgggttcaagggattctcctgcctcagcctcctgagtagctggg

SEQ ID NO: 103932 - DNA, 1030 bp, Homo sapiens
aggccccgcccgacccagccccttaatcggcctgttgcaatcactatcaacccgccaattctggccccgcccctgtcttccgggttcaccctctcacttcctgcgggtcccaggctcaggcccctcctccgccttgtttggagcaatccaatcgaacctggagggctccgctccgccctatgccgcgctcccctcctccacgagcaatgagaatcagctcaggccccgcccccgcttccgcccgcctagaccacgccccttcttcatttggccaatcaggcagtccactggcccccgccccctaatgccccgccccgtcagcacttatccctgagctgcttctgccgttgcatcttcgggactccgccccgcgcgcggacctgcagccatggcagtcaccgcccaggcagcccgcaggaaggagcgcgtcctctgcctgtttgacgtggacgggaccctcacgccggctcgccaggtaggaccctgaagattggaagctcccaccgggagtgtcacgcggacacccccgaggctgagtgtggggtctgcagcagcgtgaccgtggacacccggggaccgagtgtgggatgcggcggtacccggccccctgacatccggggccacccaccgggagtgaggggacctggccctcacgtcactgaccccgcagcgtccttgcctgtgttctgcttgggagtgctggggttggatccagtactggagggaggaggctgcgagcaggggcctagctccctccctccccggaggctgtcacacgccgctaaggcctggctcacggacgcccccgcctcctgagctggggatcccaccctagttcagccctacgacacaccagtggtcggagctggcttctgaaccggggttccaggcacacaagcacacagccaagcgtcagtcatcatctggtgggagacagggcgtctcggagtcttcccaccccgacctttgcaggcctgggactgggtctagtttctgaagccccatcacccactttaccttccacccccag

SEQ ID NO: 103933 - DNA, 1064 bp, Homo sapiens
agcactttgggaggccgaggcaggcagatcacttgaggtcaggacttcaagaccagcctggccaacatggtgaaaccccgtctctactaaaaatacaaaattagccgggcatggtggcgcatgcctgtagtcccagctactcgggaggctgaggcaggagaatcgcttgaacccgggaggcagagattgcgatgagccgagatcgtaccagtgcactccagcctgggcgacagagtgagactccatctcaaaaaaataaaataatgaagtggaatcaaggtggcaagaaaatttagaatcgtttctgatagggactttcccttatcctaaatgtgttttgaaggcacacgttatttccattgtcattctgactttagaaaggcaggttggggcatgagtgggcattttcctaatgacttgctgctaggaggttataggcagggaacagtctgggagtctctaatccagagagactttcagattccctctcttcacatgaacctccattagttagattttgggaaagtgagcatgaagaagggactcagagctgccaggtacccgagtctcaggtctgacatccttgggccccttctgccacaacttcttgccacttcacggacttgaattatgttgcttcttcctggaagtctggcctgcagcacaggcctttcctctccaaaaagctgctgctcatttctggccccatctgctgctatctttgccatcagccatcacagtttggcatcatcagagtctcagctagaggagctgtcattctgccttagtgtttgcctgcgacctgaccaggggcatgaccagctgggatgtcaagtgacatttgggaacttgtagaggccaaatgattgaaagtttaattcttctcaagacccactgatttgccagtgtgcatggaaataatagattagagcagaaactagcagggactgttgtataatcgtgatctactagcagaattgggcccaaagagaaagaatttctgaggctgggtttcttctgggagggtagcaggttggtcttggccagtgctctgtttcccacca

SEQ ID NO: 103934 - DNA, 1137 bp, Homo sapiens
gagtgcagtggcacgatctaggctcactgcaagctccgcctcccgggttcacgccattctcctgcctcagcctcccgagtagctgggactacaggcgcccgccaccacagccggctaattttttgtatttttagtatagacggggtttcactgtgttagccaggatggtctcgatctcctcaccttgtgatccgcctgccttggcctcccaacgtgctgggattacaggcgtcagccaccatgcccagcccacatcagtcaagttttaactaaacttcttggaatggagccatttagttgtttgtttttttatcatagtgaggaatcagatatttcctataccccacgtaaaacctccccctttacactgggtattttttatcctattacctaataattattgggcagctgaaaggagccttaggagtcattatttcattcattcagcagatgtttattgagcgtctgctctatgctagtcaacgtgttaaggtaaatgaggttgatataatgaacaaagatgttctttgccatcatggagctatctaatgggggagacattaaaaataaatacataaataattagttacaaattgcataagtgccttctgcacaggaagcacactgggtgctgtgatagaaaataacaagagagaccttttttttttttttagacgagtcttgctctgttgcccaggctggagtgcagtggggtgatctcagctcactgcaacctctgcctcccaggttcaagtgattctcctgcctcagcctccagagtagctgggattacaggcgcatgccaccacacctggctgatttttatatttttagtagagacagggtttcaccatgtttgccaggctggtcttgaactcctgacctcaagtgatccgcccgcctcagcctcccaaagtgctaggattacaggcatgagccactgcacccagtgaagagacctattttaaataagggtatcaagggtagtgactttgaaagtgggaatttaggatgaggaagaagtagccacaggagggtagtaagggagtaacagtgttccaggtaggagaaagatcaacctgccaaagccctgagacaggaaagagtctggcctgatactggaactgaaagaaggct

SEQ ID NO: 103935 - DNA, 1058 bp, Homo sapiens
ggcgcgagcagcgcagggcggcctctcccccacccctcagcccgggcccgggctcggtccccccctctccctccgcttcgcactcccgtcgggtacgggaaggtccaagccgctgccgggtgcccgagggccgtcgtggccgccgtcgccacgggtcccaatggagccgccgaatctctatccggtgaagctctacgtgtacgacctgtccaaaggcctggcccggcggctcagccccatcatgctgggtgagggggaaggggccaggtgggcaggagggcgggagccaggccagagggtggcggctggccgaggtggggagacttgggccacgactcacggggagacacatggccaggaggatggaagaaaagccgagtggagaagagagtggtctgaagtttgggccatctgagccccgctttagcctcgcagataccatcctcacgtttgaattcaaggggaagggatggaggagtcatgcctccaccttgcagggggcttgggcagaaaccgagccctcgagagccccttcgacgagggtgtggggtaaaccagcgctggatcccggcgggttctctgcctcgctcgggtagcccagtgcactcctgcctccttggcgcggtgtaggaaaggtgaggatgcctgccgcgcggtgcccctcgtggtgacagagacactgcggaggtcgggtggctctcggagaaccttgtctcagtgccaaaaggaagctccctttgcagtcccagggataggtgggatgggggagatagagctgcctagggacccagccatcgcccccaggtaggtcaagtcaggataagaggagccccgaactccagaattcaccaagcagtcttctccccacagtttctaagttaattgcttttgctcaaatggcaagaaagcagttttgggggaagtttggatgaggctgtgtgaataaggattagtaaagaaagtatttcggttgtgctccattaaactacttaactggcaggagaaaaaccagccctcattcagtgacgatcacaccttatttcaacttaaatacagga

SEQ ID NO: 103936 - DNA, 1047 bp, Homo sapiens
ttttttgagcaccgacctaatgttcaaaggaagtgcttattggagcattatgggttgttagatttttgggttgggaatattcaaccagtaagtactataaaatgcaaatattccaaaaaaaatctgaaatctgaaacatttctggtcctaagcaagcattttgcaaagggatacgcaacctgtagtacgttctttatcattgttttaagtagttaatatattgtggtacagattctgaggtggtatagcaaattcgattgtattattaaaaagcatatttatattttgagagcttgcttaggattattggagagaataaaacagtgaagctttggtgttatgagggaattttagatagaaaagtgcagtttttcagttcatgctctttcattttttactccctcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcaggtaggtagagatgccttttgttgttgttgtttttgagacagggtctcattgtgtcgcccaggctggagtgcagtggggcgaacatgactcgctacagccttgacctcctggactcaagcgatccttctgtctcagcctcccaagtagctgggatcacaggcatgtgacatcacacccagctaatttatttatttatttattttttaagagactggatcgactgggcacagtggctcatgcctgtaatcccagcactttgggaggccgaggcaggtggattaccgaggtcaggagttcaagaccagcctgaccaacatggagaaaccccatctctactaaaaatacaaaatgagctgggcatggtggtgcatgcctgtaatcccagctactcaggaggctgaggcaggagaatcacttgaacccgggaggcagaggttgcggtgagccgagatca

SEQ ID NO: 103937 - DNA, 1049 bp, Homo sapiens
gtggggtcctccaacccttacctgttgagatattataagccctttaaaggcttggtgtggtggctcatgcctgtaatcccaacactttgggaggctgaggctggaggatcacttgagcctaggagttggagaccagcgtgggtgacttagagatactttgtctctacaaaaaatcttaaaactagctgggtgtggtggtgtgtgactgtagtcccagctattcaggaagcagaagtgggaagattgcttgagcttgggaggtcaaggctgcagtgagttctgattgcagcactgcactctatcctgggtgacagagcgagaccccgtctcaaataaataaataataaaattaaaataagccctttaaagaaaatggaagagaaactttagggctaaaagagaagaaaggaggaaacctttttaggaggctagtcactgggctttttgttttctagggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccaggtatgtggcagagatatttccagggcttctgaaccttgcccatactttggaatcatccatggactcctaatgcagacctactgaatcatagtctctgggaatggggcttaaaaatgtctatttttaagctttcttgggtgaatttagtgcacagccaggtaaggccactaaatatggtgatggggtgcacagcatgcgcagccgtacaaggctgatctgcagctaggatagagaaatgtctgcctaggggactgtttgcagattactgacacaagttcttgggacctcactgccgacacctttctttccaaagccattgtttggcacccttgtaatgtctaatgtttggtttagttcctatacaaaccaaccatggggtttgccaagatagtgaggtatagcggaaagaccatggattttaaagtcagattt

SEQ ID NO: 103938 - DNA, 1064 bp, Homo sapiens
tttagtagagacagagtttagtagagacagagtagagacatgttggccaggatggtctcaatctcttgacctcgtgatccacccgcctcggcctcccaaagtgctgggattacaggcatgagccaccgtgcccagcctcttatattattttttaaatttcaccagcatgtagtcacagggcggcctagtgcagaggcaggtctcagaagcctgacactctcctcctctcactatggaaccagccaaatctgttccctggctgtttaagctggtctggaaaagcttccaaacagagggggtctggggaatgaggttaagtgtttagagaggactgggaaatgcacccaaattactggtgcagagtggaaccagtaagaaagcctcccatgaaaagaactactctattcaacctccttacatgtcaggtccactgcttgttccggctccatcaaatccaaggccaaggcctccaggttcctgaagtgctgctgcagcacggggttctcaaagctgtcacttctgttaaaacaataatgtaactcaactgaaacatgacaatttaaacattgaaaaaattagaataaaaccacctgagatactacaggtccggggtgagctgagaaaaacaccccaagtaaaacagttgaggtcaggtgcagtagcccatgcctgtaatcccagcactttggtaggccaaggtaggcggaatgcttgagtctagcagttcaagaccagcttggacaacatggtgagaccctgtctctacaaaaaatttaaaaatcagccaggcatgttggtgcacgcctgtggtcccagctactcaggaggcataggcaggaagactgcttgagtccaggagatcgaggctgcagtgagccatgatcgtgccacggtactccagcctggatggcagagcaagactttgtctcaagtcaacttagaaagcaaaccagcctgggcaccctggctcatgcctgtaatccagcactttgagaagctgaggcaggcggatggcttgagctcaggagttccagaccagcctgggcaacatggtgaaactccgt

SEQ ID NO: 103939 - DNA, 1120 bp, Homo sapiens
taaaattccaccatccaaaaatataaaactgcttcaggggtggtgatgagaacactggagtaagctgggagaaatgaccagcccaggatgcacagaacaggtccgactggctaaggtggctgccaggttcccccaggtgtgcttcttgctagagcaggggtatattggcccaagctggcaaagaggggatcactatggtacccagttacttgcaccttggaagatttctcaagctgagttattaggctctcaaggaacttatccttaagataataagtagaagaggcaagtgagggggcagtggctttagtcaccaataccaatcctgcatgtgccaagggttactagaaaccctgattctccaacagtgattctcaattgggggtgattttactgccgggggcatttaacaatgtccggaaacattttttggttgtgggggggtgctgctattgccacctagcgggtagaagccagtgatgctactaaacatacaacacacagggcagtcctcacaacaaattaaccagccccaaatgtcaacagcacggaggttgagaaagccagttccagtgatagcaatgctccagttgagtgtgtataagacgacattttgaactgccaaggtagaaactacctggtaggaggagacagctcttccatagccttctggtaaaaaaaagtctaagcaagtggccaggcgtggtggctcacacctgtaatcccagcgctttgcgaggctgagacaggcagattacctgaggtcaggagttcaagaccagcctggccaacatggtgaaaccctgtctctactaaaaatacaaaattagctgggcgtggtgacgcacgcctgtaatcccagctactttgggggctgaggcaggagcatcacttgaacccaggaggcagaggctgcagtgagccgagatcgtgccattgcactccagcctaggcaacaagagtgaaactctttcacaaagaagaaaaaaaaagtcttaagcagctatcaccactctagtaaagctaagtatgtcttcattccaattttagccggatacttactaagaatcaggcactgccattctgtcatcaaaatggaacagatttattaggatgctca

SEQ ID NO: 103940 - DNA, 1068 bp, Homo sapiens
ttcctgttgtgtgcggggtgtggtggaattaaacagcattcattgtgtgtccctgtgcctggcacacagaatcattcatacgtgttcaagtgatcaaggggtttcatttgctcttgggggattaggtatcatttggggaggaagcatgtgttctgtgaggttgttcggctatgtccaagtgtcgtttactaatgtacccctgctgtttgcttttggtaatgtgatgttgatgttctccccctacccacaaccatgcccttgagggtagcagggcagcagcataccaaagagatgtgctgcaggactccggaggcagcctgggtgggtgagccatggggcagttgacctgggtcttgaaagagtcgggagtgacaagctcagagagcatgaactgatgctggcatgaaggattccaggaagatcatggagacctggctggtagctgtaacagagatggtggagtccaaggaaacagcctgtctctggtgaatgggactttctttggtggacacttggcaccagctctgagagcccttcccctgtgtcctgccaccatgtgggtcagatgtactctctgtcacatgaggagagtgctagttcatgtgttctccattcttgtgagcatcctaataaatctgttccattttgatgacagaatggcagtgcctgattcttagtaagtatccggctaaaattggaatgaagacatacttagctttactagagtggtgatagctgcttaagactttttttttcttctttgtgaaagagtttcactcttgttgcctaggctggagtgcaatggcacgatctcggctcactgcagcctctgcctcctgggttcaagtgatgctcctgcctcagcccccaaagtagctgggattacaggcgtgcgtcaccacgcccagctaattttgtatttttagtagagacagggtttcaccatgttggccaggctggtcttgaactcctgacctcaggtaatctgcctgtctcagcctcgcaaagcgctgggattacaggtgtgagccaccacgcctggccacttgcttagacttttttttacca

SEQ ID NO: 103941 - DNA, 1032 bp, Homo sapiens
ttgtagggtgagtaagctatagtaatatcaatagaaatgaacatgctttgcatttgccatgtgtcaggtattattattattatttattttacttttttttgagatagggtcttactctgcagcccaggctggagtgcattggcattgatcatggctcactgcagccacgacctcctgggcttaggtgatcctcccacctcagcgtcccaggtagctggaactacaggtgtacgccaccacacctggctaattttttatatttttagtagagatggggttttgccatgttgcccaggctggtctcaaactctgagttcaaacaatctacctgcctcagcctcccagtgggctgggattacaggtgtgagccaccatgcccagcctcatcattcttattaactggtttaatcctttcaataatcctattaagtagaattattaggtaattagaattaggttaaaaagagctgaggtgtgggtgttcgtttctcaggtgaaacatggctaaaagcttacggagtaagtggaaaagaaagatgcgtgctgaaaagagaaaaaagaatgccccaaaggaggccagcaggcttaaaagtattctcaaactagacggtgatgttttaatgaaagatgttcaagagatagcaactgtggtggtacccaaacattgccaagagaaaatgcaatgtgaggtaaaagatgaaaaagatgacatgaaaagggagactgatactaagagaaacaaaaagactcttctagaccagcatggacagtacccaatatggatgaaccaaaggcaaagaaaaaggctgacggcaaagcgagagaaaagaaaggggaaaagcaaagcaaaagcagtgaaagtggcaaagggtttggcgtggtagactcttaaaaccttggaaaatgccacatgggatagatgatggattagaatgtatatacatgtatactttgatttcagctgccaccaaatgaaaaccatttgttttcctattttaacttggccttttttcttcaattcaaacccagcat

SEQ ID NO: 103942 - DNA, 1006 bp, Homo sapiens
cctgtgtctcaattgttgattagtattttgtgactcaggtaggaaaacttctggctcaatttgtctgatatttttatgtcccccccatagactgaggctgatgtgaatccaaaggcctatccccttgccgatgcccacctcaccaagaagctactggacctcgttcagcagtcatgtaactataagcagcttcggaaaggagccaatgagggtaaggcagccacaggatgctctgggggaatgttaaaggcacctgtttccatctggggcctctgatctgatttccagtttgggaggagggctagctgctctcgactacaaccagtgggaggactttggcattagatgctaaagctgatgggctaagaattttttttagacccaccaattgttaacattttgccacatttaccttctttttcactctataagtgaattttatttttgctgagccatttgaaagcagttgtggagactgtatagtggctgtatgacctcaccagagccatcagaaggaaagggatattaatgctttttagcatcccttatacggtggatacttaacattcatgaatttcatttggttcccagaaacattccctacccctctcccttttttttttggatgcaattattcaaaaacatggaacgtttcacgaatttgcatgtcatccttgtgcaggggtcatgctaatcttctctgtattgttccaattttagtatatgtactgctgaagcgagcactacctccctttgtaaaaaaggaaaaaaaaaaagctgtttttcagtagaataattatgtatgcatgatgcttctgcccagaggtgatataggatactctcactttattcattattatttttttaattttattttatttatttatttatttttttatttggagagttttgctcttgttgcccaagctggagtgccatggcaggatctcagcttactgcaacctccgcttcccgggttcaaatgattctcctgcctcaacctccc

SEQ ID NO: 103943 - DNA, 1026 bp, Homo sapiens
cgggagccctctgtcgggtagtggactaggatcctcacatctgccttcagttgggcctgaacgtcagtgcttggttacattttctttgtggagcttcagggtatcttgggccacagaggccccatttcaagggattctgtgctgacccagttcccatgggatcatcatgtggcccacatctgcccaagtcaggagtctgggtcccagcatggaaggaatgactctctggtgagcaggactcaggagaaggcagatgatgactagtgtttcttcatctgcagatggcccaggagctggggatcagtgagaaagactccaacttccagaacccatttaaaatcgaccgcacagaggtgagctgccagggcctatgcctgtgtctgctttgcctctgctgggccataggacaccgaggcctgcaggggctggggaccttgggtggctttggacttggagccaggcagcctgggcctgggtccagaagatatcactgactcattggagcctgtgggcaagtcattgctcccctcttagcctcaggctccctgtctgttcacagcatgtgaactccagttatggggggtagttaggaggctatgaacaaacccatcccagcacaaaataggcatcccacttcaggtggatatcagggtagctagggagatcaggccatgctcttccctgcctttgaacctctgagcaccaactgggcttccatcccgcactcctgtacatgctctcattccaggggttccagggggctgaggtgggctttgagagctggagaccaagtttgggataaaagatgaggacaggccgggcacggtggctcacatctgtaattccagcactttgggaggccgaggcgggtggatcacctgaggtcaggagttcgagactagcctggccaatatggtgaaactctgtctttactaaaaatacaaaaaactggccaggcgtggtggtgcatgcctgtaatcctagctattcaggagactgaggcaggagaatcgcttgaacccggaa

SEQ ID NO: 103944 - DNA, 1678 bp, Homo sapiens
cagtggacggacttgcgtgtggcgcagatccaacggagaaggcagcggctcctttaaacaaggcggagaaggttaagatgatgaccggacggctactccaggcattcgctccgaggccgcggggggagggacctcactatgcaaatctgagctgctgatcgatgacgcgccatcaccccacgcaccgcttcgctcgcccattggctgagatgagcctggtcccattgacaacaaacaggggggcgcgcggcctggaggcggggccgcagggggcgcgggctggggcgggggaatcccgccccgccctttctgtgcggcgcccgggcgcaacgcaaacatggcggcgggtggcacccgtcggtgaggcggtgccgggcgggggttgtcgggtgtcatgggcggtggcgacggcaccgcccccgcgtctccctgagcgggacggcagggggggcttctgcgctgagccgggcgatggacgacagcggcgagctgggtggtctggagaccatggagaccctcacggagctgggcgacgagctgaccctgggagacatcgacggtgagtggtgggtgggtgggagtgcgggggccgcgcggggaggaaggggttacggcggcgcgcccgggtgcgcgtgcgcccaccccccgacagccccggttcgcgcgggaagaaccccgtgcgcacggtgcccccggcggtcctcaacccttccggcgctgcgagcgtgagcccgacccagctgcgccgctccgggaggccgtgggatctggggcgccgcggggccgaaagcggcgcgagggtcgcgggttccagagcgcggggctagggacgtcgcgggggcgtctcagggagcggcctaaggagagcgcgtggccgccgcctccctcgcgcgcccacacgcggtttccgtggtccgctctcccgccgcccgcgaccgcgcgtcgcacctgtcactcccttcctggccgcggggacgtctttgggattcccggggcccagcccccagtctccgcgccccgaatccctgggcttctcaggattgaccgacggccaggtcgccgggtgctccgcgaaactttgggcagcgactgcagaagcaagttgctgatgaagagagcagtggcggcggagtgtggacacatctctccgggatggagacccgggcgctcctgctgtcacgctgcaaggggaattgagcagaagaaattttgagttgtggcccctcgggtacgggctggggagcgggtggcctttgttccagcgccttaacagcggagtggaagagctggtaggagcccagggatccactcttaaaatactaattttgcgaccacgggaacaacgatttggagagggtcagcggcttgctcaaggtcacccagctggttagagcctagttcttgcagttccttggccagtattggtttttttatacccctcctttcaagaaagagtccagttgactaggctagtaatcttattaactggatagttgcactcttatgtttaggccccaaaatgctttgtattatttcacttcttcctcacaacaatcctgtgagatactcttattacctctattttaatacggtaattaaagaagccgaggccaggagatgttgacttatctaaggccactcaccttagagagcttaggcagaaacacaggtgcattgt

SEQ ID NO: 103945 - DNA, 1034 bp, Homo sapiens
gtctcctggtctcatccagttacatttcctgggatatgtttttggaggttgctcagatcacggcactagagtccctttgggtttctcctccctcctctgtctatttggcctcgcccttgacaaacattccccacattcacacccaggcctttggcctaatgttcttgaatgctgcttgcctctcattgaataggcttttatgtagctctcatattcagttcatattttggcattttaaaaaatatatatttttgcttctttctcaactagatcatttcactcctcaaatttgtaattaaaaaaaggaaattctcaagcagttttattcaattagaactttgcaaatatcaaattgtccgtatccttctggattctcgtctgaacattgcttatctgcgtacatatcacagtgttttcacatagggattgctgtatgttgaagtagttgaggtgtaatagccatataatctaatgtgatccatctgaataggcaaacccttgcacacctgtgtacctgttgaacattttcatcatttgcagttttttcttaacataagcactgttctgaatacttgtgaacaagtcacttgggagtttgttcatgggcgtgtatcttccaaagaggagtcttcaagttcagctgggtaacacactatcagctgtagccctttcattttaaaaacatttccagtgctgcaaattactatggtgattgggaattacaacttggaaatatttttatttttttaaaagatagtacattcatatgaatcaaaataaaatacataaaaaggtactatgaaaagtcttgctcccggccctacccactatctgcgtagtcccaccgctccctcacaagtaattaaatttttagtttcttttacctgcttcaaaatgtatttgttattacaaaagaagctaataacaaatattgattttagtttttgctttgctttcctttttgactgaaaaagttagcatgctataagccctgttcttctgtgccttgccttttcctttctgcttaccaatgt

SEQ ID NO: 103946 - DNA, 1132 bp, Homo sapiens
aaatgcccaccatgtattctgtgcctttccttgcctctgaaataaaagcagtttctgccgccaaatatacatggtagcattaagtcaggcctttcacaggcagctccatctctccattttgcaccgtgctgtctctacttcagcagctggcaggacatttcctgatactgtggttttgctcaaactatttcctttgcctggaatacccttccctctctctaatttataaacccttttcatccgttaagctcggttttcactgcctgccaggatggatcagtcctttctctgctctctgacagccctttctttgtgaggcacttgtctgttcttgcccttgtcgcagtttatggagttggttaggtttctctttcttctctgtgagcatgggagatgggaagaaaacgaatacttttcagtctttgccctgtgcggagttccacacaaggcacataggatcctccagctcccagcccagagtacatagtgtatgcaaatttgagtggatgtttgtatttgtagcgtgatttgataacctgctttgcaagtattctttttctctttagttttagggagatttgggggcatggtaatggatggaagggtaagatggtgggatgttggggtctttcatttttgcctgaatggtttaagggctgaaaaaggttgagatctcttgctttgtagactctgcccccaggaggaggacagttcaggtgaagtggcttgtgcctgattttgttggcagtgggtcacctgaaatgtgaaatgtgagggcctccttttgcagaacagggtcatgcaggatcagttccttggagtctcactctgcatctcactcaattttgtagtctcctgctaaaagagagtgaaagagggaacagtatgatgccagggcagcagcaggtgaagagctgggagatacaggaaagacctgggatgacacatccttctctgtctgagcttggggcattcactctactcattcgtgaatgaagcacttactgagcacctgtccagtgtcaggctgtctttggtgatatccgtatgatgatagaaccaaagcatctgcattatgtggtagctaagagcttgactttaaatcccagctccaccacctgctgactgggtg

SEQ ID NO: 103947 - DNA, 1031 bp, Homo sapiens
tattttttggagatggggtctcactgtgttgcccaggctggagtgcaatggcgcgatctcagctactgcaaactctgccttccagattcaagcgattctcctgcctcagcctcccaagtagctgggattacaggtgcttgccgccacgcccggctaacttttgtatttttagagaaatggggtttcaccatgttaccaggccaggctggtcttgaactcctgacttcaggtgatcctcccgccttagcctcccaaagtgctgggattacaggtgtgagccaccgcacccgccccaacagatgtttttacagaggttttctaccataacatgtgcctcttgaaggcatttatttttgtatctggcacatagtaggatctcagttaatgtttcttgaatgcgtgtcttaagggatgtatcttttattaaaatgtatacttaaaaagagagagattgttctagaaaacagcatcttgtcaaggcatatggtctcatttgaagaataatttaataatttggataggaaggtatacttgtaaaatacagccagtcaaaaataccttttccccattccccttgatgcgtccattacatacatgttcaccctgagattgatcttccatcagcattgaaatgaacattgaaagtaataagatgggccgggcttggtgactcacgcctgtaatcccagcactttgggaggcggaggtgggtggatcacgaggtcaggagatcgagaccatcctgactaacatggtgaaaccccatctctgttaaaaaaatacaaaaaattagccgggcgtagtggcacacacctgtagtcccagctactcgggaggctgaggcgagagaatcgctttaacctgggaggcggagtttgcagtgagccgagattaccccactgcactctagcctgggtgacagagtgagactccgtctcaaaagaaaaaaagaaagtaatgagatggggctgggcgccgtggcttacgcctgtaatcccagcactttgggaggccgaggcaggtggatcaca

SEQ ID NO: 103948 - DNA, 2524 bp, Homo sapiens
cttttcatttatatgctttctaaatttttctttagtgaatatattacttttatgattttaacaaattattaaaaacagggccaggcgcagtggctcacacctgtaatcctagcactttgagaggccgaggtaggcggatcatctgaggtcaggagttcgagaccagcctggccaacatggtgaaaccctgtctctactaaaaatacaaaaattagcagggcgtggtggtgtgtgcctgtagccccagctacttgggaggctgaggcagaagaatcacttgaacccaggaggtggaggttgcagtgagccgagattgcaccactgcacgcctgggcaacagagcgagactttgtctcaaaaaaaaaaaaaattattaaaaacattgtctaacacaaggtgcataataaatacaaaatataagaataaatgacctttgtaaactaggtttcccagcccctaatagggctgggtaacaaatacctgttaaaggattattgactgaatctgtaatttggagaaactgtaaccctatttggaggcttcacattctttattcttgaccagaattaatttaaccagatttcaggttacctcattctcaggtagatgctgaaggctgagctgagcaaagtgatatttatgttacctccaagccacaagctccataaagttcatgtgaactcagggtctctttgtgagtcatggggctgcttgcaatgcacggatgataacaggaacctctaattttggttatttgcttttagagaccagaacccagatacagtttcctggggcctcacctactttgttaagcaacttagctataagtttacaaagcagctaaaaacaggagcaggggagtgagatgagcttgagcgtgccagcctagctcgtgggaggcctgtctctggccctgagctttgtggcctgccgtaggaactggagcttcattttcaaagctccataaaactcgccttctcccgggcctcccttttctgagtttcatggctctctgtggaaatgacagcctgtgtaatcacagaatgtgaatgatcagagcagggaacagtgaggagccattaggacattcccatgggtgtagctcacagttacaaagcacaactacaccctggttctccaggcctcctctttcctggcaccgcagaccagatggggtcctggagaggctctgcgtgcccttctggagcttcccatcactcctttctgcagatgttcatcttaacagcccctctgtgccactcagcccagtacccggctgcccggctgactggagatggctccactggagctttttgtgtgtgggttgaaagggacttttttattttaatttaagtagtctcattccatctgcctacacactcttacgcttcgtgaactaagctttctgacctgtgtaggttacttcaccacaccagcccatatctttcccacaaaagggtttcaagagtacttgacaaaatgagatcagtgcacccacatgcctgtgtagtgggtgctctggaagtaccgccaacattgacctgcataagggtctacccttcaccaagcacttcggataaattatcttattaatcctcagggcaaagaggccaagtgtgtattttcaaagcagccttttgtagtgaggaaaccaaggcttaaagagaagtatcttgcccacgctcacaccactgattaggtgggcctccagagactcacacctaggcctgactaccaccaaagcctgtgcgcatctatgaggccaccctggccttctgccctccttagctttccatggatggaaactgtcggccagtgtgtgatattcttctggctctgtgttacagccctctgtattgatttcttacagagttgggattttgggggaattctaaaaggttcaacaaattcttagatttctcttagtcattttcttaaagcattttataatcttgtacttggagtgtgtcagcactaaattatgttttgtttaaatgtactgaatttgaggacatttctcagtttaatcatgtcacggaattggaattggttagtacaagctgcaatatctgtagcaatctgcccatttctccctcgcacaaggctgagtgaggacagagcttagtgtcaagatgttggtaaataataccactatgtaggaatgtagtctggtgagatgctgtttttcccagcaggtttaactgactgaatacttaaggtgcccagattgaaatgcaaagctccagttatcccatatggagactacactagaaagccccagcagctttatttatttacatttatttatttatctatctatttatttatttattttttgggacggagtcttgctctgttccctaggctggagtacagtgacgcagtcatctcggcttactgcaacctctgcctcctgggttcaagcgattctcctgcctcagcctcccgagtagctgggattacaggcacccaccaccatgcctggctaatttttgtagtagacaggggttttcaccatgtttgt

SEQ ID NO: 103949 - DNA, 1020 bp, Homo sapiens
cacctaaggtcaggagttcgagacccacctatcaatatggtgaaaccctgtctctactaaaattacaaaaattagccgggcatggtgccgtgcacctatagtcccagctactcaggaggctgaggcgggagaatcgcttgaacccaggaggcagaggttgaagtaagacaagttcgcgccactgcactccatccagcgtgggcgatagaggaagactccgtctcaaaaagaaaaaagaaagaaaatgagagaaagggcctggaggtgagtgtgaggagggaaaagaacatcaaacagataaagtcctgtcctgttgtcctgggaccttgggcagccatcttggcccagatgatccccacaagaaagaggtaagggtttcctgacccatttctgccatggtcttaggaaagtcattgagttttcatgccttagtttcttaagcaagtttgaaagttcactttttggatagcaataaaattactccttttcttttgttcacagagatgctgcaatttgtcagtaatcaagtgggagagttccctgacttgttttcagaacagctgtgtagctcctttcctggcagtggtggtagtggtagcagcagcggcagcagtggcagcagcagcagcagcagcaatggcaggggcagcagcagcggagctgtggacccttcagtgcaacggtcattcacccaggtcacattaccttccttctctccctcggcggcctccccacaggctccaactctgcaagtcaaggtttctcccacctcagttcccaccacacccagggcaactcctattcttcagccccgcccccagccccagcctcaacctcaaactcagctgcaacaacagacggtaatgatcacgccaacattcagcaccactccgcagacgaggatcatccagcagcctttgatataccagaatgcagctactagctttcaaggtgattcagaagttagaatggtagtggttggttggttccaatgtttatgtgccagtttgcagacactgt

SEQ ID NO: 103950 - DNA, 1020 bp, Homo sapiens
aaaaaaaaaaaaaaaagccaggaccctcattagctagcccctctttctccacctgaacccggtattcaggctgtacaaaatagccggcttttgaaatggcctctatgaaatttcctgttcatttttttattctcaatttcataaaaattatatcatttctcattctttcttggaaggtctatgcagtaagaaaggaatgcataacagaaggataatgctatcatccttttacttttcttccttcttcatccaggtcctggtccagcctcagatcatcaagacagattcccttgttttgaccacactgaagacagatggcagccctgttatggctgcggtccagaacccggccctcaccgccctcaccacccctatccagacggctgcccttcaagtaccagtaagagctgccttctcccccaccctcctccctccccctttattcctggaggtgttagtcttcagagatgttaaatctctatatgctgagtaggtatgggagggtctatagcacaaatcagtcaaattgtaaatgtcacccctcttagttgtttttcgctcgaaaaagtattagcaatgtgtgttcgatgtgggagtactggagtctacaaggaggtagaaaagaatagcagaaggaccctctattcttggctaatagctccacacaagaccattcacctcttagatcctgctgatgacttctgaaggaccctagggccaccaggcagggaagggctccaaggtgaagaacatggaaggtaccccatccttcagttgtaggttcttagccactttcagcatcctatagcatgagaatctgatagagtaaatggtgattaaaatttagaagcactagctttattcataaaatccaagaactggaagcaactcaaatgtccatccacaggaaaataagcacattgtgatatattcatacaatgaaattatgcctagcaattaaaaaacagaactgctgacaggcacggtggctcacgcctgtaatctcagcactttgggagg

SEQ ID NO: 103951 - DNA, 1044 bp, Homo sapiens
tcttggggcctgatttgattaacccaggaagagtctcagacctcatgaagtactgccaggtctggcagcacttggccaaagcgggcaggtctgtgttgaggttgctttatgcagactaacaaagggatcattctgctgtgtacctgtccctattctagaccctggtgggcagcagtgggaccattctgaccacaatgcctgtaatgatggggcaagagaaagtgcccattaagcaggtacctgggggagtcaagcagcttgagccccccaaagaaggagaaaggcggacaacccataatatcattgagaaacgatatcgctcctccatcaatgacaaaatcatcgaattgaaagacctggtcatggggacagacgccaaggtgggtgccaagcaaaattgtgttttatgttccaccatctcccctctacctgtttttgcctcaggagcctagagaagtcccaggctcaaggtaagtgaatacaagaccgagttagaggtgcttttttattaaagcatcttggtgtcatgtcaagattataaaatattaaaaaacataagggactggtgagggttgataaggcagtgacccgctgagacctttgactcctttggctatgctctgcagtgatggggactccactgtcagaggcagagaaagatgcctgccactcagtagttccagatacaggactgtgtgtaccttggagtcagctgatggcatagttttagctgtgtttaggggttaccttttaaggaaaagaaagaaaaaagaggttgagtctttgaccagcaacacatagaggaaactgatgttccaaatgtttctggtgtttcagtgtatgtgtcttctagaaagtaggagattttatttttaaaacctatctatgtttaaaccctattttgaaagaaaatttcattttccttgcctacaaatctgaaagctgtacatcctaagtaaaaatctatgccttaagataactgtccaggctaggcactgtggcttacgcctgtaatcccagcactttgggaggctgaggcgggtg

SEQ ID NO: 103952 - DNA, 1185 bp, Homo sapiens
tattgagtgtcaactatttgccaggctcagggctaagccctttacactcattatctcatttagccctgctgcaagcctgtgattcacgcgctttcattatctctgtgctaatgaggaggaaagtgaggttctgaggtatggaataacttctcccgagtggcacagctaatcattgggaggaccagcatctgaacttggtttctcctctcacagagccatgctgtcatcccaagtgctagggctctgctcttttcacactgtagcctgcactggtctcactgtgttttcactcatcttcctacccagatgcacaagtctggcgttctgaggaaggccattgattacatcaaatacttgcagcaggtcaatcataaactgcgccaggagaacatggtgctgaagctggcaaatcaaaagaacagtaagtgtgctgagaaaaggcttgtcagccctggcccaggtggggctttgtaaaagcagatcattttcaccaggtggggttttctttgcagagcttctaaagggcatcgacctaggcagtctggtggacaatgaggtggacctgaagatcgaggactttaatcagaatgtccttctgatgtcccccccagcctctgactcagggtcccaggctggcttctctccctactccattgactctgagccaggaagccctctattggatgatgcaaaggtacagacttttgaaatctcctgatccctggaatctttcccatttcccctaagaagatagctgggaggtcacagttatgaggccaggccgcatgttaagagggcctagcctggagaaaaacaggaattctgtgaaattagccaggtcctggagaataaagaaagaaaaaactgactccggggggaaacagtccctcaggtttaactggtccttgccgataggccccgtcagagaggaatgagtgccagatccagaacgagaatgcagagtagctgttgtgggggcgttgggagctgctggaggcacctcattgcttcactctgcctttaatgggcctggcaagaccactttgggaggctgatcagttggtttaggatgaggctgcctctgggtcctcttttcagaaatgattacaatttgcagtctaacagataacattttacctatgggcctttaatcgtcaaagcccctggcaatggtagtttaatgga

SEQ ID NO: 103953 - DNA, 1050 bp, Homo sapiens
tttaacataatgtacagtgctatgtaactgtcactgtaatcaagatatagaacatttccatcaccccaaaaagctcttttgtacacctttgcaggtagtttcccacacccctctccagcctcagacaatgactgattcattggtttcctgttactttagattcattttgcctgttctggaattatacagaaacagaatcatacagtgtgttctcttttgtggtagatttctattttaaaagaaaatctcttctacctttgttctttggaacatgtacttttctcagttagcaagcaggtgaatgtgccaatgtttgagcagcagttagtgaattataggcttctcagttcccatctggccttagtcctgagttaatcgacttgaatttaaacctcataaccatttctcaatatatatatatgtatttataaagtgctgtaaaaacctatgcagtatttattccaacctcgaggccttgttttgaaggtcaaagatgagccagactctcctcctgtggcgctgggcatggtagaccgctcacggattcttctgtgtgtcctcaccttcctgtgcctctcctttaaccccctgacttccctgctgcagtggggaggggcccacgactctgaccagcacccacactcaggctctggccgcagtgtcctgtcattcgagtcaggtaggtggaggccccttgccccacctgggcatggctggaccactatggcaggagaaggaccctgtgtacaaacttcttggcttggctaccaggtcccaaagggcttttatagtgggcccccacctgcttgcttctgatagggactggcataagttccattttagaagtaacaaggcaagcccaagttcagtcagaatgagcaaaacaaatcagggacccacactactctaaataccctggggtggaggggtggtacctatttgaaggaggatatcgtgttttttatctgaggttgcaaaaccaatgcctcaaccctttcaaaacaaagatttttatggcactcagctccataatgagaagggctacagtca

SEQ ID NO: 103954 - DNA, 1172 bp, Homo sapiens
tgtgccaccacgtccagctaattttttctatttttagtagagatggggtttcactgtgtttgccaggctggtctcgaactcctgatcttaagtgatccgccggccttggcctcccaaagtgctgggattacaggtgtgagccactggcacccagccacattgtgaaggttttttaatgaaaataaattcaaatcagttcatctaaaaaaaatttcattacctctgttgaatgtttggaaacacacagtgtggctgtgctgctgacattgttatgttgcactgtgcgcctctgagtcctatacaacaacctgcaattgtgacagctctgggtgtgacagaaatgggtgccatgttcccagctaccctgtgaggtagacaggaacacacagccagtatatcacagagcctggcatcccatcctgtgatcaggcctgtctgatcacaaagttcacctcgcttctcccctggttcctctcttactttgatcgtgctggagagagcaggaaaaagtttggttttggggctccatcaacaatagtgtctgtttctgcccaccctagggaagcttcctgcaggatccgcctgttccgatgtacacatggcgttgtgtgccgtgaacctggctgaatgtgcagaggagaagatcccaccgagcacactggttgagatccatctgactgctgccatggggctcaagacccggtgtggaggcaagctgggcttcctggccgtgagtacccttcggttcccttctgtaaacctcccctgagcacttacctagccaggagttaagatgcagaagcagttatgaacccccttccccatcaggtgctgcccacctggaggggtaggcaggcattcattcagtcgctcatttcaccaggactcccagcaaccgataaaacagaccaaaattcctccccttgtggccttaataccataagccttgtaggcaggacattttggtcccctgaggtaatatgaggtaatatgaagattggttcagcaatagcagagctactgtacttgggggttaatatgcaacttttctgttcttcaagtggtcataaaaattcttagaatcccctggttatgtctcatggttctttcatttactcagaaggtatttattgggcatcttgtattgatcacagcactgtgaatccagaaat

SEQ ID NO: 103955 - DNA, 2030 bp, Homo sapiens
ggtggatcacctaaggtcaggagtttgagaccagcctggccaacatgatgaaactccgtgtctactaaaaatacaaaaattagccagggatcgtagcacgcacctgtaatcccagctactcggaaggctgagacagaatcacttgaacccaggagtcagaggttgccgtgagccgagattgtgccactgcactctgggtgacagagcaagactctgtctcaaaagaaagaaagagagagaatattttggattcttaataatttcttagaaatcatggttattaagaatccaaaatattcttttatttatttatttattttttgagatacagcctcactctgttgcccaggctggagtggaatggctcttcacaagcatggtgtcactgtttcttaccaatacatgaacctgtcaagcactgcacacctcaagctttggaatcagactagcaaccatcactctctctcttttccacattgattttcacacagtactatgacagatatcacatctccaaaggaagctagtgtggtctcaatgctgaggctgcatgctctccccatctagtcacttacagtgcccagctgatgttgagcatcactgttttcctcgaaagtttaaaatagccagtggctcccttgatcacttgctgtggcacctcagactgccttggcacacgatttgagagccatggggttagaccgatgttaggggacacaacctggggttgggactggcccagggatactgagtggctctcaggatctaaacagttgtggggttcttgccacagcctctttcacatcaggcaattagcagatgagttacagggggaggctcctaggccccagttggggaagattctggtgtctataaaatttaggaaaacttaaaaaaaaatttttttttttttggcttgggattacaagccaagccaccagcgtggccaagatggtgaaaccctgtctctactaaaaatataaaaattagctgggtgcggtggcgggtgcctataatcccagctacttgggaggctgaggcaggagaattgctagaacccaggaggcggaggttgcagtgagccaagatcacaccactgcactccagcctgggtgacagagcaagactctgtctttaaaaaaaaaaagaaaagaaaagaattaagcttaaaatacatttttacttagtgatttccacatttgcctttctggttcctcttgccgtatgacctggactaggctttgcttctacttgtaacatttgggccctcgtgagggaccagttggtcctcagtttctcctggagcagccaccaggctcccttgctgattggacatgtggaattggctgttcttggaaagagagttggagtcaaccgttcaaatgttctgggacctccgaagcccaggaatcacgccaccaccccccaatctccctccctgctcagctcctcaactgctattctcccaccattgcagttatcagctcagattcagtgagtgctttgtggaaggttggcagagggtcgcgagggtcctctacatttgttctccagtatccagtatcaacactggttaccaaagaggaaggacggactattggtgcccctggtcccagtgattagaaatgtaagtgaaacaccccacctcatctcataagctgctttgagattatgagtatgtgtctatagaacaggttgttttctctcagactcaggcagtgtctccaggttccccctggagagagatagtcttctctgtctgtgtcctcgagtggcactctgacagtgctatttctgaccctggcattcaagtcttctgaagccgttacattcgctgatggctacttagagcccagtaaaggtcagaaccatcagactgaaccagaccatgaaacagcgctgctcctgtgggggcgagggctggggtgtggaagcgatgtctgcgggcctcggcctggcagccccgcccctgggctccctgggctttctatcttatgcttctccctccctcctgtcttctgtcctcagtt

SEQ ID NO: 103956 - DNA, 1045 bp, Homo sapiens
ccttacatcacacagcaataaattgtgattaagctccaagggtactcttagcccttgttttgggcactttggagacacaaaggatgtgtgaggcttgctttccctggcctccaggtctctcccattgggagagcagacagacataaatggagagtttgggaacaataggtggcaggcagtcatcaactgctcagagtggtgacagggacgaggcttcaggcattggaaggaggtgctggctttctgtccctggcatttgatagtgattggagttgactcgcccggccttggagcagtagaggctggtcaggattgacttagaccttgagtgctcagtggctgtctgctttctgctgtacttttcctcccctctcagaattggagtctgtggggagagtaaggttctacaggtataggggtgtgtgtcacacattgggggagttcactgtccttttcttttttaaataataactgtattgctcaacgtgagaattgtgtgcaacaccaaaatataaaggatgaaagcaaaagcaatcctaaatctttctaccccacccctgctggctaaacatggacttctcagtggctttgtcatctctggcagtctctggctccaggccttgttacttggaatgtgttcataagtgtccctcctcctggtcattagatcgaggcccacatatctgccacatgtgaggagagagaaggggctggtgatttgaggcctgccagtaaagaaacttgctggtgacagtcagctatccaagcattgcaaggccccgtgtctagccagttcagacaggtcactgctgatggcacgttccatgacaaggctctggaaaaaccggagcatgttcttcgttgtcatgagcgtggcagcagctaccacctttttttccttgcctggtggttctccttagccacatggagaagagaaatcctctgagacattccattttctgttttctgatccaactccacctgacagctcccaaccttagagtactgagcactgtgccaggagacacagcaccctcccccacac

SEQ ID NO: 103957 - DNA, 4114 bp, Homo sapiens
tcttactcttgttgcccaggctggagtgcaatggcacgatctcggctcactgcaacctccgcccgcaccgaggttcaagcgattctcttgcctcagcctccctagtagctgggattacagtcacccgccaccatgcccagctaatttttttgtgtatttttagtagagagggggtttcaccatgttggccaggctggtctcaaactcctgacctcaggtgatccacctgcctcagcctcccaaaatgctgggattacaggcgtgagccaccgcggccaaccaggaatgaacatttttaaggctcttgatatatattgccaaacactttccaagattgtgctggtctattcccctcccccagaatcctgggtgtgggagcccagaggctgctggcccgttcccagcaggcaaagatgttacccatctcctaggaaggaagtgtagcagcctctgagcgccacaggtctcgtttctgtgggtgctggagtgcgtttggtgctgttctcctctaggtccagacatcatctgtcggtggtggacgtctgcaatcactgtggccatcagctggctccagggagacgatgcagctgtgcgctctcattttaccaaagtggaacgcatccccaaggccctggaagtgacagagtgcgtaaccctccttggccactcacttgcttctctccaggggaatcttgtttgagttagcaggagcaaactggactgggtgggcgtgttggggtgaagggtcaggactgcatgacaggtgggcggctagaaaagtcgggggtgagggcaccatggagaactcaagttgggccagcaggtcctctgtgcaagtgtcctgctctgcacaacacgacagttgtcccagcagctgtcagcactgtgtccgggtcctcctccctgcagccttcatggcgccacaggctgaaaagaagagacgagagcagtgtggcccccagcatcttcagaagctttgtggtggaggcaggcactggtggttcacaatcagtgcagagaggccactgttgcccccaaaactcatgtgcactggagcatcttgcccctgtgtgctagcattttatccactttccttccagccacctccacccccaccatcaaccctggcaactttgtcctgtaactaaaatagcctttagcacatggcataaccggagagcttttgacattcctctttggagattcatgtctgcgtcttgggggcattcggcactagtgatgggcagccctgcctgctgactccccggctgtttctaattggatctgagtattctaagagaaactgtaaaatgctccaagacagaaaggccccacgaggtcctatccttagagccaaggctgtagcatttcctatcaagcagacccttaaccggcgcacaggaaggagctgagaagagtgagtatacacaggcttgaagtcctttgttccctgaagtagatgtgacaccctaatttcattgaagtagccccatttgtaagcactctgactaggtaagcacccagcccggtatagcattccacctgtatgtgtgtctcccccagtcgatgtgcctgaggacactgagactcagcaggtaagttgtccaaagtcacctcgctccagagcagcagagcttccatggacagccaagacacccctgcaggcactgctgcctgctggattcacttacccctgggtccctctgcttttcagggactaggatgctatgagaaccctcccccatccctagcctccccttccactcccagtctcctctacagaaagaagctaactaagtatctccagagagtttaataccacatctctgggggggtggtcccttaaagaacgggtacaacaccttattgtggccactttataggtaaggaaactgaggcacacgttggaatgactatcttgggtggcttcttagcagcagacgtgatggtgaagcctgtgtctctgacttccagcattgaatgaaggtgctaaagggtggggcgctaaccctagctcagggctggcatttcagatctggagctggtggcatggtgccatagtggcagcattggagtcaacagatgcacatgtcatatcagtgtggggcgtggcagtcactggcttgggcccctctgcctgtcacgcaggtgacacatagtgacctgcctctcgactccctgtcactgctgcaggagccccctggtgaaggccatcttccatgcctgcagagccatgcatgcctcactccctgggaaagcagatgggcagcagagttccttctgccattgcgagagggccagtggccacctatggagcagcctcaacgtcagtggggccacctctgaccctgccctcaaccacgtgagtgggagctgagttggcccctgggggaggtgctctgcactggtttacgagaacactcccactcacctcatgctgaccctgcgggtggggccatccgaaagacagagaaaccaggacagcagccccctttcaaaaaagttacggcttattggcctaggtggactcctttttcatcccttttcagcctctgaggcaagtgtgtttctacctgcacctttcttaggctcccagagtcccaggtcctgctggcccatagcctctgtaagcccaggtgcaccccagctggccaggggttcacctgcatttgctccagcggtttgcgtgacttcccaggcctctgcaggcagccttggagtgggttcctgccccctcgggcacacaaacagagctgaagaccaccctgggcacctccttggctggccgcatacctcctggcgggcagctgtggtgcattgtagttgcattgcatgttctggtggtacccatgcaatgtttccacagtgcatcacagaggcctgcctggccctcgagagactgccctgactgaaggccctatcaggtgggggaggggatcctgatagagggcactgctgccactgttggggcccaagtcacagccatcccaggaaacaggagggcacccagctgaaagtggagcatcacctggtctacggggaacatgtccttagctccagagtgggagggaccgggagagtcctggagattcagattctcagccactccctggggcttggtcttagctggctaggctagtacttcaagctagatattgtcagtggacctgggcactgggatgaacccaggacagcgtggcagcccctacagggacaggcaatgtgcagaaaaggcccaaactggctggacgcggtggctcacacctgtaatcccagcactttgggaagctgaggtgggcagatcacctgaggtcaggagttcgagaccagcctgaccaacatggtgaaaccccgtttgtactaaaaatacaaaaataagccaggtgtggtggcatgtatctgtaatcccagctactcaggaggctgaggcagaagaatcacttgaacccaggaggtagaggttgcagtgagtcgagattgcaccactgcactccagcctgggcaacagagcgagactccatctttaaaaaaaagctggtgggggtgcccaaatgccctgggctgccaagaccaaaggcagatggtgagccacatttcaccttctcttttgggctttccattagtctcttccgtatttgtcttcatgagagaaccaaacagtacaggctcagtttggggaatgagaggcttgcagccaccctttggactggggttccttggtagcagctctgtggtaggaaagtgagcctagaagacaacgccatgcagcctgatggccctcggagggcagaatccagacataggcctgctgcctccatgcccacaggtgcttctgcagcatgcacagcttagaagtgccaggttttgaggagagggatccttttccacatccccttgaagcacacaacagccagaaaacagtgtaggcaaggatcaaggccttgtgcagggacagggcagggtcttcctcaggcccagtgtcctgggaaggaggaaagccagggctgggtgagatgaggctcagcctgagggagttcatcaggaccggagggctgcttgcggcccatctcaacaaggactcctcactgctcggtgtcgtgcaggtgtgccactg

SEQ ID NO: 103958 - DNA, 1050 bp, Homo sapiens
gtcagggctcctggcctggtcccgagctccacgttgactttcattctttttcacagtagctagaggcttcggttctgctgctgggtaacatccccttggcagtggccacgtgatctgaactaagtcacggaggaaagttctatgactgggcttgccaggctccagctatttccttttttgtttatttgtattgctatataatgtattcaacatatttgtacctgtatttttttctaaaaatttgagtgagatgactcaagtgtcattgagggggcacgggctgggctggaagaaggcctcagagcgaggctgctgccgtggagcttgggattcagcccccacacccatcaccctgaggtgctgcggggcccacccagggttgcactgtggccactgtgtgcagcaagccaagacagacacaacagacagtatcatcggagagccattccttactgtggagaagagggcatgtaccccaggcctggagcggcacccctgcctcctggagcccactctggtcagctctctggtctgctcacagcatggctggcatcagtggcctttttttcataatagatggggtcttgctatgtggcccaggctggtctcaaacccctagcctcaagctgtcctcctgcctcggcctcccaaagtgctgggattacaggtgtgagccacctcgcctggtccaaaggcctcctcttaaataccatttccattctgctgctccctgctgagagcccatcagcggctccccattgcctaccaggaccagaatccacttggcagcactgaagaccctccctgaagactgagatataaaggcatcaaaaagagcttgagattttaagaaatgacagacctcagccttgcccttcacccaccagtggctcatacctaagcgctgcagactttacccgcacacctctagactctcttcctttctaaagatacggaaagaggataccaaacctctctggtaccagcccaactgtccctcctcacccctctgtccctgtcacacctgtccttttgtcaaactgcaggcag

SEQ ID NO: 103959 - DNA, 4719 bp, Homo sapiens
gaatgagtccaggtaacgccaaggaactgcaccaacttcatggtagattctcggttgtgacacacatctccttcccacaggagaggtggatgcctggcccggccagcgagagcgggccaccgccatcctgctggcctgccgccacctgcccctctccttcctctcctccccgggccagcgggcagtgctgctggccgaagctgcccgcaccctggagaaggtgggcgaccggcgctcctgcaacgactgccagcagatgattgttaagctgggtggtggcactgccattgccgcctcctgaccaccaggctcagcccacccctccacctctctctcgatttctctctctccccctcagcatcttcccgctgagagtggtggggaagagccttgtcttcttagctgtcacctgccgaggcttctgggccactcaggccagtgcacccctgggcagagccccttaaagctgctgtcactagatgcccatggtccagggcctggtgggcgtgagaggataggtggcagggcagaaactgggcagccctgacttgatagcagcagggggagctcccaagctgccaagcccctgcctccagccttcctgagtttctctctcctgaaccctactctctcctttttgcttcctcagtttttatcaggctttctctgggggacagcagtctctgagcaccagggagcagttgccctcaggcctgtgcccagcatgccctcccctttttatacgaatgttttctaccagtgtgcttgggtttgccatgatgcgaggctgagttgctgtagcgtcttgattctctccctgggtctgcgttccctcccctgggcctgactgagcctgctcattgtttttccctttattacacaggacagccaggggaggaggggggcccagccctgggaggctggtgggaggcagggggcaggcctgcggatgcatgaaataatgttggcattattttttaattttttaaaaaataaatggtatcttatttaattgtcctgttccttcccactccccgcctcctaggatgttagcccaagctcagggtaggcccagggggctgggagaaatgaagccacccatggggactggggaccaggggccttcagcatggcttctaggttccctcctccccctaccccatctcctacctccacagtacagactgtccccaacttaacagtggttcaacttaaaccatgtttcaactttacaattggtctgttggggtattaaatgaatttgtgacttaggatattttcatttatgatgggtttatcaggaagtaaccccatggtaagttgaggcatatctgtatatatttaaacctaattaattcttgagctgaaaataaataaaccaggatggcagggaccaacccctaatccctccccagcggcaagcccctcttttcagagtgggcagagggttgcctatggtgggcactaggaatgaggtcccctgcctcgatgcgggtcctaggagaaaaagtcctacttttctgggtccccaggtgcagcacctcccggagactgtttctcccatggcctcctgagtgatgggccctgcctccctgtgcctcatcctcaggctggttggagcagagggtgggcaggagccccagcacagactggggggtgctcacagcagggccaccttgatgcaggctggaatgttatccctggggtgtgcttggaccccacctgctttctttctctcctgcccctcccctactctcactgtaatttatggaccctgcccgcctgcgtgttgtgtgtatgtcctgtgccttttctcactattgtttgggtgtgggagggggtggtttttcactgaaaaggggggtacacctatagctttcttgatgttcaatcaatcagtcactgtgtcccagacatattcaataaacacagattggtaccacccagcacgaggtgtgtgagggtctgtagtgcgactgctgtggtgcccagccaaggggctgcgtgacttggcaggcaatgggccagggactgagggcagccccccaactgctgagagggcccctggcttcagtctaatgggcctcccttgtccaccttccttccggtgcctggcgcaccctccagcctgggataaaagggctgtgggtggcactttgggggtcagaggtcactgtatccaggttccagcttgttccctggatgtaatgcaggctggctgacagatttggggtgctgaccctctcccccactgggtaaactgctccttagtttctccctccctgaagtcagtgatcctctgagccaggaggctcactggcccacaagtcagatccaagtccaggtcctgtgcttcccagctgggtcacctggggtgggacctggcctcagtctccacttccacgtgtgcagaattgggaagctaagctcagccatgaactgcagctccaaaggcttgtctgccaggactgagtgatgggatgcaagtttacagcgagtgccttgtgtggctggtgaggccaggcttggcgtaagacacaccaggggacaggaccacagactgggatgggagtgctgggcctcgtcgcaagaggagtcaggatgtgactgagcatgtggctgaatccctcagctatgagccacatccttctctgaagggtagtcacagcaggctaccctgagaccagagcagcccggtgaggcccaattgcagctggtcccgtgcacagctccatcattttcagggatggccactgcccacagcctcagcctggctccactgggatggagatccagggcccttggaactgagaatgagcagggggaattgcccactcttggcacagcccagcagggggtgggaggtggggtgagaagcaaccagattcctttgtgagtctgtgtaggctccatgcctcagcccccaccctcctccagctctgcacagctgtgggacaggggcaggaccgtgggcccagagctctgtcctggtgcttctaggccttggtttccttaacagcctaaagggacagggaggtggaccctttgtggcaggagcggagaccgggcctggtgggttctggggcctcagggcagcccaaccagcagaaggaaagctccagactgtttatatataccctgggaacagggacccctccctaccaaccctcagaaccctccctcccagccaaactgcctgttgcttgccattccagccgattcacagcaattcgggagagtcctaacctgggagtctgctgggtgaccttgggcaagctacttaggtttcaaaacccaaatttcctcctctgtaaagacacacccacttgaggcgcttgtggatttcctgagaaaggccaacaaatggtggccattgttcttaaaacagtacaccacacttcaggtactcaggagggaaacagacccacctgggtggctttgctgaggtcacacacctcaaccagccacagccctggcccctagcctccccacatcacacacctcaaccagccacagccctggcccctagcctccccacatcacacacctcaaccagccacagccctgacccctagcctccccagtgttacctggcggagaggaactctgtggaagatgcacgcagactgctagcagtgctctggaccacagccaggtgcaggaagccctcccggagggacactgccagggaccctgctccagcttttcccccatttccttcagagaagctcctgggaggaggcgcccccatccggagcaccagatgtccacacggcccacacccattaaggggggtagcccggggccaatctggccaagcgacctgcaggccaggggctggcccacagccagtggtcagtgagcatcagccaggttcagccaactcaagctgcagagtggcggctggagggggctcaccttcagtacagggcatggaccccccactgggccttggacccaacagccctctctcctgtgcccgggcctttctatggctgaagtctaactgttccctctctcccagggctcccacgggggtgggcattaaccctgacattcaaccctggcccccctctccagccacttccccctggctctggccggtgcactggagcagtcctccaaccttgcactcgccgtgccctctgcctgcactgccatctgtacagtcagtgaccaatggtgcctcgcagccacgctggggcttctttattctcaggggcaggaaccacataaaagggcttatttacaagacgaacccgcggcctgcaggctccaagacaccactgccgttgaggcagacagaagagctggccttacggcaggcgctcctctccctgtggcctgaggctccgacgggcagacaggaccccagcccatgcctcgagggcaccgcggccccgcttcacacggtgacctcggtcttgctattggtccttaggtaccgggacccgcggcccgcgctgccgtaaaggccggggagctgcgggttgaaggtctcaggcatcttcacactgaactggcgccgggccgcgtgcccgggtcgccggggtacctggaaggcccgagccgtcgggtggctgagcggggcgggccgggccgggcgactggaggtccaggcggcataggggcccggcgcggcagggggcgcgtagaccggcggggcccaggggcaggcgtccagcggcgcaggcaagtccggggatggtcgcggagccc

SEQ ID NO: 103960 - DNA, 1074 bp, Homo sapiens
ctgagcttgggtgctcggcgcggcgtcactcttccctgccctgtccccgcagaggccgccccgcgggacttctgtcagcgtttccccgccctcgagccgtccccgcggcaacccccggcgcgggctccgcgaccatccccggacttgcctgcgccgctggacgcctgcccctgggccccgccggtctacgcgccccctgccgcgccgggcccctatgccgcctggacctccagtcgcccggcccggcccgccccgctcagccacccgacggctcgggccttccaggtaccccggcgacccgggcacgcggcccggcgccagttcagtgtgaagatgcctgagaccttcaacccgcagctccccggcctttacggcagcgcgggccgcgggtcccggtacctaaggaccaatagcaagaccgaggtcaccgtgtgaagcggggccgcggtgccctcgaggcatgggctggggtcctgtctgcccgtcggagcctcaggccacagggagaggagcgcctgccgtaaggccagctcttctgtctgcctcaacggcagtggtgtcttggagcctgcaggccgcgggttcgtcttgtaaataagcccttttatgtggttcctgcccctgagaataaagaagccccagcgtggctgcgaggcaccattggtcactgactgtacagatggcagtgcaggcagagggcacggcgagtgcaaggttggaggactgctccagtgcaccggccagagccagggggaagtggctggagaggggggccagggttgaatgtcagggttaatgcccacccccgtgggagccctgggagagagggaacagttagacttcagccatagaaaggcccgggcacaggagagagggctgttgggtccaaggcccagtggggggtccatgccctgtactgaaggtgagccccctccagccgccactctgcagcttgagttggctgaacctggctgatgctcactgaccactggctgtgggccagcccctggcctgcaggtcgcttggccagattggccccgggctaccccccttaatgggtgtgggccgtgtgga

SEQ ID NO: 103961 - DNA, 1043 bp, Homo sapiens
tggcccccaagaggtgggggctttgctccctgtggctaaagggctgtggtctgccctctagtctcacatggagggcccatgtcctctatcccggggccatgctgagagtggctggggtgccctggccagaccctgtggagtgcaggagcgcgcgtgtgtgcgcacgtgtgcatggagtggcgggctggatgacaggcagctccagcccatgaagacccaggcaaggatttgtgactgcttcatggaagggcgtgacctgccctcccctggtgtgggttcggggaggaacgggatctggggactcccaggcctctgcctctgggtcacactgctctggactcgccaggactttgtgctgattccgtggccactctgccctctcccaatgaaccgaggcccacggcactgcatcctttcccctggccccagcaagaggtactctgtagcattgtacttgtttgtgggggcttttaaatacaggagaagggaaaggaaataaccacaaggggtggtcctggcgctgtcatgagacaaaatggagccaagagagctgactcgaagccctgcaggcccaacccagccagcagagccatctccactgctgaccccattcctggaacacgggaaaagctgtttgtgtgtacacctacacgagggggcaaaggcacagaaccaggcagtgaagaaaggctcccaagggaaaacagagactccctctggggaccgtggggaaacgccctttgtcactcatagacttctgtattgtttgcaggtttttcctgagcacgtgttcaggtactactgcataattacaacgaaaactgattttgaagtacagagtgcatcccaggccccagagcagtttcacatccagatctgggggactgggcctctctgtccccaaggactgctccccatgacactgtgcttgtcccatccccagagtgctctcactttccccaaccccgtccctgaagcatgtagggcccaggccacgcttcacagtcaggtggacacagaccccctgcaggcccctcccatct

SEQ ID NO: 103962 - DNA, 1009 bp, Homo sapiens
aagatggtgccactgcactccagcctgggtgacaaagcgagactctgtctcaaaacaaaacaaaaaaagccccagctttgttctagtcaaggaaacaaatggggtaaatgacgtgctggaaagtggaggcgtggcgtgtcaggtggtggtaaacaggcaagagttaggcagggtaaccagggaacgcccctgcaaacaggacttctaaataaataaagacctgaaggaagtaggcaggcaggccacggagatacctcgtggaaggaggaacagcaagtgcatgggccgagtgtgggacttgcctggtgtgctcaaggtctggcaggcaggcctgggtggctgcagcacaatagcaaagggcgggttggggtggagaaatcaggaatggtggggctggatcagtggagcctggtggggagctgctggagggcttggggccagggagggatgtggcctgacttgggttttaaatggacccctctggctgccgggaggagagtggactgaagggaaactagggcagaaatagagagacaggtctggaggctctttctttctttctttctttctttctttttctttctttctttctttctttctttctttctttctttttctttctttctttctttctttttctttctttttctttctttttctttctttttctttcttttttgagacagacactgggcagcatcgtgttcttccagcggacgtgtctagaacatctgtgcccgggcctagagcagtcttgtccctctctggccccacagctcccctgggcccattcctttttgatggcaccttcttatctgtggtgagggccacccgctgcccctccctccttcctatccctgtatcttctgctccctggtcttgagcatctggggcccgagctgcctgggcattggttggaagtagccctgattcagagctcagctctggagtcactagctgggtgaccctagacagtttgttcgacctagccagccttgttaagccttca

SEQ ID NO: 103963 - DNA, 1030 bp, Homo sapiens
ctggctcaggactgtgctgagacggtgacctaacttgtgatgggaagtggtgaggatgggagaggctggctgaggtcaatctgtaaggtgaggagagaggagccagtggtcagtgcacaatgtttaaaatacacaacggccgggcacaatggctcacacctgtaatcccagcactttgggaggccaaggtgggcagattgcccgagaccagcctgggcaacatggtgaaaccccgtctctactaaaatacaaaaattagccaggcgtggtggcatgtacctgtagtcccagctactcgggaggctgaggcaggagaatcatttgaacccaggaggcagaggttgcagtgagccaagatcgcgctactgcactccagcctgggcaacaaagtgaaactccatctaaaaaaaaaaaaaaaaaaaaaattaaaggacaaatatttctccagagaaagtcaccctcttgtcattctctggcctctaggatcagagaagcaaggacttctgctttctccgttgtaaagttttgttctctggtttgttttctcaccctggcctggccaccccagtctccagaacacagaggagtccctgcgccatgtggatgccagcttcttcttggggaaggtgtgtttcctcgccacaggtggtaagtacgttcctcgcctgttactgcccacccccagccaagggaaagctggggcggccgtaggcttcttgctgaggcaccctgggtgatggaaagagcatgtattttacacacactggggcctatcggagggtggagggcaggaagaaggagaagatctggaaaaataactaatgggtactaggcttaatacctgggtgacaatgatctgtacaacaaaccccatgacacaagttttaactacataacaaatctgcacatgtacccctgaacttaaaataaaagttaaatttaaaaaccgaaagaacacatatacacatactttggaatctgacctgttgtcagcctttctaagagtgaatatgagcagataactctgcca

SEQ ID NO: 103964 - DNA, 1032 bp, Homo sapiens
gctctctgaggcgccaagccagcgcgcgctaccgtggcgggggcggggaataggcggagagccatgctctgaaccaattggagtagccgctctctgaggttgagggacgcacccaccaataggtgctcggcggaccctttcccagcttctgattggcgagttcccgcgcctggaattggttttcccgcgtctgggggtctggcctcctggagaggccggcggtgggagcgagggtcgggtagtagagagtgcggtgcccacaggcctgcagcgggtccaaacctcaggcccccagcccgtgccgcttcgcggggtccacttctcgggaaatgtcctccgagccgcctgctggcggtgtcccgatccccccgggagtgggtcgaagggccaggccctccccagggggtgctgtgcctagggctcgactgtccgctctctctccctgcgcagctggtgggcacggaggatgctcttctgcagcagctggcggactcgatgctcaaagaggactgcgcctccgagctgaaggtgtaagtagccgcggctgtggcctgggcccacgtgtctctcactccagagggattcggtcctagctgctaaactccgaagcccagcgccccctcctctgaggctggtccttctcccagcatgcagcgtagctggctagtcccatgccgtcttatatcccaacctccccttgccgaggtggtgactaaacagagcccgtttctggcagagggaatcagacaggagtaatctgaataggaccggacctgtcctgcctctgtgctggcccaaggagtcgtggccacaagagcctcgggtggctaggatgaggtggggagcccttgacggcctctttccacatgaagggcagcatttaaacggtcgctatgaggggggtacggatatcttgagtcctgcaatttcctgtttttcagccacttggcaaagtccctccctttgccctccagtgtgaatcggccccgaattgacctgatcgtgtttgtggttaatcttcacagcaaatac

SEQ ID NO: 103965 - DNA, 1117 bp, Homo sapiens
cccagcctcctcctcctctcacagtgccctctctggcatgtatcttcacaggacactaaggcttctgggagcacaatctaaaaaccactacactagaagaaagagtggatatagagccaagatgttattagggtttgagttcctggtcttgcatgtattagttatgttgctctgcacatattttgttagaagaggattcatctctctaggaccatctcaactgaggataaagatagttctgcttcaggatccacagggctgatataaaaatgaatttggctaacaaatgtgaatgtacaatatgcactgtgaggcagtatcaggatgcaaagtcattctatttttccttttagtatcattaaaaagtgaaaacctaagcaaaaaatggaatcacgagaaaacagaaaaccacgacactagacatatgcagaggttgtcccttttcccagtggtcctgtggctctgggaaggagagaatatggaatccaagtgatgtttccccaaggccctctgcagtaagcaggaagccattcccacctgcctgcaatccccactcagcctggccatcccccagtgagtggtcagacaaggtgtggcctggatcatggctctagaattctgtaagcttatggagaaatattaggctcaggaggtggatgcagagtctccctacctcctcctcctgctttgctgtaggccagagtggactgggcaaatcaacgctggtcaacacgctcttcaaatcccaagtgagccgcaaggcctccagctggaaccgggaggagaagatccccaagacagtggagatcaaagctatcgggcatggtgaggaccaggcagggacccctatgggctttgttcagtgagtgcctctgctggaaaggggaaagaatggggcttattgaagaataagatcaataaaaggcaaccttaagacaaaacagacgtgagcacttcactctgaagcaaactccttagactgcaggttcagggaagagagagcagggagctcgaatggaaggaggtgagatttgaggtggatgataaagtacaggatttagacaggtagaaagaggtaaggagtgggcaggtacggtggctcatgcctgtaatccca

SEQ ID NO: 103966 - DNA, 2262 bp, Homo sapiens
tggccaatgatttgcaaatactaggtattcaatatatgttgaattggatttgtcatgtagtgcatgacctttttaaaatggctcaattattattttctctgtgttacttccaaccggattataagcttctgaagaatgggaagtgtatcttaggccttggccagtttctcagacttggtattagttttctcttctataaaatggtaaaaattatagtccctcttggctattatgccacagcgtctagaaggatgtcgtgcccattgtagctgcttaatatttgttcaatgaatcaaatccagtacacccaagtgagcaaatctctggaagggttacaaaaaatgacctgtcccatagctttctcctaaatgcctccgtgacccaaacagaagctcacctcctgggtgttgctgtattaatgaactgactacctgttttgctttgttttgttttgttcatagtggaaaacctcaaccactgtgagtttgccctgcttcgagactttgtcatcaggtaagatgtctcccctccagctgtccagacagcaggttgaattatttggggtcagggtctatctgttcagattcacctcctgcatctccaggtctctctgacagagctttctgccccagttccagctcctgttgcaaaatggaaggtgctgtagaagaatccttagctcctgggagtggttcccattcactgggtccagtccctcgaagtgatgtgtgtcaccgcctcctcttcctgcccctaattgcagccctcttcttctcaccctgtgtcctctaggacccacctccaggacctcaaggaagtgacacacaacatccactatgagacttacagggccaagcggctcaatgacaatggaggcctccctccggtgagcgtggacacagaggaaagccacgacagtaacccatgacgaccacttctctgtgtcatcacacatacccacttcacacacacacatcccaaataccaccaccaaccaccttcttcctctcaactctgtcccacaggcctgtctggtatttgtggagcatcttgtctgtgtgtgtgtgtgtgtgtgtgtgtgtgtgtgtgtgtgtgacagagagagagcgagagagcctgtgtgtgtgcatgcaggggtgaggtattttcactgccctccctggagagtcccttgtaagtttggctcctccatgcctgtccattatctgtctcctttccttgtgtcccaaaacaaagctgtttgcctcactcaggagatctgggggaggtttcatttaaaagtgctgggagcaggtgagccacaggcaactcttctctcggaacctgcacacaaactggggctatagagattctccaaggacagatggcagtggagctagacctgagtagggggcagggagttcaggacaaccctcctgtaagttgggggtggtctgggggtaaggctggggcttcctgggaaaaggaaggccatgagaaggcagagaagtaggccagagctgggttcttgcagaaagcatcagtgcctacaaatggagctccacccttcagtctgtgtcgtgttcagtgtcacaaagctaccacctgtcaccagagcctactgctgctctccactcaactggcctctgctgccaggccactgcctgtctctgcttccgactttgtcttctttctccctttccctccttccctcatacattgctttctctccctctcctgcgtgtctctgacatctctcacttccttttagatgaatctactttaggttcattcctatatttagcatttatgcccagtctacttccagaaatgactttagactgcctttcacataaaatcacaaaactacaggacagtacaaacagattgccagagaaatctgggtcaaagaaaggaataggaaagaaagtttctgtagtcaagcacctgaacaggccctgagctcacaggcagccaatgtaaagagggaaacacagtgagttatgcagttcccagtgtccagttaaaggaagcacacatgctagtcatgtgagacaaccttttattgggacatcaggttctagaactaattctaaagaagtatcagaaacaatatacataatttgtctttcttagtaatttggcttcaaagacaaatttttgaccacacctccgttttctccgtcagacttctctcccttctaagcaggcttctctgttgctccatttgcttcatacatacttgacctctcttttctattccccatcacttttgtgctgaag

SEQ ID NO: 103967 - DNA, 1027 bp, Homo sapiens
ctcaccaccacagcccctctcagccctcagtaggtgggaggggccagctgcctctttaggccagttgcatcctccatttatccaaaccactcctctcctcccagtggagtggggttctgccagtacagccctactgcatcatctgcgtcagccggtcctagcccatctgcagggtgaaagaactcatcaagagctccttctgcccttgtaagcccatcccagctacttgtaaccatctctaagggcaatggcattgctccctacccattcatctgcatgagctactcttggcttccttaaagggtcaagaaagcaatttttctgcttactagattcattgagatcagctgtgtgagccccaaagtgggacaagggtgtctccttcattacttaaagatattcatgagggtgggtcactacagatgttggggagcaagggctaggatcactttttaaaaaatcaccacttgtggctgtcccagagtgcggttgtacatcctccccacctcataacgcagccactgaggaagagtggttttcctaagaagacattgctggagttgactttcttctgtccaaacaaacaaacaaaaactaaacacacacacaaacccccagaaacccacaatatgtacacgctaaggaaaaactagcacccttctgtccactcagcaataagagggatctcttcccacctaccctacctactcctacccccaacccccttccccattaatgtgagtaatgaattagcctgaccacaggtggtcactgtaggctaatggaaaatacccaagggagggcaaagccccccatcagatgcatgaatgtttgcgaatgttgactgccactgccccacacactgtgtctttatagaattcccctttgcccaccctcttcctgtctccacctggacacaacttgctcaaaggctggtgacttgtgggccattcatctacaaccaagtcctgatggagcaagaggcccacgcctaggggatgcaagaacaacccgtttcttaaatgtt

SEQ ID NO: 103968 - DNA, 1045 bp, Homo sapiens
ggtcctgtaattgttgctagactttatgtgttgtacaactaaacattgctgtttgaacagtaactgcctggcctgtcttatttgtgctccttgaccaaatcagccattatgtcatctcacccatgtgtggagggtgagactctcttggtaagaaatagccacagatattagagatgaaaacactttgtgaggtcagttcatcttcagttggcgtcaggtcgggcctcagtcattattttctagtgtttcataaccaaagtgagtaatggatgggaggttgaggtgggaagatggcttgagcatgggaggttggaggtgcagtgagctgagatcattcctgacaggaccaacccaagtccatacctaaaggcagggggctaagggggcaggtgaggtcgggaggccactcacctatcactcaccccttcgcgctcgagccaattctcagggcccgcctctttctcccctttctcggcgggggcctctaccctgactccgccccgctccccgggcactgccccaccacgtgacccggtctcgctcctcctcctcctcctccttacgtcataatctccgccctccccttcagaaccgcgccccacagctcggcgcaggtcccgcccctttccatctacggggcggcaggaggcccgaagcaagatggcggtgaatcagagccacaccgagaaccgccgcggagccctcatccctaacggtgaaaggtgcctgaggggaagcacggcgtgctgtcggaggagaggagacgaatgagatagacatggcggctcgcaaactctcagcgagtcagggactttgccgccttttttgggcgcggcgctcttagctccgcccccgacctttgggagcgcgcgcccctcactggtgttccggcatgtggaggtggcggaggccggaacgcgtggcctcgcgcgtttgaggggtgggggtgggaatgcgccttttcaaggcgcggggcccagacgcatgtctcctcagggcggggcggggagggggtgcgagacgcgtgtgtccttcgaagagaggc

SEQ ID NO: 103969 - DNA, 1095 bp, Homo sapiens
gccgggctcagagtaggtgttgatgagtatctgctgagtcagggaaggtgggcagatagggttagataagctggggtgctggaggcccgtggcatcctccctaaacctgtgtgacatggagctgtgaactgggggacccagaactcagggagggccagggaggcaatggtaggtcctgtctgagcaagggaccccagccagtagccaccttctgtgcccaggaaaaatctctcatcgaagtgtacatgcggcctctgtccaacaaggctagcgccttagtcttcttcagctgcaggaccgatatgccttatcgctaccactcctcccttggccagctgaacttcaccgggtctgtgatatatgaggtgagcacccggctgcctgcagccacccgcctgggcttcagatttctgtgggagggtattatggggggtggttgttcacatatggcctcccctgagccgtgggcttagggcctctggcaggtgcccatggggagctgcaggcactgagagctgcagccagtgccgtgctctgcaccagtattttcaacctatgcaaacagaactactgcatataaatatgaatcccattagcctctacggctgtactcctcccaagggtcagcccttgctggcacgttcctcacagttttccatgggctggggctttctccactgcccgtgcttgggcacctgctggatttgctggtggagaagtgatggggattcagggctcccacttctgtagggcatactggaagcccagcacagacaggccaaagtccaggcagaaggcttctacatcctctagcggggggggtctctgtgccgccactctcatggtggcattggtgatgtccctccccactgcaggcccaggacgtctactcaggtgacatcatcagtggcctccgagatgaaaccaacttcacagtgatcatcaacccttcaggggtagtgatgtggtacctgtatcccatcaagaacctggagatgtcccagcagtgaggagctgggacatgtgacaggctgtggtggcaccactgagcctagaccatggagccttggcatgcccagggcaagtggggaggtt

SEQ ID NO: 103970 - DNA, 1050 bp, Homo sapiens
tttgacaccaaaaagggtgggctcaggcctctggagctgagaagaaagcagacagcagtttctcactgagagaacatgggggtgggtgggtgtcagggagggttgtttgtgggtgcaccagcctgggcccacaccctgggtttgacccaagctggcatgagaaggcagggtaggctcctggcaccagcatgcacagaagggagaccccggtagccccagagcagggccaccctctgaggccctcctcatcctgagcaagccggtggggcctgttctcttccctcttccccactctctgtctctcctgctgagcctcctcaactcctgtgtgggtccctgggctgcagcgtgtgattctggtgctggactctgccttcccctcgacatccaggtgaactacagtctgctggcggacatctgcaacctctggcgtaactatgatgacatccaggactcctggtggagcgtgctctccatcctgaattggttcgtggagcaccaggacatactgcagccagtggccggccctgggcactggaatgaccctgacatggtaccaggatggagggggatgtccctaggcccaccatctgtgacgaccctgctccccactgccctgtgctttcttccttcttggaggctcactgccgggttctaggtcagcgcttctgaaatgtgtccctgaactggttgctttagacttgacttagaagctggtttccagggccccatcccccacgttttgcatcacaatgttcaggggaagaacactgttaaccatctccccaggcaattctgatgtttctgaaagctcaagaacttgggtctgtagtgaccctggaataagatgttattgctctgcaggttgaagatcacgaccttgctattcctagtgcctggactgctctcccccgtgtgcctctgatccttttgtcaatttcctgcctcatcctccacagggacaactggccctcacagtcctgcttctagcccttccattctatctcggtcattgccctgtgacattttgttgttgttgcaatttatagc

SEQ ID NO: 103971 - DNA, 2415 bp, Homo sapiens
tgggattacaggcatgagccactgcatctggctgatgtgatattttcaacttacactgggcttatgagaacgtagttccgtggtaggcctaggagcatctgtactgttaagttctatatatgggatgggaggagctgatgggggttataggaaggttaggacataaggtgttagttttgctaattccagcaatgctgtggtgacggccagacctcaagccactgcctggcccaggcaccatcctcccacttactgctttgcaagagccagccattgcaggaagagccaattctaccctaaacccaggagtccagtttcccttatatataggcaggcagcctctgtagggctgagcaacatacagatggggtgggatgagggctggagctgtgggggcaactgatagtcaccatcccctcctcccttgccccctagtgctcttgctgggacatgtggcccaggtgctgatgctggacaatgggctcctgcagacaccacccatgggctggctggcctgggaacgcttccgctgcaacattaactgtgatgaggacccaaagaactgcataaggtgagtaaggtccacactcacctgatgagccttgcccagggccctgcagattcgggggcaggaagtggagagtccactagaaaagagggcaaggtcagagttctccatcccagagactgcagccagaagtcactcggactgtctgacacctagccccatgacctgtctggagcctctgcagggactctcaggccccaacctggtcacgaggcagggaccttacatggacccagcccctgagataactcttagaaggtcaggccaggccccctgtacttcccctgacccagtcctgccttttagcctggggccagccactcctttcaagccagcttgcttatggctcatcgcacaatctctggtggtcatttacactgatacctggcttagggctcagcaaggtcatggtttttatagcccagattcaatcagagctgaggcagggtgtgggtgagggccgggctgggtccctgagctaccccatccctctgcccctcactagtgaacagctcttcatggagatggctgaccggatggcacaggatggatggcgggacatgggctacacatacctcaacattgatgactgctggatcggtggtcgcgatgccagtggccgcctgatgccggatcccaagcgcttccctcatggcattcctttcctggctgactacgtgagccgcaccccagccctgcccttggcctcagggctagaccactcctttcaccctacctcgcttagggctcacttacatgattgagatctcacagtctagtgggggaaacagacaaatgaacaccgacttttggcctattctgttgagtgagagccagaaagggcatctcacacagcctggtattctaggaaggttccctggaggaggcatttcttgagctgagcccagagagatggcattggaggcagagaggatggcaggagcaaaggcctaggggcaagaaacagccgctgggaggtgtgtgttgggggagaggtgggccatcatgggcagaggccgggccagcatgctgggaccatctcctttggtccgtgggagccactggaggtttaatgggacggggtcagatatgccttgaggaggctccttgagggtcctgcttgagcccactgtgtcctcaaacccccacaggttcactccctgggcctgaagttgggtatctacgcggacatgggcaacttcacctgcatgggttacccaggcaccacactggacaaggtggtccaggatgctcagaccttcgccgagtggaaggtagacatgctcaagctggatggctgcttctccacccccgaggagcgggcccagggtgagttacgcagctggctggggcacgtaggcaaacggggagggtggccatggagacccacccagcgcccacctggctgagcttcccaattccccctacccaggggttagggggattgtggctcccaggctccctaaatatgagtggcagcatagcccaccctggaagcatttgaggctctgggtatgtggggaggcacctactgtttggagcttgtttcttcacatctgttgggaaaaggtctgggctaaggccccagactgcctcctgcacttcctcaggactgaaacaggttgggctttctctagggtaccccaagatggctgctgccctgaatgccacaggccgccccatcgccttctcctgcagctggccagcctatgaaggcggcctccccccaagggtaagccattctgccccctgcctgatggcgcttcccacacccaggcctccttacctcctgagtgccaggcttcagggacggggccttccagagccagggctgctctcaccacagg

SEQ ID NO: 103972 - DNA, 1096 bp, Homo sapiens
gccttttgtcttttttttagacagagcctcactctgtctcccaggctggagtggaatggtgcaatcttggctcactgcaacttctgcctcctggattcaagcaattatcctgcctcagcctcccgagtagctgggattacaggtgcgcaccaccatgctgggtcaattttttgtatttttagtagagacgggatttcaccatgttggccaggctggtctcaagctcctgacctcaggtggtccacccacctcagcctcccaaagtgctgggattaaaggtgtgagccaccctgcctggccttctccttttctaattacttttcttgccctgaatttttccaaggactttaaaatcaagttgcttatgatgggtctgagggtatgtctgtgagagggccaggtcttctttggtcctgccagagtgggctctggagctcacagctgccactctgaccctctgcagatgtccttcggccttctccgtgtgttctccattgtgatcccctttctctatgtcgggacactcattagcaagaactttgctgctctacttgaggaacatgacatttttgttccagaggatgatgatgatgatgactaacaggtaagacttgctttaccctagatggagcaggaagcagggtggagcatctgtctgtgatgcagtctggcctggtagcagcatttggacactgggggcagaagcattaatgaattggcccacttggtggctaatgttttcgtttgtttgttttttgagacggagtttcgctcttgttgcccaggctggagtgcaatggcatgatctcgactcactgcaacctctgccttccaggttcaagcgattctcctgcctcagcctaccgggtagctgggattacagacatgcgccactgtgcctggctaattttgtatttttagtagagacggggtttctccatgttagccaggctagtctcaaactcccgacctcaggtgatccacccaccttggcctcccaaagtgctgtgattacaggcgtgagccactgcgcccagccaacttcatgtgctctaatatgtgctgcatggcattctgtcaagagatgaggacactc

SEQ ID NO: 103973 - DNA, 1032 bp, Homo sapiens
gaatgcttttttatctcattttagtgcttgtgatggcatctttcatctaacacgtgcttttgaagatgatgatatcacacatgttgaagaaagtgtagatcctattcgagatatagaaataatacatgaagagcttcagcttaaagatgaggaatgactgggcccattatagataaactagaaaaggtggctgtgagaggaggagataaaaaactaaaacccaaatatgatataatgtgcaaagtaaaatcctgggttatagatcaaaagaacctgttcgcttctatcatgattggaatgacaaagagattgaagtgttgaataaacacttatttttgacttcaaaaccaatggtctacttggttaatctttctgaaaaagactacattagaaagaaaaacaaatggctgataaaaattaaagagtgggtggacaagtatgacccaggtgccttggtcattccttttagtggggccttggaactcaagttgcaagaattgagtgctgaggagagacagcagtatctggaagcgaacatgacacaaagtgctttgccaaagatcattaaggctgggtttgcagcactccaactaaaatactttttcactgcaggcccagatgaagtgcgtgcacggaccatcaggaaagggactaaggctcctcaggctgcaggaaagattcacacagattttgaaaagggattcattatggctgaagtaatgaaatatgaagattttaaagaggaaggttctgaaaatgcagtcaaggctgctggaaagtacagacaacaaggcagaaattatattgttgaagatggagatattatcttcttcaaatttaacacaccttaacaactgaagaagaaataaaatttagttactgctcagataaacatacaacttccaaaaggcatctgattttttaaaaattaaaatttctgaaaaccaatgggacaaataaagttggggagatgggaatctttgacaaacaaattatttttgttttaaaattaaaatactgtgtaccctctcc

SEQ ID NO: 103974 - DNA, 1027 bp, Homo sapiens
gcctgaggcatgagaatctcttgaacctgagaggtggaggttgcagtgagccatgatcatgccactgcactccagcctgggcaacagatcaagactcagtcttaaagacaaaaaaaaaatactgagtcttacacacttttgcatctttgtgtctctatgggtcttcacacagagcttggcacattgtagctgctcagtcagcactgtttgtgctgaattgaaacaatgagatatgtacaaaggggctgtctctcactactggggatttaaagccaccccgaggcatttgacaagctgttctggccaaggttgaagaggttgtcctgtcataaagcccccctaagacacgatgtcacacatagacaccactctctgtgcgaaagggggggcctgtgcactgaactcccagacttagctgggcctcagtgctcttcttgggtttggtcatagagcccaagaggaggtggataagctgcctgacactgatatggtaaaaggattatctgcaaatttctagcgtcatcaagactggcctctttggtaagcaggcctaaaaggctgccctcaataaaccacccaagcaggtgaaaattatctttttaccccaagcctaccttttctacatccttttctacttgacatgccccttctactcctcttctctcctttaggactcattctctctcctttcctcctctaaacctcctcccagaaaaagacctgataacttcacttacaccgggttatagatgactaacaaagcttactattgaatatgttgctagtagaaatctgaataagatacagcaacttttcaactctgatcatggctttaagcactaggatgaaccacagccatgtaatcattcatttggttacttagctcttgctgtgtcccacgcataggggcagctactgggggtttgacagtggacggacctaaagtggtccctcagtcaggggacagtacagtaccctaagagcactgaggagggccaccccacgtgaactcaggtagtcaggggag

SEQ ID NO: 103975 - DNA, 1033 bp, Homo sapiens
cccagcatggctactgccaggtgggcccactctaggaaccctggccacctagtcctcaatgccaccacactgactgtccccacttgggtggggggtccagagtataggcagggctggcctgtccatccagagcccccgtctagtggggagacaaaccaggacctgccagaatgttggaggacccaacacctgcagggagagggggcagtgtgggtgcctctgagaggtgtgactgcgccctgctgtggggtcggagagggtactgtggagcttctcgggcgcaggactagttgacagagtccagctgtgtgccaggcagtgtgtgtcccccgtgtgtttggtggcaggggtcccagcatcctagagtccagtccccactctcaccctgcatcttctgcccagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggtgcctgtggggagcccggctccctgtccccttccgtggagtcttgcaggggtatcacccaggagccaggctcactgacgcccctcccctccccacaggccgccgtgcatgcctcggggagcccctggcccgcatggagctcttcctcttcttcacctccctgctgcagcacttcagcttctcggtgcccactggacagccccggcccagccaccatggtgtctttgctttcctggtgaccccatccccctatgagctttgtgctgtgccccgctagaatggggtacctagtccccagcctgctccctagccagaggctctaatgtacaataaagcaatgtggtagttccaactcgggtcccctgctcacgccctcgttgggatcatcctcctcagggcaaccccacccctgcctcattcctgcttaccccaccgcctggccgcatttgagacaggggtacgttgaggctgagcagatgtcagttaccc

SEQ ID NO: 103976 - DNA, 4184 bp, Homo sapiens
gagctggtgtggggtcctgttcttctgagtaatgagcaagattggggtgcaggcccaagactgctgtgtattggtaaagagggcaaaccctgccctgtcccctccttgagcagagcctggcagggtacgtgtgggcattggccttgattcacacgggcatcctgcagccccaacaagatgacacccttctgtgttcttggaggtaggtgcccattagctcaactgctggcctgcattcccagggcttgcttttacttgtctgtggtgatgttgtgccatggcctctgtgtgtgttcctgcttattggtgttttctgccaagtagtcaggaacctccttgggcaagagcatgtgcatgtacgtgcttgggaacagctcaatcttagctcccgcaggccccagccgccttagcagttctgcgtgtgtgaactttatggaagcagaaagggctggtgacacttgggttcttggggtttgtcaggggagggcaccaaattggtcttgaggaagcagttaggtgagccccagtgacagtcttaagcacagtgattggcagatagcaagtgaaggaggggcaaggctgccaccacttctggcttctggtgaaattttactggactgattcctaggaaactgctgtttgtctttgagacctttccacatcagatggcccatgaagcgttccacagggacctttggtacaatccatctgtcctacgtgggccatcagaatccccttctgcacatgggctggaagaggagagaagccctccagcctggggatgggagacctaggggtctcaggttcctgagaggtcgaaaggattaacatagtccagctctgtctgagcctcagaaaacctgccctccctgttagaggccatgggaagagtgttctttttaagcatgaagaactgactgtgggccaggtgtagtggctcacgcctgtaatcccaacactttgggaggccgaggtgggcagatcagctggggccaggagttctagaccagcctaacatggcaaaaccacatctctcctaaaaatacaaaaattagccgggtgtggtggcgtgcacctgtgatcccagctatttgggaggctgaggcacaagaatcacttgaacccagggggcagaggctgcagtgagccaagagcacaccactacactccagtctgggcaatagagcaagactgtctcaaaaaaaaaaaaaaaaaaaaaaaaaaaagactgtcattagccaagcatggtggcgtgtacctgtagtcccagctacttggaaggctgaggtgggaggattgcttgagcccaggaggtcaaggctgcagggagccaaggcgacagagcgatgtcttgtctcaaaaacaaacaactagctgtgttgactagaggcagctgtgaaactgtcctaaaaggctggacttcgagaagtttcttccacagattgaccaggtactgtaggtttcagtcacaactggggtcctgacactggcaaaaccccaccagctgccccacaagtggggcctgccctgaggtcagggagttctctgctgtactggttcctttatgcactaggaaggcagacatgccctgaggagccctcagagtccaaccccagcacccccactaggtcattgctgcctttaatcacattccagatccagagccacacagtggccctggcattggtctcgggtgtgtcccatatcagcagcacatctgcagaggggcgtgagtgcaggctccctgctgaaagctcccaggggtaccacggaacagcggctgttggtggtggaccctgtggaggctcctggccttcactgtgtgtcccttgtcttccaggtgagactgtggagatgagaaggtggtggacactcgtgatggaatggaaatcgtcctaccgtgcagccacaccctgccctgccccgccccgccccgcccgcgtgcctgcccatgccagcacttccttaagttctcacatcacactcaaaccagtgacaccacaggaaagaaagacccaagacgttggaatggctgtttccatggacacaatctccatagtgacaatgtggggggaggggggaggggtgggatgatggggaaagggtggggggaattaaaagggagggataaatatatatatataaatctatttttagtctggaaagactttgtttaaatgaaaggtgcgctatcccttttgattctgttttaaaattatctcgttaaagatctccaaatttgttccgatgacaagtgaaatttaaatgtgagattgaactgaacaaaccctcatctcatgaaggacggggtgtgtgtgtggcgttgatctttagcctgtctcacaccagttcagaaaacactagacccaggattgaaaaagcaaaccacagcagaaccatccttttgtcattaatttgtctcaaagtgggaaggttttgggggagggggaaatacagggatggtccatgttttcaagagtaggggaatgatgtttaaacacaaaaataaattttttttcatttccagaaacactatttatttatggttttttttttttaattttttctttttgggggtgaaattggcagatgcctgaggtcatagctgtgtcctgggtcactgtggctggtgaggacctcaaggaccccatcaagtgtacacagcagcagcaaaatcaagggatgaccctcctctggggccccctgtcctcagcacattccaggcagctgtgccctgacccacagggacccgtggggatgggaggaggtccaggcctgtgttgccagagctggcagtgtgagctgtaggcagggacggggagggactgtcgctgtgatcagagtgggttaagctgaccaggaacacccatttaacccctttttctttttgctttcatttttataaaggaaaagaggacctgtcagataggcagccccatgctacgtgattctttatgttgtgttgttttgttttgtaaattgtataatttttaaatatctgagttttaaaaaaagaaaaaagtacaaaaaaatcttgttatggccttaagaaggggttagtgcatctttcaggggtcactctgccatggggataaaatagctgtttcacaaacagttttatttaaaaaaacaaaaaacaaaaaaaatcaaaaaatcaaaaaaataataaacttcattttaaccttgtttcctcttctgtttactttaaagtgaatgcgtctcttccttctcccattctaacccccaaagggtagctctggttctccagaggaggccatgatcagaacctgtctgtcccattcctggcctctcgatggccacgcagccgggaagcaaacaaaatatagggttcttctgccactcctctgggcaggtggagtgtggccagtgtatggggacagtcagatttactcaagttgatatgaagacatatttccaatcaacattaagggttataaaaaaataatggaatgttaatggacttttttagagaatggaaatactggaaggaatattgtgaagcagaaataagcaattataaatgagttctgtgttcatcaatttggggcagcagaaatggcagattaattgtattttaatggctacatcaagcagtccatttctcatttcactccgccaggatggaggtgtgggtgggtgcgccgtgccggccgtaggaccaagcttaggcaactgaacaggacctgcacagaaatgatggcttttttgagctagttgttgtctcattctggtcttgacttggcattaatacagttaaaatgaaatggatagacttcaggtgtcaagggctaaaccacaaaacttgaaaaatatgtatcttgaggaaaatattttcctgacagcaaatgtttgtcattttgtcttttattcttttgtccccttttgatttgcctgagtggagcacttgtgattgttctaggtctttccttaaattggcttcagtaatgaccttcactggggagtggcagtgatacacgcatgcctcctgactccagtttctggcttctgcagttctcctcaactgctcaagtgccttttagttcctttagtgtttgtcttaattgatttttttaaagtagttttatgttcacagaaggattaagctgacggtacagacagttcccatataaccccttccccccgtatgcatacctttccctcta

SEQ ID NO: 103977 - DNA, 1022 bp, Homo sapiens
tctcccgcctcagccctcccgagtagctgggactacaggtgtgcaccaccacgcccagctaatttttgtattttttgtagagatggggtttcaccatgttgcccaggctggccttgaactcctgacatcaagtgatcttcccgccttgacctctcaaagtgccgggattacaggcgtgagccacggcgcccggccaactcttgaacagaacaatgagcttcatccttctgggttgaagcacagtgatgaagtggcctcacccattgaagagagtcgtctcaggtccattgaggttgaaccattccattcagctcttggagggagaggatggactcactgcatccagtcctgtccatctgaaatgttttttatgtgctgttcccacaaggcatatagcttttcctggtttcccagttcagcagtgacattgagggtggtcaccgtccttcatttgtggtagaagccctggtgactggggatagaatcacacctctgactaaaggaggactcatcttgggccccatgctggggacagagagccaccattattgggtgccctgacaaggcagggaacagacagcgaatgtgcgtgtgtgtctgcctcctagtgcgccatgttctgacagagtgatatgataggtgctgtgtgactaagatcagactactccatgtctctgtacttcggtttcttctgtaaaaacaggaatagcagtgccaaccttttgagattccattgggaaatgtctctaagtgccagcacagcacactggctctcagcccgttgatctgccatgcctagctgtgggtttctcttgggagttggaggggtcaaggcagcagattggaccctgcagctgtctcttatagcaaaaaatacccaaggcttggggttaaaagatgccgcccctgcctcccagcctgtgaggtatctggtacctgaccctcgccaggagtgcggaggggaaaagtccttctgcaggcccgtggttgcccactgtctctttgtgccaagggggttgcct

SEQ ID NO: 103978 - DNA, 1050 bp, Homo sapiens
cagtggatgggctgtctcgggctccacttcccagtttatttaggaggtggtctcgtggtcgcttcctttaggaaagggtgggaggtaaggggtgaatggtctgtttgtggataccacatatgtgtgtggggagggtgtatatggagaaggagccccaagaaaggatcagaacggagaccactgccacctgatgtttcctgcaggggctgcactgtgtctctggctgaggtcacactgacacctggtggtcactggtcactcgcagtcttaaatctagtagggccgaaagtactagaaggaggttgtccagagaggtctgccctcaaaatgctcctgaaagatgcttgcttatgcttttctttaaaaattatttctggggaagggcggggagtggtcacaggatcttatattctctttatttttacttaatttgcatgttatttttagaactcccctttttaagggtcacattttgcctcagaaaaccctgtctgaatgtctcctgtttgtcggtcaggactgactctgccttttctttccttttccatgtgccactcctgtcctccctttgccctccctgatttctgcactgtcctctcccacctgtctgtctcctcttggttttgcccgtgtcagcctccccttccgtgccctctcccccccttgcagaacaagaccgcgaaaggcagcctcagcacagagcagtcggagcgggggtgaggggggcagtgtgctcgtgggaatggaaaggacagcaagcacaggtgagtcggggccaccgggctccctgcatcctgcccggctcccagcaggcgtcgttgcctctgccctcctgctcgctctatgctctgccaccagcatttcatcctgtggatgacaacgccaggtggatgcagtgttcttccattggttacttagctccccagattatctgtggaaaggagtgggggcttctaaactgtccactgccaatggggtgcagggtgactgttcctgaaggcagcccttcagggcacagctggccaggggtggccttgtgagtggacacaa

SEQ ID NO: 103979 - DNA, 1003 bp, Homo sapiens
gccatcacacccagcctttcagtatttttttttttttttttaatagtgacaggatctcactgtgttgcccaagctggtcttgactcttggattcaagtgatctttctgcctcggcctcccaaagtgctgggattacaggtgtgagccatggtacccagccccaagtctttttttaatgcgtagaaacattttaataaaattagcacatttatacatttgtacatcctggttttttcaagcagttttgtttcatgggtgttttccataccattaactcttttcaaatgttaatttttaagtgaccgatatccatcatgttaaggtatcatagcttacttgggttgtctctaatgttttcctattagaagtaagtgtagcgacctgctacctttatgtctgaccctgtcaatcccagccagcatgaccacacctatgtccagctgtgaagtctccatctgactgtccccttctgtcttccagattgtttgctacatgaggagaacttctcggtgaggtgccctaagcacaaggtgagtcagaggccccaagagctaccagcagggatgggatcgagggtggctcctcctgaaagacctgaagaccaggtgttggtgggcctcacccacacctgtccccacctgtgcctccggctgttagtcccctcctggccctgggagggtggaggggcatgatgctgaagggagacccgtggcatgggggccagcactcggagtattatgaggatcccaggagaaatgtgttttgggagagggggtgtttgtctgttcattaagagaggtgagaatatctaactcgatcaagccactgatttccacttgaggtgaatagaaccccaattcacaggttggcgtttggtaagtctggttctaggccttgaggcctgtgcaaaggcatcttcccagactagaagtcgagctgaccacaaggctctggggaagctcagtctcttccaggttgtgcttctgcagaagcagcctgatgc

SEQ ID NO: 103980 - DNA, 1246 bp, Homo sapiens
atcccctgagctccagttgtctggctcctgctgtttataaactctctggcagattggagcagcgggagtcttggtcacactatgtacttgtgggttttaaattaacacatttcatttattgccttgctagttgcttgctgggggaggggcttggaggttagtagtaagttgctgagctcttgggcccacggagccaagaaggctgccgcccactctcttagatactcatgggctccaacgaaagacaggctatgatgttccaggtctggccaaatataaaagggtctttttgatttgttttaggataccgggacctgaaaagttttcatgtgtatgttcattgcttattactattgcacttgaaatctgtgggtgcacaggctgctagtctggatctcagtttaaatttaacaaggataagtaccgtggctgcctcctgccatggtgcctgggagctctctgagaatgtgttatcaatatttattaacattctgccaccgcgttttgcaccagtgacctggctgtcggtctccaggagctgtggtgtgcagagtgaactcattaattagatttccttgccctgatccatgcactacccttgtgtgagagctcagctcacctggaggcagatgtgtccttgctgccatccaggatgctgtcatcatgttacaagttggaatgaatcatttttcctccaaggattaaaagcatcctcatgggattttaccttcctctgaagcatttagtgtggattatgtgatttgtgttggaggcttctgtgtctccgtgggtcgtggggcaaaggtgacagtggggctcttgggcctggccacctttctgtctcagacacctgggcattctctgtacagagaagaaaatacgcgtctagattttaaagtgtttttacaaggaggctttggcttgagcctgagaaatggggttagcctagaatcaaggatttttaaaatagcatttattggtgatatcgtgggaatatagaaaagataaaatttaaatcagctgtatcttcttacccaaagagaattattgttacatattcatagatttcctttcagtctttttttttttttttttttttttttttttgagacggagtctcgctctgtcaccaggctggagtgcagtggtgtgatctcggctcactgcaacctccgactctctggttcaagtgattctcctgcctcagcctcccaagtagttttttttttttttaagacagttttgc

SEQ ID NO: 103981 - DNA, 1849 bp, Homo sapiens
agtggaagcttgtgcccaggttgtcaccccagcccaccagcagagaagcgcaggaccctcattattagctgaggacttgtgagtaaatggtgtctgtcattttctgttttggggcccatcttggtagcctgcctagttaagctggtagcatctctatttaacagaagttggtggccgcgtgtccagcaagacagaggggtctgggttgggaggagtgagggtagggctgtcggcctctggctttgctgcctctgctgctgtgcactttgctccttcatgtggagacctgggacccagaggcagtttcacaagatgaccatgtcttggtcattgcggtctttttgatgacccaagtcacagtgacccagaggcctgcactgctctgtggggatggacgcttgtattattccacacagtcttcttggaaattgctctctgtgtatgatgtaactttgtatccaggaaacaagtttattgatggacttttctttctaatcataacaaaaataagtccttggtttgagaatccctaacctcccttatggagtaaagagcagtttaacattttcatctctgccttgctgtcaacccacccagatctttaaagagctgttgatgtctcagggaagacttttattactgggacatctccatagaaacagaatctttgtttcatgatctgtgactcctgccaccttcccccccacctgatgttgaccctgcatttctgacatcatggtcagctgttttgtgttgcttgttatgtcataggcacaggatttggctccaggtggggggggttacagtaataagagcatgagctctgtttttttttttttttaattaatgtatttaatgcaatgagccacaacaattaagacgagaaaaaaaggctgtggtagctcattaataattccactgtgcgtaaagaaccttgtgtggagggttttttttttttcttctactctcatgaaaaaacagctgggaattctactttctgcagctctcgttgcagtagcattttaaagctgctatctctgctgcagactttgatcttgctggtgccatcagagccctggatgggtcattaggaaatgccagtagtctgactcctccccgggggacagccgtctgcctcacaggagccagtcccagtgccaagagccccatatttccctccttatggcccaggagcctgagcctacccttcggcaaggcagggtggggctggcaggcccctgtgtcccaagccctgcagtgtgccaacataaggaataacagtagtactggggtagagtgtaggtgaattggagtctgtgtctgctacacaacagatccaaaggacattaaacccttcttgtttttcctacctccctccttgagcccaccatcctcagcctgggagcatgtggatgcatgtgggtatctgaagcttcacagagcttataatgaggagcttagtaaatccattctgcctttgagcttgaagagggaaatgaaagtggccttctcttctgggggttgatgtttgtgtctgcaagccatcttgttgactaggccaccttgtaggtctttttgagcttggatgatgatctcgcaagctgtttactttgacttcactatgcagaagtgctgactgcgccctctggacagtgtaggatggtgcctgggccttgaagaacacagattgagagaccttgactggctggccatgtaggtgcagttgcctgttcagagtcctcagaagaggttttactacacctactgctcttcactcttccctcccagcagggactggtaagaggagaagctcccctgtgccctccaggtttctgagctctctagctgt

SEQ ID NO: 103982 - DNA, 1038 bp, Homo sapiens
ttttttttttttgtcacttcataaaaaaacttcccacccattagcagcactcatctcccttcccttccctccagtccctggcaaccactattctgttttcttttttaaatttttatgatttttttttccctttaagctctgttggactcaatcctttctatctctgtgggctttgctgtacatttgggttacttccactttttgactgttatgaataatgctgctatagaacattcacatgcaagcatttgtgtgaacatgttttcagttctcttggatgtgtacctgggagtagaattgctggatcatatggtaactctgtttaaccttttaaggaactgtcagactgttttccaaaatggctgccccattttacgttctcagtggcagtgcatgagtgttctcctttccccaggtcctccctgacacttgctgtcatatgtgtttctttttttttttttttttaattgtagccagcccagtgggtatgaaatgttatttcattgtggtttttatttgtatttccctgatggctaatgtcgagcatttttttcttgtgcctattggccatttgtacatcttctttggagaaatagctattcacatcctttgcccattgtaaaattgggttgtttatctttttaatgtcaagttttaagaattatttgtaggccgggcgggtggatcatggggtcaggagttcaagaccagcctggctaaaatagtgaaaccccgtctctactaaaactacaaaaattagccagatgtgacgcgcacctatagtcccagctactcgggagtctgaggcaggagaatcacttgaacccgggaggcagaggttgcgagatcacgccactgcactccagcctgggcaacagagtgagactctgtctcaaaaaaaaaaaaaaaaaaaaaaagaattatttgtaattctggatatgtggtttgcaaatgttttcttccattctctgagttgtctttttactttcttttcttgatagcatcacacaggtaattcaccattggacaccaactggg

SEQ ID NO: 103983 - DNA, 1028 bp, Homo sapiens
agatcattcagtctgagcgtggcgagcgcttgggctttgctgttgctggcgttagtgtagttttccatcagtatctgtgtcgggggcctgagccagctcagtgtaattgcttagggaacacttttatttttcatagaagcaggaacaagtttctgtctcttccagctagtcttgctggttgtgtgcctctgctatctgaagagccagcatccttagtagggtcacatgtggttgagttttatgaatgtgtttgttgctgataggacacatttcttacctgacaggatgagcactcacagcagccacatcacagggctgacagagatgtgccccactttaagaaaacctgaccatataaggaggagtgtctcaattacaaaataatgtctcacttagccagaaattcatggcaggttttctggtgcatttaaaataagattcatgtataaaaataccatttgcacacaggagcccatattttctgaaaagggaaatgtattgggcatttggggtaagtagatcaaaaataaaaataaaatcttcttacaaatacaagaactagaaaccaaattccacttctaattctaaaaggtttatatataactctactaccttaccctctcttaccccagattttcacagcagaagtaaacagggaagatctgcaggccgctcacgatagcagcaaggaaatgcctggcatagtgtgtgggtgggtggatggcgggggtaccagaggcagggctggggaccccactctggcatgtcctttatgacatggattgctcatctcaccctgctgtattgttgatttgagaacatttgtgaggcttggtctaaaacattattgctggatcccttcccatggtgtggtcagtgaatggcatttagaaattgaccagctcatcctgccaccacggactcctctaaccacagagacacgtgctgaggtctaacagatggggaccagggaaggcctggaggagagggccaaatctgggatactgacatgcctgacttttcccttc

SEQ ID NO: 103984 - DNA, 1389 bp, Homo sapiens
accccgtctctagtaaaaaaacaaaaagttgccaggtgtggtggttcatgcctgtaatcctagctacttgggaagctgaggcacgagaatcacttgaacatgggagtcggaggttgcagtgagccaagactgtgccactgcactctagcctgggtgacagaacgagactctgtctcaaaaataacccaaaaaacaaaactgcatttctgacaagtccctgagtgttgctgatgctgctgttccaggggaccacacttcaaaaaccactgaactaaactgtctttaaggatctttctctaagtccctaatacagcctgagagtctttcccctttggatgcaatgttataaattaatcatagtggagtttgcacactgcttgccaggttgtggagttgaggtaggaagcaaatggacattgttcagatctaagctccacgtcttctctttcctcttgtaaaccgggatggtgatgaggcctgctgtgtggttgcttttcatgagatggtctttgtagattatctagcatatgtctgacacatggtcatcttgggtcacatttacttagcacttttgacccagccactgttttaagcctgaattaattcatttaacccttatgacatttctatgaggtgagtgctattattagtcccacgtctgtaggttgaggaacagaggttaggagtttggccaagaaggcagagctagaaagtggagccacttaccaggcagttatttaggttccagagcatgcatacttaacccttctacagcagcacccaagtttcctgtaacaaggctagaggtggcctggtcctgggtttgggtgatttagtgcttgacagtgtcatggtaggcccaggtctctccatcttgccactcttctgtcctcagcaggctggctttgtcttcagggctgtcccctcatggtgatactgtggctgccacagatcccactgtctaatcctcacagaggctgcgcaagaaaaattacctgttcctccctcttgtctctttttgagagggtgaaactttcatgcttgtaatcttagcacttttggaggctgagatgggagaattgcttgagcccaggagttcaaggacagcctgggcaacatagtgagaccctgtctctacaaaaacattttttgaaaaagctggatgtggtagcacacaccctgtagtctcagctactcgggaggctgaggtcaggagaatcacctgagcctgggaggtagagactgcagtgagccatgattgtgccactgcactccatcctgggtgacagagcaagacatcgtctcaaaatatattaaaaaaaaaaaaaaaaaggttggggggagtgcaaaatgttttcagaagccctttttcctgcagactttcctacc

SEQ ID NO: 103985 - DNA, 1027 bp, Homo sapiens
ctggccaacatggtgaaacctcatctctactaaaaatacaaagattagctgggcgtggtggcaggtgcctgtaatcccatctactcgggaggctgaggcaggggaatcgcttgaacccgggaggtggaggttgcggtgagccgagatcatgccattgcactccagagcgacaagagcgaaactccatcaaaaaaaaaaaaaaagaacctaaaaggaaaatgaacaatcacttgagagtcttgggaaatccccgtgtattagttttctatcattgtcataacaccttaccacaaacttgttaatacagttctgcttacagttctgtaggttcaaagtccaacacaggtgtcttactgggctggaattgaggtgtgggctgggctttggaaaagtccagagtcttaggggagaacatgcttccttgccttttaaaaattctgcagctgccgccctgtcccttctcccatcttccaggccagcagcattgcacctatgaccctgctggcaaatcatcaggtctccctgaagctgacaactgtaactccctctgggggggaatcgtttgcttttatgggcctgtgtgattagattgggcccacctggataacctagcatattcttcccatctcaaggtccttgacttaatctcatccacaaagttgattttgtatatataagatcacaggttcttgggattctgcctaccatatcccaagatctgattgctctgtaggagacagaacactgaatggctctcaggaaaccagtaatccagtaatcctagctcacccagtcattgtgtctctctgggtttcttttttccgcatctgaaaagttggggagttgaattagaccagtggtcctcaaactgcattgtacatcagaatagcctggaggacttctcacaacacagatttaggtggggctcaaaagcgtgcatttctgccaagcacagtggctcacgcctgtaatcccagcactttgggaagccaaggcaggtggatcacttgaggtcagaagttcaaga

SEQ ID NO: 103986 - DNA, 1065 bp, Homo sapiens
ttattacaggtttataatttgacttgaaaggttttcccaaagaaacaaatacttgtcaggatctgtagcagagccatgttttgattggggcttttatgggaggagaatggtgatctaaatatataattttatttcaaattatgcttgaaagatgatcagattaaagaaagtttgtgtgagtgttttcatgggcttgtattggagggaagcagatgactgggtcccaggaggcagagaagatgaactattgggccctaagtgtgttgtaaggaatagtaccatctgttggacctaagatccacatggcagcagagggtccagaatcagccacagcagattattctagattaatgtgagtagggacaggtttggagaagtatggctaggagcacctggcaggtgactctgatgcaggcagcaaaggagtcattggtttccaggtctgctctccacataacagagggcactgtctgtagagtacaacaggcaagcctgtgaggcggtttttctcattctagttgtgctcaatatgccattttggggcagttttcaatgctttcgaaatcctgctagaatttaatttgtatgcagttgtgtgtcattattagtccccatttatttaacatcttttcttgtaatgcaaaatgctttagaaagctttaaaaatagttttagtttgtattggtcccagataggagaattgagaggggagatacaatgaaagtaatagtaaatagtagctaagaagtgaagtgtccagagacttggccaagaactgaccttccacaccgtcggagatgaaacattactgaaacatacagcagctagacttaccaaaaaaacgaccagcagcaggtgtccagacccatgcagggtctgcttgtttaaggcagattgtaggagagaaattacttaacaaaaaattaactttaaactgtttgtcttaatttaatagactgtactttgtattatatctgattttgatatcagtaattgccaaagtatgacagagatgaatgtatgttttatgtaatttttatttaaaagttctaataattacataac

SEQ ID NO: 103987 - DNA, 2909 bp, Homo sapiens
cctcaaactctttggcttgatgaatgagtgacagagcgagaccctatctcaaaaaaaaaaaaaagtgtaggtggaggaggaggagatgtattgaggaattatgcaggatttctaaacttggttatattacttccagatctctattttcttcatggagactcttggagtttccttttctttttttcctttttccttttctgttgaaatgaggattgtactcttgctgagtatcttcctaatctggtaggaatcttctgaaacagaaatgtagaagaaaatttccatatctatgaagatgaattgaaccaatagttctaaaactttcttgaggataagaacctgggatgcttcccattcagtctcttctgggacagtgtcctcagtctgtgttttttaactcaagcttaggaccatgctggtgcaggtggcagagttaccctttgagaaatgcaaaaatcaattctgaaaactgaaggttcataagctagtcacagatttgggtgccaaagtttccattctagtgtggacgtagtttttccttccagtaggtttccaggaagaaaaggccccggtttgagcatgacctgtgggagtgacctgaaatgagatgtgagactatgtctcatgttgttgccaaattaaatgaccccactgaagcttggctgagaggtggcaggggctggcttaggatttgaggaccagtgatcctgtggtagtttcattggcattagcttcagtatatcaagatatcctcgtttttgaaagttcctttctgctgggactctgctatttcctgagcctccagtgtctgtcctgtcaggctgcccctgcctttgaaaaacttgccacttccaggaatagggtggctttgcctgacaatacctcaacctgtttgagaagatggacaggcgagagcgttggtgagatggcagtggctccgggtgcgaaagaggaaggtaatatgaatgcaagtaggaagaaaggagtaaaaatgagaaagacctccagagccaagtgtttggaacagctttggagatttccgcttcagtatgatcttcacagatttgaaatcttgttaagggagtcctattgtggcagcaggtttgtcgtttctgcactgaaactgtaaacatttcagtatgggtgccttgtgaataagcagcttccagtaattggctttctggaagcacagacccaactcctgggtaggatgagccatggagagaagcagcttacaccaagagtcacttccctggagtgtaatttctttaaaaagatgcctttttagattcagaaagcacaaaatgtaatcatttctctttataagctaatccactgtttgagcaaagggtaaaataaaaataagctagtgcaagaccttgtgcaacttcaatttcagtgtttcaaactatgtaagtatttctctccctgtacttgagaaaaagctcttctctttcttcatcacagggctgccgcaggtctcctactcctgctgggttcagccttttctcaggttctctgcttttattcagaggaaaagtgctaatcaatggcttatacctagtcctggactctagcactctgtgcccttcctttctaatttcttaaagggcacaagctccttttaacataggaaaaactccgttagacaaaatatataaggttttcagcacagtggcaattttcttttggggctataaaagaaaccctctgattaggattattttaatggagtatatataactgtagataagataaaatgcaggctgggtgcagtggctcatgcctgtaatccccgcactttgggaggccgaggagggtggatcaccttaggtcaggagttcgagaccagcctggccaatatggtgaaaccccgtctctactaaaaatacaaaagttagctggacgtgatggtgggtgcctgtaatccagctactttagaggctaaggcaggagcatcacttgaacccgggaggtagaggtttcagtgagccaagatctcgtcactgtactccagcctgggcaacagagtgagactccatctaaaaaataataataaaatgcaaactgtgtttcagaaaaaaaggcaagtttggttagcacaaagaaacatcattagtgacacctgtgttggccttctgagttatgagacttcatattaacattataacaaactacgtatacattttgtgcaagagaaaaattactaaaccaggccttcttgagtaatgctttaattttccagaagggggacatagattggatttaacttaaattgaggcaaatggatgtattttatttgggaaattgttttttgttcctcctttgttttgcctccataaatttattaatgcagaacctgaaggctgtaaacccaggataattagagttacagtgttacagaacattaaaaacccacagcaagtggctgatatctgcctaccatatctgcagttgaagttcataccatgtgtgataattacgaactttcttttttgtgggcaccttggtagaaattattagtatcacctgccatattttcacatgttacttaaacatcaataaagtgtacatagtaaagcagatagctgagggtggggaataagtggttaaatactgtgtctgacctgtaaaatacgctctaaatagacaaaaggaacccctttgtgtggcagcatagctgggtttggtttagtagcaatagtagattgttagctttaactcctcctggatgtctgtgctgctgcccatagccttgcagacaagcacagacggcctttgtagtttcaagggaccatccattccacatgggactagagagtaacaaaatgactagggatcagtgctggtacttcctgggaagtatgtgcagggtgtgtgtgtgtgtgtgtgtcagtcaaggtcttgcc

SEQ ID NO: 103988 - DNA, 1059 bp, Homo sapiens
tagaattgtgtcctcatgtgttggtttagtaaagataaccctcctgtctctaaacttattggtggaaattaaactgaagagaaaattcagccctatctgatgctgtccacgtaaacctggtaatagtggagtgattttggttgtatgcacttaagagctgacacttaatttgaagatgttggcagcatactgctgtcagttaacgtgccttatgaaaatagaattgaagaactgctacacaggcagatagacaataccagggtcaacagaataacaaatttccagccgaactcaaatctgaagtggtgctagtcccttctgatggactagcaccaccagtgggacctgggtgccctgacattgttcagcggtggaggcatttcatctctgttatgtgtttctcacggagcagctagtggaagtttctagtaaaatgtatattcatctaacaagtctcaggcctattcattgtggctggctccctaggggtgccatgtggttccagactttgaaagctgtgattgtgaaccttaaatcttagttcagacacatgtcaggtgaaggcctctggtttgcttgaaagttatttttgttttttcatacaaagctggttgctaggataatagtgtaattcattaggataagtgataggacagttcccaaattattctgtttgcttgtttctaggtagggttctttattgaagtaataaaaatatactaatgctttgaaagggcaacccctcaaaaatgaaatgtatttgtttgctgatataagactttgtgtctccctcctcttcagagagcaggcctgggcattttaatccactattatttgtgaaaagcacatcgatttaaaaccagctcacctgtcacctcattccccaggcagcaagtgctgcccagctgcactcccattttacctgttacaccacttagcacccatgggtcaaatcccccaagtcactccaatagtggcaggtctgagtgcctcctcactgagggtaggacagacctctgagaccttactgactcagccttccctttgcaggttacacag

SEQ ID NO: 103989 - DNA, 1055 bp, Homo sapiens
tcacagttctggaagctgtataggaagcatgatgcctgcatctgctcagcttctggggaggcctcaggaaacttacagtcatggagggaggtagagggggagcaggaaggcttcttgcatggcaggagcaagacagagtgaggtgcgaggtgttgcacactttcaaacaaccaggtcttgtgagaactcagtatcacaggaatagcacccacatgatccagccacctcccaccaggccctgcctccagcattgggtgctacagttcaacctgagatttggtgaagtcacagatccaaaccatatcagggatctattgtatttgaaggatttagcctttaatttacgggcagtgcaaaaccattagtgatttctaagcgtgtaagtcacatgtacaggtttgtgttttataaaggaaactcaggaaataagtagggagacatcagaagcagacaggtcattcgagaggctgtgggattaatttgtgcaagagctggtaaggaccgagtatgtggtagaaacgggagtcagaaggattggatggatctgagaaacgttttagggattcaaagttgatagacttttttttttttttttttttgagacgaagtcctgctctgtcacccatgctggagtgcagtggcacgttctcggctcactgcaacctccaccccccagtttcaaacatcctcccaggcctcagcctcccaagtagctgggattacaagcatgtgccaccatgccgactaatttttgtattttttagtagagatggggtttgaccatgttggccaggctggcctcgaactcctgacctcaggcgatccacctgcctcccaaagtgctgggattataggcgtgagtcaccacacccggctaaagttgatagattttaaacactgactagatgcagcaggtttgggaaagtgaggaggcagaggtcaaggatgaagttgaggtttctagctccagcaagtcagtgggcgaggtgaggggtcatcaacataccaataacagaaagaagggttgaagaaaagaaatttaggtttgcgtttaa

SEQ ID NO: 103990 - DNA, 1327 bp, Homo sapiens
agtcttaatgacctagtctcaaaataaataagtagagaaaaatattcaaaaaaatcccaaaggaccataaacaaaaatattgataaacaagccacaacacacaagttattatatgttaattactcatccctgggatgttaaactagttattgctaatctgttaaaagagctaacagcaaatagtatgtaaaagcaggcatccctttcaattcaacaaatatcttgagtctctactggaaaaccagttgaaatgtgaagttaaactcctgtcagggaacttgcagggtgactcagcctcagcctcggccccttagctggtgtgtggttagagaagctctatgtcaaggcttctgaacttcatgcaggaaagtttgtgtgattctgcagaaagcaatgccttgccgcacacaggtcctgcactagggcttcgatttttccaaaagatacggcttgcttcatccaatactgtttcaggaaaatggaggttcctcctccgcaccccaagccaaggccaatttcgcgggaccctcaaggcttgctactgcagatcagattcgtccaatttattggaaaaacgtatgagaagagaaaatcaaggcagctaaacacttgccccggaaggtcctggcttttgccgttctcctcaacagctgtgtagaggggaggcctgggtgagagccccagagtcacactgcttcatatgaattccaggacttgttgtttccttgcgaggtcactagctcaagtcacttaacctctgtgcttcactgtccttaccatacaaagtatgaaaactgacagcacctacagtaaagaggtatgttaggaggattaaatgtgttgctctttggaaagtgcttagagcagtgtttggcacatttcaacagttaggtggtttcagaggaaatgcaagctgcagactggtgaccgccctcagatggtgtcctccctcattgttgtcttagtaaagatgtgttcctgttagcaagctcactcagtactctatagcttatgttgtagttccatcatagtgcagctagctcatcttgccaggggtgttcagaacttaatctctttgaaagttgtccttggtggaaataaaaacattatctcctttttactcttgttggaaactcaagtttgctgcggggggaagggtggcagggtgtgaggtatttcaggtgcagtattaatattatgtcttatgaaatagcatcagccaacacgaacacactcaggaattatatctctcaaaagacagaaggcaaaagggagggactaaaatctaccttgcatgttaagtaaaagcattaacattctagtgaga

SEQ ID NO: 103991 - DNA, 1049 bp, Homo sapiens
tctcctgtctcagcctccccagtagctggaattacaggtgcgtgccaccacacccagctaatttttgtatttttagtagagacgggatttgaggatgttggccaagctggccttgaactcctgaccttaaggaatccaccctcctcggcctcccaaagtactgggattataggtgtgagccactgcacctggccagtttaggggcttatttttaatacaagtttaaataatggataattatttacttcccccatctaacagactcacatctttcttaaatttactttaaattgtgatggaaaacatgatttggaaaatataaaatagattgattacattatgaaaatgaaatcacatattaaaacatcaaaacagccaagtcagaaaggtaggctctctagtttaactgtaaaatagagccaccagtctacatgctctctaaattctcaactatatgttccttgaaggtggtcatttccagggcctggcaaggcccccatcctggtgaaggctcccttcaactcctgttctctgctcctaactccagtacctcacccccacccctacctgattgttcttcctctgtgcttgctacaactgccctttctcacattcccacactccctttctccattctcctctccctcccagccccctctctctggcaagcacttgctttttgttacttctgctgggacccatcttcatttctcactctctaggcggtggcgccctgttcccatggctttcagtatatagcagagacttgtatctaatttacctgtttttcttaacactgtgtggtatatctttttatatcactgcatgatgacattgacactaaatttccagagaaaaggttcattttctttcaggatttcgtccaaattctaaggaatcaagtgaaattttcagttttgaattttattgcatatattaccttacagaataaatcatgacaaattgaaggactcaaattttactacgatttatttcttgactttttttttctctctagaggtagggggatgatgtggggagcattacac

SEQ ID NO: 103992 - DNA, 1245 bp, Homo sapiens
gattcaatctctaaaaaaaataagaaaaaagttaggcttgttgtctctttgagctgatgtaccactatcactataagatccgtttctagcttttatttacctagcttttattctacttttctcagtgcactcaaggacaaattaaaattacactaacttgccttttatttaatttgacagatgatgtttcaattgtccaggatactttgagtctagttttatcttactaggttttagcagatagatgcattcagttttggtcttgcttaatgagcatgcccttaatcctatcatgtaagataaagtcacatatatttcattagagatccattttggcctatgtatttatcaggtgttttgacaagcacgatgttatattaaaatattgggaagtcctcaagagacattgctcctctccctgtgtcacactactctgaaaattgccgaaaactagaacatttctatatttaaaaatggtgtttacttcccttcctttttcccttcctttttcccttcccacaagtgtgggacttgtgaatctattcatttcagcacaagtcccctttgcttctgtccaacattgaccactgtttgccttggtataattgtgtatgagaatcacaatgacctctgacatgaatgatattacagaggtaattgcctctgaatgggtatggatataacttggtatgtacaaatcacctttgagacattaaggaatgccaaggcgtgcagggatgtgacagaaggtagatctggtggccatggatcccttgaggctggatagccctactagtgggggagtcggggagtctttgcttgttcccctctcatagaaggtgcccctcccaaatttttccaaccccccttgggaaacttttaatcttttttttttacctgacagtatatgttaactggttttaggttaatttttattttctatttttatttttattttgagatgagtcttgctctgttgccaggctggagtgcagtggcacaatcttggctcactgcaaccacctcctcgtgggttcaagtgactctcctgcctcagcctcccaagtaactgggactgcagtcatgcaccaccacacctggctaatttttgtatttttaatagagacagggtttcaccatgttggccaggctgatctcaaactcctgatctcaagtgatccacctgcctcagccacccaaagtgctgggattacaggcctgagccactgtgcctggccaattttc

SEQ ID NO: 103993 - DNA, 2699 bp, Homo sapiens
aagatggtatgatgtatggcccaccagtggggacttaccatgaccccagtgcccaggaggctgggcgctgcctaatgtctagtgatggtctgcctaacaagggcatggaattaaagcatggctcccagaagttacaagaatcctgttgggatctttctcggcaaacttctccagccaaaagcagcggtcctccaggaatgtccagtcaaaaaaggtatgggccgccccatgagactgatggacatggactagctgaggctacacagtcatccaaacctggtagtgttatgctgagacttccaggccaggaggatcattcttctcaaaaccccttaatcatgaggaggcgtgttcgttcttttatctctcccattcccagtaagagacagtcacaagatgtaaagaacagtagcactgaagataaaggtcgcctccttcactcatcaaaagaaggcgctgataaagcattcaattcctatgcccatctttctcacagtcaggatatcaagtctatccctaagagagattcctccaaggaccttccaagtccagatagtagaaactgccctgctgttaccctcacaagccctgctaagaccaaaatactgcccccacggaaaggacggggattgaaattggaagctatagttcagaagattacatccccaaatattaggaggagcgcatcttcgaacagtgcggaggctgggggagacacggttacgcttgatgatatactgtctttgaagagtggtcctcctgaaggtgggagtgttgctgttcaggatgctgacatagagaagagaaaaggtgaggtggcttcggacctagtcagtccagcaaaccaggagttgcacgtagagaaacctcttccaaggtcttcagaagagtggcgtggcagcgtggatgacaaagtgaagacagagacacatgcagaaacagttactgccggaaaggaaccccctggtgccatgacatccacaacctcacagaagcctggtagtaaccaagggagaccagatggttccctgggtggaacagcacctttaatctttccagactcaaagaatgtacctccagtgggcatattggcccctgaggcaaaccccaaggctgaagagaaggagaacgatacagtgacgatttcaccgaagcaagagggtttccctccaaagggatatttcccatcaggaaagaagaaggggagacccattggtagtgtgaataagcaaaagaaacagcagcagccaccgcctccaccccctcagcccccacagataccagaaggttctgcagatggagagccaaagccaaaaaaacagaggcaaaggagggagagaaggaagcctggggcccagccgaggaagcgaaaaaccaaacaagcagttcccattgtggaaccccaagaacctgagatcaaactaaaatatgccacccagccactggataaaactgatgccaagaacaagtctttttacccttacatccatgtagtaaataagtgtgaacttggagccgtttgtacaatcatcaatgctgaggaagaagaacagaccaaattagtgaggggcaggaagggtcagaggtcactgacccctccacctagcagcactgaaagcaaggcgctcccggcctcgtcctttatgctgcagggacctgttgtgacagagtcttcggttatggggcacctggtttgctgtctgtgtggcaagtgggccagttaccggaacatgggtgacctctttggacctttttatccccaagattatgcagccactctcccgaagaatccacctcctaagagggccacagaaatgcagagcaaagttaaggtacggcacaaaagtgcttctaatggctccaagacggacactgaggaggaggaagagcagcagcagcagcagaaggagcagagaagcctggccgcacaccccaggtttaagcggcgccaccgctcggaagactgtggtggaggccctcggtccctgtccagggggctcccttgtaaaaaagcagccactgagggcagcagtgaaaagactgttttggactcgaagccctccgtgcccaccacttcagaaggtggccctgagctggagttacaaatccctgaactacctcttgacagcaatgaattttgggtccatgagggttgtattctctgggccaatggaatctacctggtttgtggcaggctctatggcctgcaggaagcgctggaaatagccagagagatggtgagtatgagaaatctcttaccagcttgggatttttatttcatttggttccttttcttgcatgtttttgttcttacatgtcacatgattattcctccaaattaaagtgcctatgcccatgtgatggacagaaaatgaaataggtaatttggaagatttgtatagacttctaaaatcgtttttcattttttgaaatgtataatgcttatgaagcatattattatatttcaagtttcttgggccacatcttttctaacgcacactttccagttaggatatttattctttggatctgtttcataacttatcctggggcagatcatcaacatcatcatcttcatttctttctctcctctattgaatgttctgtttcctgaatcccatttcttcctcattcttaaagtgagccttcatttaagggcgtgcatcatcctttagtagttttgtgagaaagggtgtgtg

SEQ ID NO: 103994 - DNA, 3339 bp, Homo sapiens
accagtcagcttcatctgggcctctgattcatctttattccctccatcatctagacttgattttatttgtaccaaggagatgcgtgtctaatgtttttctttcttctatttctaggagggctgttggcctgctgctgtgctgctgaacagtatgcagtcctttcgggagcaaagcagttaccacggaaaccagcaaagctacccacaggaggtacacggctcatcccggctagaagagttcagccctcgtcaggcccagatgttccagaattttggaggtacaggtggcagtagtggcagcagtggcagtggcagtggtggtggacgacgaggagcagcagctgctgcggcagcgatggctagcgagacctctggccatcaaggttaccagggtttcaggaaagaggctggagatttttactacatggcaggcaacaaagaccccgtgactacaggaaccccacagcctcctcagcgaaggccttctgggcctgtgcagagctatggacccccccaggggagcagctttggcaatcagtatgggagtgagggtcatgtgggccagtttcaagcacagcactctggccttggcggtgtgtcacattatcagcaggattacactgggcctttctctccagggagtgctcagtaccaacagcaggcttccagccagcagcagcagcagcaagtccagcagttgagacaacagctttaccagtcccatcagcccctgccacaggccactggccaaccagcatccagctcatcccatctacagccaatgcagcggccctcaactctgccatcctctgctgctggttaccagttaagagtgggtcagtttggccaacactatcagtcttctgcttcctcctcctcctcctcctccttcccttcaccacagcgttttagccagtctggacagagctatgatggcagttacaatgtgaatgctggatctcagtatgaaggacacaatgtgggttctaatgcacaggcttatggaacacaatccaattacagctatcagcctcaatctatgaagaattttgaacaggcaaagattccacaagggacccaacaggggcagcagcagcagcaaccgcagcaacaacaacacccttctcagcatgtgatgcagtatactaacgctgccaccaagctgcccctgcaaagccaagtggggcagtacaaccagcctgaggttcctgtgaggtcccccatgcagtttcaccagaacttcagccccatttctaacccttctccagctgcctctgtggttcagtctccaagctgtagttctaccccatctcctctcatgcagactggggagaatctccagtgtgggcaaggcagtgtgcctatgggttccagaaacagaattttacagttaatgcctcaactcagtccaaccccatcaatgatgcccagtcctaattctcatgctgcaggcttcaaagggtttggactagaaggggtaccagaaaagcgactgacagatcctgggttgagtagtttgagtgctctgagtactcaagtggccaatcttcctaacactgtccagcacatgttactttctgatgccctgactcctcagaagaagacctccaagaggccctcatcttccaagaaagcagatagctgcacaaattctgaaggctcctcacaacctgaagaacagctgaagtcccctatggcagagtcattagatggaggctgctccagcagttcagaggatcaaggcgagagagtgcggcaactaagtggccagagcaccagctctgacaccacctacaagggtggagcctctgagaaagctggctcctcaccggcacaaggtgctcagaatgaaccccccagactcaatgctagtcctgccgcaagagaagaggccacctcaccaggcgctaaggacatgccattgtcatccgacgggaacccaaaggttaatgagaagactgttggggtgattgtctcccgggaagccatgacaggtcgggtagaaaagcctggtggacaagataaaggctcccaagaggatgatcctgcagccactcaaaggccacctagcaatggtggggcaaaggaaaccagtcatgcatcacttccccagccagagcctccaggaggaggagggagcaaaggaaacaagaatggcgataacaactccaaccataatggagaaggaaatggccagagtggccactctgcagcgggccctggttttacgagcagaactgagcctagcaaatctcctggaagtctgcgctatagttacaaagatagtttcgggtcagccgtgccacgaaatgtcagtggctttcctcagtatcctacagggcaagaaaagggagatttcactggccatggggaacgaaagggtagaaatgaaaaattcccaagcctcctgcaggaagtgcttcagggttaccaccaccaccctgacaggagatattctaggagtactcaagagcatcaggggatggctggtagcctagaaggaaccacaaggcccaatgtcttggttagtcaaaccaatgaattagctagcaggggccttctgaacaaaagcattgggtctctattagaaaatccccactggggcccctgggaaaggaaatcaagcagcacagctcctgaaatgaaacagatcaatttgactgactatccaattcccagaaagtttgaaatagagcctcagtcatcagcacatgagcctgggggttccctctctgaaagaagatcagtgatctgtgatatttctccactaagacagattgtcagggacccaggggctcactcactgggacacatgagtgccgacaccagaattgggaggaatgaccgtctcaatccaactttaagtcagtcggtcattcttcctggtggtttggtgtccatggaaaccaagctgaaatcccagagcgggcagataaaagaggaagactttgaacagtctaaatctcaagctagtttcaacaacaagaaatctggagaccactgccatcctcctagcatcaagcatgagtcttaccgcggcaatgccagccctggagcagcaacccatgattccctttcagactatggcccgcaagacagcagacccacgccaatgcggcgggtccctggcagagttggtggtcgggagggcatgaggggtcggtccccttctcaatatcatgactttgcagaaaaattgaaaatgtctcctgggcggagcagaggcccagggggagaccctcatcacatgaatccacacatgaccttttcagagagggctaaccggagttctttacacactcccttttctcccaactcagaaaccctggcctctgctta

SEQ ID NO: 103995 - DNA, 1059 bp, Homo sapiens
catcattgtcaatgtcttgaggatttaaaggcaaagaaggagaataagcagaaaatcatgacagaggatgaaaaaattagctggggccaggcacaatggctgaattctagcactttgggaggttgaaacagcaggatggcttgagcccaggagtttgagaccagcctggacagcacagtgagactctgtctctatttttaagaaattataaaaattagccatagtcccaattattttttaaaaattagccaggggtcccatgcctgtggtcccagctacttgggaggctgaggcaggaggattgcctgagctgggagttgaggccgcagtgagcctgtggtcatgccactgcactccagcctgggcaacagagtgagactctctttccaaaaaagagaatggattgggaagtgggatgttgttggacatatggaggaagaaggacagagaaagccaatgttggttttctataagagggcaaggtcatcagccctctaataggatggggagaacaagtctgcagctggttatgagtgagtttgtgaggtcggcacatggactctggaatgtttaggcacagagttctggacctcactaatacacctccacagcccttctgaaactgttcagaaagttaggaatataggagaaaaacaggaaagggagagtcattatggatgggaagtacatcggtaggcctcttttttatttatttattgagacggaatctcgctttgttgcccaggctggagggcagtggcgcgatctctgctcactgcaacctctgcctccgaggctcaggcgatcctcctgcctcagccccccgaggtgctgggactacaggcacgcatcaccatgcctggctaatttttgtattttttataaagatagggtttcgccatgttgcccaggctggtctcgaactcctgagcccaagtgatctgcccgccttgacctcccaaagttcagggattacaggggtgagccactgtgcccagcctcttttttagagtgtgtatgcaagttccttaggtgacttattcctttgaggtatcagat

SEQ ID NO: 103996 - DNA, 2284 bp, Homo sapiens
aaaattacattaatttttccccctcattcattaattgagttacaggtaaaaccacacagtgactaacatatatagattgctaaataaatggcaattatttatttatttactgggacaggtcttactgtagcacccaggctggagtgtagtagcgtgcagcctcggctcactgcaacctctgcctcccaggctcaagtgatcctcctgcctcagcctctggagtggctgggactacaggcacaagccagcacacccagctaattcttttgtattttttgtggagacggggtcttgttatgttgcccatgctggtctcctgagctcaaacagtctgcctgcctcggcctcccaaagtgctgggattacaggtgtgagccactgtggccggccagcaatttttattatatcagtggtacataccttagatactggttaaaggtaaatactttaattggtttgtttttactaagcaaggtaaagccaacacattctctgcttagaggaagatttgtagagaaaatcacatggataacacattttaggagctcttaagatacagcaggacacattctaagagctcttaagaaccatatgatctcatgtggcaagaaggaatttatgggcctggggatgcttaaaaggctccaagttgagaccaaggtgagagtgggccgatggcacaaagggggctgagcaggcttgtttgagagggtggggagaagcagaaattgtgttgggaagatgtcacagggcttcagggcctatgggggggtgtgatggtgtcaaaatggcagttaagcaaaagaaagtactgggaaagagaacttttcaggtgttattctagcccaagaaagatgaaaatgacagtgacgagaatggaatgggaaaggacaaatacaggaaggagagtagtgtcatgatgaggtagcatggtaaatacagagtcaaagtgaaaggtcagtttggggttattctaaagcttcttgcttgggatgatcatggttttctttgagaataggcagttgggtcagttgaggaagaacaaccttatctttgtcattgaaaatgagttagttactgcctaataataaatgcatttgttgtcttttagaaatgattacagtcacaagtgacactgtccagagtccttaagtactgatctgtctagagggccagaggccttgctctgtctctgcatggtcattaaaacctttgccatatggggccgggcgcggtggctcatgcctgtaatcccagcactttgggaggctgaggcgggcggatcatgaggtcaggagatcgagaccatcctggctaacacggtgaaaccctgtctctactaaaaatacaaaaaatcagccaggcacggtggtgggcgcctgtagtcccagctacttgggaggctgaggcaggagaatgacgtgaacccgggaggcggagcttgcagtgagccgagatatcgccactgcactccagcctgggcaacagaacgagactccgtctcaaaaaaaaaaaaaaaaaccctttgccatatggttaataagccctatagaccccacatccttggcattcagagcccagcacctgcctgcaactctcttcatagtatctcatccaattttggactttgggcatttcttactttcttgcaacttggctatacattttgtctgacatttctaagtgttttgttgagggaggatttttagtccctgttctatgtcatagtgcatgaaatagaagtctctcattccccaagtggcaatagtctactctgaaatcctaggaatgagaagaactcttatcagtcagggtcccagtagaaaacagatggcacattcaaactgggtaatttaaggagtgtttaattgtatcattcagggttcattcaggaaaagagaagttgtctattccggtatgaatggttttgatacaggaattaaggctttacccaaccctggaagaactggaattgggaaggttcctgatgatttcatactgaagtgtcatagtgaatggttctcgtgagctcatggggaagccgctatgaatccacgtgtgctgcatctacctccagggaatatcatcaacctctacgtttattttgccttctaaatctctcttgcacttctcattgcaaactctaacccagaaccatgctgctaaagggttctggaacggaagttctcagcttctgatctgcagaggagagcttggaaggagggtggtcacgatgctgagttgacaacaatgcagaagattaataaagggactggaaagggtg

SEQ ID NO: 103997 - DNA, 1043 bp, Homo sapiens
gagcttttttgggttgttcagtgaagtctctaattttcatatagcttttgcccacttctgctttggattggtcattgatatcttttgaattttaattcagaattgtatttgtttgttttattattatttctttttaagagacagaatctcactctgtcacccacgctggatggagttcagtggcgtgatcttggctcactgcaacctccacctcctgtgttcaagcgattctcctgccacagcctcctgagtagctgggattataggtttccgccaccgtatgtggccagtttttgtatttttagtagagacagcatttcaccatgttggccaggctggtcttgaacttctgacctcaggtgtgatctgcctgcctcagccttccgaagtgctgggattacaggcttgagccaccaggcccggcctcaaaattatatttgaatgaattataaaatggaacatccttttagcctataagtggcaacactaattacctcccttttgcctctgaaggtttagaaattatgtattaatacaacctttgaatgaaaaaatatattcaatgacatctcagaagcccctacgctcagcatttaagaaaatcccacaggagcctctagctagccccagagatgtcctgctcccacccttctcctgccccctttttgggaactgtttggccatcctgctcacatatgtggtcatctgaagtgatcttgggatgcccctgtgaaaataagacagatagccatggagtgggggtggggccaggatagggcccaggtgcctttggtctgctcaggagcagatttatagcatctccttgcagagttacagaagcatgtggtggatataggatgcttgcagcctcttggctgtttgaaattatgcctaataataggcctgccgactgtgggttggaattcagctgactttaggcctgattctcaaaaaataattttgagctagtgaccctgtgtgcacacttgcctgggcactgtggtgtccaacaaccctgtgtgtggcattggcaccaggtttcc

SEQ ID NO: 103998 - DNA, 1038 bp, Homo sapiens
ccaggtgaatgtggtaaatatcagcagtagtgggatgggttgccatcagtcttcttcttatgcaatgtcctgggaagaatacagcaccatgtgtctggtattgccgctaaggaagcatgacctgagtctggtcacgaggaaatacagatcagattgagggttatcctgcaaaatgaaaagactgtactctggcagggacatggaagtcaggaagagaaaagggaactattccagattgattgacactggtgagatgtagctctggggtagactcctggactagaaaggaaagacattgttgggacagctgacaaaattcaaatggggtctatggattggattgagagtgtagtatcagtgttgatttcctgatgtggaggcttgtatgctggttatggaggagaatgtccttgtttttggaaataacgcactagagtattgagcaacaatggagcttcatgccttcagcctgctctcaaaggggtcaggaaaagataatggagcaaatgaggtaaagcatcagttggagaatctcgttgaaagagggtatgtgagccctttgaactatttttgcacttttctgtacatttgaagtaatttaaaattactatttttttttgagagaggctgttgctctgtctcccaggctggagtgcaatggaacgatcttagctcactgcagcctccagagttcaagtgattcttgtgcctcagccactcgagtagctaggattacgggcatgtgccaccatgcccagctaatttttgtatttttagtagagacggggtttcactgtaatggccaggctggtcttgaactcctggcctcgtgtgttctgcctgccttggcctctcaaagtgctgggattacaggcgtgagccaccacgcccagtcttaaaaattattttttaatatcctattgagattttgactggaacctattagaattttataaactaatatgtggagacttaacgtctttacaatactagccctttttatctagctataccatttgttctgctagtttgtttctt

SEQ ID NO: 103999 - DNA, 2190 bp, Homo sapiens
atttatacatggcaccctccttatcatagttatggcttgcaccctaaaataaggtctagagcgacagacatttacaaagttctttttttttttttttttgagacagagtctcattctgttggccagactggagtgcagtggcacgatctcggctcactgcaacttctgtctcctgggctcaagcaattctcctgcctcagcctcccgagtatgtgggactacaggcatgcgccactatgcctggctaattcttgtattttttttagtagaggtggggtttcaccatgttggccaggcttgtcttgaactcctgacctcgtgatccgcctgccctgccctccaaaagttctgggatttacaggcgtgagccactgcacccggcacaaagttcttatgctaccgaaatgatctttttgttcttctgaccctaattattaggttttctgaccctaaattaatttgctaattcttgatgctcttcttggatacttagatgtaactatttcaccttagtttggagttagcattttgatgtttttaatatatttgaaataatcctgcaaactattttttggtttgggcttttaagtgggacgctcaatcttcagaaggacttttagcttatggacacttaaaaaaagcaagaactagcacattgtttcttggtattttggaattgtggtgagtttgaggcaaccgtggaagtgtagagtgtgttgactcacctccgctcctcctaactcctgtgttcatttcacaggaattaatcgtccagacaatattcctcccatgcctgcatccccagccatatggagaggaccccataaactgtaaaaaggttcattggcttttatctggaggggactaaacccatagaactcggttctgctttttgcttcatttgacaggttgacctatggtgttggtacgtccagtaaaatcaagtctaaatgctttggttgactgcatttctcattgctttgctcaggaaggccaaggacacattaaaatctgtttgtcccctcctatattttctttctaaggttgttagccagcacttttgttttacagtgtgtttttgtttggactcgacttctgctcgtaaattaggatgtggtcagttaagagcattttgaattttaaacgtgtctgtttcactggttttgtgtctccatgtttatgtatagggaaagtaagttttcatgtttttacattttgtttgtactaaacttaagtgctttctttcaagggctagaggcattgaaagtaattttaaaaactctaaagaaacctttttattctcattgcttacatttttaataacaagttaggtagcttttattcttcagaagtgggatttattatgtaaagccactttttggaagaggtgaaaattaacctgcctttccttatgcctcagtgagaggtgaggttcagagcagagaatgcaggtagggattatggaaaccctttcttggtattaattttcctcacagattaaaacttttggtcttcatctgttacctttacatttgtcagaaagagaatttatattgtcaacttaattcacccagtgttcgattgcttgctctgtgcgtggcagtaagagaactaaggtcccacgctgtgggggaaatagaagggtagataactctggtaatgcttatcatggcttgtgttctaggaaggtgttaagggaaaagtgcgatttgcactggacttgaaaggtgagtggtatgtcagcaaagctggtattattcacgcagaaggaccaggctgaacaaacgaaaaggtgcagaaggtgcctgctgggtgtgctgggaatacacagaacattgctaagaacagtagaagttagggcacattccttgttagtcccagcctgtcttccttactgactggctgtataaccttatgagagttactaaactttctgagcctttgtttcctcatctgcagaatggctagttactgcataatagagttaagattaaatgagactataatatattgcattgcagctgggtgtgatggctcacacctgtaatcctagcactttgggaggccgaggcaggtggatgacttcaggtcaggagtccgagaccagtctggccaacatggttaaaacctcgcctctactaaaaatacaaaaattagccgggtattgtggcacaagcctgtaatctcagc

SEQ ID NO: 104000 - DNA, 1056 bp, Homo sapiens
cagcaaaaagattaggactccctgaaggctcagatgattgttagcattttttaacgataaagtattttttaaattaaggtatgaacattgtcttttagacataataccatttcacacttagtagactgaagtatagcgtacacatataaaagttaatatgtgctggaaaaccagaaaatttgtgtgactcgctttattgccacggtctggaaccagacccacaatacctgcaatgttatgcttgtggctgatttttcatagaatgtttgtgtctctttgacttttttattttcaaaatttaggattgcaggtgactctccattggcttatttcagaatgactggggttagggtgtttgctaattgcatgccagtggtcagggaagaagggaaaactcttgcactttagaggccatctgcctccaagtagagctccaactgtcaggccactgtccctctgtggggagggtggggattggtcctgtggcttgtagttcttgccatatagattaagaatgcgctccgtcggcattcttcattgtgaattagaggattgatgaggatttaaccctgctgtgatttctatgaatggactgtagatcccagggtgtgggatctttcctaactcgagaatgacaaaaattacctgtcacagagtgctgttacaccaatcagtagttatttattgtgttttttagggtttattttgtttgtttgataacctcttttccatttttttccttgttgtcttttacttgtttttttgtttttgtttttgtttgtttttttgaagtggaatctcactgtcacccaggctggagtgtgcagtggtgagatctcggctcactgcaacctctgcttcctgggtgtacaagcaagtgattctcggattacaggtgcctgccaccatgcccagctaatttttgtatttttggtagagacagggtttcaccatgttggccaggctgatcttgaactcctgacctcaagtgatctgcctgcctcggcctcccaaagtgctgggattataggcgtgagccaccatgtctggtgtctt

SEQ ID NO: 104001 - DNA, 1109 bp, Homo sapiens
ctccacccgcggctaatttttgtatttttagtagagacggggtttcactgtgttggtgaagatattctcgatctgctgaccctgtgatctgcctgtcacggcctctcaaagtgctgggaccagctccttttggatttttatggaagtttcctgatgtcaatttcttctcccagggtatagggctggacgccctctgaggagggtcttaagagccacagtctgagaggtgggaaaggattagagtcctgccttagggcaggtgaatggaggacaggtgagagattgtttccccaggccttaacatacccaatattataacaaaacactgttacaagggctggacaatacccagtatatatcatgataccacaggcaccctggctctggactctgtgcccttaacctgtaccctgtgtgaatgtttaatttaaatgagctggaatataacttgcaggataagtttgtggccatttgaagaggaagagtttagttttggattatagaaacaaagaaaaagaaagtggagtggagctgggaagtaccatcctgggatctacctgggagaatagtctgctgtgtgagggcaaggacttgtctgttgcccatcatattcccagcatctagaacagtgcttgatatgtagctaatgcttagcagatatttttgagtgaatcagtaaataaaatttcgctgccagctctcaaaggaatatgctgtggaagcttcagttactttttttttttttttttttttttgaaagggagttttgctcttgttgcccaggctggagtgcaatggcacgatctcagctcaccgcaacctccgcctcccgggttcaagcgattttcctgcctcagcctcccaagtagctgagattacaggcatgcgccactacacccggctaattttgtatttttagtagagacagggtttctccatgttggtcaggctggtctcaaactcctgacctcaggtgattctcctgcctggcctcccaaagtgctgggattacaggcatgagccaccatgcccggcctcttcagttacttttttctctttggttcatggttcaggatcctttctgaattaataaatttattacttgtttt

SEQ ID NO: 104002 - DNA, 2949 bp, Homo sapiens
agattttaagaaacttcctgccaagcggatagagctgactaaggaaacagtaattgtagggataaagtaagaaagtagttaagatgagctttctacttcctgggattttagagaaactggtcagacctttataatcctttgtctagttttggattccagtgatttggacacaactttttgtgccttgtgtctggcaattccactgttccccatatattagagcaatcccatttattagaccagtgacttgtaaattatttcagagccctcacattttatttaaaaaatatgcatgtagcactagctgtatagttaggtggcagtgtgctaagtgttatatcaaaacagaataagatggaagaaaggcggcaggggggcactctcatctcttccgtgctgggctcccccaggtctgcagaggcattttgggaaacaggtggcctggctggggtagaagtgagggtcatcctcttctcaactccagccagagcagctcatcatctctcttatcttttgggtatatcaacataagatttttgctgaaaaaagacttgcagaatattttcaaacaccatttcactaggctctaaggtccttatagtcagggctgtgttttgcttttatagccccatcatctgcattgttgcctgccagtgcattgagaaagaatgtaccattttgcctctgagcctctgctctctaatacttctccctccttcccatctctagccgtatattagagttaaaatagaatgtgtctgtttcatcgcaaatttgtatattcttaggtgatcaccatgtcttattaatctatgtctttgtgtcctgttcacataattctattaaagtaatgttgaatttggatttgttgtagaaaacttgcaaagctcttctaagagtaactaaaatcagtaaagaataggggaaaaaatccagagaaaatataagcaggaaaaccatagcagacagggtcagatggaatattagcggtttaggtgaagaacccagagaaccgcctgccctgtaaggaatgctgggtatttctcctggagggttttattttaatttttgagacaggatgttgcactgtcacccaggctggagtgtggtgatacagtcatggcgcactgcagccttgagttcctggactcaaatgatcttccttcctcggcctcctgagtatctgcgactacaggcacatgccaccacaccctgctaattttattttcttttgtagagattggggtctctctatgttgaccaggctgattttgaactcctggcctcaagcaatcttcttgcctaggccttccaaagtgctgggattacaggcatcagccactgtgcctggctcctggagagttttagaacaataaaatagaattgttactccatggcagaagtgtagagaacatgcctgccagattccagccagatgactcctataaacacaacatacagtcagtgtaaatgaacctaaacagatttaccagtacctgtacattactaaacagatgtaaatgaaaagatacactatgcattgaacttaatgctacttttttgttttttgttttttgtttttctagtagatgtgagtttaaatatagcaggaataggattttcatcttctcttgttgaaagtcttcgtggaagtggatttaagttctagcatattcagtaggagaaatttgagctggaatgaaggacatcacagcctgcataatttgttaaatgtctctttaaaaaaaaaaaaaaaactttgctacattggctagcgcatgtgctgaaagttggcttcccctaaagataagggacacaggccaaatgaagcctatgggaatgaaacacatcagagaaaataaaagaaaaaagaaaatttctgttcagccaagtttgctaagtagttgccatgctaggcacacacacacaaaaatcaaataaaacacttcacttttccttagagttcagggtctgtgggagagtccaatatggaaaattaacatttatcaaacgtatgaatgattgataaggctgtaatagtggtgtagctggagtgctggggagaactaggcaagaggctgctccctcctgatcaagtatgggaagaatattggagaagccggtagaggagggagcatttgggtagaccttgaaggatggacgagagagagagacaagtggaagagtggagaaagagcattcctaagagaggtcttttgggaaccaaggctcaaaagtatgtagcatattatcaatcaaaccctgggcccttaggctaagggcctagagatgacagaggggaaggtcagaagggagcgtgggcctaatagtatgagagcaaggtgggaatagctttgaacctggggctggggcacttgagtctcataaatggaacaaagttttgtgaagagaggtgtgaatacatggttgggggcgttgttctgactgaggagagatggtggtgggaaggagaggggagggccggaaacagatgatgaattgatcatcttggcctcttactgttctgattttctcatgcccaaagccctagtctgcataagaaggatctgtaaaatttagcaattggtttaaataaaatggatttacaggaaattttggcatcaacccatgttgattccaaaacaggtcggcaagcatattttatttacccaaacatttataacaataaataatgtggttttgttgttgttgttgttgttgttgttgttgttgttgttgtttgagatgaagtctcactctgttgccaggttggagtgcagtggcgcgatctcagctcatggcagtctcctcctcccgggttcaagtgatgcccctgccttagcctcccaactagctgggactacaggcacgcaccaccaagcccggctacttttttttggtatttttagtagagacggggttttaccatgttggtcaagatggtctcga

SEQ ID NO: 104003 - DNA, 1302 bp, Homo sapiens
ctacctttcatataggcaggaaaaaatgctggcatttgtataaaaaacaagcttttgtgctagactctgtccaaggcattttaaattgtgttacaatatccacccagctgaccttagagatagatgacctttcctttccctgagagctggtagagctaatgaggctcaaggcttagatataaccctcctgctgttggctccagagcctgtgctgtactaggtttgttgcctgctcaaggcacaaatcagtcagtggtaagtgcggccctggaatccatatcttcctgctgtgcccctctttttttttttttttaattttaaagctatgatgaacctgaaatctagatttaggtgaaatactggaaagggtggtttttgtgactgcttatggttttgtgaccccctgggagttccctaaacttttaccttgcccatacttggtcagttttgccagtgtacttgagatttaatctgtgaaaaaatttctcttttcatacttaattccgtcattctgtcctgagctgaaaactttggtatcagcttaaagagtaacataatacgtaaagggctatctcttcctgactagtttacaatgcactagaatcattttgtatggtgactgctctcactcagttcgactgggtgggactcaaaagatatatttaccaaagacagttctttccacagtatgccttaagccttcttactcatggggactttgtgttcaaggcaccttagtactcattcattctgtctggggctttgtctctgctgtcttcattttctttttgtggaggtaaaaaagtaacaagataaagcaaaacaataaaaccattgaagtaaaacggtacatgacagtgatacctttgaaatacagtaagcctgggcaacatagtgagacctggtctctgcaaaataaaaaaggccagatgtgacgtgggtgcctgtagtccagactattcaggaggctgaggtgtgaggatcatttgaacctgagaggttgaggctacagtgagccatgttgttgccattgtactccagcctgggagacagagcaagatcctgtccaaaaaaagaagaaaaagaatacagtatactgaaatcaaggtatttatagttagtagagcataatttggtcacattgcactggatagtttttgattattggttaggctgttgaaagtcctgtaatacccttggtacatgtggtatgggtgaaaaggttctcatggcgacaaacacaatcagtactttctgtgtaagagcaatgtttgctttttgggtaatatgcgtgacccagca

SEQ ID NO: 104004 - DNA, 1055 bp, Homo sapiens
ggattacaggtatgagccaccatgcccagcccacaagtagacacttttatatagccacacagattatttgtgattttctagaataaacagtttgttaggatttgaattatgaccttgcgttcagtgtggtgtttaaaaaaactccgattactcaaattggttttgttttttctgttgttgttttgagatggagtctcgctcttgttgcccagctgggagtgcagtggtgcgatcttggctcactgcaacctcagcctccagggttcaagcgagtctcctgcctcagcctcccgagtagctaggattacaggcatgcgccacctcgcctggctaattttgtattttcagtagagacgggatttctccatgttggtcaggctggtctcaaactcgacctcaggtgagccgcctgcctcagcctcccaaagtgctgggattacaggcatgagccaccgtgcccggcctattaaattgtaagcagttatcatgctcacatgtatattacacttgtcttataaaacttacaagggaaaaaattgttataaaattttcattctacaaagtaatttgtgtgtattcacgtgagaggttgccaaagttggtaagatatcgggagacatggcttttaggttccataacctagtagtggtatacttttttgtttgtttgttttgagacggagtctcgctctgttgcccaggctggagtgcagtggcacagtctctgctcactgcaaccttctctttctaggctcaagcgattcccctgcctcagcctcccgaatagctgggattacgggctcctgccaccatgcctggctatttttttgtatttttagtagagatggggattcgccatcttggccaggccagtctcgaactcctgatctcaggtgaggtcaggaggttatcagcctgcctcagcctcccaaagtgctggggttacagatatgagccactgcacctggccaactttttaaaactctgtaagataaaatggaatgtaattgaaatgatcacacttaattggagttggactttttctcatgagtccaa

SEQ ID NO: 104005 - DNA, 2258 bp, Homo sapiens
gcccgagggtgcggagggaaggtctacctgctggtcgcgcgaggccttgggtgcaaaggcggcgggtgtgagcgggcggcgtccgggagtcagcgccgcctgcttcggggcccctggcagccccgggggcaccggccgcgctcgcctcttggctacgggctggaggcgaggccagcggggctgggccgggatgtgggcgggagggcgccgcgctggggcgcccaggagagcaggggcccgtttactgccatgtgaacacctgaagccatgtggacgcggctgcttctcgcctgttgggggcggagggcaggtaccggcgggttgggcgcaaggtcccggcgcaggacacacttcctgtgtggggcggcctctcctcccgcgccgcggggaacagggcggggtgtgcaagccggggtctctgggcgagggagcgctcgtttggggacctgaggctttcgtccctttttcgggggaaagtggtggtttgaaggagcgtggccaatcgggccgatccctctcaggctacggcgggaggtgcactgtcctctggacgccggaatgggagtggaatttagtgagttggggggcggtgccgaggagcggccgtcttcctctgcttgtgggtgggattattgtctgtttttgtggttgcggataccaatacggtctgctggtctgtattcaatcctttagtttgaccttaggggtcaggtcaaaattaggatttcccccttttcctttttgcttttttttcctcgaagattagatgtctctggtaactgctgtaaaatggatggaattttcgagctattatctaacaggctgatctttgaatgataattggacccttatgttaacagcctcagtgaagagtgaagagttttatacagcatcttccgtggggtggcagttaggtggatggggaagctacactgaattccgacctgggagaccaggaatctgcttacagctttgacgccaaataaactgcagcccagggcaagttactttccctggtaattttctcatctgttaagtgaggactcccgggtcagacggtacaggggtttgtggttttgcttttttatctctcattttgtgctctgttttagccataggcaacttttctgagaaatgcagactgtaccttagctggcttttaaaagcctgtctttaagcttccagcctctgccttcaacagagcataaaagttggtcagggtacgctcttttttgaaatcccacttgctgttctgtgcttcagatcagaaagtgtattattctgacctaggtggaatgcaccttaacatattttttgtctttgtgaaagaagttatcagaaaatgtttcagagaatatttgtctacttggaaaatgtgtggataacatgtgattgggtctgtgtatgttggctcagaggagttccaagatctttctacgcaggggattttggaggatccagattttattaaagttcttcaaaggacatttgacatttggctaactgttgaaatttccagccagtttcagcattctcagagtagggggatgaagtagaatgccataacatctcctgtgaaatggtatgctagtggaattaactgtcacctcagggtgcactgattatctgcatccccaactttctccttactggtagccagtgctccgcagatgctgaagaaccgcaattagtttcactgattttatggtgtgtgaaggccttaggctgtgcttttgactggtaagtatttctataccaacctcagaatttgtcttaaatttctagaactgtgctgctgggccggatatgagcccaatatgttacaatatgtctttctcagatcactttttatttttatatattatttaatttttaaaattaaatccccttttatttacttatttattttgacacagtgttgttctgttgtccaggctggagtgcagtggcacgatctcagctcactgcagcctctacctcccagtttcaggtgattctcctgcgtcagcctcccgagtagctgggattagaggcatacactaccacacccggctaatttttgtattttaagtagagacaacatttcgccatgttagccaggctggtcttgaactcctgacctcaggtgatccgcctgccttgacttcccaaagtgctgggattacaggtgtgaaccactgcgcctgggctagatcactttttgattcagtctctttgaacagtttccaaaaggatcccagcataggggcagagtgctt

SEQ ID NO: 104006 - DNA, 1010 bp, Homo sapiens
cctcacaacaaacccatgaggcagggattgtcatcttcattgtacagagcaggaaatgggtgcacacagaggttaagagacttgcccaggtcacacagctaggaagaggctgtgatttgaactcagtcttctggctccaaagcccccacagagtcactcagggcactacaaagagttaacctgaatatgaaatgatctaagagtcgcagtgacaaaggcatgctctaagcgcttttcctgcagtaacttgcttaatccttacaacaaccctataaagtgggtactgttctcgcctcattttgcagatgaggaaactgaggcacagagcagctcggagggggcagagctgaatctgacaggctacagggcccctgcgttgctttgttataagatgacaataaggaagttcctttcctttgggattatttctgcctgaaagctcaagacttttagccacatcattgtctgggctccacgggaaggcagtgccacatgctgaggcatgctgggaaaagactttgttccatcctgttttgttgacatgctcttcatttttaagcctgaaaccgaagcttcctgctaagaattcaaaccatggagaaaaacgcagccatgataacggccactacttcctgagcctccagtgttccctgtgcttggggatccatatatgtcacttaaccttaaccttcacaacaccagggcagcctccattttcacaagtgaagaaatggaggcccagagtcacttagaagatgctcgaaggtgcacagctgctaagtggtggtgctgggatttgtcctcaggtcctcaagagtcctgactcttatgtgctggctccccacggaggcgtggagtcttgtttgctgggcatttgacagaaatgtttctgctcatcttctgccacaggttggtccttcagcgtcaagattcctgggccacttattaatagaaggcaccaggacacaggtgcagggatgcagagctggatgctgccttctcaataggag

SEQ ID NO: 104007 - DNA, 1067 bp, Homo sapiens
ccgaaggtcacattgccctctgtccttccttattttattttatttattgagagggagtcgctctgttgcccagactggagtgcagtggcgcaatctctgctcactgcaacctctgcctcccaggttcaagtgattctccagcctcagccttccaagtagctgggattacaggcacctgccaccagagatagggtttcaccatgttggccaggctggtttcgaactcctgacctcaggtgatccgcccgcctcagcctcccaaagtgctgggactacaggtatgagccactgcacctggcccttcctttctttttcacacccacctactaccaagaaggcacagaggcagatgatgatgctgggagtccatctgaggcaggacgggtaaaggaagcctagagagccctaggggaggaggctggggagacacaaaacttgtgaagaagtggttaccatgcatgtctgtcatcatttgcccacagagggatatactgataatgggaataatggtcgtcaggtgggcaggggaaggggtaccctgcaccatcatgtctgctgaggaagatacagtcgtggttccctcttcccaagatgtttctgctcacctttgctcaggacatggggttgcttaagggcaatgtgtgggttcagatccggcctctgcactcacctgccgtgtgatctcaggctaattatttattgctctgagccttagcgtccacgcctgtacatggggatggtcatcgtattcacagtgttgtgaggatgttacgagtggacgcaggtaatgcacttagcaccatgcctagctggcgggagagctctaggaatgttctctgttgtcggcctcttgaatcagccttgcctctcctcagcattccctcagcacctgctgtaagtcagcgccaaacccaggcagcctcctcctgtgccctgggctaagccgccagcctccaggcctgggagctgagcgtctggatctgccgcgcagggggaacagcctctgagagttggtgtgttggctcccactgctggcgtgacagacatcctgaggaaatatgtcactt

SEQ ID NO: 104008 - DNA, 2788 bp, Homo sapiens
gccaacaatgaagaggcagatcgagggctttgctcattcaggctgtcgagggagccgtcattttgtgttagcgtgtgtgtgtctgaggtgggaggaggaagagagcggagaatgacaggagaaggattatgacattgtgttgtctctgtttgtggtaaatgcaaatttggcaccagtggtttcccgggaaaaggagcagcaagtaacccaggccgaggccctggcccagacccacggagggagcccgtgctgggcggcgtggggctttatttggccctccctttttttctatctggcgtgtgcttcttgcatttattttacagtgaagagctggagacagacaggccggcgaggcaggaggagccggccccctcctcccaggcatggcagcccctcctcagctcaccccggaggaggcctgggcagctctcccaacccccaggcgctgtcccagctctccggcctccctcccaggtctctgcccccagccagggtcaccgttccatcattctcttagcctgggcagcctgaggtctctgaaggctacttctgcccgcagctgcttcccaagcgtgaccagagaccgagaacctgggaccgaggctgggatggggctttgcagaacgaaggccagggctgggcgctcccccggctacagtgctggcctggctggcctggaggttggcaaacagctctgcagccaggggctgttagcacagcctcctggaccttgactcctctgacgggcccatgagggcaagggagcttgagcctgccctgggccaggaagcggccatggtacaagtctctgggctgccacagggctcaggcaggtgcagtgacatgggcgcaggtggtcagtgtgtttacagcaggcctccagagagggcatggtggagtgagttttaccagggccaggccgtagctcaggccctagcagagactgtgagttctaagctgagaagccagggcaggaaccatctacaggcagaaggtcaggggaaggctgtggctctccttccagtctcccttcccctggagctggtccctaacctgacgtcaccacctcctcttttctggtcaagtcttctggtctcaattcacttcctccaggaagccttccctgtccttctctcaggtggacttgggtcctgtgcctggcccaccttctttgccctctcacagtcctgaccacacagacgtgggtctgtctccctgttaggcctttgggtgcagagcctgggtgaccatccttggttacagggacacttaaggcctcccctctgcactcctggcacctgcccagagctgggcatagaggagccctgttcctagagctcagaggaacacacccagactcagaccccccaggaagtgggaccaccaggatggaacagctgccctctccccatgtcctagacggtgtgatgggctcacttcctttgggcaaactcaccccaaggggttttttccccacagaaatcttttccctgagtacccctgtgaggtctgacagggaaatcaagagaggcttcacagaggaggtggcatttgaaggccttgaagagtgagtaggagtttgccgtgctaaggcaggagagggtgtaccatcagagggaagtgcaagaacagcgcatccaaggtgtaagaggcgggttgcactctgtggctgaagccgttggaagggaagagtggggagaggcggcgacagtggaagtggggcccttgtttcactggctgggggagccacttgtggaggaagggagaacctgacctgatgacagactgggcggtgccacatggacaccgcagtcattgcaaactcgccttctttggacccgttttcaggatcttgcaaagctggcttgttctagctgctcccaagccagcctctctcaggctgccttgtgctgggattcccagatggcctcagatttgaatttaaagaccagcttgggtcttcttttaatttggagtctcaggaccagcccaggccacattctgagctggaaccaaattggcgggaagcagtttggatgccgatcaaggggtgaagggttcaggagcagctcctccagcctgggaccccgagatgactggaggctcctgtgggagactggggtggctagtcccccagacctatccccaacggagatggcagcacagaggggtggccaacgtcctgaggccagactgcctgggttcaatcctggctctcccatttcctagctgtgtggcttcaaggaagttacctgccctctgtgagtctttgtgttcttgggtaataataatacctacatcacagggctgaggtgaggattacatgagatcattctcacaaagcagtcagccagagcctggctcccagggggcactgaataattgttagcttaaaaaaagataactccagagagcaaaggctctagcacctagtgtctggggtctaatcactcaatccatctgagcctcagtttccctagttgtaaaatggagatggtcatcgtgtctggtaataatagccaagactgaggagcactgactgcgagatttgcaggctgtgttctagttgcctaactatgtattagcttaatagtctctccccaccctgagccacatgtaggggcagagcaggggccagggcagcctagaaactaaaagtgtgcagggaaaagccccagagatttggtagtttctgggtgaagctaaaccagtccccttgcttagcaaaggcaagaacagagggaagtggatggctggagtgtgaggcatggagaccacaaaggcccac

SEQ ID NO: 104009 - DNA, 1092 bp, Homo sapiens
ggcgtgtgccaagtttggggcagccagtggtcagcagcccagctgccccgtggcaccagggaagaggggaagggccctgccgtggagtaggcagagcagggcctggaggggccctgggccaggggcctcaggctgaagcgagcatggccgagtgaagtgcatggcctctcactggagggcagaggctggaacactggacagggaagtccccaccaggccaaggatggcttgaacagctacggagtaggcggctcaggtcaaggatctggccacggcccagagtccaggcactggacacttgggtctctgttgtgtcccaatgcttcctgggccttggtttccccatcttgacacggggcgttggtgcttacctctcaggcattgccatggggtaggaagggggtgtgaagcgcctgtgctgggcttgcaggtagtaggtgctcagcccctcggaacggacgctgctgttgtacacagagaaacagagccaggaccccaggccaggcctcctcttgctgtggcctccctgagatgggacttgggacaaaaggtggtcgggactgccatgccctgccctttccaagcccacctttgtagggggcagccagggctcactccagtggcccatgaaggctttagccctggagctgcccagctagcccttcaggctctgggccactttgctggcctcacatcccagctcaccttcctgctctgcagcctcagagatgcccttccctttctgagccttgccaggtaaaatgcagccctctctggtcctcgtgacgaccacctaaggtgctgggtgcaaatccccagcacacagtaggtgctctatgaacggtcacacttgcctttaccccacagtctccaagcacagcagtgagctgcgattctcacctgtggtgggcgttggccccttttaagccatttactctggggccaattataaatagacacataatcgcccctatctatagagataagacatactcttcagatgagcccgcccctcccctgcccccctccacgctggcacgcgctctccgcagttgaaggcgaggggggatcgggtgctcccctccctcctcc

SEQ ID NO: 104010 - DNA, 1076 bp, Homo sapiens
tgggactacaggcatgtgccaccatgcctggctaattttttgtattttagttgagacagggtttcactatgttggccaggatggtctcgatttcctgacctcgtgatctgcctgcctcggcctcccaacgttctgggattacaggcgtgagccaccgcgcctggccatgcctggctaatttttgtatttttagtagacggggttttaccgtgttggccaggctggtcttgaactcctggcctcaagtaattcacccacgttggcctcccagaatgctgggattacaggagtgagccaccacgccaggccagcactctgatctcttaataggaaaaggtcctgttctcctgggagctcaagagggctttctgtagggtgcccagcacatacaactggcctgcctcctctttgcccagggtgctggacttgccgaaagctcttctggtgaaggaattcaaccattgcactttttcgctcaattgcttcactccctgtctgttgaacatttccaaatctgatttgcaggacttttttttcttttcttttctttttttttggctagtgaggctttagacttccatgcaactcaccacgcccagaaatggatgctggaccaattgtctttactccccctttcccatgcaagcaatgtaacggcctttgaaagggggctggtttgtggttttccagcagtagaatggtctgtggtcttgagcagctaaatttgaaaccgggcttttcaggaggatcaactgagctctgaaacagctgggcacagtgcaaggtggcaggggtcagggacaggcaggtggggctccttgggcttggctgtgctttcactgctgactcctcagtgccgggaacagtaagagctcacacagccctgcttgaatgaatgcatgcatacgtgatgggatggatctgtgctatgatgagatgcagtagagtatgttggttaaaagcctaggctctagaactggacagcctggagtggaactctagctctgctctttgttagtggtgtgactgggtaactcagttccgttctctgggcctcagtttgctcatctgtgaaa

SEQ ID NO: 104011 - DNA, 1288 bp, Homo sapiens
cccagcggtggggagtgtggagtgaatggggctgaaagggtagggctggctcacagagggtggggaggctgcagcaaaagaggagtttagggtggctatggtgcaggggcagctgtatgcttcacctcaaatgttactgtcttctctctccatcaaggaggaagggcccaggctggggttaggaggcttagggaccagactgtgtcaccctctctcctcctgtgccctgccccccacgctgtcatctccctcagtggcagtgggggttcatcactgggtcttcaggtcccttgcccatggctggtggtgttccaggtgggcccaaccaggcggcccctgcctctaggcagcgcgtaggtttccttgggcagcctcaatcctgccagcgccagcatgtctccctgcacagaagccatcaagcacctttggatcctatctgagggtcatccctgtcccccagggccctccacccaaccacagcaccggtgtgtattcccctctgcaggctgccaggcactccgcctgcacctgctgcagttggacagtccaggcgtggtgtgtgaccacagcaagccactgcccacctctgagcctcattgtcctcatctacagagttgggacatcagcgtctactttgtggttggctgtgaggcctaaatgagataatctccatcaagtccctgccaggagcctagcctggcctccatcagtggccgctgttgaaaatgtgagtcctaaatccttgtgaccgctgggcccagcaccctggacagcaacagcctggccctgccctctcccggagctgggagggagggccctttcccaacctgctcgcctgggagcactgcctgccagtgacttccctgcctctgccacgccgacccccagcagccttccctggcctccctcccgctcctggagtctttagtcttcagcacagtctggtaattaaaaaccttcaaggggaactttattgagttagcattagttattttgtcaggctgggagagcaagagaattatctgtcctccgggagagggggctagggcggggtcgcgggctgagattggcaggtgcctgccagtgtagtgcacgcagggtttgtgctctattaatgcaccgcactgcaggtgcagtggcaggatgtgaccggggtggagcgggctggcgggtgtgtgtgtggggagggaggattccccactgtgaggctggccctgcggggatgttcccacttcccaggctcttcctggctcctgtcctagggctctatcacttcctggctttcaaa

SEQ ID NO: 104012 - DNA, 1006 bp, Homo sapiens
cttcccctcctctcctttcttcctctgctccctttccccctcctcctccacccgctccaagcttcccttctacccctttctgtcttttccctcctccctcctcccctccgcttccttctcccccttctctcttcccctcccccatccccaccacttcctcctcctctgctattctctcttaccgaccccactccaggtacctgctaattgcacttccctcctgctattaattacctgacctagagagaccccagccaggtcactcctaggaggtcttgaagtgttggggtgcgggcaggggggcctgcgttcggggagaggtacagaggttggagagctgctagctgggacagaaaggcaagagggactggtgaccagtgggacatgtgattcccctccacccccattccagttcctcggggttcctgggtgacccaccactgccagcatgttctgttcatgaggccttgaggcccctttgtcctgggggaaattgaggccccagggcattggaggttggctaggagtggggaggggagatgggagagagagtccatggggagggagagcaaggtaaggactgtgtgagaggcagatggagagagtgccagagcagggggctggatgtggggagaggggctgggaaggaccctcagttcctgcacccccagccagacatggcctcacctccttgccgccgtcctccctgtgattgtcctctgggctcactggttgctcttgctgtctgcctaccgcccccttgcccccatcctcccgtgccttctaaaggccagagaagcctgcagggccaagtccagatttttgggggtacccctccaggtctccgttcccctccacagcaggggtctgggcaggcggtgggtgtgggaacccttggagcccacccatcactgccatggttattctctgtttcagttggtccacagcttctaaggctgaggacacaccagtgggtgcctcctctgtgctggccgtggtgcccggc

SEQ ID NO: 104013 - DNA, 1041 bp, Homo sapiens
aggtctccgagcccccaggagcacccctgccctccacggctgccagtgcctccctcctgaggggcttttcctgccctccagctttgagagcatctgagggccaggcctgcatgaggatggagatggggtgggggagggccagatctggggtgggaggtccagggatctcccagccacgggggaggcaggtggcacactgatgatgacacccatccaggggccactgtcaggccaggggtgtggagaccagggaaggcagtctggggaggccagggtctggaaggacgaatgggaggtggctgggaaagtggtcccccatcctggaacagcacagtgcatttccaggaacagcaccttcatccatccatttgtcctgtagatgttgacttagcagctgttcgggagataacacagcaggttctggtggggtgagccaggtgtccagggccaggggtctggtctcccctggggactgggagagacttggtcagatgtgcagtttagagagacccatggagtggcaagtgtggagtgtttgggaggcagtcataggaggaccaagaaggatgctgggggttaaggggtgggatggccccatgtttctggccccaggtggatggcagtgccatgccctgaggggggcagggagctggtcctcattaataggaagtagtcaatcactgcctagtatgaattaggggattgggccagctcttgaactgattcttaccagcagccttgggggccaggaggcagtgctggagctggagcgtgggtctgacatttgctcaggttgtgtttgcagtgctgtacgactgcatggggaggggctccagggggttatttagttcaggtcctgctttctctctcccatgggcgaccagggagagggtctgctgtgtgctcaaacaccccacaggctgtgcattccctgggcatctctgagcctatttcctggtttggaaagagcacaagctgtagagacaaacccccaagagtacggggcccctggtagaaactggggccaggttaagctggagg

SEQ ID NO: 104014 - DNA, 1064 bp, Homo sapiens
tcagctcactgcaacctccgcctcctgggttcaagcgattctcctgacaacgagtaacctggattacaggcatgcaccaccacgcccagctaattttttgtatttttaatagagacgggatttcaccatgttggccaggatggtctcaaactcctgacctcaagtgatccacccacctcggcctcccaaagtgctgggattacaggcgtgagccaccacgcccagccttgtctttatatctttactcctgctgttccctctgcctggatgcctttcttgtctcctccacctggggctacctctggttcatctgccactctaatgatgcctcctctgggtagtcctctctgaccagccctgtcccaggatggtagatgtcttatgtgcccccctctctggccccctaggcttccctcattcatggcactgtccacaccttcctgaagccaccagcttcagtgaggaagtctcactcagtgttggccccatggccagcccaggactttgcccagaggtagaaccagtgaaagtttgttgagtgaataggcaagggagtggatgttgctcttcctgcctatgtccagcccattccacctgcctgggctgccctcctttcctctcttaccctgtgtgcctggcctggataccccagcttcaagctgcctgtccttcagagagtccttcctctctgagcctgtcctcacctgcagcccacctgccatgaggaccccagatggagcccactgtggtgcctctcctgcacccccagcatggtgtgtgagcaccctggggctcccactggcttctcccacttttcattgcttcaggcccccattaggtggctggtgattgctgacagactgaactgttccagaacctcccctgtcaggactgccctggggaaatctctagaggtgtccacagcctcctgtctgccccctccctgcttgggtctcctcagaccattccttgattccaggtttctgaaaaattgtgtgaaaactggctttgtgtcatcagatccaatttcctgccacctcttacttttaaaggaggcacagcca

SEQ ID NO: 104015 - DNA, 1092 bp, Homo sapiens
ggcagaacagaacttgcaagagtccagaggcccaaaggaggctggtaagtttgagaaacagccagaaggcgggtgactggagcagagtgagcaggggtgagaatggaagtggagaaggcggagaggtcaggggggccagtctcaaaagtgaaagtaggagctcgctgtgcttcttcatcttactcctgaaccgagatggcagtggtgggaatggagggaagatggaaaacagcagagcagagccttggggtagagcctggagtagagcagtggggcaggatctgggggctcagggctgggagagaccaggtgctggggtgggagggagaaggagacttcctgggaaacaccctgcaggtgggggtaaggggatccagtgacacagctgcggcacagccctgctccggggtgggaaacccaggactcctagctggcttccccggcctcctcgcctgtccaccgtggagttcatccaggccgctgcagggtgtgaagaagggctcagagtcagccctgacactttgtttagttgttcatttgtcctcagttcctccatctgggaaatggggatcctgatactcatcgggggttaggaatcatggttgcaaagttccagcgctggtagaagtgaaaaccctgcccgttgactacttgcttcctcatttgattctgtgggctcaaataatgtcctattttactgggagggaattgaaggtctgaaagggaaatggcttgcccagagccctgctggccaggctcaggaggcaggggaggtctggggagagaagcctgggatgaggtcccctgtctccccaacacacacgatgagagcccccatggctttccatggctgcccaggcaggagtggagccggggttgcttggagcacttggggagtttagagcagcagcaggtggcctggcccccagatccccatgcctgtggagtggaagggcagggccagaggagtactcttccccatgctgtatgtgctgcttggaatgtcctcccacagcccccagccaagtcttcacccttcaagccttagctctggccagcacctcctccaggaagtcttcctagactttacgt

SEQ ID NO: 104016 - DNA, 1940 bp, Homo sapiens
taacaaacaaggggctgcagagtgaggtggagggtgctgggagacccatgtggacagagcaggctccagccggcctgggcctggggtcatgtggttcaggcgtttcaggcttcccacacagtgggcagggaggcacgaggctggagagagcaccaggatgcttgtggcttgtcctgccccagcctgtgactttcaccggggatgcccttccctggctaagacctggggtgggggctttcccccccgtctggggcaagctttagcaaaggggtttagtgaaccagtgaacactgacaatcccaaaggggtgctgagccctgaccgtgtgccagcacctagattaagcatttcacatgtgtgatccctttgactctacccacaaccctgtgaccaggaaacggaggcacagagaggttaagtgacttgctcagggcgtgggtgagtgggaggtgagccagggagtaggtgagctggcatttgatcctgggtgatctgaagctagagcctggatgtgcaaccaagagatgaaggtgggaagggggctggacaggggaccagaccaggttcacggggggctgcggatgggagctgtgcttgagccttgtgggactgggtactgctagagccttagagctgagctgcctccacacacaccctcagtgggcctagacctcggagccacatgcctggaccctgagggcgcccatcccgtcttgcctcaggggagcccacaggatgccccacagggctgctcatttgctgaaaatatgttgcagagagctgggccctgcagaggctgtgtccagtctggctggagcggacacgtgggcagaacagctagagacgtgtggttctcccgagtagagagcagctcacgccccctgcatggctgagcctgggagggtgggtggagaaggggcatttgttcagttgagagaagacaagccctgacccaacaatagtaatggcaaatcagatattcacagaggtgaaagtaacgtcgcagctgacataagggctgtgaagactgaaggaagtcagggaggcttcctggaggagggggcccagagctatgatgggaaggaggtaggaattaaatgagtaagcaggaaacagtgtgcaaggctaagagaaagcctgtgcaaagcccctgcggtagggagtgctatactttgaggccggggaaggcaacctgtgttttttgagcaagaggatctgagggcaggggtgtggtgcctgatgagctgggccctctgggagcggtcacatgagatgtcagacatggacttttggattctgtgaatctggaatgtccttagagccccaggcctagaagtctcagggttcacagcccagctccacctcttcctctgcattcagtctcgggtaaggagggtgccatctctgagcctcggttttctcatctataaaatgggctcactgtcccatcaaagcctgcatgtgaggacttattgtgggaatgtgtgtgaagtgtctgtgcgaggtgccctggcccgaagcttccgcacaggaaatgagtgagccgtgtctcctgtcccatttcctggggttcccactcaccctttgggcccagctgcaggttggtggagaggcctgtgccctgcacctctggcttctatctcattggcaggttgggggagggggagttcatggccaaggtcagaggtgccttccctcagcagggttttctgagggccatggcaggtgcccactgctccaccttctgatccttcagcatgaggcctctccccacctggggatgtcttcaggaagggttacatctagcaccattcttagctcctgcgccaagggcattgccgtggcccctctatatcagtgccagcctccagactcagccctggggtaaaccctggcttagctctgtgggcacccagtgcctccgccccctcccctccaag

SEQ ID NO: 104017 - DNA, 1050 bp, Homo sapiens
ctgtagcatcgtgtttgcccatgcagttgctttatcagaaattggctgtgcggggcacggtggctcatgcctgtaatcccagcactttgggaggctgaggcaggcagatcacttgaggtcaggagtttgagaccagcctggccaatatggtgaaaccccatctctactaaaattgcaaaaattagcagggaggctgaggcaggagaattgcttgagcccgggaggcggaggttgcagtgagccgagatggtaccactacactccagcctaggcaacaacagagcgagactccgcctcaaaaaaagaaagaaagaaagaaattggctgaactggtatttgaactctcccgctcactctccccgtcgaacccagagtgctgcccttgcttacattgccatcacccttggaatgagaccgagatcctccccctggctgttcctgctccagctcctgcactggtcactacactccagccacatagagggaccttttgttctcaaaagccctgagctgcttcctacctcagggcctttgcacttgctgttccgacctcccaagcttctccctgcctggctaataccctcagagcccagctggagtatcacctcctctgccaggcagggccttcctggtgcatgttatcaggctagttcgtagtgcccatgtcatttgtaatagttatctgttatgcatctgctcgccctagacagaaaactccaggaggcagggatggtgtctgctgagttcacggctggaccccggtgcctttcgttggttcactcactcttccttcctgtcatctgttccttcagcaagtcctgagcacctgacatgtgatagcatcttgctagtatttgttgagcggatgagtggatgaaggaatatccatctgtctctaaagcctgtactctttccactacattccgtgatctctgacacccctctcttggccccattttccccagttgtcaaatgaaggaaccagaccttcccttcctggctaagttcagattctgaggatgtaaggcaagtgggctggcttacagccca

SEQ ID NO: 104018 - DNA, 1057 bp, Homo sapiens
gccgtgccatcctctgcaatgaggagttcacccaacctgctctgttttttggcgccagctggtttgcttgactggaggaggccacgctaatggggccaaggtcacaggttgcagcctgcatggtggcaggttggctcccagacctgtgggtgggtgccaggactgtattcctggtgtctgggcagaggaggagtgatggctggcccccagatttggttgcccaccacaggtggcctcgggggtaaagttgggctaggggccaggctcgttgctggtttgggcagggctgggggcgtgatctgagtgctggggcacccccaccccagagctggcaccctgaagggctccctgtcacccccttgccaccctactggctccctagtctcacgtcctgtgcttctgccgcactcagaagctgcacttagaggtcccagagcccagttctttcttgccctcaggtctctgcccctgctatgccttctgcctgggacacttccccactctctgcccccctgctgtctgctcagagtcaggggtaacagatgcgtgcactgtgttctcgcattctctctgccagtcagtattcattcagcaaatgcagtcccttaataaggatattgcagccctactatgcaccagatgtggtactgattgggggtgggatggggagagctacatttgtgaataaagcagaccaggttctcaccctcgaggagctcacagtggagtaggagtgacagacagcaaacaggtgaaaacgtggctggtgccggcctgtgggcagggctgtgtggaaaagctgagtggtgccagagagagagtgggaggtgcagggggtgctgatagaggcagggtggccagggagcctttatcaggggcaggagaaggtgccagccatgggaggtgtgcggggagagcatcccaagtgggactccttgctttcttgtctgtttccccacccctcttgcctggtgggggccagcacaaaactgggatctttgctggggctgagctgatgtgggcagggccccgggagcaggaatggtctcggatgtct

SEQ ID NO: 104019 - DNA, 1032 bp, Homo sapiens
cctcctgggatgattgaatctcactgtggctgtgccactcactagctgagggtcactctctaaggcatgtggttctgtttctgcaagcctcagtttcctcctttggacaatgggaatcccgcagtagtaattgtccagcacatgctgacgcagagtgggtgcagagtgagcgccgtttttgtggtcatttctggccccaccagctgccccaactcctcacttggccttccatgcagttcgctgcccagagaatgctgggtttagtcgctatgggcttctctatggccccagatctttccttcaacaagccagggggtaccaggtacccactgtgccctgcagaatgtttgaagaaaaagtgagtagttttggattctgaaaccccagccctgagtcctggctctagatctgtccagctgtgtggccttggatatatcacttagtctctgtgtgcctctgttttctcgcctggagctgcagtgagatgtaaactggaaaccacagtgtagattgcagtgaccagtaagtgcccaccttgtgtgaggacgagcgctaggccaggagtctgagccttgggtgcagcgactgcccctgtggcttcgctgtgtgtctttggtccggactctttggggagcacctgttaagggggttcgtggcatctgcctgcctcacagagcttttctgagactggaaagacccaggggtggggaggagaggggctgctcgtgggagggctttaaagggctggatgccttctggaacaaccctgtctccctggatatagatgacctctcctatctgaaaaatgggaccagacaccctgctcacccccatccttagatctccgtgattatggctttaatcagaattttagcctttatatttataatgcatctgaagggactccagcccaatttaatacgagatgtgttgaaataaactgtcatctggactttgatatattaagattgccctttgaaagtcacgtgttgagaggcagatgatgaagaggtgcctattgttgccgcctcg

SEQ ID NO: 104020 - DNA, 1075 bp, Homo sapiens
cagagatagactaggcatggtccctgccctcaaggggttcccatctggtgagatgctggtgggagcaggactccgacatgacccagtgcaggagccgtgaggccagggacagggcctccaagcccagctgagctcaatactgactcgggcttcctgggaggaggcttgggctatggggggaccgtggtcagagagtgggtggcaggagcttgagacctccagggaggcgcatatgggtgatgacagcagcccaggtggcccaggaggggtggctgaggggaatgaaaggaaagtgacaggcaagggggatgaggggtgtgctgagaaccaggattggactctggaatcccccagcagggcacaggctcgatgaccagggagtgtgaccccagtgggtgcctgggttatccttgaatacaggctggggtgggggttggggagagctagagggtatgggtgggtgggaggaccctcacaggggccggggctttgaacaggggggtgaaggcagaggtcatgggggcatcctattggagcagtggccacaggtatcatgcagggggctgctggctgccaagcccttaagagcctagggacaggcagggacagcaggaggaggcctggccctttctcttgccagccaggtggaagcctggatagaaccctccaggtggaatacaaggctctactggaggtccttaagggaggttagggaggtggccgagaacagagaggggtcagccctttacaggcagggaaggggaaaggtgactctgggaaagggggtggcaggtgcaaaggtgtggctgggcttcaccctcccctgggctcccacggtggggtgtgtaacaggcagggggctggctgctggggccagggactgcccctctacacacttgcccctgatcctggcaccccgtttcctgtaggctctgcagcgccgcgagaccgaggtctatgcctgcatcgagaatgaggatggcagctcacccaccgccaagcagagccccctctcccaggtacacaggcgctggggcaccaagcctggcttcttgctccatctgaccctcccatc

SEQ ID NO: 104021 - DNA, 1094 bp, Homo sapiens
accagtgtctcctggacggggcccctgctggaaaggggccgagacagggtgaagcccaccaggggttggagtggggaggcttgggtcccgtctccagctcttcttctggttgtgtggcctggaccagtctcagtgccaggttcctcatctggcggccaccctgctgggctgttccagctttgcttctgagcggaaggtcaggggctgccagggaggagcttcgtggggaaagcaaaggggaagctgtcagcgccggccgtcccctcctgtgaactaaagagtcgccgcagacaagcaggcccccagatggagaaccagcctgtgaggtggcgggccctgccaggcctcccacgccctcctgggctccccgcagccccctggctcctccttggcgtgctgctgctgcccgggaccctgcgactggcaggtagtgtctgtcttcctccttctctctactctctcgctccagaacatcagagcggctttcatcccgcccggcgcagctaattcccagggacctgtctctggggatttgctggttgtcgtttgaacgctgcagacttcacaggggaagccttctgggaccgagaagatgtttagctaatgccttgccaaggtggcttttgaaggggagggggacagcgctctctccctcgctgctgtgacagctttgccccagcagtctggcctcctggcccttaaacaaggagggtgggcgctgtgtggctggggccaggggcggggcaggggggagggacagctccccatccgaggaacctcacgtggctgctgcgggggacactgcgttgaacctggcaagtggtggggctaccctctgggttgttgctggcattggccagggagagcggggagaggggggagggggggataccagggccagccacagggctctgcgcccagaggcacaaaactgtcagtcaccagaaagggtctcacctcccagttcctgaaacacaaccagaggccaagtgttttaggatgcaagtgtgtctttccacgccagcggcgctcctttcctggttccaggctttcttggaagctgggtggccgggatccgagccaagctgtggggt

SEQ ID NO: 104022 - DNA, 1078 bp, Homo sapiens
tcccatatttgagaggtgcttcgggcagtttccgaagtgtgagagccagggtctgtttaaatgcagatttcctggccctgcaactctctggggtggagccagcgtgtctgcagaatagtggcagccacacacacaccctctgctcacgggagactgaggctctggtctcacagaacctgagaactgtgggtgaggaagcatgaatagcctcaggggaggctaattgcttccttaattagctgaacccgcgctggggagccctgcccggaaagtcccagttgctgggaaggatgggactggcttgcctggcggccaataaccgtttccgctggcggctgcccccgaggagactgtgcggcgtttccagcagaaacagcacgaggggaaagggccgggccaccgcggtgcccaggaagggatttaaagaggcaagctgaggtcctgcagccgccacgccctgcaccctgtaccgacagccctccgccggcacactcttggttctgcctgcaccggacccccccggaacccccactgccctatcccactgccgctcaagccctatcttgatcttgctaggcggtggcctcagggcagcccaggacccctagagggggaagaagggtcacggagaggaaatctcaggtgagggcgttcccatgtctaccaccaggtggcaccatcagcacaggccaaccctggggccgtcctgcgtggccaggaggggaagtgggtggcaccgttagtgggggacttggtggctctggcgtctgttgtctgagggcctcctggttctgtgctcgtctctttcagggacatggttgtgtcaagggcccgagcctcccagaaccttggcacatggtggacgtggaataaatgttgaaaattgtggccgggtatggtaggtcacacctgtaatcccagcactttgggagaccgaggcgggcagatcacttgaggccaggagttcgagaccagcctggccaacatggtaaaaccccgtctctactaaaaaatacaaacatagccgggtgtggtggtgggtgcctttaatcccagctgcttgggaggctgagacagg

SEQ ID NO: 104023 - DNA, 1044 bp, Homo sapiens
ttccctagaaccttcagagggagcacagccctgccaacaccttggtgttggacttctcgcctccagaactgggaggaaatcaatttctgttgccttaagccacccagtttatgttattttgttacagcagcctgggaaaaggaatatactgaataagaacccaagtgagcttattagaaagaatattgaggcctggcgcagtggctcacatctgtaatctcagcactttgggaggctgaggcgggtggattgtctcagtccaggagttcgagaccagcctgggcaacaaaaatacaaaaattggccgggtgtggtgatgcacacctgtaatcccagctactcgggaggctgaggcaagagaatcccttgaacctgggaggtggaggtggcagtgagccgagatcatgccattgcactccagcctgggcgacagagcaagactctgtctcaaaaaaaaagaatgttgaacctcctcaagaggaggtaagtgattttaaacactctgaagccacacagggacaagccttttacaagccaagaggagaaggaggaaaaattgaagtcacttttttttttttgagacatagtctcactcttgtcgcacaggctggcgtgcactggcgcaatctcggctcactgcagccaccacctctgaggttcaagcgattctcctgcctcagcctcctgagtagctgggattacaggcgcccacgacggcacccagctaatttttgtatttttagtagagatggggtttcaccgtcttggccaggctggtctcgaactcctgacctcaggtgatccacctgcctcagcctcccaaagtgctggtattacaggcataagccactgtgcccggccttgatttttcttttttaatggttaaaaaataccttcaaatgtacacacagtaaaattcacttcttttggtatatagttcaaatgcatagagtcctatcaccatgaccgcagtcaagatagggaacatcccgtcactcccagaactcctgtgctgccgctggcaaccactgctctgttctcccg

SEQ ID NO: 104024 - DNA, 1094 bp, Homo sapiens
cttatcttgctggacacgccgctctttctcctggaatcagatgtgagaagcgggctttcgtgcatgctgtcattagggaggacctgggccccgggcagcgctcccagccctgtctcctttggtggacactagggaagcacgaggaggcggcagagggtgggaaaggggagtcagggacccgctccccaacagatgacaggcttctgctgcttatacccctagcagtggtcaggacaaggggtgtgggggaccccttggaaactggatgtgtggctcgggatctgcagaatgccaggctgatcacgcagtggcaggcagtggaagagggcagcggccatgggtggaagatgttctagggcacacagctgggccggcacactgcactcacacccagtcgaatgcctttgcactgtgtccacattgcaccaccacacatgacagccctaaatgtgaactgaaggaacaaggactgacccctctgaccaccactacccataaccagtactgtctctgcgtctgagtcctggcctggtttacctgctgggtgacccctggcaagttactttgcctctctgggccttagttcccgcacgtgtaaaatgaggttgggctcaatgacctggccagctctgacatcctgtcattttcttgccaaggtctcagcctatcagttgtgacacaagtctcatcagtttcagttttcttgtccatagaatgaccacagatcggccagatgcggtggctcacgcctgtaatcccagcactttgggaggccgaggctggcggatcacctgaggtcaggatttcgagaccagcctgaccaacatggagaaatcccgtctctactgaaagtacaaaattagctgggcgtggtggcacatgcctgtcatcccagctacttgggaggccgaggcaggagaatcgcttgaacccaggaggcggaggttgcagtgagccgagattgcgccattgcactccagcctgggcaacaagagggaaactccgtctcccaaaaaaaaaaaaaaaaaaaaaaaaaagaatgacggcagatcccataaggataaggatcatgtccatctctgtcaccacatccc

SEQ ID NO: 104025 - DNA, 1061 bp, Homo sapiens
ggaggcctccaagtccctagggttagacacctcctggggtgctatggactgtcggggctccaaggagccgagtgtgggggaaactcactgtgggaggcgctcctgacctgcagggagctggaatgctgtgggagggccctgaccccggggcccatggagctccctaggctcctctggccacacctcaccacccaccccctcccctctccagcagttccagtttgtggaagtcccaggcaatcactgtgtccacatgagcgaaccccagcacgtggccagtatcatcagctccttcttacagtgcacacacatgctcccagcccagctgtagctctgggcctggaactatgaagacctagtgctcccagactcaacactgggactctgagttcctgagccccacaacaaggccagggatggtggggacaggcctcactagtcttgaggcccagcctaggatggtagtcaggggaaggagcgagattccaacttcaacatctgtgacctcaagggggagacagagtctgggttccagggctgctttctcctggctaataataaatatccagccagctggaggaaggaagggcaggctgggcccacctagcctttccctgctgcccaactggatggaaaataaaaggttcttgtattctcactgcttttgaggcttttttgttgccagcaagggcttttgcattgagggaaaaggaagcacagaacggattcatccagggtcctcaagggtgtggaggcaagaggtgggaaggacaagtcctcctctaggcacgcctgggtctccaggactgctgaagcacaagacccgaggggtggcctggtccttcactcctggcctgtgtggactctgatggggctgttggacgcgatggccttcaacctggggcccgttggccagagctcggcctctcagagaccgctgcaggccctgcctcacctcatgttcctcctggccctgcacctccagccatccactgcggctctcacggctcagtagggtcggaatttgcgctgggcccgcagcagctcgatcctctgcttgt

SEQ ID NO: 104026 - DNA, 1488 bp, Homo sapiens
ttcacagttagtactgcgggaggggtctggcgcctcctttctgggctccgggttggcaggacactctatggggacagtgtctgaatgtcacaagccaagtccatgctccctgagagcagcatgtggaggcctgggcaggaggaccatggggctgtgtctgggtccccagggagtcattagcctgagcccctggcacagagcggcacaggcatactgggcaggcagagcgagggcgcagcttgcagcccctgggatctccttagcgcctgtgccccgggccctgtgggaaaaggtcccaatttgcctggcaggccctggggtggggcccaaatgccaggcctgaggaagccccgtttccctggctcccttttcctcagaatggatcagtgactacgcagactctgtgcccgaccctgaggccctgagggtggaagtggacacgttcatggaggcatatgaccagaagatcgctgaggtagaggccccgcggggtcggccgagccccgcgtcgcccgtgtggctgtgggaaggtggcgccccagagggagggcggtggtgtcctgtccttggccactctgtagaggccaggctccctgtttccctgctggatcctgggctgcctggttgggtgacacatgtagtctccacatggtctacagtggagaaggaggcagcgccagcaggtccgtgccctccccgccctccttagccccaacactgtgctgggaggaggggagcagccctcccctgcgggggctcagggcagttctgactttgggaggagggcgtggagggcgcgctgctggaggctgcgggaggtcccaggcgcccaccggacgatgggatcaccttccttgcaggaagaagctaaggccaaggaggaggagggggtccctgacgaggagggctgggtgaaggtgacccgccggggccggcggcctgtgctcccccggactgaggcagccagcttgcgggtgctggagagggagagacggaagcgcagccaaaaagagctgctcaactacgcctggcagcatcgagagagcaagatggagcgtaagccaccccgagtccatcctcagacccctcggccttggccccagccacggatgaggcctgtggccagtgctcctgagggcgggcgctggacttggtggtcgaggagggagggcgtccctaagcacggggctcgcaccagactctgtggaaagaggcccagcctggcagcaccctgtgtggcggttccccatcaccccccaggggcagatgcatttgctcagtgggtggggaccctaggtcatcagtgcccacctctgggttcctgtgcacttagtgctggcgctcgtcagcctccagctaacgcgttcaagtgcagagggggcttctgaacccactgtgggtgcagagaaggtgctgcagagtatgtgtgttgggttggtggtgggtgtgtgtgtgtgtgtgtctgtcaggtggccccgcacaggaccc

SEQ ID NO: 104027 - DNA, 1040 bp, Homo sapiens
gtcccctgctggttgggagtgaagagaatccaggctggcagagctggagccagttggggagcacggttctgggagctctgcaaaatcagtagcaagtgctggaaaaggcacatgccgaagatactcaagagctcccaagatttgcttgaggctagcccagtgaaaaaaaccagagactcatgtttccaggggtcagtctgtcaggcaggaaggacccaggatttgaacccagcttcagtgtgcaggctctgaggctgcccaggacgggaaagtccaaggaaggggcctggtggtgctccacttgcagttctttaaagaatgctgctttttattctcctaaccctttcaagtgggtgcagacttctcgttagcagctggaagacattcctcccacacttttcccttcctggcccaagagagcatccagaaggcagtaggacctggtttttcaggtactgggagccgggggctcactgcttgcactgtgcttagggtagggatggtaaatatcctccctgcatggctttatcctccctctcatcccaaagcaggtatcttctggttgtcacagagtttcattgagtccagctgcagccacgtggccatctggagctggtgctataggtgaccatctggtacattgaggggacctgtttgcctcctccactctataagcagtcatcttgggagaccgggaggagaaggtggtgggctagtcctgtgtcctcctccacttcccatgcctctatgttacccatctgtgtctcctgtgcagaaggagaggaaggggcattaagagatgaagggtgattatgtattacttatccatttctgaataaacatttgttattcctacctttgagttatcttttttttttttttttttttttttttgagacaaagtctcactctgttgccaaggctggagtgcagtggcactatctcagctcactgcaacctccgcagccagactcaagtaatcctcccacctcagcctcccaattagctgggactgcaggcgtgcatcaccatgtctggct

SEQ ID NO: 104028 - DNA, 1004 bp, Homo sapiens
agtgcctagctcatgacagatgcccagtaaatggtgggtcccctccccatctaaggaaaaactgacaagaatttttgactcttctctgctctccacaggcggctgagtgacagcccatcaatgaaaaaggagagcgagctgcctcgcagggtgaactctgcctcctcctccaacccccctgccgaagtggaccctgacaccatcctgaaggcactcttcaagtcctcaggggcctctgtgaccacgcagcccacagaattcaaaatcaagctttgagcaggggagtgaggcagccagaagtgggggcagaggagggtggctctgtttccccaaggcaaagcttatgaccaatgggccatcggactggagacccctgattgtgggaagggttgccagggataaagagcttcctcactggatgggacccgcctttctgtgttgtgttctgccctgtgctcttctctctacgttaacgtttcctgtagtatgtttcttcatctcatcgccaaggtaggcttgtgtttttcagtgtgtgcctccccgagcctcagccccaagctgatttcttatctggaaatggtacactgaattctctgggtggctttcttgtggccccatgggatgcagcgtgggggctgtctgaaggaccctgctttttccaggggccgaggggctgcctttcctttgtgtgtattaagcttttcaaacaatggaggggatggagagccctggtgtcctgacgggagccaggtcggcctgagagctgtgccgctcctctgtcttgtcagtggaggtgcctgggtggggagcaggtctcaggcctcttgtcctctccccagtggctccaggcctcactagtggcaagggcaggatgaggctgcaccgctgggaagagtctatctaagctcttggcttggagtcccgtgtcgtctccacccagaggaagttctccagagttcacctttcccttttccttgagttgtgctgaatgccccaccccagct

SEQ ID NO: 104029 - DNA, 1327 bp, Homo sapiens
ctcagattcttttctgtctcttcgtttaggctgggctaagcagttccaagctttccatgtccaaggccctccctctcaccaaagtggttcagaatgatgcatacacagctcctgctctcccttcctctattcgaacaaaagccttgaccaacatgtcccggacactggtgaacaaggaagaaccccccaaagagctgccagctgctgaggtgaggtgatggtggtgactgcagcagttggggtcaggagggctgtatgcttatatgtacctcattgtgttccccacaacgcctttgtgaggtgggcattgccacccccattctacagatgagcaaaccaagacctagggactcttaccctcaaagaccttgcaggctagtggggacggcagacctgctgagagattgcggtatctggtgatatgttagactctctcagaagaaagctattaggagggctgaggacagattatctcattccagttgggaagtctgggaaaaagggctcttttagctgagtgggtctggaagcatgagtagccttccaggtagaggctcagggcctgagaggcttgcgtatttgggagatgggagagggtccatgcttttagcatagagtgatggggggtgtagtggacactgaagttcagggggcccatttgtggtaactctccatggagctttcctctgggccttcctagtcacgtgcctggaggaatttctgttgtgggaatgcttatcagccatctggcttctggtaatgctcttgtctgtgtggcagcctgttctcagcccattggaaggcaccaagatgactgtgaataatctgcaccctcgagtcactgaggaggacattgttgtaagtactgtgacctaccaaacatttaaatctcaaactgcctctgtggcaaaggtctcttaagacccaccctcaggtttgatgactgctaggactcaccagactcagcatatagtcacgctcagggctgagactaatgacagcaaaaggatgcagagcaaatggctcatggggtgaagtcggggggaaacgaggcacaagcctccagaggcccctcccagcagagtcgcacaggatgctgggtgcaactcgcagcaagttgtgacaatacatgtgacaccagggaagctcattaaagactcagtacccaaaggttttactgggggctggtcacttcggcattctctgtgtagcatgtactaaaattccagactcccagagggaaagcagctgttgagcagaaaccatgttgtttgcacagtccaggcacagtgaactgtggggtggcaggagccctcctgagatccga

SEQ ID NO: 104030 - DNA, 1044 bp, Homo sapiens
tgaaatcccgtctctactaaaaataaaaaattagctgggcatgatggcgcgtgcctgtaatcccagctgctcgggaggctgaggcaggagaattgtttgaaccccgaggtggaggttgcagtgagccaagattgcgccactgcactccagcctgggtgacagggcgagactccgtctcaaaaaaaaaaaaaaaaaagaggtcgtgaagctgaatgatgccagtttgtttctttacaaagggaccaggcctttccagtaattagactgctcaagtctgctatcaagggaactatcagcttgctcagtgagtctctatccctatttgataccctaattgaataaatgccatatttatactcatgcgtcttgtaccctgtgagatgggtactgttgattaccctcgttgatggatgagggacaggcatggagaggtgaaataagcctgttcaacatcacccagctgatgagaagcagtggatctaggaatggagcccgagcagtctcgctctcagggccctgtgtggagtcactgtgctgtcccagctctggagacgcagaattccacatgaggaatgtggaattcagcatggggatgacgctgcttcacccagacttggaggagcgtggtgaattgcccgtgcccatgctctgatgtgcctctctggccgctgcgttcctcctttctccctgccctgggtcagtgcctgtaaacactgccctaaatcagcagggcccccgtcacttctgctttatgcacctttttcctcagacacattaatacaggggagttttgtttccaagggaccacatccagatggaggggctgtttttggtgatctgcactgccaaatgcccgagtgtccctgacagtcggagctgatgaggccaaggctgtgtgtggttcctctggatggccagaagaggaaccaaaacactgaattctgggccttcttaagagtggtgatcagcacattgtgatagaagcatatctgggaatgaacttggcctcaagcttttggccttttaatttttttttttgtaagc

SEQ ID NO: 104031 - DNA, 1157 bp, Homo sapiens
ccgccctcctcggcctcccaaagtgctgggatgacaggcttgagccactgagcccagccatggttatattcttatccaattttgtatcattcttttttcactttgtaactcaagcatttctctgtgacatttcatatttactgtacatgttttagtaactgcaaaatctatatagttggcattccagttttatttaaaccattttcctgtcattttcactgttagaaatccttctgctgtgaacatctttgtaaataaagctctttctagggtttggatttatttctgtaggtcatattaacaaggatggactttccaagccaaaggatataaagaaacattttagggactcttggtacatactgcccactgggaaaaagggacttctgatgtatctggaagttgtaggactttcactgggtccttgctgacagggagttagcctgtgaagacttgggccccagtctttccaggcaccgtcacccctgtgcccacttctccttggtccctttgtttctccagcagccatttccttgccatgcctgttctagatgtctgttgagggcccagatgccacatttgcttatatttctttatgttatattctcagaatttatatgacctggatgaagatgatgatggtatagcttccgttcctactaaacagatgaagtttgcagcctcaggcggctttctccaccacatggtatggcatttcatgttttcttacactgcgtgtctgatcaggcaggtgggagaggtcgtgttgaatagaacctgttgttttttttgttttgagacgacatctcgctcttctcccccaggctgctggagtgcaatggcgcaatcttggctcactgcaacctccgtctcctgggttcaagctattatcctgcctcagcctccctagtagctgggattacaggcgcctgccgccacgcccagctaatttttgtatttttagtagagatgaggtttcaccatgttggccaggctggtctcaaactcctgacctcaggtgatccgcacgcctcggcctcccaaggtgctgggattacaggcgtaagccactgcgcccggcgtgaatagagcctttcaatgcagaaatatttctttgtttgggccgtaagattttcagagctggaactagtccattc

SEQ ID NO: 104032 - DNA, 1741 bp, Homo sapiens
ttggaggtgtccgatctcgagttgggatccagcaaggccttctcagccagtcaacacgcacagccaccttccagcagagatttgatgcccggcagaagattggcctctcagatgcccggctcaaactgggagtcaaggatgcccgggagaagcttttgcagaaagatgcccgatttcgaatcaaagggaaagtgcaggatgccagagagatgttgaactctcgcaagcagcagaccacggtgccccagaagccccgccaggttgctgatgcccgggagaagatcagcttgaagaggagttcccctgctgccttcataaacccacccattgggacagtgacccctgctctgaagctcaccaaaaccatccaggtgagttgtggcttttgtcatgaattcccagaaagctagtaacaaaggtagatttagaggcaaggtgccaggagtgactgggcaaaaatactatcctctcaagtgttggcataatacagactttgctccttacagaggctttaagtacgttatagccaaggaactatacaaggaaggaaaggtattatctcagttctaaaaaaaaagaaaaaggaggcccatagaaatttggtgactttcccaggtgagatactggtggaagaaagagagaggaaaggacaaaagatttattgagcacatgctatgtggcaggcccttaatatctgtgaccttacagtcctcactccacccccaggcccagtgggatttggcccctagtccaaggccctggccacccttcacagctgccaccacagagggaaaggaaacaatgtcatttaaccttcatagcagctttggtaataggaacagcagcggccacagcaaacatttactgagccaagtccattaagccctacatgtgcgttaccggcatggtctctggattgatgattcttctgttacttcctactgtggaggataaggccctctgtagtgccttttaccaaagaccaaagctgcatgcccaccatgtatcaagttcagtaacccccttcttctagagaatgcatgtggaccctgtggggtggattctgaccactgagtgtttccaggttccacagcagaaagccatggcaccacttcatccccatcctgccggaatgagaatcaatgttgtcaataaccaccaggccaaacaggtagagtgagtgagtgagagagagagagagaatctgtgtgtacatagcgaacatgtaggtgtgcacgtgttttgatgaggcctacttgggtggatggactgaggcttgctcagttggtagttcccagttggtagtattggaggcagggttacagcgaactttttgcaatttgagtttaaagaagaaattttttttatttttttattttttgagacggagtctcgctctgtcgctaggctggagtgcagtggcgtaatctcggctcactgcaacctctgcctcccgggttcaagtgattctcctgcctcagcctcctgagtatctgggactacaggcgcgtaccaccacacccagctaatttttgtatttttagtagagatggggtttcaccatgttggctaggatggtctcaatttcttgaccttgtgatccccccgcctcagcctcccaaagtgctgggattacaggcgtgagccaccacacccagccaagaagaaacttcttaatagaggaagggaggcatagggggcagagaggctaaaaaaagttttgtttgttttttttaatttt

SEQ ID NO: 104033 - DNA, 2064 bp, Homo sapiens
tttgtattttctgtagagacaaggtctcgccatgttgcccaggctggtttcgaactcctggactcaagcagtcctcctgcctctgcctcacaaagtgctggggttacaggtgtgagccactgtgcccagcagtttcttcctttagatatgagggcatccccagttaagtcagttgacatgtccgcttttgttagttcgatgagtttaaccctcagcggatagctttctgtcagctgcctccaagcagttcagtgtggcagccttgaatgtgctggaggctggagttgagcagctctctgggccagacgcctcatctggggagtccttggagctggaagtgggaggttgttgggggacagggtggattgtaaactttgcagttcagcccaggactctggtcctggtactgactgcttgtttccttgttgaaataagataaaggaaataaagacctaaacacaaaagggaggaaatgagttattacataactctagggaacgaattatgttttaaaatgaaacatctgcacaagactcttgggtaaggggatagtattttattttatttatttatttttgagacagagttttgctcttgctgcccaggctggagtgcaatggcgcgatctcagctcaccgaaacctccacctcctggattcaaacgattctcctgcctcagcctcctgagtagctgggactacaggcatgggccactacgcccggctaattttttgtatttttagtagagacagggtttcaccatgttggccaggctggtctcaaactcctgacctcaagtgatccgcccatctcagcctcccaaagtgcttgggattacaggcgtgagccacctcgcccagcaggggatagtattttagtgtcttgtttttctttgtgtctcttaaacacctaattcagagttgaccctcagtcatagttagaattaagctgttttctctctataaaaatgacctaaacacacacctaaacgaacaccccctaacccagaagctttttttgtttgtttttataagacggaatcttgctctgtcacccaggctggagtgcagtggtgcgatcttggctcatggcaacctctgcctcccataacccagaggattttaaacccatgggttaaaatctgctttataataatccagggccccacttcatgggcctgaatcttttggactggacatctgtccagaatgggctgtagccctgccctccccagacagagccaggagggtgaaatattcctatagcccagacagaccctccctggtcatcacacctatgccaggttcccgtagggggtatagaggagagaatttggggtccagggaacgtttgccttctcacctgccagcagcgctcttgccaggacctcgcggaatacctggtgaagccctggaagcagttgcagagctgtagtttcggtgcgatggaggtggggcattacgagactcagtcaaaaccttcctccttcgccctcccaaacatttactgaggataaaagtgcaggatgtgttttgggaacgtcagtagtcactgcagtggggagtaaggctgcagccataagctggagccagagccgaggcccccccaggggttgggctttgtaaaggagcccccagcagttctagaagcgggagggtaacataattgagtctgtgttttagagacctacccctggcaggagtgttgatttgaaaaatttccgatgactaatgcctgcctgaaaccagtactgctgcctgctgggatgaatagctgtcttttcatgcaggaagagcagctgtgattataaaaagcctgaacactgaagccccctcaagctgttcacgaaagaagttgaaagcactggtggaaccagggaactgagtgcatcagattgagggaaatagcttactccctcccaccgtgaggagctcctactacatcctcaactaccgttaactcccacccctaaatgtgccttttaggctgttcaaatagataaaaatgccagcacaaagcatcttggtggtccttcctgccaggcaggcattgtggtatgcgagt

SEQ ID NO: 104034 - DNA, 1018 bp, Homo sapiens
cttgagggcgacctttacccgctcaaaaattcgtctcacattagcagtgaggattcgggcgtcaccccgaatcgttattttccttactcataagtttaaggcataaggacgtttttagtttatttcctaggtaatgaattctattctcattaggcgtatgatgactatcgtagttgactgttgaggtcatgatccagttccattgaagtttgtctcacttgttaataatgtattttgttgcttttcatttaattttttccctcgaggaaaataaataattcataatgtgccgaacttccgtatgcagatgagcagccagcaccgcgaaggctcacggggaacgtccccgccccttccggttcttgcctgctttgagctggctgtcgcgagagttggtccgcggacgccggaagtagttcgtcgctccctagcggccgaaggggcgggctcgcggggtctcgactgctttcggcttgctcggcggagcaagatggcggacatctccctggacgaactcatcaggaagcgcggggcggcggcgaaaggacggtgagaggcctttcctttcttcggggtttagggtcctcggcctagtggagctcgaggcgggggaggtagcgatccgggagcgacgcggaggaccgggtgcgcccgcccccgaccacagccgcgctcctcattggccggctgccgccgtccccgccgtggccccgaccgcccgcccactggccgaggcgcagtccctctggcggccctgggaggccgacggggccgcggcggggacagggtgccgcctcgtggacctgaggggctgccccctggggcccccgcgttccggggtcctggggtctcggcggcgcagcctccttgcctgtgtggactggcatttgggccccgctccgtgatctcggcgctgcctggtctccacccatcttagagttgagacaaccgaagtttagtagcggggaagtgacttgctccgaccgccgaagctgaggcgcaagcccaaatccccctg

SEQ ID NO: 104035 - DNA, 1147 bp, Homo sapiens
tccactaggccgaggaccctaaaccccgaagaaaggaaaggcctctcaccgtcctttcgccgccgccccgcgcttcctgatgagttcgtccagggagatgtccgccatcttgctccgccgagcaagccgaaagcagtcgagaccccgcgagcccgccccttcggccgctagggagcgacgaactacttccggcgtccgcggaccaactctcgcgacagccagctcaaagcaggcaagaaccggaaggggcggggacgttccccgtgagccttcgcggtgctggctgctcatctgcatacggaagttcggcacattatgaattatttattttcctcgagggaaaaaattaaatgaaaagcaacaaaatacattattaacaagtgagacaaacttcaatggaactggatcatgacctcaacagtcaactacgatagtcatcatacgcctaatgagaatagaattcattacctaggaaataaactaaaaacgtccttatgccttaaacttatgagtaaggaaaataacgattcggggtgacgcccgaatcctcactgctaatgtgagacgaatttttgagcgggtaaaggtcgccctcaaggtgacccgcctactttgcgggatgcctgggagttgcgatctgcccgaccttattcacgcctaaaaagtagactgactgtggggtggtcgtgttttttgtttcttgttggtaggtggtgaatgcgtttttttcgttgttttctccgttactcaggctgccagttgcttggcagtcttgtcgctggctgtggacgctctgcacttcatcaccgtccccagctgcgctttgagccggtctaaggttgcccacagtattgacgttgggacccacgaaactggcaatttccatgtgtgcggccttacccagttctcccaaacttctgcgtataaccgcttctctgtgcttcagaaagataagtccggccccggcctcacacagcagctcagttcgtgacagcgtttaatatgtaaaatggagcaaataatttatagggcgttgggagagttaaagagactaattcatttacgtgttaaatacagggaatggcttttgcattgatataaccccagcctccagcatgcgccagacctgacgtaggtgttcggcaca

SEQ ID NO: 104036 - DNA, 1518 bp, Homo sapiens
ggcagttagagactgtcaccctgagcagcctggggcagagcaccagcctggggacctctggatcctggaaggtacatctcagtcgtgtccctgcctcattgtgtgatcttgagcaactcaactctgggtcctctgggcctcagttgccacatctgtaaaatgggattcatattccccgccctgtccacccactgggttgttccaagggacaccccggaggccaaatggaagcaaaaggctttgcaaactgtaaagtgcagtcaggggaaccatgatgggctttgtacactggtttcaggctgcagggcctgaggccataggcttgagtcagggttgggggcagggggtcctggtgacagtttgctgggatcagcctctccattcttcagcatttaaggaattcaccgcctagggttggtcggtcagcaggttggtgaccacacagccacacgtcagcttacctggtctctcaccccacagcctgggactacggccagggcttcgtgaatgaggagatgatccgggaccaccttccacccccagaggaggagccgctggtgctgatgtgtggccccccacccatgatccagtacgcctgccttcccaacctggaccacgtgggccaccccacggagcgctgcttcgtcttctgagggccgggcacggtcacacggccacccgccccgcgcaccccacgccctgttcacgctcacccagtcacctccccacatcgcacactggggccccgggttcagcctggcctgcccgtgccctggtgaatcacctggctgagcagttcccctggagccccttcgggagcagggctgtgtcccagatgggccacggctgagccttcagagtacgtcctgcctggcacttactggtccttaccagagacgcccagccccatccctgtcctcatgacccctcgtccaccccccacacacactataaggctgagggctgccagcagccccgtctgcccaccattcccggccgtggaccatagtcgggatgtcagcagacacacatgggcagcccaaagctgcaggtgccagggcccaccccagcctcgcctgtcacccccactcccgcctcagggccaggcccaggcctcaccacctgacgctgcatgagacattgacaccagaaagccctcttgggggcactgctccctaccccagggccctggccagccgggagcttggctctcctctggctagagtgggaagagggggctggccatggggccctcccagaacctcagcatttccttccagcccatccaaacactgaggcagccttggggaaccccgagctggggggttggcagcccactgcaccgcctcagggttttggggtcctgggctggggccaccatccctgatggcagaactcccacaaccacatgtatttattcctctgtcctaaaccgtcccctccttccctcacccccagcacagggggattctgagcagtgcctcttgtctgagggacatatcagtgacctcgacgttg

SEQ ID NO: 104037 - DNA, 1049 bp, Homo sapiens
gagtgagggaggtttttagcgacagcacaaaacggaagggactgagtgtccaccaggaggagtgtggcttagtgggcctcccagagccttgactttgctgacgggttcagtgtctcccgttgggagggggccccagagacagttggtgaaatgtgagtgcatccagccctggagttggtcggccttgtacacgaggctggtggtttgctttccccggatatgtcaggtggaggctgactcctgggaggacggggtgaaggacggggtgcaggacaggtaggatttgacggctgggtggatggggctccacgggagaaggccatgtgtgggcctcagaagaagctgcagaagaggcacttgtctcccactgtgggcaagagctcgcccctgagacctggagctggggactgagggctgcgggggtgtcttgcaggtttacttcaaggacacccatcccaagtttcccgctggagggaagatgtctcagtacctggagagcatgcagattggagacaccattgagttccggggccccagtgggctgctggtctaccagggcaaaggtgattcgggtcggaatcccttggttacacggcaggctcagagaattggagagcttgggcgtgctgggtgcagggtgcaggcccctggctctgtgtggatgggtgactctcgtcaggccagctgtccctctctgggaactgagtctccctggctgtagagggggtaagttgctggcacaggggttgcagacaggccactcctgggggccacgtctcacccactgccagcctctatttggctttctcagcatctgaaacaagcaagcaagaggacagagctgagcctccgggttcccagcctctccactgctcctgcaccttcctcatggctcgcgttagaatggcagctgcctctacctcggacctcacagtgggggcaggttctccagccccctctccagcctctccagccaccacacatggcatgtttgatggccgggcctcaccccttctctctccccagggaagttcgccatccgacctgac

SEQ ID NO: 104038 - DNA, 1092 bp, Homo sapiens
ctccctctcctggccatgctgggtactggggaccccacagggagtgcaccctcaggacgctgggtttggttccagctccgactggaactgattatgtgatcgtccctggcctgagcgtaagacccacttaacaagacctcaggggttttagtctcagctccttccctggcccaatctggctcttagccagcccccctcctcctctgccactgtcccagccactgaccatgccctgggtgcccaccctgtgcagggtggaagcctggctttgggctcttggagttcctgggcagggaaggctcccactttctgccctgtgaagcccacctcagtcctggctgccccatttcccaaggggctctcaggtgcagtggcttctgcagcccctctcttgggatgcaggcctgggcacgtgcagccttgtctagctctgccccagtttgcccatccagccctcaagttcttcctgccccttcaggccactgcttgagctgatggcagagatggattcctccctccccgtcctgtctggcatcctccctttgggaccctgggttcattccctgttctggccaccttgtttgtggcccctctaggccagcaggacagacacacccagcgtgcgcctggcctcagcacctcacacgcagcgtgcatgtgtgtgcatctgtgcttggcgtcggcgtcacgtcttacaaggacaagcaggcactggggaagggtggggacacaaaggaggaatgggatgggggctccgaggcctgggagccgccctgggaggcctctgccctggggaccgttcagcagctttgggcctctctccagatcatcagccatgacacccggcgcttccgctttgccctgccgtcaccccagcacatcctgggcctccctgtcggtgagtcacgcccctgctgggcccattcggagcccggcaggctgctggggcactagatcagagagatggaagctttacatttccaccagggagagcagggaagccttcaggaggaggtgacagctgccctgggcctttgagggcgagtctgttggaatgagagtgggaaggcccagagtccctggcagtggcac

SEQ ID NO: 104039 - DNA, 1052 bp, Homo sapiens
aagaccagggaagttgactgaaggaagcaagagaaggaaggagcacaaatacattatgctcaagattaattttactctgagcttcctagtagccaaagtgaaaaaggatatgtgcttagacccacagctctttttggtcctggctcttcagaggaaatggagctttttctcatggtactgagcatagaagcccaggtaatgctcagtgacaggtgtcatgaggctggtctttatagcttctcctagtgggcaccaaaatggatgatgaagctttctggatgagggtggtggggagagggtgctcctggcagagggggcagcgtgagcagaggcctggtagtgtggacaagccggtgtgtttggggaaaggcaggctcctgcactgaccccgcgggtcctgtcgtttcagttgggccatatggtgctcttcccagtctggttcctgtacagtctgctcatgaagctgttccagcgctccacgccagccatcaccctcgagagcccggacatcaagtacccgctgcggctcatcgaccgggaggtgagtgccggccgccgccgctgcctcgtcagcatcacagcattgcccagcacctactctgtgctcagggcatggtcctgctctgaagtagatactgttgtccacccattttacagatggagaaagcaaggtgatgtctcttgctaaggccaccaggaagtagcagaggaatttaaaccctggtctctctgtccacagagccccttctctgaaccacactcactgcctcatgcaaggtcagaatggaaggaacccctcagaacttttaggttcaatcccccatttatggggtaggaatgcagggggtgagagatttgaagataaggtctcctccctcctccccctcccccagagtcattccccacagcctggtactactggacctggacacctttcacatctgtgcagattccctgggtgctctgagctgtgtgggcttcctctgccctgtttgattcttactttctttcattagtgagttcatacttttttttttttgagacagagtctt

SEQ ID NO: 104040 - DNA, 1048 bp, Homo sapiens
ctgaggtcaggagttggagaccagcctggacaacatggaaaaaccgcgtctctaccaaaaatacaaaaattagccaggtatggtagcgggcgtctgcaatcccagctactcaggatgctgaggcatgagaatcacttgaacccaggaggcagaggttgcagtgagccgagatcatgccactggactccagcctgggtgacaagagccaagactccatctcaaaaaaaaaaaattgaataaggcttgtggattagataatagtgttgtaccaatgttactttcctgtaattattctgtggttacgcaaaggaatgtccttgttcttaggagatacacactgaaatatttaggggcaaaggggcaacttactcttaaatggttcaaaatatagacacagttgacccttgaacatgggttggaactgcttgattcacttttttttttttttggaatttctgacaaatcttattttattcagatagcagtctgatcacacctggtccaacaacactcaaataataaatcaaatataatcagatgttaagactggtcttcaaacattctagccaatgatgccacgcttgcctgtgatctctctgacataaaaccacgtcgacacctcagtggccaccaaaccgttcagcaaagcttccttaactgtgagctgtttgaagctaccagtctgagcactactgactatttttttcaggctctgaatagctctagggatctcagcaggggtgggaggaaccagctcaaccgtggtgtagtaccaaaatgcggccaatcgaggcttcaagtaagtcacagcagcattcaccagtgctggggtcttctccacaaggttacggacaaatggagccatggttctgggatggaaagtccatcatcccgaatggccagctgaaggtcaccccccggaaggaccctgcgtggttcacttatttatttatttatttatttatttatttatttatttatttatttgagatggagtctcactctatcacccaggctggagtacagtggtgtgatcttggctaactgt

SEQ ID NO: 104041 - DNA, 1018 bp, Homo sapiens
aggccgaggtgggtggatcatgaggtcaggagttcaagaccagcctggccaacatggcgaaacattgtctctactaaaagtacaaaaattagccagacgtggtggtgctcacctgtaatcccagctactcgggaggctgaggcaggaaaatcacttgaacccgggaggcggaggtcacagttagccaagatcacaccactgtactccagcctgggtgatagagtgagactccatctcaaataaataaataaataaataaataaataaataaataaataaataagtgaaccacgcagggtccttccggggggtgaccttcagctggccattcgggatgatggactttccatcccagaaccatggctccatttgtccgtaaccttgtggagaagaccccagcactggtgaatgctgctgtgacttacttgaagcctcgattggccgcattttggtactacaccacggttgagctggttcctcccacccctgctgagatccctagagctattcagagcctgaaaaaaatagtcagtagtgctcagactggtagcttcaaacagctcacagttaaggaagctttgctgaacggtttggtggccactgaggtgtcgacgtggttttatgtcagagagatcacaggcaagcgtggcatcattggctagaatgtttgaagaccagtcttaacatctgattatatttgatttattatttgagtgttgttggaccaggtgtgatcagactgctatctgaataaaataagatttgtcagaaattccaaaaaaaaaaaaaagtgaatcaagcagttccaacccatgttcaagggtcaactgtgtctatattttgaaccatttaagagtaagttgcccctttgcccctaaatatttcagtgtgtatctcctaagaacaaggacattcctttgcgtaaccacagaataattacaggaaagtaacattggtacaacactattatctaatccacaagccttattcaattttttttttttgagatggagtcttg

SEQ ID NO: 104042 - DNA, 1062 bp, Homo sapiens
cagggctgacacatggtgccatagccagcggagggcgctcagtgagtgccccgggccttctagacaacaggcaggaaggatgaacctcagggcacccccaggtggtgcggaaagccaggcagttgggacagaggtgcccacgagggcagaggccggtgctaaggggatggggaagaagggacaagattcccagagaggagaggaggctgttggtaggaaagtggcagggctgggggagacccagccccaagggtccggggcggaggatgctttgttcttttctggttttggttcctctttcgcggggggtgggggaggtcaacagggactgagtggggcagaggcccagaagtgccagcctggggagccgtttgggggcagccccttctgcccaccccatccttcttcctctccagagatgccaggggggcgtgtatgctctgccccttccctcagacaggggctgggtggggaggctctttaggctcaggagaagcattttaaagaaacccccaccctgccgcccgcattataaacacaggagaataatcaatagaataaaagtgaccgactgtcacttcgggccttgtgattggtgaagtgtgttcaggctcacagcctcctccgctccattcttctgacggggaatccactgggtggactggtggtgactttgccaaggtctcacaacctgcccagcacggaagggctcgggacctggctcatagccccagtgtccctggtgatggagagcccccgcagtggggaatggggggagcctgtttttccctcctcctttttcaaggctcacaaacacggaaggttgggtcccaccagcacaactccccccatgacaagcctgaatctgtttaacataaatgggaccaaatgtggacactgaggagcccaccgccggagcagggctgagctgccacccatccagggagaggtcccagtgagggagctgtgagggcctgtggctgaaatcccgggagggacctgaagtgccttgtgggcggctccaggactgggccataggaatatctgctccccgcagggcga

SEQ ID NO: 104043 - DNA, 1046 bp, Homo sapiens
atcatcggcttcaagttcacgtttttcgtctccatcatgatctactggcacgttgtgggagagcccaaggagaaagggcagctctataacctgccagcagagatcccctgccccaccttgacaccccccaccccaccctcccacggccccactccaggcaacatcttcttcctggagacttcagaccggaccaaccccaacttcctgttcatgtgctcggtggagtcggccgccagaactcaccccgaatcccacgtgctggtcctgatgaaagggcttccgggtggcaacgcctctctgccccggcacctgggcatctcacttctgagctgcttcccgaatgtccagatgctcccgctggacctgcgggagctgttccgggacacacccctggccgactggtacgcggccgtgcaggggcgctgggagccctacctgctgcccgtgctctccgacgcctccaggatcgcactcatgtggaagttcggcggcatctacctggacacggacttcattgttctcaagaacctgcggaacctgaccaacgtgctgggcacccagtcccgctacgtcctcaacggcgcgttcctggccttcgagcgccggcacgagttcatggcgctgtgcatgcgggacttcgtggaccactacaacggctggatctggggtcaccagggcccgcagctgctcacgcgggtcttcaagaagtggtgttccatccgcagcctggccgagagccgcgcctgccgcggcgtcaccaccctgccccctgaggccttctaccccatcccctggcaggactggaagaagtactttgaggacatcaaccccgaggagctgccgcggctgctcagtgccacctatgctgtccacgtgtggaacaagaagagccagggcacgcggttcgaggccacgtccagggcactgctggcccagctgcatgcccgctactgccccacgacgcacgaggccatgaaaatgtacttgtgaggggcccgccaggtcacctccccaacctgctcctgatggggcactgggccgccctt

SEQ ID NO: 104044 - DNA, 1192 bp, Homo sapiens
gccaccatgcccggctaattttgtatttttagtagagacagggtttctccatgttggtcaggctgttctcgaattcccgacctcaagtgatctgcccaccttggcctcccaaagtgctgggattacaggcgtgagctaccgcgcctggcttttttttttttttttttgagatagagtctggctctgtcacccacgctggagtgcagtggcacaacttggctcactgcaacctccgcctccctggttcaagcgattctcctgcctcagtcacctgagtagctgggattacaggcgcacaccaccgcgcctggctaatttttgtatttttagtagagacgaggtttcaccatgttggccaggctggtctcgaactcctgatctcaagtgagccaccacgcctggcctctttgtctgtttctaaatgatgcccccaccagactgagaactcctttagggaaaggctgtgtctgattctccccttctcctgggtaccagtgcagggcctgcccctattccctgagtgtcccctgagaggtggagcgagtgaatgaatcagtgaacacatgagccccaggcctgacctgcctgtgtggccagggggacgaggcctctgagagccagcgacctgtttcactctcttcttgccatcttttgcagatggatttgcagccgctgcaagtgtgtggaagggccgtgttcgtgttggcaaagaaggtcggctgctgagccagggcgtgtctcccggaggcctgtgggctgccaggatccccacctctctgcaatgggctgcccaggctggtcagttaccagccagtgacatcagcgaggttccctgctctctaccctgggaagggcccagcctaagttaccaagccccaggctcccagtaccaccctcagcctatgtggattgccaccccaccttctgcctgtccttgggaggggaccgactcttagctccccttagcaatcaggttgcacccagtcccttgactttatgcccaggtttcctggcacctaaagtagaaacgatgcaactgcccctcgggcttgctgagggtcaaagggggtgtgactttgtcatggagcgtagaagtcagagtcgatggtgatcccgctggctgttaacatcgatacagttcaggtcagcatgcaccaagttcctccaacacaccaggtacattggctagcca

SEQ ID NO: 104045 - DNA, 1014 bp, Homo sapiens
ccacctcagcctcccaaagtgccgggattacaggcgtgagccaccgcgcccggccatgccctgcacctctcctctctcctcacttcctgcctaagatgagtcatggggaatcctggcgatgggagccatggaagggcttagagcaggggagtggccacagtaacaggctaactgggagtagctccctggtgacagggcgggaagtagtgagcctggaggcaggggcaggcagcaggggtgtgccaagcccagctgacaaggtccaggacataggctgcaactgcgaggcccgtctcgggggccaggagcatgctttgggcctgaggtcacctggatattgggctgcggccaacttggccccatacacagtttctattcctgggtcttgggctctgacaccaaatatggcgtggcctgagtctggcacccccaactgtggtccgacgacatatcctgctcctccaagtgggcccggaccccgcccacaccatggagtcagatcatgccagcactcggggcccccaagtgggcagaggctcctgctgctgctactggccctccaactgtccacccgtccgcgtggttcacatggggttaaaagtactcaggaccaaaatagcccctctccctgcagaagaaagacaggggcagggggcaccatgtcttggttcacaccacagccctgtccttgctacccgcatcccagggagctcacccggcctctgccccccacctttcgcactggcccacttggtcacacagcgatctacacactcattggttcactcttactggtcactcactcgttcactcattcattcatttactgatcattcattaattcactcattggttaactcatggaatcactgcctatttattgaccacatactaagagctggacaccgttctaccatttcagagctgaacaaaacacaaaacatacctatcctcatggggttatgttctagacagacaaccaaagcaaataagtaggatgtaccgtgtgttaga

SEQ ID NO: 104046 - DNA, 1003 bp, Homo sapiens
cccccttcccttccagaccagtgtccacataccctcccctgtgcccacacaccttcccctgtgcccgcactgtcacccaccacaagcctactccagcaggagcaccacagccttctgcggtcacgctgtgcagtcagctggcagacagggagccaggtggaccagcacatgagagcgaaacaggaagagtgtctgtcttcacctgtttgaaagtcattgtcccagatatagttacgggacccagagagccctgatcatctgtgaccatcatttgctccttccccttcaggtgggggtaggcctctacccattaagccagacactgttacctgaccttaccagaccctctcagccaccatgctctgttattcccattttacagacaaggagactgagtctcagagtcaagcacctcctcttggccacagtgagattgagcccctagccctggtgcagccccaggcaaatgaggctgggccacaggtagacagacccctttcccccagcaaagggtgtttgaaccccgctctgccgctgcccagcaggccttggtttcctctacacttacactgtagttaatcataagaggacctgccacacaggatggtgagggattgaacaagtcaaagcaggaaaccactttgaccaacggctgcacatggtcagtgctcagaaaatacacgccattgttactattaaaccacacagctccaggcctgacagtgagcttttaataaatgttaactcaacactggagaagccttctcaccccgtcagcagtgcaaacagaaacaacagtgagatcacatttgccactcaccccagtggtggagaggatggtcatgcaccccactcgccctcctatgccctgggagagcctgtggtgaggcaagtgtgccctgagcctggagtaggagtgggagagagcaggttagggctccatatctgaagatttaaattatatttctgaggccgggcgcagtggttcatgcctgtaatccca

SEQ ID NO: 104047 - DNA, 1129 bp, Homo sapiens
ctcctccgtccgggggaagcctgggcgtcgggcggtgctcgccccggagcggatgcgaccggggacggggatggagagcggccggcaggagggggctctgccgggctggcagcgtcggcgccggccttagggagggtgaggatttggacctgcccagaagcgggaagggccctccccgtgcgggaaacggcctgggtacgagctgggcacggggcgagccggttggagtcgcccggcctccgcgctcgcctcggatccgcaggcgcccctccctcctctccagctggggaaggttgaggactgagcgggagcggaactgggcttgggagaggatctgccggggcacctggtcccagcgcccatcccgtttcactgccagggcgagtccccttccctcagtttcatcacctgtcatccggagggacaagttcccacctggatagtctcggctgagcctctggccctgagtgggttaaagcgccatttcccctgcacccacctttccctcacgacaccctctctgcggcttcctcccctccgccaacgtcgagtgattgttccgcgaaggccccttggggtcacgtaccctgcactcagcaaataaccccgagcacctggtgggtctcaggccaggtctggccttcccgttcccgccaccagctgcccaaagacttcccctttgtcacctcctcccaaagaatgagggagccaccctgcccagggtcccatagcagagtgcggatggagccaggcctccctcaagatttcccacagccctcttccagcctcaaaccttctccaggacccgaaaccctgctacactgtgtttccatagctgcaaccccccaaaagagggtccccaaatcaaaggaatacaaaggaaaacaaaatagaaaggaaaagaaaggaagaggagagatggaatcctctctgtcattagttttctgtttgtttgttttttagggtctccctctgtcacccaggctggaatgctgtggcagctcactgtagtctcaaactgctaggctcaagcgatcctcccaccccagcttccctagtggctgagactgcaggcacacaccactacacccaatgttgtcattagtttttctctcaaacatttttctaa

SEQ ID NO: 104048 - DNA, 1299 bp, Homo sapiens
agataccaagtgaaatttagaagacgacgagagggtaaaactgattactatgctcggaaacgcttggtgatacaggataaaaataaatacaacacacccaagtataggatgattgttcgtgtaactgacagagatatcatttgtcagattgcttatgcccgtatagagggggatatgatagtctgcgcggcatatgcacacgaactgccaaaatacggtgtgaaggttggcccgacaaattatgctgctgcatattgtactggcctgctgctggcccgcaggcttcttgataggtttggcatggacaagatctatgacggccaagtggaggtgactggcgataaatacaatgtggaaagtactgatggtcagccaggtgccttcacctgctgtatggatgcaggtcttgccagaactaccactggcaataaagtttttggcgccctgaagggagttgtggatggaggcttgtctgtccctcacagcaccaaatgattccctggttatgattctgaaagcaaggaatttaatgcaggagtacaccagaagcacttcatgggccagaatgttgcagattacatgcgctacttaatggaagaagatgacgatgcttacaagaaacagttctctcaatacataaagaacagcgtaactccagacatgatggaggagatgtataagaaagctcatgctgctatacgagagaatccagtctatgaaaagaagcccaagaaagaagttaaaaaggagaggtggaaccttcccaaaatgccccttgctcagaagaaggatcaggtagctcaaaagaaggcaagcttcctcagagctcaggagcgggctgctgagagctaaaccaaacaattttctatgatgatttttcagatacagacaataaacttagggccagcaaaaaaaaaaaaaaaaagccaagtaattaacttgaagtcacatcatttatgagaaacaagcttgcccttaactataattggcatcgtagtcaatgtataaaccttacggagaacattatccagaaaactgggaggtataacattcatctttttttttttttttttgagatagagtctcgcactgtcgcctgggctggagtgcagtggctcaatcttggctcactgcaacctccgtctcctgggttcaagcgattctcctgcctcaacctcccaagtagctgggattacaggcacccaccaccacacccagctaattttttgtatttttagtagagacagggtttcaccatgttggccaggctgagctcgaactcctgaccttgtgattcgc

SEQ ID NO: 104049 - DNA, 1015 bp, Homo sapiens
gccaacatggtgaaaccctgtctctactaaaaatacaaaaaattagctgggtgtggtggtgggtgcctgtaatcccagctacttgggaggttgaggcaggagaatcgcttgaacccaggagacggaggttgcagtgagccaagattgagccactgcactccagcccaggcgacagtgcgagactctatctcaaaaaaaaaaaaaaaaagatgaatgttatacctcccagttttctggataatgttctccgtaaggtttatacattgactacgatgccaattatagttaagggcaagcttgtttctcataaatgatgtgacttcaagttaattacttggctttttttttttttttttgctggccctaagtttattgtctgtatctgaaaaatcatcatagaaaattgtttggtttagctctcagcagcccgctcctgagctctgaggaagcttgccttcttttgagctacctgatccttcttctgagcaaggggcattttgggaaggttccacctctcctttttaacttctttcttgggcttcttttcatagactggattctctcgtatagcagcatgagctttcttatacatctcctccatcatgtctggagttacgctgttctttatgtattgagagaactgtttcttgtaagcatcgtcatcttcttccattaagtagcgcatgtaatctgcaacattctggcccatgaagtgcttctggtgtactcctgcattaaattccttgctttcagaatcataaccagggaatcatttggtgctgtgagggacagacaagcctccatccacaactcccttcagggcgccaaaaactttattgccagtggtagttctggcaagacctgcatccatacagcaggtgaaggcacctggctgaccatcagtactttccacattgtatttatcgccagtcacctccacttggccgtcatagatcttgtccatgccaaacctatcaagaagcctgcgggccagcagcaggccagtacaatatgc

SEQ ID NO: 104050 - DNA, 1059 bp, Homo sapiens
cctcatgagggcaggagctgaatgtgtcttcttgccctttgtcttcccctagcagagtgcctgactcctcgtaggtgcttattaagtagttttaaaattcctcactgaattgatcttagttctttcatggtgccttaaaataagtccctcaaacatgtgaatatcaccttgcaggccagcacacatcccacatcttttgaaccttcctccgatgtaacttccggttccttcagtgtcctgatctctcttctctgaaaggggatcggtcatctctcttcctccaggcagagcctgggtgcagtacagatccactcatccgccatagggagagcctggtcggtttctagctgaaatccagatacactttgaacaccacgttttccttcctaaggagtagatgctagtgtcatgagatttgttcttaatgaccttcttgccagagaaggcagaagccacatttagaaattctactttctgtctattaaggatgtaatatcataccatctgctccaacagcagtttatcctctgtcccttttttgtttcgttttgttttctgccaagaaagagtaaatgtgttcttagcatttcccccacccagatcttagctcaccgaggtccctggcctctttgctcttatgggttcttgcttccctcttatattggcctttggttactggcccctctgacctcctatgatctgcatcttctgtgcaactccttatagcacggagcttggtgctcatcttatttccagtgtgcttcctgtccttactctctggagaaaacctggatgatgtctgttaaggcctctgcattctcttctgtcacccttcctttcctaagacctccctgggatctgcctctctcctctgaacttcttggactgccttaatgaggtgtgtatatctggccagactgcttttccatcctaagctatcgtgaattctggcatggcacagtccctttttttttttttttttttttttgagacagtatcccactctgtcacccaggctggagtgtagtggcatgatcatggctcactgcagtctcggcc

SEQ ID NO: 104051 - DNA, 1381 bp, Homo sapiens
gtgagacctcatctttacaaaaaatttcaaaaatattagcctagcatggtggacatgcctgtagtcccagctgcttgggaggctgaggtggaggatcacttgagcctgggaggcagaggttacagtgagattagattgcaccactgcactccagcctgggcaacagagcaagaccctctctcaaaaaaaagagaaagtttcagttaaatcagtactgttgcttggtagccgggttggtaagaaagctctaagtgaggttgcctaatgggaacttcagagaccctcactggctccaggtcactgacaggcccctgtggggcctttctgccttgtaaaggcttcagggatctttcagacttccccttcttcaaaggcttaatcaaaagagttagacccagaagccactgttgctatgaaactgttacttatggtttgaaacctgggagcagatggcatatttatatagaccacacctcctggactctttccagagagaccttggtgtattgtttatcacgacctgcagattgtctaataggaacataaatgccttctctagtcctccttggcatggtgaccaccactagtagaatgaggatactattaggtactttggcaactgaggtaaaataaacatggactctgaaagcaaatatattagttcgatgaagagctcttattgctttcaaattattcattagcccattagaacttgaacattatgaattatgaaagagttctgtttctgttaaaaataagataaaacctgtccttgtttttttttattattgagttccattatttctaggatataaacagtataattatatattgagtacaagataatgaaactagaacaatttgctcagccttataaagccagcatggccttaattagaatagacaactgtctatagctctaaatcagagcaaatgtgatattagggtgctcttatcaagggattttaaggaatgttttcaagattgggtaaagacagagtgggaggggaaaaataaaagtaaaaaagcattgagagctatacaatcaaaacattagaaagccaataaaggtttggagatgaggaaggaaagtctgtgtgtttctgagcagggactagtggccgttagtcgtcccactcaccccatccttccaaaggtcagctggagtcctggctggtggtctgtcggtcctcttagtgagttgccagtcctcctactgagttgctcctgcttagcatgagcacagagagcctctcgtggatgactggaagacagagaagccgccagccagcccacgcatggactgctgcctcacaggctcatgctggtcagggggacccaagccgatggctgtctctcttctttgacttctgaatagttc

SEQ ID NO: 104052 - DNA, 1036 bp, Homo sapiens
ggctgccagatcacctgaggtcaggaattcgagaccagcctgtccaacatggtaaaaccccatctctactaaaagtactaaattagttgggtatagtggtgtgagcctgtagtcccagctactccggaggctgaggcaggagaatcaatggaacctggaaagcagaggttacagtgagccgagattgcaccattgcactccagcctgggtgacagagcgaaactctgtctcagaataaaaaaatacataatatagtaattaactatactaatttataattaatataattatatataataataaaagagcatgaaatttgaggcttttaaaaaaacctaggtgagatattttctaataatacaatcccaaagtttacattgtaaaggttaaacagttttcaagctaagtcatttactgtatcttacaggataatttatttggctaacataaattagtaactgaatttaacattttttttcaggtgtgttttgattgtggtgccaaaaatcccagctgggcaagcataacctatggagtgttcctttgcattgattgctcagggtcccaccggtcacttggtgttcacttgagttttattcggtaagtgaatcttctctcattggggtgagattgattacattgttacatgggtgtttttttcccttttttcttttctttttttgagacagtgtcttgccttgtcgcctgtcaccttggctgcaggagtgccatcatagctcactgggctcaagtgaactcagcctctacaaaaaataaaaaatgttgtggtgtgatgatgtataactctagtcctagttactcaggaggctgaagtgggaggatcacttaagcccaggagtcaaggctgcagtgaactatgatcttgccgctgcattccagcctgggcgacagagtaagaccctgtctcttaaaaaaaaaaaaaagaaagaaagaaatgtgattttcagtgttgccatacagtattaaaaggtgaggcctttaagaattgattgagccctcattggtatgggttaat

SEQ ID NO: 104053 - DNA, 1039 bp, Homo sapiens
ggccacgctcaccgagccctgggaaggctgcccagaaaagcacgccagctgggcatggggcctcacagagcacctgggaggagcaaggcaggcagctgcccctgcagtgtggctttgtcccagctcagcaagggtatgggacagatccttgtcacgcagcctccttgtctgaggggtggcgggtcccctgctcccagcttctgaggagttggagccctacagcgcagggcggacacccggctcggcccacagccccaggctgcagagaaacaggcagaacggggttgggagggaaggtggggggtcagaagcaggctcctggtgccagtggcctcagtcactgcccaaacaccatggcaagaccacggtccccgctgagctggatgaagcaacctccactctgaggctggatcacacggccccccccgtgagagatctggcagggcctctaactgcccatcttccctctcctgccctgccctcaggggccagcttggaaacttcagcttgtctctaggcctcagtttccccaagtagaagtgatacttttccagttggagagttagagcaagaagaaaaggtggcctgggcaacatagtgagaccttgtctctacaaaaagtttaaaaattggtcgagtgtggtggtgcatgcatctagtcccaactacttgggagactgaggcaggaggattgcttgagcccaggaatttgaggctgcagtgagccatgattgcaccactgcactccagcctggacgacagagctctcgagacagtctcaaaaaaagaaaaaggccgggcacggtcgctcacacctgtaatcccagcactttgggaggccgaggcgggtggatcacgaggtcaggagatcgagacaatcctggctaacacgatgaaaccccgtctctactaaaaatacaaaaaattagctgggcgtggtgcctggcacctgtagtcccagctactcaggaggctgaggcaggagaatggcatgaacccgggaggtggagcttgcagtgagccgagatcgcgccactgc

SEQ ID NO: 104054 - DNA, 1048 bp, Homo sapiens
gcctgcccgccacagaatgcctggccctccaccctctgtgggctcaaagctcgtgaatgcggctctgtagcccaccgtcggtgtcatacctctcatggagacggctccctctttgtcttgcaggggatgagctgaccaagatggaggacgaggatgagcagggctggtgcaagggacgcttggacaacgggcaagttggcctatacccggcaaattatgtggaggcgatccagtgatgagtcggggacaggccagcggggggacggaggcggcgggcccaggagcctcagccagccacgtgggcatccactccttttcctgcaagagatgatggttccattgctcttggcttcatggtgttcctggaaggcagatgagctggtcatttcgcctgggactcggcacctttccgagtgcagctggagggatctgagcgcaggaagacgcagaacaacagaaatagccgcccctccccgcccactgtgcctgttggcctatcatagatctctatgttcttgactttgtctctcctttccgagtcaatggtgggttacactgatcttgttccactgattactctctctgacgagtccatcacctgcaacttaaatgaacaagcttacatcccattttgagtgaagattttgaggtttttaatttaaaggctgtgtacagttatacttttttatacacctgttcatttctacttaaattatggcacagattgatgcgcaccagtcttgaggaaacgatctccctattcccttaccctgttactcagccacgccgtgtgtaggcttagcctcaggtggcagatgtttgaggaaaggaattatgccaggaaggtgggaccgggttatggtcgggtttctattgggaatgctctttgtgcttttgggcatctgaatggaagctttacatagaaccttaggtagaactcccccaaatcgccatatttaaaaattattttcactctattcttgcttaaaactgtactcttttgcaaattaacaattttatcactgattcagagttaaaaagaagacta

SEQ ID NO: 104055 - DNA, 1034 bp, Homo sapiens
aagaagaaggccactgacggcgtcaccctgacgggcatcaaccagacaggcgaccagtctctgccgagtaagcccagcaggtgagtgggcgccacctccatccaaaagaggccgttccatggtgggggccctgggcaatctgcatggtccagggcagccccggcctggacacctgggaggttcctgggctcctgagctctgtgggccgtggcccagcctggacacctgggaggttcctgggctcctgagctctgtgggccgtggcccaggggcatctccagggaaggtcgtcttcctgcctggtgccagagctgctgacagatccagagagggaggcttggccctgagcttcagacctgagtggggaggagctgatgacagggctggcattcatgtccccagggatagcaccgccctgcccggacactggtggaggtgccaccctggttccctcaggcagctgaggtcctgccgaggttcatgctcactctgtattgtgtgcaggcgccagtcgagggagggacaggagaggactgccaggcatctcctttccaaattacctcttcactaggagcattggttatttctgacttagtcattggctgaaaatgagagatataagggtggcactgtggtcattagaaccttctggaaagtgtgtgctagaggaggtcttcctataggacctgcccacaggcctccatgtgacactcagtaatagtcatttcatacgggggcttcctaagaaggcttagcccaggttcccttggccttcctgcagccccaggcactgaagcccccacccaggctccccagcaggtgtggctgtcgtcattccgctgctttgcacgctgtctgggcaggtgggctcggcagtaagtgcctgtcccagggatcaggccagcacctgtatgcttgggggtgggaatgggaaagaagaaacactgcctcagaggagaccctgggggccctgggctggccagggttgctgcacaatccagccgcccccaccagtgccgtctcacaacagtctg

SEQ ID NO: 104056 - DNA, 1044 bp, Homo sapiens
acagcgtcatcgtcttgtgatttaaaagttcacaggaagggaggggctcagccctcggccccacctcccctcctttggtcagccatgaggggtgagggctggggggtgtgattgccgagggcctgccctgcctcggtgtttggagaggagattcccaaccaggatttgcagagagagacggaatgaggtagagagaggctgcactccaggaagaggacatgggcagaggggaggcaagaggcctaagctggtttcactacccaccagcctttcctggcccctgtcagttaggtggtggcatccctgttttgtgaatgaggaaaccaagatcagagaggttaagtcacgtgccatccagcaggtgagagcaggaacttctgacctcaagcccatacatatgccctttctccactgttcctcactgctatgccgtcggtgtagcaaggggaacacgtcatctacacgagagttcgtcactcagaccaagtgtcagaatcctctgggaaacccctctcactcccattgctggagccaggaatctgggcttttgaagcagcccaggtgcctccacggtgggatcaggtgaggagcctggaaccaactactgagtgggaggcacctgggctcaagaagcacaaggtccgggagaactctcgggcctttgccagaatcccagggaatcaggtgcccaaaaaggtgcctagaggaaagatggggcttctccatgttgggcgggggcgtgcctgtgtgagagaaagggagacagagatggagaggaagaggcctttcatgtttgacagccacccagaacatcaactcaggcttttgcagaacaggcccagggctcgaggttggacataagcgcctggcaggatgactgggacagtttgtagtgggttccctcctgggaccctccctgcctctttggtctggccagtgactgcaggatatgagaggtccttgtgtgcctagagctctggagaggaggccagtccctccccaccacccttcttgacgcagtttccaaaatccagcacacagcct

SEQ ID NO: 104057 - DNA, 1043 bp, Homo sapiens
tggtgaaaccccgtctctactaaaaatacaaaaatttagccaggcgtggtggcgggcacctgtaatcccagctactcgggaggctgaggcaggagaatctcttgaacctgggagacagagtttgcagtgagccaagatcacgtctctgcactccagccgggacaataagagcgaaactccatcccaaaaataaaaataaaggaaaggcatgtaatcccccaattttcctaacacgaggggcagagcaaattcagctttgggaactgaaaaaggcacagagtccctgagagaaaaatatctgaaaccctgaaaggaaaccctctgtggtctaaatggccacattgaacagccgaggtgtgagcagagcagaccccaccatggccggcgctgagtgacccgcagcttctctcccctgcacagggccccagtacgggaccgtggagaaggcctggatggccttcatgtccgaggcagagagggtgagcgagctgcacctcgaggtgaaggcctcactgatgaacgatgacttcgagaagatcaagaactggcagaaggaagcctttcacaagcagatgatgggcggcttcaaggagaccaaggaagctgaggacggctttcggaaggcacagaagccctgggccaagaagctgaaagaggtacatctgtcctgcaggcttccctgcccggccttgctctgcctggcaccccactagcagcaccacctcctgcacctaggacttcctgccactggctgtaggcacaggaggccagacctggtagagatgaagccactcctcaggctagaagcccatggtagttgacatttacccaggttgaagatgctgaatgctctatgtgcattctttaaattttttatttttattttttgagacaaagtctcactctctctcccaggctggagtgcagtggtgcaatctcagctcactgcaacctgtgcctcctgggttcaagcaattctgcctcagccctccgagtagctgggactaccggcacatgccaccacaccctgctaatttttgtat

SEQ ID NO: 104058 - DNA, 1068 bp, Homo sapiens
ctagcaggtcgcctggcacatggtaggtgctcaggaagtggaaaagtttttacagctatgattgggaagtaataacccagcacatgatggatgacatcaaagcagaaggctttggttagatgtcacctactccaggaagccagccccagcccctcagtctgcgtgaggtgcccgtttaggcatcctcagccccaccccttcctgagccagtcagcctcccttcctgacccacagcccagtttctacttggtacccaacctaaagaacattgagaagcccccgttcactgatgtgtatgatcttattaataataaaaatagagaggctcattatctaactacacggagtgcctttcaaactcttggagaggggtgtggtaaacatgaccccaggggcgcatcagggcctggttggcatggaggccatttgtgccacagccaaggacaggctgccccaagccccctgcctcccagctggttctctctcctaggtcgggaactacaagcggactgtgaagcggatcgacgatggccaccgcctgtgcagcgacctcatgaactgcctgcatgagcgggcgcgcatcgagaaggcgtatgcgcagcagctcactgagtgggcccggcgctggaggcagctcgtggagaaaggtatggggccccggcacaggtcctgtggcctggaggcagctacaccccagccgggggctctgggcacgttgtgaccctctctatgccagttttctgtcttttaagattggggcaagagtgcatttcccagttccagagcggggtgtgatttttatggggagcattagcgcccatcaccagaaggcacaggctccatgagcttttgtccactttccttggggacacaggactatagcccttgtcatccataggacacacttgcacttgccgagttaactcagaactcgggtaagttcctatcacgtggaaggccttgccgcttggcaccttagtttctaacactgagagctgtttatttttaaacttggccatgtagcaggtcagataagactagctggcaacacctggcagtctttctgag

SEQ ID NO: 104059 - DNA, 1131 bp, Homo sapiens
tagccctaccagttaggtagagtaggtcgggatgggcaagcccagagatccaaggactctgccttttatgcacatgcacccctcgcccccatcacccaccatgcacacacacagacatacacatatgtgcccagagttgattagagtctactggctttctgccacctaaaggaaatattatagaccgccctgtactgaaggcagtgattagaaacgggaagttgtgaaatagagatgacttgtttctttaccttgggaatttaaaaaccactatgttatatgtttttcatttataggtttgtctacagattttgagcgttcgaagttgacccctgactaagtatactttgctgctccctcagcctttgaaaaaatgtctgtcacatatgatgattccgttggagtagaagtgtccagcgacagcttctgggaggtaatgcacctgctttcttccagtgaatgaagtggccaggccaatagtgtctggcaggccctttggtttttttggtggaggttgggaactgaggtgaacatacccccaaaccagccatgcatttgtagtcagacctagatagcagcagaaaaggtttggacacttgtttttaggcagttcaggtatgccttagccatcatcgaaggcagtgaacttaccttgctaggaaaggctgatacttaaagaggttaggggtgtttatgaaaggtcttggggatcaccttcctttttatgtttgccatggtgtgagtgggagagacagacactaattgctcagcttatcctacgaggcactttactgttgagttttatgtagaaacaaggagggctgtgatttgacatcatgctggacaacacaggcaagtggccagagggccaaatgccttcaaacttgctggagcatctgccgccagtctgtacccatgagtggccctcttcctgattggattatttttgtttttttgtggaggcggagggtgttgttcctgagtcccacttacttttccttcctgctagttaatggaaagtccatcttttttttttttttttttttaacagttgaggtctcgagagcgcaggctggagttcagtggcaccatcatggctcactgaagccttgatctcctgggctcaagcca

SEQ ID NO: 104060 - DNA, 1025 bp, Homo sapiens
tagtaggatgtcagccccaggagggcagggacccagtctgccttgtccactgcccctcccccagcttagaagagtgcctggcacatggtagatgttcacatggtaaatatgtcccttatcaaagggccctctcaccttgggcccaaacattggcttagaataaatcgttatttcccaaccactgaagaatctccccccagatagtgaagaggaaacgagctgcaggtcagcctgtgctcagtgcaaggcctgtggagcggccagaacccagccagccaggtgtgctcgggccgtggcagcgaggatgtccacctctgcctacctctgcagttagaggattagagcggggtatcgggggctttctcccgaggccagctttcaggagagatgagcaacatggtctttttactcagaatgttcttgctttatgaaaatagccttttggcctaaaaaatgacctgttcttttgtctggttgtggaataaattaagggtgttaagggggagctggatgtccttgtgaatacatcatttgtttacctgatatctgttatcaagcccaaaggggaggaaggaggttatgccagcttccagcctgtgccacggtcaccttagcaacctctgttaacctctgagactctgcacaccatctaaggaatggctctgactcactgtacttacatacattgctggcagaagtcactggaatctgagatctggaactgttttcaatacctcagtcattcccggattcccagattcctgagaagtgccccttagaacaaaagggttgggtggctcacacctgtaatcccagcactttgggaggctgaggcaggtggatcacctgagttcaggagttcgagaccagcctggccaacatggcgaaaccccgtctctactaaaaatacaaaaattagcctggcatggtggtgagcgcctgtaatcccagctactcgggaggctgaggcaggagaatcgcctgaacccgggagacggaggttgcagtgagctgagatcgcgcca

SEQ ID NO: 104061 - DNA, 1060 bp, Homo sapiens
tctagacatctaacagaccacccttggttctttggtcccctcaaacatgaacatgggtgtgttctgttgctcttatttattttgtcatttatttttggacttgaattgaggcttccactttgggcaggtctcttgttttgagaatctgcagtccagagaaaaacaatgctgggcttggcagtcactggtgaagtcggctttgcccgccctccaggcatgcaggattattcagagaggtacctttctacatctcattgctttgagaaatatatatttcttaaagagttgttcaggatttaaggaaagttggggaggtatatggaaccatagagatagtttgtttccaatttcttaaagtcttagacctcaacttttcagggataacaaggttttcctctgacacataaagataataatagactaggttctgaatatgtgctttggacttaattatgggaacttggctttgccaggtgttttcaaattctactgtaaatataaatgctgattcaatgatacagcaactcttgatacttgagaatttaaagtgctgcgtaactgattggacatttcgtctcctaacacagttggttcctctgattcagagaggacccctttttgaagatcaaaagcaaaataaaagtgtggaaagtgtggacttctagtggcatgtggacaggggggtgtcctgggggctgcccaggaggctccaggtgggaagtgcttctgacttagtggctctacaagctggccattgtggaagaattggctttttccttttttttttttttagaattgactttgtaagaatcatcaaaaaattgttttgctctcagctcaataaacatttgtagttaataatccgagtaactaatcttttttctctcctgtgtaatccaagatatgtcagtatatggtcttcgtgagtaaaattgataccaatagtacattatcctaaaggtcttatttgatatccttttatcaagtcaacactttactgtcccaccatttcacttgtaaagatccccaagtgtgtcgctgtcagtttcaacaaatgtta

SEQ ID NO: 104062 - DNA, 1064 bp, Homo sapiens
tccaagctattttttctttgagtttatttgcttggggcatgttccccagagtgggacttaagggtcagaggttggtaactgttatctgccttgttctgtattttcagatttttccatgaagcctattagcaatgttagagtacatttctgttttcctgtagccccaccaaaactggcattgtcatattaattttccttattttacaagttatttccatattttaaaggaagttgtgcttttttttcctgcatgggaatttgttgtattatatttagctaggttacattgcagtaacaagcaaaccccaagtctcagagacttagcctaacacaaatgtctttctcgcttgatctgtgtgtcccttgtaggatggctgggggtgcggttccacagagtccctcaggccaggctgattaaggagacagcactctctgagagctgccactcgaggcctgctcagtggacaacacagtagacaggagaggctgggggctttgtgtggacttttcactactgatgtggccaggactaccaacacagtctggcttagcaggtagaacttagtgagcattcctgtctctgcccagccatctcctcttctgtttgttcctctccagcaacttctttgtccagtggaattggatcctctgtcttcatatcagctcttaatgtattttaggtaataagatttttatcaattgtgtctttttctttctttgctttctatattgtattgtgcaaaagtttaacgtaagttttggacacattcatgttttcctctgataccttattatcacaaatttcttttctcaaagccagagaataagctgcttttctttgagttgcttaaaatggattttatttggctccttatgacacttgaaattcatcaaaatatataatgtcaggtggttttaatctaagttaattaggtccttggtgatgcctgttctgcaacattaaaacaaaacaaaagaaagaaaaaacacccaaccccaagcaacacctcttcatgacagaaacactcagcaaaccaggaacagaagggaacttgactggataa

SEQ ID NO: 104063 - DNA, 1002 bp, Homo sapiens
cccctcagttcttctcatttctcatcccagctggaccctgtgccctcgtccccctctgagggctgtcactagacactgtttatatttttgtcgggtaacaaaatgtaaaagtcttattgttttaataactgagcagccttatgtacgtattcaattgtttcttagaagtcatattctggaatttttgaaaaacagtggctcccctttattgctgtggtgctgtaattctaattagatttttaaaatcctgatacttaagtgacccatcactcagtgaattatacttactggattactgattgccattaaaaaggcagcatcctctctccgtcctccagaaaatactgtgctggtgcagcctgtgcctcacagaaaaacatgctttcttgttaggatgttacctactgtgaagtgtgtgtttcaaatacttttaagattgcataggaaaggtttctagaaacccccaaggtatatagtatgtctgtccgaccttaatcgggcccatcagttttgtctttgctcttgtagctctgaatatctctttcttcagatcccttccttcttgtcagtaaaacatcctactgaattctgcatgaattttaaatgctgtatttatgaaaacagcaaagaggtttcataacttcaaaccaaagcatttttacaggtatgagatttatgccaataagtaaaaatacgccttccttttttctttttaaacagtgttagtcctttgagacccgtttgcccacccacacaattctgttattcatttggtggcataatgcagaaggtgggaacgcaatatttagagctgtaatggctcttggacttaatattccaggatcctcactttaccaaaggaattgggatccagaggtgacgacttgtccaaggtcactcgtctcgttggtagccgagtgagtctgaaaccctggtcatgagactcattactctttccattacagtaatctgctttcttcgcattattatcttaagatgaat

SEQ ID NO: 104064 - DNA, 1029 bp, Homo sapiens
tatttccatgtaatcacagttgcgtatttgagtgtcctagttcttaggagacagtcgtgctgctgagagaccatggggtcacctgcctgtctccaggggactctgtgtccccagtcctgtctcctgcatgaggcttcctgttcatctgctgacaggcattgccttgttgtgtgtagtcacagaaggaagttgacttccacatgtagggacagtgtaagattatcctgtgcaagcaagtccctgtcccactgactgctgtgacgcccctcagatgcagagagagcatgctgtcttttttctcttgtaagcaggaggatcccaaatacaagaagatattagaagactcatgtatggtgtaagttagtttgtatataatttgattttttgtgtgttggggagggggtagtatgaattttgttctcagacctcttctccctgattttccgtggaaatactgaaatttctctttggccactttctgaaaagagagctcttctgtgatggccacagcaggcaggagcgtgcagtctgggaacctgggactgtacagcgaatgcagcagtgtatgggaatgaccttatctcggcagccaacaggaaatgatgaaatgtgctgggagaattcagctgagagacagaggtcagacatgccagcagggttggaaagaggcaggtacggaagctgagctgcagagttagccggcatctgacagaaaaatgtgagtgtgctgtggaaggcttgcatttcctttaaggtagacctctttgaaagtagaattttcacggaattgttttctttctcactgagtgactgatttaacagaactctcaccttctatgcaagcgcacctagttttagagctccgtgacggcaatgttcaattagttcattattaactgagcaatgcagaatgctttatccagggtgcttggagaagatgtcagagtaagtgtttgattttcttggagaatagatttcggcttaaacaaatgaaggattgtgttttgtaatttttgactctggttttag

SEQ ID NO: 104065 - DNA, 1639 bp, Homo sapiens
ttagccgggtgtggtggtgcgcacctgtagtcccagctacttgggacgctgaggcaggagaatcgcttgaacccgggaggcggaggttgcagtgagccgagattgcaccactgcactccagcctgggtgacagagtgagactcctgtctcaaaaaaaaaaaaaaaaaagaatgaatgtgcccgtcttctgaacatggtgccatgggtgtgtgtgtgtgtgtgtgtgtgtgtgtgtgtgtgtgtgtgtgttgctcctggactcagggtggggtgtctcaaaccacatgctgggtggccagtgaggtccctcgggcagagccacctgcgtgtaggggtgtcatcttatctaggggctggagatgaaatttttatctgtgggaagctaagcagcccatataataacagtgatgatcagtgttggggtacccaaggttagtgctgttatcacttttttacacataaatgaaatggaggctcagagagatagttaaaatatttgttcagggacacatgggtggtaagtgacagagtcagggtttgaacccaggtcagtcttggtgttttgtgtatagattcagacacaccccccagcaagtcatcaaaaatgtcttctcattgactacacatcaagggtgggtggagtggactctacaggctgtctgaggggtgttagttagggaaggcgtcagtgggaatggagtatctatgtatgtgtgcgtgtaggtatgtgtgatttacatccaataaactttactcaagaaggggatcttaggggctttattatataggcagtggctatcaaaggcttttaagcagaagagaaaggtgagaccacatctaggtttcgggaaggtttttttagaatgggtagaaaaggatagagattagatctagagagacaagtgttgatgcagtagctgctgccccttcttagggtctttgcacgtggggttcccacttcctggaatgttctttgtcttcaggtcatagcacaaaagccccctctcagtggtcactgatgttgctctctgccctgaagtagccctctgctgtgtctgaagtcattgtgttcccatgtggattttagtgtgtatcttcaccccccattagagtgtcactgtcatgcatgtgcactcagcagcgtgcagggccccaaaaggcctccgtgaactgtggaggaatgagcccctgaagtggcgggtggtgagatcgagcctgtctgctggttgccatgctgggaaggggttgtggagggagaggggaaccaaggtcatttcttttaggcgtttgatttcgtttggccggatgaatgctgcccttgattgatactcacgagtgttttctttgggggccgctgcgcttttccaaacagccagggtgcttaccagactcgctgaccacactgcagcccagcgtcgtggctgacgcagtggcacggttttgcttagcttgaattgcttttccttttctgttggtcaagttctcttttgttagtgatcatttacctcttttaaatctcctagcatagttcctggtcttccttttcttgtttttcccttgcctaatgcttactgtttctgtgttaattctggggaaagggaaatcaccttgagggtgcttggctaaaactacagagcaa

SEQ ID NO: 104066 - DNA, 1930 bp, Homo sapiens
ttaaatattttctcaagtattttccatgttttaccttcatcttcaaaaagattattaatggttatattatcctgttgacgtaatgagattaaaacattccctagtgctggacattttaggttatttccacttttttgctaatgtagatgaatttgcagtttataatttcatcctttttcatctgtgtaattagttcctggggataaattcccgagaatagaaatcttgtattaaagggtatgaacaccttaagagtgttttgaaagcctgtcttgctgcttgtaagtgtatttttctgattttttgggtgaaaaaatggggattctttctctttaaagtgcctgccttggcctttagaacttccaagtatctgtgagataagaaagttctgtgagggtttcttaaatgagtcacatttccttcctaagtttctggatatcattttacttgaattggttgccatactttgatgagcaaggaacgctgttttagaaaatccttactacttgatgattaatccttggagctaatgttccacgttcccaaggttgtgagtgcttatggccacattcctgcatcagctcagccatcgcggtaggtatctcacagaccttctctagctttcttttcctcacttaagggatgcatattggaaagactctgcagggttctttctgccaggcagcctgggggtcgtgtggtcctttagagttcatctctagcttctagatgctgctctcatgggggttcctggctctgttcatctccagagacaagcatctcaaagggaacctgggaagtttatagcactggtgcttgcttgccttgtttgcttgtttgtttttctgttctggtctgctgtggaacttgtcaccatgtcccctccccatggactgactttcctaccctccactgtcccttaggtattcactctcagactgagtggtgtcctgttttcctggtggctcatttgccagggtctgcaaaggacaaggtgcttagcagggacagagaggggctccaggtggggagcagtggtcaggccagctgaccttagtgcttacccctgggtcccctccctagaattcctgcgatgcctccaccatgtctaccctctccccacaggggctgtttcccttttagttctcttgccttactgtgggcaaaagcttacttttcttggttcctcttatcccagctaagaaaagctgatgttcacaacaaaatgaagagacttgactacccaggaaggtagacataagaggaaacagccacaaacagcacaggcatacaagtgtcttgcttcccaagcacaggcaggtttttgtgcccacacttcagggctcgtctgactgcactggctctgccaggcgctgcccagcttcctgcttcccctcccagtcctgcttcttctgtcagtaaaacaaaattttagagtgatgctttgcttgatgctttgggggctgcatttttatcacaagtgtggaaattgtactttgctctggtttctacagatgcctaaacatgtctaggttgctgttgccttggcaactggctgagctgttggttgtgtgtgtggtgaaggttctggcaggggcttcatggaagcctctggtcatccttagagcttttcagctaagctggcggttactcccaagcccagaaccatatgctcttagctcccctttgtcgtttggagcttcccattttatttccctgagaaatccctgctcagctgccctagacttgggtgggtggtatggcatggcatggcatgcactgatagggctgatttatttcgagactggatttttggtaacacaagacgtgattccatagcagcccttggcctaagttttatttgaggtcggacggggcccaagggctgcttgtgctctcccttcaagtgccttctgctttttaggcctgg

SEQ ID NO: 104067 - DNA, 1182 bp, Homo sapiens
gcagtgatagttaaggctttagaattataggaagtttctccttgttttccacacagtaccattgcccttttacttttagattaatgtttaagtaataactttgtaattaaaataagtataaataaaaagagcttggttgtctaggcatttgcattttaccaagaagctttccatagccctcattttgttttcaggacagccttgttgatttgtttcccttttcattgtttagaggagaaagagagtcagagctaaaggggtgagtggttttgcctgaggccacctgccaggaccccatatgggcctctgagcccaagcccagagcgcccagggaggcctgtgacggggcctctgcctggacctgcagggtggtctttagataggatcaactgtgtattctgaagtttcctattgaatgaaatgaaatcttcttaatgtaaagtgatacccaaaccgtagtttgtgagcattttcatgttttaaactgcatttgtctttcattatattaaattatgttgtcgccaaccgagcgtgccaagatcatgaattgtggtcttcagaggaaccacagagcaggcagtgctccctgtacagacgtccaagcccgctattagtgggttctgtagctgtctgattggctggagctggctgcctgctcgccacttagctcgcacgtggtgatgctttaattaagcaattgcgacctttgctcctgcaaatgtgtcatcagataaggagactgggcatgtgccaccaaggaggatgtgcgtggggggtgcagagtcagtggtgaggggctgtctgcacaggcccccatgttctgaagtttctgagggaccattcaagaagctttacattcctgcccatttaattcttgcaaccagatagtgttctctccacttgatccatcagtaaacctaagctcagagagattcagtggccttcagagggtcaccatcagagctggtgctctgcctaccgaagcccacactcatttcacctcctctggctggctggaataagtaagttgtgaatcactctcagatgtgaacatctttaaaagataattaatctttctcccccacctctgagaaacatagacatgagggagattatgtgtgtcctttgcttaagacggcatctatgtctgtaactaacttggtttcaataatctgaaagttt

SEQ ID NO: 104068 - DNA, 1030 bp, Homo sapiens
ctcctgagtaactgggactacaggcatccaccaccacgcctggctaatttttgtatttatagtagagacgggatttcaccgtgttggccagtatggtctcgatttcctgaccttgtgatccacctgccttggcctcccaaagtgctgggattacaggcacctgccaccttgcctggctagtttttgtatttttaatagagatggggttttaccatgttggccaggctgatctggaactcctgacctcaggtgatctgcccacctcagcttcccaaagtgctgggattacaggcgcctgccaccttgcctggttagtttttgtatttttaatagagatggggtttcacagtgttggccaggctgatctggaactcctgacctccagtgatctgcccgcctcggcctcgcagatgtccttgccttttgtttcttctctataccttgaaagtctgtgctgtgttaagggcgtcatgctcaggcttactgattctgaaggggttatcagtggatgattccggatgttgtggaatatcaaacagatcgaaaagtttctttaataatagtgatggcaccttgtgtttagagttcgcagtggcatttaccagatgctctctggccaccttcatgtgaacctcccagctgactcgggcctgctttatctgccatcagattgtaatggcagctttgtggaggccgccctgtagattatgcgattaatgaccacattcatgtgagcaatagtgctggcttagtttttttccagttaggttgtttggaatggtagctgcatacctgagggcagtgcagcaatgccttagttacgaaggcagtttgcattccacaggtagagtctttccttatggccagggcactgatccctcacataccagaaagtatcattcgtccctgccccagacagactccagatgcgtcccagtggtggttcttgggatagttttgtaggaatttctgcagaattttagtgttcagatgagtatgctctgtctgtggactggagacaggcttcaaa

SEQ ID NO: 104069 - DNA, 1108 bp, Homo sapiens
aatactgcctggctgtcttgatgaaaatcaggaaaccagctcaaagagtttgaacctcagctgcagatggtgagctcacaccttcttccttccctccttttcggtgccttcctctgcggttattcccgtgtgctgaagttctgttttaaccctcctgggattgccaggttggagcccagggcaagggaaccgaccaggcaggcagtgttgaatgccagccctcctgttcttgcccaagatgttgtcgttccacttgattcatgagcctgcctgcatgcagcctcctcatggagacattgaagctgtgccagtgcaacttggatctctcttgattcacctggaaaactttcacttgtgtggacttaaacttaattctagagtttggtagcctctttggtgaggttatgctggttgagatatgaggccactacatcaaaaacattggtgtgtttttcttttgacaatagacttaaagctttaaagaaagtggccattaggctggtgatatttattacttgggaaagtaacataacacagagaagtagatgggtgattaggtctgcactctttatccactttttgggagaagaataacaactcatttgaatggaaatggtatccttagctcgtgctgctttgggacttggaactttatcacttttaatctcaaatgtatatgaagttgtgatgtgatatttaaataatctaggctgggcggggtggctcacgcctgggatcccagcacttgggaaggccgaggcgggcagatcacctgaggtcagaacttagagaccagcctggctaacatggtgaaaccccgtctctactaaagatacaaaaattaaggccgggcgtggtggctcacgcctgtaatctccagcactttgggaggcagaggcgggcggatcaccagaggtcgggagttcgagaccagcttgaccaacatggagaaaccccatgtctactaaaaatacaaaattagctgggtgtggtggtgctcatacctgtaatcccagctacttgggaggctgaggaaggagaattgcttgaacccaggaggcggaggttgcggtgagccaagatccggccgttgcactccagcctaggc

SEQ ID NO: 104070 - DNA, 1040 bp, Homo sapiens
gtcccagctactcgggaggctgaggcaggagaattgcttgaacccaggaggcagaggttgcagtgagccaagattgtgccactgccctccagcctccagcaagactcagtatccaaaaacaaagaaagaaagaaagggcccttatgaatcatcttcaagttcctcccttccaagaacagagatgctaggcgacttgcccagaggcacacagccagcatgtagcaggattcatgcctgtgggagctggggttgggggatattgacggctttagcggatcaaaagagctggtgagtagggctatacaatctgggggtcatcctgtgagagagcccccagactgctcagttcttaggggtccagtcatatgctgtctttttgccccagaggagaaatgtctgaagtaagacccctctccagagacatcttgatggagaccctcctgtatgagcagctcctggaacccccgaccatggaggttcttggcatgactgactctgaagaggacctggaccctatggaggacttcgattctttggaatgcatggagggcaggtaggtccccatggcctgccctaccccctgcctgatagtgacttcaggggtgggctggatgagcagacattctatgagcgggggagcgcctgcagatgcctcccaggcagggcctccgagaggaagatttcccggatgtgggcatggaggcttctgccctgggagcggcttcactttgctgccccaccctcccctgataccagctcacagacccctggacagccagcatgttcacagtctcaagatggacctggggcccctggctgtcaaaatggcacagtgtttgggcctcagggagctagacaggcccttagcgacctgctgaggacatcagggcctcttgaaggaggtgactctgttgccagaaaggggacccgatccagatcccaagagagggttcttagatctcaagcaagaaagaatttgggccacacgcagtggctcgcgcctgtaatcccagcacttagggaggctgaggcaggcggat

SEQ ID NO: 104071 - DNA, 1022 bp, Homo sapiens
agcagcggcagcagcagcgccagcagcagcagcagcgccagcagcacctgttcgcaggacacctgtgggagcaaagcagaggagtcaggctcggggcaggccccggcaatggggccagacgggtgacagcggagtgccaaggggaagcccaggagggtggggactgggaaggagctcgaggggaccagagaaggaaggagttcaggagagggggaaagtggccctgaggacgtggccagagaggccagcgtggcctgggcctgccagtctgcgggacacaggcaaagacacccggtgggcacaggtgagggcagtcagctgcccttgtggtgggcggtgccgagtggacaccatgggaccaggctaccaggaaggctgctcagggaggcccctgccctggccaggagacgggagtcctgcctgccaggtgaaggctctcggaccagagggagacccaggaccatgcactggtttgtgcactcagaaccaggcatctcaaacccaaaagcccatgggatcaggcagatgtggacacaggtgacacagatgatgatacggagtggtggggactgtggcgccccaaggagcggctctgacagcccccactggccgcagcgcaagtcagggtcagggatctcaaggctcttacccaggacccggggttcggggatctccagaacctcattatgttctccttaagtgtggtgaaaccgtccatgaaacttctaagaacatccctgatgtcctcagtctggtcgtagatgaaagccagacccaggctatagacaaagaggatggggggacaaagccattactgcaggagcaggtaggggcagcctgtacttagatgacaccatcacagctgtggggagcaggggcctgtgccctcccaccccacagccacccggggccctttccgtgggcgcctccacctgcaggggccgcgtggtatggactgtttgtggtcaaattcattccaacttcctgcttcctccgccagccagccgcccgccagcccaccg

SEQ ID NO: 104072 - DNA, 1030 bp, Homo sapiens
caagggaatccagagccctgggttggcgtcagtgtgaccatggacggagttgatggactgtaactaaccaggaaagctcctcctaaataaaggggcaggactcaatgattgtcaaggtcacttttgtgtgtcctcttccagctggtgcaccaagttcgtagaacctggctcactgagatgctgaacaccccgccagctctcaggtacagagccctggaactgggatccccaggagagtgagggctcacgttctgcatctgtccccacaggtgattgagaactgtgttgctgctgctggattcagtgtgggagagtttgcagccctagtgtttgccggagccatggaatttgctgaaggtacaggaaggagtttggttttatgcaaggctgtggtcttgggctcattaggggtaagggacactgccaaaaatgatactggacccactcaggtgatgggaagggagcacatggacaggggtgacattggcacatgaggacagggctttgctgtgattccttttcaagactgaaggattcattagggatttcccttatttttgtaatctcatgaaatctgcttgctgaactgtctaacccgctatcctgtgcactcatacctgcagcacctgcaacacgagagtatgtgttcagtagatattcgttgaattaaagagtaaataaatattggatctggagccatatcagttttacttcttaagatttttgctggccaggaaccatggcttacgtctgtaatcccagtgctttgggaggccaaggcaggaggaccacttgaggccaggagttccagaccatcttgggccacatagtgagaccttcatctctgcccccaacaaaaaacaaaaattacgttgggtgcagtgattcacacctgtaatgccagcactttgggaggcagaggcagatagatgtttgagcccaggagttttagaccaccctgggcaacatggtgaaaaccccatctctaccgaaaatacaaaaattagccaggcatgttggtgtgcgcctg

SEQ ID NO: 104073 - DNA, 1044 bp, Homo sapiens
agagtgagactctgtctcaaaaaaaaaaaagaagaagctgttatgtagaggggccagtgaccctgcccacacagtaccaggcttcgtgtgggttttcctacacagtggcccccaaacccacccctgcaaccccttctgctttaatagcttccctcaccggaggagtcagtagaggggaggctccagggtgtgggctgcttacagctagagagacatggccttttgtctcccctggccccgcctatagacactgacccagtgtcatatgtgatgccccacgtcctccaagggtcggatccagggatcagggacacatgctgtggccacacttacccagcccatttgtcgggcaccaaagaagatggggggccatgcccagttcagggccagctgcccagtgtagaggcccaggggaaccacagccttctctgtgaagcctcccagctctttccagaccaggtaggagccgtacctgaaacagaggccgcagttcagagcaccattaggaacaaggccaggagcgttgcccacctccgagtggcacagtgatggttcatacgtgacctgacactgactgctgtgtgatctcagggaagttgcttgacctgtctgggccttcatttttcatagggttgctgtagagattctagttagcacattggcagtgcttcatgcgatacccagcatttaggacactcagtaaatacctgccattattatcactgtcactgctatgaaagggaagcacatggtgtgaataggtagagaggaggctcttaacctagccagggcactgcatagaggatgggacatttggcctgggccttaaatgatgaataggagttttccaggggaggaaacaggacatgcaaaggctttgaggcagatgtgagaccctgagtcagtctgtgactgcagggtgaggtccagggggaggcctgatcatgggagctgttaacacagggcaacgataacaccaccagtaacagcagccgatgccctccagcactcacaggagccaggccctaccacttcccaagcatt

SEQ ID NO: 104074 - DNA, 1082 bp, Homo sapiens
acccattccagctcacccagaaccttcaccagcaaacctcctgctgaggtcctggcaggaggccaccgtcttgttaccgtttccttttcgtttgctgagggtcacagaccccaacagggaaatcagtatctgtcttcccagtggttgccctgctcgccgggcactccacggggtcccgcccttgtgtgagatgggccaggatccttcggcaaggggcgcctggggctggggctgattgtgggcggtggagcgccagacagaaaaggattccaatgagaacttcaggttaaagtcagatgccacctaccagggtctacagtcaaaatgttggctttttcttattttttaatgtatgggagaaaaatgtaaaattccagttcttttctaattgtgtttctgaaattaggagtcagctgccagcgtttttgtgtggctgcagtgtgcctgggcccagctcacgggcagtgggtggacctaactgcccaggcaggcgagagctacttccagagccttccagtgcatgggagggcagggctaggtgtagcggtgtctcctctttgaaattaagaactatctttcttgtagcaaagctgcacctgatgatgctgcctctcctctctgtgttgtctgggcccttgtttacaagcacgcgttacccttcctgaggggagccatgctctagcccctggagggcctgttgcaggggcagggcgggcccgtcgcctttggcagctcctggagagctgtggacatgcagtccccctcagttcgtgctgcaataaaggccatcttctcttatttctgccctcctttctctttggaccctggagccacaggctcagcctggcctgtcgccccggctgtcactgaaaagccccggataccaagaagtcacccacaaaaagtgggagaagaaataagatggcctttatatcgcaggcctccaccccacagtctgatttccatgtgctggatctgtttccaagccggccgggagcctcggtcctcgagtggccccacagctctagtggccctggagatagcagcctccccacacttgcctccttgtcctggggtgggga

SEQ ID NO: 104075 - DNA, 1037 bp, Homo sapiens
taggaataggccatggaaatgctggcagtgagtgggtaaagggccccctgggcagaagcgttggccaccactggtccccatcccacccctgtcctctgggcaccaaggggtcctgttaccaaccttgcatgtcatggggctgctccgcttacctggatacgatgctcatccagtcctggaaaccgacactagccaggcctgtgcatgccagccctccccacagcagggagcctttgctggccaggaacatgctgggcacccacaacaggcacccgggctgccagtaggggcccctcccaggaggctgcaggtgtggctgttgagttaaggaaagccaggccggcaggtccaggcgggacaccttgcagaagcaggcacaggtgaggacccagagatgcagagcagattccacctcagccttcacaggagcccctccctgaggctcccagacactccccttggctgcccaaacctggtctagccaagaacaggcaggctgctccactctgccccctccaccgggcctgagggctttcctccctgctggcctctgccccagctgggcagcccaggggctcttgctgagacgtgagtcttgtggtgacctggccagggcctaaggtccctccacctcctctggggcagaggcctcacggaggcccttggtgtgcctgtctgagattggtggccccagcctcatcctcttgttttgcatgtgagaggaaagaactagcacataataaacacccaaattatgccatttaattttaatgacaaatgtgaggtggacggtgtggtccagtcctgcggatggggaaccaggggtcacaagggtacaggttgcgcccctccctcagcagattggagggagcggggtctgaacccgggctgtccagcatcatgactcgaacccaggacttgcctctgcctcattagcttcaaaacagggaagggagtccctgagccagggctagtgctggagtcccgcttggacacttgggagccgggatcacccagctcgggctctccccacaggg

SEQ ID NO: 104076 - DNA, 1142 bp, Homo sapiens
taaattctagcccttctctatcagctgtgtgacctttggccagtcactttacctctccatgccttagtttcctcacttgaaaaatggaaggcatagtccctatctggtagggctcttgtgaggattaaatgagatcatggacgtggagcatgtagcagagtgtctggcaccaaatattcaacatgtaaccagcattcatctggtcactggcttccagatgagatgtgttgatgtggagtggtttgatgcctccaagacctcgtggggaccagtccccaccatgtgcgctcccacggctgtgcctgacacgtggaactctccttccagccactgtactcttacctgtgcagaaccacctgtttgtaaataccctgttcttggctacagcaagtactcccagtgtccccagagcctgacgccagcagcctgcagactagcagtgagtctgtgtgggcctttgtctcaacaacattgttttcacaatggattatgtttacactgattaatttaaaagaactgggtaaggttccccccctcccccgccccaccacctctgagcacagattgcaacctcacgcggctctaacttgcacacacagcagccaagaaaaggctctctctgttgctcctctgcctttagctgagggcagacccttcccaacagagttctttctgttcaggctttctctttctcaagacaaaactccagctctagagaagccggaccttggttccaacaggcaccaacccatcctgaccatgtgacctcaagctagttaaccgacttcttggagtctcagctccctcatccatgaaatgctgtaagaactggagtacctcgtactctaggatcatggggcttaatcagtgttggcagaaataaatcatgctgtaagagtcagctgggcttggagtttgaagatttaggctcaaattcaggtgtcaccgctcatgagttttatagttcgggacctgttcctctagcccaccaagcttcagttcccctaactgtgaaatgggtcagtaatacttgtctcggagggtcggtgtcatgattaaatctgaaaggagattgtgcagagcttgtgtacagatgtaaattctgtgcaggtgctggatattgtcatcactttccagcaaag

SEQ ID NO: 104077 - DNA, 1045 bp, Homo sapiens
gtgaagatgatgataagggtgttggtgatgatgttgatcatgatagtgatgatgatgacattagtgatgattatggtggtagtagtggtgaaaaatagtgatgatcacgataagggtggtggtgatgatgatgttgatagtgatgatggtggtacagtggtggtggtgatggtgacgaggatggtggtgaagatgatgtcgatgatgatgactcactgcgtgcttcttatgtgccaggcactgggccgagcacagtacatagataattatctcatataatcctcacagcaggcttggaagtggcatgtatcattatcatctccattttacagatgaagggactgacctcgagagtttaccagcttgccccaaacacattcagcccacaggggctgagtgccctatgactgccacacccccctggccaccctcactactctggctgctggcctgatgggcatgtgcttactttccagggtatggtgtcatggcagatgggacgaccacctatgtgaatgcgtccgtatgcactgtgaactaccagcccgtgaacccgcccatagtcatcgacctccccacaccccggaactcctgactgctccccactgcccctgccctgcccgcccgtgtcagctccacaggcctggcccggccactgttccttccatgctgagttgcctggacgacccatctggctgcggggactggcctagcaggcaggtcagggccttggaacgactctttagccttctgtcacctggagttgggaccctgcgcatccccatcaggggttctgtgctcatttactttttctgcgtgtacatcctgcgtgtacctcgttaaaggacctactaagctcatggccctgtcatgtttgggaaatgactaaatcttcattcttctcccttggacgccctcctggtttgggaagctgctgctcttgaatgggttttggaagttacacaaaatctccctctaaccacgggtctgtgtggcggcatgcccctgggttggggtgggtgggaggattcgtgagctgcacaca

SEQ ID NO: 104078 - DNA, 1065 bp, Homo sapiens
ggagtgaggcctgaactcacgcatttccagctctgccaggcggggctgattccgctggcccacagggcatgctccgagtggtgagggatggaagacgagctcctcatggatggtgcaggcattttccaaaccctgagcatcagcacaccttactggctactgagaagtgctttctgtttttgtttttgttttaagatacgacaccgagggaaaagggcacattacttaccaggaatttttacagaaattgggtattaactattcgcctgctgtccatcggccctgtgcagaggattatttcaacttcatgggtcattttacaaagccacagcagctacaggaagagatgaaggagctgcagcagagcacagagaaggctgtggcagccaggtgagtgaggaaggatcacggggccatcatctagaagtccccttttacatctggcctcacagcacaagttattttaaaatggtaccttcccatgctggcaaagttacagggaaatgatcgtgcttgttcacagttgtcgattctagaaattggtgcgaagtcaaagagtaattgaaaagctatagcccattccatcttacccagtcacaatcttatatcattcatcatattttatgggtcacccttgaaaatgatcctttaaatttagttgtggatggcataccgcctggccacgcccttggcccaaatagaatgcaggctcaatagggatgtctgtcactttacctggtgtctagcaccgaacagacacccacacccagtaatatctgttgaatgaataaaggaaagaaccagacatatcctttaactcacacttctactttcaggacttgatcccgaagaaataattcagaataagccaacagctgagcaacgggaaggtgtgacctgcagtgtgtcttttttttttttttttttttttttttttttttttttttttgagatggaatctcactctgtctcccaggctggagtgcaatggcgctgtctgagctcactgcaacctccacctcccgggttcaagcgattctcctgattcaggctcctgagtagctg

SEQ ID NO: 104079 - DNA, 1079 bp, Homo sapiens
agctactcggtcatattttgcatgtagcgctgctccagccagtttcttttcatttctttctttctttttttttttttttttgagacagaatttcactcttgttgcccaggctggagtgcaatggtgtgatcttggctcaccgcaacctccgcctcccaggttcaagcaattctctggcctcagcctcctgagtagctgggattacaggcgtgggccaccatgatgcctggctaattttgtatttttagtagagatggggtttcaccatgtttccaggctggtctcgaactcctgacctcaggtgatctgcctgccttggcctcccaaagtgctgggattacaggcatgagccactgcacccggccttcttttcatttcttttaagggtccatataaatgtatttgggtcaacttctattttggaacttagtattttggcattttttcccttcatcaaatagttacggagcattggctttatgctagagccaatgctagacactgcggtgcagataagtcagactcaggccctgcccttgaggagctcccagcccagtgagacacttacggagtgttggcaagtgctgggagaggggccacgacagggtggctgggagttactggagggagagctatctgaaaatgaggagaggtagtccaggaaggctttctggacgaggggcatttaacttagttttgacgaaggagtgagtattctcgagatgagaggggaaggaaaggtcattatagcagaggggacagcctgtgtgaaagcttggatgcctgcatccgcctgccatgcttactcagggacctgggtagttctgtgacttctatcggaagtgaagggatatgggtcatgttgtggccagaagggccaattcagaaaagtacttcgtaaaacagttcgacatttatcctagaggctgtagggagccggtgaagggtttgcagcaggggtgatgcagttacatggggagggatgtggaggatgaaggcccttggccacctggtggtgtgccacaccagggggatgaaaggagtaaaaatctgtggactgtatccttgggggccttaaa

SEQ ID NO: 104080 - DNA, 1912 bp, Homo sapiens
agagttgggctgtggaaggacatcttcaccgtctccatgaatgagaagtttgacttggtgtataaacagaagatgggaaagtgtgacctcacgtttgacttttatttataataacagaaacaacaacctgcatgctcacaatacccagacagtctactagccaaaagtcctgtatgcattcatttattccttgctggacaaactctggaagcagcgtgtgaaacagcgggggaagggaagagcggcgtgagcggagggagtgtgatgattcccaaccgaaagcagctgtctcgcctttagaacgtgcagcctctccatgtctgattacaaacagtctccacattgcagttccaatggcctggaccgtaaggataaagcctgtaatatatgcaactagaatgtctgccttttcaaccccgtattattgtattttatagagcttttcactggaaatctacataaatgtcagtaaaccaaataaaagttcatttccaaggggaatcaggagcgagccacacccgaatggtagaaagatctcagggttaactctttatttttgtagttttattatctaaggcacagccattctgttctcacttggttctgagatagtggtgagaacagaggatgagttgggtctgttggggggaatctggacacttgtttattctgacggagttcacttcttcagaaccttcctgaaatgagcagaaattgttcactaggtcttcagaatggacgtccttctgccagagacttccagcgggcggctccaaaggcccaatgcagaggagcccgcggagcatgtgctgagggaagtctgcctggtgaggctggcaggtgggagtctaatgcagtcaggagcatttgcatgcagtgggtggagagtcggccaccaaaggaccgagttgcgctcggaatttgagctgaattccacagccttactttgtttcctgaagtgatagcctactaatgctggcaagcagatgcttaatagtaaatttctaaaatccccgggtctttatcattcagtttgttctgtgcacctgaggcgctcagccgtgggaggaccattttgcgagtgtagccctgtttcactcggatcaggttggcacggccgcctgcgtgtctgtccacctcatccctccgtgtatctgagggagtaaaggtgaggtctttattgcttcactgcctaattttctcacccacattcgctgaagcgatggagagtcgggggccagtagccagccaaccccgtggggaccggggttgtctgtcatttatgtggctggaaagcacccaaagtggtggtcaggagggtcgctgctgtggaaggggtctccgttcttggtgctgtatttgaaacgggtgtagagagaagcttgtgtttttgtttgtaatggggagaagcgtggccaggcaggtggcacgtggcatcgcatggtgggctcggcagcaccttgcctgtgtttctgtgagggaggctgctttctgtgaaatttcatttatatttttctatttttagtactgtatggatgttactgagcactacacatgatccttctgtgcttgcttgcatctttaataaagacatgttcccggcgttgcgtcgagcgtttctgcttgtgggggtagaggggtccctgcagcggtgctgtcggtgcttgggacaatatgactgtgggccccgttgacaccccattccctggggttgacagcagagggaaacaggcccgtgttgggctttgatgaagcagaattcagactttccaggggttcacttctccccattatttcactcaaattcagactttccagggggtcagttcccccactatttcctcattcacctctgatcacttctataaatggggtggaggagaaagggtaaaagcatgggagatgcgggtgc

SEQ ID NO: 104081 - DNA, 1858 bp, Homo sapiens
gtttgcattgcctccaagcaaacagtgttttgacttgaaaaagtgcatttcaggctttgtgggcgggatgtttctcagcagggagtctactcagatggcctgaaatcaaacgccccacagagcagatccagggactgggtttggtgctatgacatgtcaaagcgcaaagcatgctgatgggtttctcagtctctaactgacttgtgggagagttaaatgaagtgggcgggaagttaggagacaccgtttttcttccttcactgagtggacgctgactgagcatcttctgggtgcaggcagcacaggtgaggcctagccccacttcggggtggtgaacttaagcagacagtaccaagctaagccgctgcacagagggaggccagttcctgctcttggcggcaagtgacagtgggcatgaggcagctggagatggggacagtgttcctgacaggaatcctccccagatccacctgggttgctccccctgtccttaagggtgtgtggcatttggctttgatgatggagagcccaggctctaaaacccctgaatcccagggtgctggccttggccataggaggccccctgttggtaagtatgaacctgatggacacttggtgtgttgggcacttcctgggttgagaatgtttgcagggagggcccagaaacgtggatggctctgttcagcagcagccccacaagatggagtgggagatgcctggggcggatgagagacgcgctgggctccagctcagctctgctgccctctgggaacgcaacataggtcaggccttcagcttctgcggctttttgttcttctctgaaaaggggctgatcacggctaagggcggtttgaaggtcaagtgcaaagtgccgtctcttataaaggcagagcagtggactcctcaggaggaagtgaactgaaccacagtccctctcgacttctttcctggctgcattttcataaatatttgttatttaacatttatttgctcttttttagttttgcttttgctgtgttttgttatccttggatgtgaccttctccaaaataccccttttggttcacgtgtgtgtgtgtgtgtgtgtgtgtgtggtgaagcagcgtcgagaacatactgtgtgcccatatgctccttcccttgggtttgctttatcatggtttaccttggttttgctttatttcagttctttgatttgttttcttttagcacattgcgtctttgctcggaagatcttcttgagttggtgagaatgcagggccgagtagccagctgcattgcttagatttgattcatgtcacagcataaattgtcttgattccaaatcctaaaccaggtgggtgactcctctgacgagctctcagctgtctcagctgagaaaaataatcatggaaaaatagtttggttgctctagcagcttctaattttgccccttaggtatcattaaagggttacaagaataatttttcttgtttttctctccaacactgataattttttgttaccaaagagaaagtccgtgttacgttgggtattttagctcagcatttgcagggttgcagtttgaaaaacctgaggtcctgcctggacaaggaccgctgttaataacggagctagtgaaggacatttgctggagacagagctctgatctcagagagctgacaatggaaagaattctaaacgagcagttcttcaaaagcagggaggcagtactcgggtgatgtgctcacagctcccataactgggaagtttggaatccccgccccagacatcttcacggtcaccgttgctattggactagaccaacctaagattttatattaacaaagacaatgggagcaacaacttctcttgtcat

SEQ ID NO: 104082 - DNA, 1042 bp, Homo sapiens
ttttgagtgggggttccaatgacttgaacgaaaggagccagggcaccaatccgggtttgtgtagcagatgccggtgagacccgactactgcagctcgggggtggccggacccggggtctccccgctgagtctcggggcttcaccggcgcgtgggcacaagcacagcaccctcgggtcgggggtgctaggagggctaagagcagcaggacttgagtgacacccaacagctggtctgatctctttcaggcgccaacgccagacgccagcctcccagcggaccctctcgcagacccaccttcaccccacgcgccctccccacacagtccacgcgccagcagcttcgcggatgtcagtgaacgctcttcgcttgcgcagtcagaacgtcctccgcggccgtgtgaacatccgggtcacaggcgcataaggaccaatgagcgaaggcatcgcgagccagggggcgcggagaaggcggggaatcatggccgcccccagtgttccgcgtccgggggtttgtgggagttgccttgacctgcagctccgccaccgcggacccgccttctgccctcagcagcagacgctctgtcccgcccgggcagctctgcgaggcagcggctggagagggaaccatggggactgtgcacgcccgggtaagaggcccagcgacccgcgggctgcgaggcctctgggccagcagggcagacgggcgccgcggggagacgctctcgtggctgcgcccagggttcaccgggagagagggtgccaagggtgccgggctgggtggaggaggccgaaaagaggtcgcctcgggccagcgagtcttgcagaccttcgagcaggaacctgataggagggacgagacttggctaaaggtcactcggcgagtccgtggcccaaaggacttgccaactttctgtgatgtcttagaccgcagtgaatgtgctctttctttgcatgattttaagttttctctctttactggtcacttccagcctttccccgctcagccgctgctggagccattgtaggctcctagagcaacaag

SEQ ID NO: 104083 - DNA, 1018 bp, Homo sapiens
aaattgaaacaccacaagaagatgtgcatttcttcctcaaagggagagctgaaaaaaaaaatgaaaaggtgtgcagacacacgtgtctttcttttgccagacataaccactgttcacgattgtgatctcttccagcacaacgttctagactgtgtgttaggtttgtgtatctgcgttagtcttgttgtttatacgaaggggattatatgttgcacactcttgatgccaaggcttggttttgcacttgtgaatgggcatttttgttgcccctgtggtgcttttcccttctgtcatgtggctggtcttggtagtgctctctgctcagtgatctgacttagcaccgaatggtaaactaccagcctcgccgtgtggctgccatttgctgtttctgtatcgtagaagaatatattccttgtttttcttcccccattttataggtaatgcggaaatctcatgaagcccgtgaaaaattgctccgtcttggaatttttagacaagtggatgttttgattgacacatgtcaaggtacatattgtggtgtagtatctttataattccctttctgtccatcagagaaaagctgtttttatggccagatgcagatctgggcagcagagcactgctccctgctgtgtagaacctgaaagttgatcaaacaggtagtccttgagttagcagtctcagggaagggattggattttttgtttgtttttggagaggggtcttgctgtattgcccaggctggtctggaactcctgtgctcaagcgatctacctgcctcagcctcctgagtagctgggcttacagttgcgggcctggatttttgtatgaggccggggaggagtggtgaactttgaagatactgttgtgtgaagccctggactccacgggggcctgagagtgactctgaaggagggggccaggcttcgttcacatagcccagcccagcactgtgcagacccccatctcagtgtatgctttaaaaagaggagggaatccaatttccattttagttttt

SEQ ID NO: 104084 - DNA, 1086 bp, Homo sapiens
tttcaaaattcggtcatttcatttaccttaatctgttgttatttgtggtttctctttaatcaccgtagaattggtgataatatgttttgggttgtttgataacaatgttaacgttagtaattaggaatgatttggagaatgttcatattaatagtctcttgttcaaattcctttaaactctaaatctgtaacattcttgagcctcacgggtggcaaggttagcttgtcccttgcattaatcaggtttgaatgcaggatgtgagcactcagcagcggcatgttttaaagaatgaaagtgattacaaatgaaagactagatctgtagttagcatcttccttctgtttttatgaaagtcccttagctagcatagtctttatccaatccaaagttctcattccttcaatgtagaccactgctattttttttttttcccctcctaggtacttggcctcaagcttcctaatcttcttggtcgtgcagaaaaggtgacctttcagttttcctatggaacaaaagaaacttcgtatggcctgtccttcttcaaaccacggcccggaaacttcgaaagaaagtaggaagcccaacagatcattgagtacactggcctgatagaaaagttaaaataggtggcttatttgtgaaaagaaccatgacagaatcagctgccacttctgcagtgaccacatgctgtagatttcctcttgaagatgagccctacgggcgtagtgttaagtctgttgatttaaatgtgtgcaagttctaatcactgtttcagcttttaaagctctatcccattgtctcctagtttctctgtaaacttatataaagttactggacagttcccttggagctcactgcgggagacggacagaggaatgtcagctgagtacagtgtgagtagcatttcagtccttccctctgggcttgggggaaaacagggtggctttttcactgattcccaaaggcagcaagagggcagcgtggaaagcacaggccctctgccctccgcaccaggtacctcctggccaggtgcctcttctctagccgagtacaggctacagggacccgagagtggctgatgccca

SEQ ID NO: 104085 - DNA, 1005 bp, Homo sapiens
caccttctctctgggccggtgcaagtcgctgggttgccaggcctggcttcagacagggtcgggtggaccaggtggggtttgcgccatcagatcatcttaggtgtcttacccattacaaagaagtgggaaagagatagcacctgtcgatgatagagctgcctgcagccctcagaccagccctgtccctcacctggggtgcagtcctgctacttagagcagtactgcctttgattcccttcacagctttccccctttcttcctttgtccttcttccctctggttttctcttccccttcttctcttcttccccttctccctctctctcatcattaaaaaaaattagatatttagttcattgtttcatgatgcttcattccaaaaaatgatttgcaacaagttcctaagtatgtgtggtccggaaagatgtctgatctccatgttgcagtttcccatatggaagaccagccacactgtcaagtgggaaggcgtatggcgagaactgggctgcctctcaaggacggcgtcatttgctgttcgaaaagaaagcggacattcactgaaatcatctctttcggtaacggtttctcttagttggagtaaataattttgttgatggaaccatgctatgcattgggaaaacagtctttgccaatatcagggctgactgagaagcgtcacccagatggggtgtccacagtggcggcccccactccccgagggcttgtggtgtcctgcctcgcgtggtcctttccgaataatgtcagtggtaacaggaagaggtgtgcttcagagctgactgtggaatttcagctttcaaaaagaaggaggaaccaggctgagccgactgaggccagggcgtcgagctccttgagagaacgaacccggtggtgggtgttcaactcccacgtagtgagcaggaatcgtttattcagttgaagctcaagtctcagtgtggacgtctcagtgtcctcctatgtaagatagggacagtcaccctcacttcct

SEQ ID NO: 104086 - DNA, 1225 bp, Homo sapiens
ttagattacatagtcattaaagttagagactgtgccttacttgaaaaaaattcttacaacagctaacataatgcccagcattaagtggttggttgagcgaatgaagcatacaagaaaaataatcatctaatgcccttacgaagaaaaatctgtttgtctatttaataaacaagtcatgatggccacagagctgagtaggattgggtgccttcctcagggagttcaggtccagaagagactcccagcagatgcctgggtgctaggggtgcctggaaagcttcctagaaggcatggaagtctccaagctgagactcagagtggggcttcccaggtggtcaggggatggggaaaagtcattctaagcagagggaacagaatatgccaggcccaaagaattgagaaggcgtggctcattctggatgtgagtaagtgtggctccaagtcctctcttgacctgggtcctaatctcacttcatgcatcctccctaatctctaggcctggctttaaaaacaactgcagggcccagccagggggagccagggcttgtctgggagagctgggagagcttggaaggacgggcacgcactgttgctcacaggtctttctcttttcaggggagggccccaaagctcatattcgtaagctggctgagtgcatccgctggtcgtacggggccgggattgtcctcaggcttggcaacatcgctcggttggaacttaattactgcgtccccatgggagtacagacaggcgacaggtacgtgttgggaattattttccacaatcacatcccactctccagtaattttattttgttttggacgtggttaatttcattagtggcttttaagcttgaagattttaagagaattaaatagttgcaaaataatgaaaacacatgtattttcctcctttgcgtttttctccatctagctgggaggagcaggtgtgaagcgttcccaccccctccctcaggtgctttgtgcttattgttcccagggtagtgggagcccctgccagggtctggctggaggaattgacaggtgatttggttcctgtgtgctgaaaacagaaggcagtgttttgagcagttgactttgcaggccagggtctctaggaaagttggggtgagtgaagctttgttcctgaccacagaggacacgatcttgagaacccctctctctacagcagaggaacccaccttcttggcttttcttcacccctt

SEQ ID NO: 104087 - DNA, 1037 bp, Homo sapiens
gaaataattttcatatgaagtggttacatttacctttcagctttacttccgtctcttcaggttaaatctaaaaaacacgtttcagagattaatttcaaaatatggtttattccgggaggaagcagcatcctaagcacgtgacatttaaagaccaggctataaggaagtgcctctgcccccaggccaggtggcagctgttcagatgtttattatggacagtgagctctgaacggggtcagcctggcaccccgagtgtggaagacattttcgctcagtgtgaggccttgtttgaggttggtcatcaatattggaatttcgtgaagttggagtgaggttgccagatttaatcttcatttctaaaatttggtagctggcaggatggggtatcgtgtgtgtagaaattatccacaggtttcccccataactgaggcaggcacactgtaaataggacttcagacattcacaaagaaggaaacagttttgagatgtttgcttactgttatgtcgcaagtgatttgtggcaccactgtctctgggatctaacagcattctgtcagtttgtgtcttaggagtccggtctctggagacacagggctgaatcaggcaggctcgcttgggagagcagctcacagttagcagcaggaagacaagaaagtggatcatcttggttgttggggagggtgctgagagggccccctggagcaggtccctgagctgaatcttcctagaggacagacagccaggtgcttgcagaagacacgcagggacagtggtcctggctaacaaaggcaggagcaaagctgtgcaggtgtgcgctgtcggcgggcaccgggcagaaccgcgtcctacaggaacagaagggggagtggggaggtccaggccctgagctcccacgcctttgccttccagccccgctgacctttttccccttgggtatatgccagggtctttgagctcaggacttcatctgccttgttcaccgctgaggtccccatgactacaactgcacctggtgttggaagtgagagccaggtgga

SEQ ID NO: 104088 - DNA, 1068 bp, Homo sapiens
cacacctgcagaaggtcagctcataacagatatggcaaccaatgtgacctttgcatccttccttcctggggtcaggagcaggtctaagaggtggtcaggctaaacccctgtagggctgtgggtactgctggtttcctaagccccgggaccttctgggggccgggcggaccttaagttctgtccacctgcctctcctccatcctcactacccaccttgtccttccggctccttccctccctgctccgcctctcatcggccctctgtcctctccgtccggagaggggaacgtgaaggaggtgaggagggagtagtgcaggaggatttgggtctctccttctttcccttttccattctccgagggcttaaccagctggtgaaggttcttaaccagcaaaggaggaagcagccggggccggtgagggtgaggccggcagccaggcaggaaggcagcaggaggaggaggaagcggaggcggcaccttctgagaggcgcatgctcagtgagtcgtgaagatggcagggctggcggagcggccgccgcatctgatctctcccctttttttaggatatgtgatggcgtccagtttggagctgggataaggttcctgtagccgacacccctacaggagaagctctgggactggggcagcagcaaggcgcccatgccacacaccgtctctcgaggaaacgcggttcagcgattctttgactgcggaccctgtgggaaaccccgtcaataaatgttaaagacacactccgaggcagcgtggatgtggtttgctttcactcaacagtatggcccgcgtggcctttccccgggaccacccgtgttctcacacacccgcccagtgtctgcgagtctccgtgtttggttcccgtgtaccagacatgatgtattcagagccaggcagcaggagggagctttgccccagaggaagctcagccatgctgttacggagagggcgcgctcccctcgatgcaccagccgttgtcagaggaggcccacggcagcgggcgcttggagccacagtgctcgagccatttgagtgtgtgagtggcaagggagaa

SEQ ID NO: 104089 - DNA, 1052 bp, Homo sapiens
gcaacatgcgcttctgccactccagggtggagcagcccctggccctgactttgggccgtcagagctatgctcggttgcctaccagggagtgacagggcgcttgggaggtttccacgaccctgcctgctgcaccgtcggcttcatttcctcctttgttagaaagttgagggtggatttgggagaacggatgtggctccgacatgttcctgagttgaggactctaagggaggagggggaagctgggggaaggggcgggctcatcggtgaggttccagattcaggcaggggtgtgacaaggcacggagggacttttgggagggatggttgggatgagtgacgtggcctgttccagaggagaggggttaggaaatgtggggccctggggtttggaggaagcagtgcaggaagtgtctgagaatgagcttcacggtgggcgtgattaaggctgatgtgctacgggaggcgtgtcacgtggtggcctgggtcagaaaagggaactgtgaccaactgtgggcattcagaaaatggaaaggaacgccggaaacccccagggctccccacagaagctctggggacgtgaaaggacagcgtgtttcaaacttgggttcagctttactggggcttggaggagcccgtgtgcagagaagaccaacaacacacagggttccccactgtgaccatgtgatgagaggccctgtaggtccagtgggccaggatggaggtcggggacagcccagctgctgctggaagtcctcagaggcggatggccggccctggccagtgtggaagaggtcgggtggagtgctccacacatttgccacaagaggcctgttctgtgctgcaccaggcactggacctcaggcgccactgcccagtggccagggtcaggtttctcagagacagctgaaggcagcggggcgagagcagccagtctggaggttctgtccctcttttctgagcaacacattcaggaagtttctatcccctgattaccttaaaaaatatgtatgtgtgggccaggtgaggtggctcacgcctgtaatcccagcact

SEQ ID NO: 104090 - DNA, 1981 bp, Homo sapiens
tgggaaacgctcctcagggtggtgagtggaactccctggagaccattttccagtgagggcctatctctttcctcttgggctgagaggaagtgggtggctcagctacatttcctttgattattattctgactataatcttcaaaccctacatttctcattgtgtgttccgcccatgcgttctgttgtccggggcagcaaagtcgacctgcaccacgtgggtgtttttgttttcttttgttttgttttgttttcttgaaggcctactaagagctgtcggaaactctgcttctgtagaaaaggtaaaggcactgcttggccacaagtgatgactcttccctgcctttcggggcttggggaggaagggcaggttctcggtggttctcctagcaccttggttacaaacctcccagcagagtcagatcaccttggcaaccccacactcatcaaagggactctgccttgattccctccccaccgctgtggaattaatatcgattgcacatcctgaaattgcttaccctcgcgctccctgtccagtcgtcagaataattaaggggtgtttattggatgtaagtgggttcatccctgctgcgagtatggattttaagtgctccgttggattgattcctccctgctgtggttggcacagggcaggtacctttaccgagctgttttcttcttttcgaacatgcggttccatcacataaaagacataccctatgaaaatgtctctgccttagctgtacatgttacactttaggtttcaggtgaaaaattggtttatctcctaatatgtctgctatttgttacatcacatagaggctgcaaaacagattaataagctttggaggatattataagcatacgttggcccaatggtattaatttgcttatccatactaattgctgtcttggtaaaagaaggcggacacaatgcaatcaatcctagaagtgttctgtggctttgcaactttgagatacctcaggctgacatattcaaatgagagccttctctctggttacaagaaaaaaatggaatgagcagcagttttggcctcgtccagtctctagggctcccagcatctgggtagtaacatgatcagccctgggaaaccagcggagtcttttacctcctctgatgttctgactaagagtgtctgggccgtggggactgaacgcaccctttgaggctatgtgtgttaaagtttgggggcccatttcttcatttctaatatggggcagtgtgggcagatcccagctctgcgtttctgagctgctgagtttgccctggttctgagaatgcccgtcgcggtggtgcagtccgcctccttgcactggatctgttgcttcttctctctaagcctctgttcctgatggtcccttgtggagcaaagcagcacttgtggtgtaaggaaggaaagcctcatcagcaattgagtgagcgctcaatcagaattcgttatggatgaatgtggatgactggaggcattgacgcagacaccagagtccagagctggtacgtggtacagcagaagtggcaagtcagctcagtttaggacaagtacctaaccctgtgttgagaaggattctgtggctgagtctgggcttagggaaaaagaatgctgggaccagtcagccacactaccagtgtgtatggagggttagttgctgagtggctgtcacccccagaacaggagccttttccagctctagtgctgtgtcatttcagcagcactggctgctttattcccattgagtgccgtgcaacagctagttggctgttggtaacaaaagttgtgtgaatcgtttaagatattgcagtgagaatgttggtatcttaactcttcccctagctgtctgtggctaggaagcatctccagtgctattgtttttttcttgagacagagtcctgctctgttgcctaggctggactgcagtggcatgatctcggctcactgcagcctctgcctcctgggttcaa

SEQ ID NO: 104091 - DNA, 1039 bp, Homo sapiens
gacagagcaagactccttctcaaaaaaaacattgttccggatttgctaataaggaggcaacctcctcagaccttggtgtcacaggagaatggcccgcggcagccttagggccagttgtgattttatccacagtgttggtcagatgcgtcctctgtgcttgtttaatattcattctgcttgcgtgaacaaagccatgtcagtttcagtaacgcttgtgccagggggcacccggtgtggagcagggctcagtaaaactgctgcaaagaatgttccaggctttttgaaattacgtggagttgctggggctctcttgaggctgttaatttacttagggctgctgtgacaaaataccacaaacccagtggtttaaaccaacacaaatctattattttacagttctggaggtcaggagtcccaacatcaaggtggcagcagggccggttccttccggaggctccaggggagaatcccattccttgccttttccaacttgcagaggcacctgcgttccttagtgcctggcctcttcctctgtcttcaaagccatctcccgatctttctctgtctccttcgccacacctcctctggctctggccctcctgcttcctcttgtaaggaccctgtcaatcacattgggccccctgcataatccaggctaatctcccaccccaaggtccttacctaatcacatctgcaaactccctcttgccatgcaaagtcacagtttcctgggacttgatgtggacatctttgcagggaccaagatccagccttccatagagacagtgacagatggagtagaaagtacatcctttgagtttttacaggagacactgcagtagagagaatggtagagtcccgaaaccctgattcattcattcatgaattcaccgagtgttcacggagcacctgcctcagtccaggcgtcatgttgggagcaggggagacagagcaggccatgcatctgtcctttcagagcactgtagacgcaaatcctgtagcacagatgtgccttagactaatagtgcctcgaaaggag

SEQ ID NO: 104092 - DNA, 1027 bp, Homo sapiens
tattgattcttttccatggaatgtaccaaacattttccatttcattataaccatccagactcttcaaatgtatttataaatagtggccacagggaactacctggtgcctgaagctttcccacataccagattccggccagcggaggcatctcatgccctgtgaatgctgctctctccttatttctcctgaaaaatggaaatggtttggaccagctgctggcggagtctgggaggagcgaggccgggcagaatgatgagtttgacttcatccctttccagaagaggggaaggcgggaggatgccccatccaccttccagaaggcggttccttgcagtcaccctcccctagtgctgggttctctgcttctccatttgtcagagatgagttggcctccccctggttccccgtgtccctgccacccccacaatcgctgaccgtgacttccttttgtccctggcagaggagaacgaggagcgcacgatgattgaccccacttccaaggaagaccccaagttcaaggaactggtcaaggtaaggagctccgtcttggttggaatcttcctcttagggcgaggacttggctttggggttcagggctctcatggacaaagggagctaaacccggggctcctgaaagggatgttggtgctgcatgagaaggtgggcagacatgttggcagaggaggacggcagagaggatccagcccgaagtgccaagcgcctcccatgtgccctgctcggctggggctttaacgaccagtcttgtgaactctttgctggacagagctcggcaggaggggattttaggattaggaatgagtgctggcgtgagctagtgtagtaccttacagatggagttggaactccgtctggagcctggtggggtctagattcagatttaaccctgaaaagcaggaggggtcaccctggccactcctggccaggagccatctgatgccgatgcctgcgctgagtggacagtcagtttccaccacgtctggaggcgtgaatcccagctgggcgagg

SEQ ID NO: 104093 - DNA, 1051 bp, Homo sapiens
tttttgagacggagtctcacactgtcggccaggctacagtgcagtggtgcaatctcagctcactgcaacctctgcctcccgggttcaagcgattctcctgcctcagcctcccaagtagctgggattacaggcgcccgccactacgcccagctaattttttgtattttagtagagatggggtttgaccatattgccctggctggttgcgaactcctgagctcaggcaatctgcctgcctcagcctcccaaagtactgggattacaggcatgagccaccaccacgcctggcctgctgtgcctgagttctaacctttatagtaagttggtaatcctcagtaaaatgcttttctgagctctgtgtgttctgccaaatcactgaacctgaggtgagggccctgatttgtaatcagtgggaagaggctcaagtagcctgggagccccatctgcagctggtgtctggaatgaagtcaatttggtgggactgagccctcagcctgtggggtcaactgtagctagtgttagaatcagactgaactctaggacaccccattggtatcagataatcagagaattgctgttggaattttcatgtgcgtccgtgtgaagagaccaccaaacaggctttgtgtgagcaacatggctgtttatttcacctgggtgcaggcgggctgagtccgaaaagacagtcagcgaagggagataggggtggggccgttttataggatttgggaaggtaatggaaaattacagtcaaagggggttgttctctggtgggcaggggtggatctcacaaagtacattctcaagggtggggagaattacaaagaaccttcttaagggtgggggagattacaaagtatattgatcagttagggtggggcaggaacaaatcacaatgctggaatgtcatcagttaaggctgtttttacttcttttgtggatcttcagttaatttaggccatctggatgtatacgtgcaagtcacaggggatgcgatggcctggcctgggctcagaggcctgacaggaatgacacgttgggtgtcagaaaa

SEQ ID NO: 104094 - DNA, 1067 bp, Homo sapiens
atatcttgtgggtcaccttgactgtcttggggtgatgagagggcagtattaccaatgcttaatcatttgcccccataccaaggtgaacacgagatgctctggtcctagtggctgcagagttgtgcagcctctgtccctgtgctagctctggacctggtggtggccgcagagctgtgtagcctctgtctctgtgcttgctctggtcctggtggccacagagctgtacagcctctgtccctccgcttgctctggttctggcggctgcagtgctgtgcagcccctgtctctgtgcttgccctgtccttgtggtggctgcagagctgtgcagcctggccccagagctgtgcagcctctgtccctgtacttgctgtggtcccggtggtggctgcagagctgtgcagtctctgtttctgcactttccctggtcactgcctcattgccgtggcgctggtggactgaggccataatgcctgcgtctcctgcaggtcctcctcgactggattaatgacgtgctggtggaggagaggatcattgtgaagcagctggaggaagacctgtatgacggccaggtgctgcagaagctcttgggtgagttcacagcagggacagctctgtcccacccccatctccctgcagcggccctgggctgggccaggattctctgcatagtgacatcggccacaggtcctaggaagacactcaaagctgcagtgtgcatctcccaggtggtgcccaggccctgggctgtggcttcagggtcctctctccccttgccgtttctacagagcacccagccatggggcagcagcaggttggggacagcttccaaaactgcctgcggctcccatcctgttgggtctcaggcccactttgtgtccctgccaccctcttttgacttgaactccttcggttcaggatgggaggcagcaggagggaagcgggtctgcagcaatattctgtgagtgaatgtgtcaccaaatacatgatagctcatgttccctcaccaggggcgggctctagtgtctgcatttgctgggtgaaggcagtttagtgatcttcccgggact

SEQ ID NO: 104095 - DNA, 1397 bp, Homo sapiens
agatgttaatctcctttggcaacaccctcacagacacacccaggaaccacgccttgcacccttcaatccaatcaagctgacagtattaaccatcacgcctgtggagaggggaagtggctcagatcctgcggggcttgaattgagaagatgcagccagcgtgtcccccctaggctttctttactagaccttaagctgtgctgggaacattcacaggccttctctgttttttgtttgtttgtttgtttgtttttaaggagaattccagctcttttaaattgtctctattattaaaaaacaaatgcaggaagagaaagagaaacatcctgtatatagttgctgagggaggcgaaaccgcagtggggtcacagctcatgggaccggggtgaggcgtctccccaccctgcgtctaggtagaggcgcgttttgggggcccagtgcccccctctgtcacctcttctccatcttttcttcctggaggaggctcagaacccctttggaattgtagaggcctaaagatgaggagagggccgggcgcggtggctcatgcctttaatctcagcactttgagaggccgaggtggatggatcatgaggtcatgagatcgagaccagcctggctaacatggtgaaaccccgtcactactaaaaatacaaaaaaattagccgggcgtggtggcgggcacctgtagtcccagctactcgggaggctgatgcaggagaatcgcttgaacccaggaggtggaggttgcagtgagccgagattgcgccactgcactccagcctgagtgacagagcaagactctgtctcaaaaaaaaaaaaaaaaaaaaaaaaaaaaaaaaaaaaagatgacagtgggcccctcaagcatttttgagtctttttgttttttttgtggcgctgtcacttttgtgtttggttcgggccttgttggaggtttagggaaaagacagtctgttcagttcagttgggagcacatgggcctcaggctgtgtatagcaccctgtggcccgagggcccagaagcctggccccggagcccctgccaccccatgaatgagctttagggtctgatggctggggcagtggctccctaggtaagagccaggtgtcacatgtgaaaagtggacccagctgccactccaggggtgggaggactgtggaatcgcaagaccatgtacaagaggccgatggaattgttctcgttactttgtaggctttatgtgctgtgcttgagaaaatgcaaacaggctattagtcggtgacaggcaattagttccacccccggccttgctgcttctgctgacgcaggttccgaagtctcctggttacccagcctggcaccctcaggcacagcagggtgtctggcccggcacccgcccctgtgggggcagcagcac

SEQ ID NO: 104096 - DNA, 1065 bp, Homo sapiens
gagttttgtttgccacattttctttgcggtcttttccatgggaccgtgtagtttttaataattgtgatcacatctcggtagagttgtaaacccttcccccattctgctgcagctccaccacctgtggttttccctgctgcttcccaagctttccaaataccatctccagtggtggcacgaagtcccaaggatggctctgttaccagcgtctttccattccccattcttgggcagtcaacttgaacatgtttctattgtttttccctactgaaacaacagagcatctttttgatacagattttttttttcattcctgtggattgttttcttaggaaaatttctcaaatagggtcaaatttggggcattcctttcaatctgggctggcccacgccacccggtcccgctgtcactgccctcgtgcgtgggcctctccctgctgtctgccctctgtccagggcttcccgcagccaagcctctcacagcagtatttagcacattgcctttaaaaacttggccatggatggtctatgttgctttggattcatgggcatctgtcattttattttcccaaagtgttagacccatgagtcagggaggcagacaatgtaagctggtggcgacagccagagaaatagcagaaatggggccagtgtttatcaatctgcccacttctggcacgttgcagtctgtttgcttgtggccaaatgttgttcctatcttgcctgctgagatggaatcaggacagattagagaggtcttggcacatggagtccatgttgaatcgagagagagagagcgagcgagcgagcaagagggagtgcagagggaatgagcagaattgtgcagaactcaccaggaaactcaccaggtgcctgtgctgtcatcctggaaatgaaaggtcagaccatccagcgaagaagcgcatgcatttccaggccccgatatggctggttgcagacacattgttttggagagatcttttctttcttcaaactagtaagaatgctggcgagaacagtgagtttagccaggagacctagggctggtttctttccaagacaagg

SEQ ID NO: 104097 - DNA, 1002 bp, Homo sapiens
actgtgggccaggcgcagcggctcacgcctgtaattccagcactttgggaggctgaggcgggtggatcatttgagcccaagagttagagactagcctgaccaacatggcaaaacccgtctctaaaaaaaataataataatacaaaaattagccgggcacagtgatgcgtgcctgtagtcccaactactggggaagctgaggcaggaagatggcttgagcctgggaggtggaggttgcagtgagctgagatctcgccactgtgcactagcctgcgctctagaccctgtctcaaaaaacgtaaataaataaataaacaaagaaataataaataaaatggggcccctgtgacttctcatcaggtggctggcatctggggcagagcaggctcttggtggccgtgagccctcgagagcaggccgggcacctcatccttccatctctcagcccagatcactggtgtgaggggtgagaaccacctagtaagcgcacatggccctccgcagacttcctcacccgtgtctgcccaccctgtggcccgccccgggctcactgggtccttgtggacgtcagcgttgcagaggctcggtcctgtccatgccggctgtcctccagcagtgggccgtgtgtgggaacgactgttggaccctaacgctgacccaccccccttccttggcaggtccacaatgtgtccttcgcctttgagctgatgctggacggaggcctcaagaaacccaaggctcgtcctgaaggtaatgcccctggctcaggttcccccgggagaggtgcgcacggaggggaagaaaaacgggtcctagaagtggctggaaggctggcatgttgttccccagatgggccccacgtctctggctctggggcaagggtctgccaaccccagctcctcagtctcctcattttgggaaccaggaggacttcgctggtggagctggcagtgccggttctttaataaccacttgactttgaaggacgtggcctctgcccaca

SEQ ID NO: 104098 - DNA, 1924 bp, Homo sapiens
gcactgagccccaaatcacggaagtcacttagaggtcacagagcaagtgaaatgaacaaggtgtctgattcccaggaaggttcttgtccacataaagaaagtggcccaagacttccagggccccagagggagctgtcgggtccattaagtgttactggggtttttggtcccggtaagtgtcattagccatgtcccccaaccggttcttagacatgtcctgatgcagatccaggaggggctgtgggagtgtctctgttcttgtcaccccaggtgcctgtccccgcagggtgtcagcccgcgccaggagctctcacaaaacctgtgtgtctggggaggcactgcccagagcgtcctggacatggtggtggccagtctttaaggggaagcgctgtgtgtggatgcggcagctggtgtcatgctggagacgtggcttctgagagtacctaccgcaatgacaggaggatggcacgcctctgaagtttctctgtttccttctgcagacgtggttaacttggacctcaaatccaccctgagggttctttacaacctgttcaccaagtacaagaacgtggagtgacgggggagctgtggatggtggcaggagtgtcccagcaagaaaggcggcatccgtctgtgccctgtgcctttccagggagccaggcgccatgggcttctggtccaagctgtgttgactgtcatccccaccccacccctacctcacgcctgccccaccccctgcctcttttggttgttgttcttaatctcctctccatgtagttcccagtgggcaagagcctttgaaaatgcaggattctaaacactcgtgcttgcgtttgaagcctcgcgtcactcagtcgcgtgggatgatgagtccgttgttgtctgccttggccgaaagatgaaaaaaagcctgaaccccaacccccagctggttgagagcaccctgcattctgcctcatggtgcagttagcgatcacaggccttcagaagtacaacatcagctcagcaggaacgccggctccccgaggacccaggcttgacgattcaccggggatctcctgggctgggctctccttggaagtgaggccttttattaaaaataaaagggttttgcagtttgaaaaactttaaagtcccagaagcttagatgtgacatgggtgtcctccacccacattcctatcacttcttggtcactcgttttaatgtaggttttgcacaaacatccaagactcaggatggcccagctcccacagtccttgaaaggagctgtctgctggggacgtttcttaatttcttgctgtggttgaggggctgggtctggagatggctctaattgtgctgcttgagacagcttgggtcacagctttccccttcagaggccctttttgggaatgaatgcatctttggaaactttaaaatgaggggggtgcattggttcactggcactgtgtagtaaagtgccacaggggagtggctcagacatcagagaattacatcctcaggcctttcgccttggcttgtagatgccggcttctccccgtgtcttcacatggtctcccctctgtgtgtctgtgtcctcaccgcctcttttattttattttttatttttgtttttattttttgagacagagtctcgctctgtcaccaggctggagtgcagtggtgtgatctcagctcactgcaacctctgcctcccaggttcaagcgattctcctgcctcagcctcccaagtagctggcattacaggcaggtgccaccacacctggctaatttttgtatttttagtagagacggggtttcaccatgttggccaggatggtcttgatctcctgacctcatgatctgcctgcctcagcctcccaaagtgttgggattacaggcgtgagccactgtgcccagcctatttttttttttttttttgag

SEQ ID NO: 104099 - DNA, 1056 bp, Homo sapiens
tctcccttagagtatcctataaaaggagtcgctgctcactcagttatgggttgttcaccccctcgctcaccccagctctgcagagaactggggatcccatcggccatgctttctgggctggcctctggtcgcagtcagtccctcgctgtggcgcccccccctcccccagctccttcccagggtgatgacccgctgaccccctggggtgcacctgctgcaaagcagcccccttccttggcatctctcagcattctccgtagtgagcctggcctttctgatcttgttagctttttgtcttcctgccgcagatcagagctttggagtaagttttgatatgaaatcgaatgccaacaccgaagttttagaaaacagtttaatattccctctcagttccggctgttgctaggctggggatgggttcagaatagccattttgatggaggtgatttcccagcaggggaaagaaataattaaaacagcattacggtgtctcttgcgggatgcagtgacattcaaaagccacactgacaaaaagcctggggctggaacgttctgtgctgcctgcatggcatgtacaggaccgcggccccctggagctggtggagtggcccagccttgccctgctcacaggtggacctggagagggcactgtgccttcccagggattgggatttgaaaagaacagagcttggccaggtgcggtggctcacgcctgtaatcccagcactttgggaggctgaggcaggtggatcacttggggtcagaagttcgagaccagcctggccaacatggtgaaaccccatgtctactaaaaatacaaaaattagccatgcatggtatgtatgcctgtaatcccagctattcgggaggctgaggcaggagaattgcatgaacccaggaggtggaagttgcagtgagctgagatcatgccactgcactccagcctgagcaacagagtgagactctgtctcaaaaaaaaaaaagaaagaaaaaagaaaaagaaaagaacagagctgtgattttcagccaaaatgagcagccctggcccattctgtg

SEQ ID NO: 104100 - DNA, 1004 bp, Homo sapiens
ctgtgggcacgtggggccctcggaagaggggaggagggtgagcacgtcctcagagggcagacccagcgaggcgtcgtggcagctgcggccgcggagacgccggctccgcctcttgcacacgccccctcgcctgaggccccgccccgcccgcgatgcccccgcccccttccccgccccgccccccggggcgccgagacccgcccctgggcccgcccccgggtccgcccccggcctccgtttgcgccgggtctgtgctggccgcgcgcctggcgctccacgctgagcctctccgtgcaatgattaacccggcggggcggccggcgcgggacccgagacggaggcgcggggccggggcgggaccccgcaggaccgctcggcttcctgctctcgccggagtttccgcgtagagggcgcatcgccggcccggggcccttggtgcggcgtggcgcagggcgcggcgtggggcgcgcgtgggcgcggcgcaggcggcccgggtcaccatgaggactctccgcaggttgaagttcatgagttcgcccagcctcagtgacctgggcaagagagagccggccgccgccgcggacgagcggggcacgcagcagcgccgggcctgcgccaacgccacctggaacaggtaaggccgcgccctcccggccacccggaggccctggagccgggggaggggacccctgagccgtccgcgggctaggggccgccccgagccaggaacgctgccgaaggcggcgcggcgcttcacagtttgcaaagaacttgccccgccggagtggtgcgggcctggaggaaagttcagtgcagcgtggttccagaacccagggaagggagcgaggcccgccagcgcccggggctggcccagaagcgcccggcgggtgggcggcggggtgggccgggaagccgcgtgcccgcctcctacccggggtctttccacgtctccactgcggtgctcgtgacaacctgggaggctaacggagcaggaagtatttttc

SEQ ID NO: 104101 - DNA, 1033 bp, Homo sapiens
ctcctgttgggaaatctccctgacccaacgactgcacagtgtcttaagagctgtgttctccaccaggcacggcggctcacacctgtaatcctagcactttgggaggccaagatgggaggattacttgagccagggaagtcgaggctgccatgagccatgatgccaccactgcactccagcctcggtgacagagcaagaccctatctcaaaaaaaaagaagagcagtgttctcctccagtattgagatgaaagccatctctctgtccttgaatctctgccgtgatttagaggaaagagttaaatagacttatttcaaatcccaactctgcctcttccctactctgtggtcttgagcaagtcaggtcctcaatttccttatccataaaacgggcagataacagtgcccacctcatggggctgttgtagggatgaaatttgaacatgcaaaataaagccctcaacacagtgcttagcacatagtaagtcctctgtacctcacagctcaaccccagactcacgcagtggaccagtgtcggggtgtccctgtagggatggcatttggagggctccacaggaatcagtcagttcctgagcacccactgacagccacttggtgagctccctcccacccccgaggtggggcgtcctgctgcgggtccccagacaggtgggggcactggctggttgctggcttagacactgccctcacccaaccttgggtgaccctggagtgggctctgagtctcaagtgtcttctcagagttcagggaggcctcagggggactctgcctgagcaacccccgccccaccagatttcactcagcagcctggcagattgcagagaaatgccagcccctccccgcggcacctgcagggctccaggtctcccagcccttaggcctacatcagctcccaccaccccaggcagcaggggcacggccatttcctgcactcctcttatgtgccaggccccaggccagccccgttcactgcccttaactgactttgccactctcctagcccagcgaggtat

SEQ ID NO: 104102 - DNA, 1033 bp, Homo sapiens; identical to SEQ ID NO: 104101

SEQ ID NO: 104103 - DNA, 1033 bp, Homo sapiens; identical to SEQ ID NO: 104101

SEQ ID NO: 104104 - DNA, 1033 bp, Homo sapiens; identical to SEQ ID NO: 104101

SEQ ID NO: 104105 - DNA, 1063 bp, Homo sapiens
caccatgccagctaattttttgtatttttagtacagacagggtttcaccatgttgtccaggctggtctcgaccacctgacctcaggtgatccgtcttcctgggcctcccaaagtgctgggattacagtcgtgagacaccgcgcccggcctaaaagcccaaagtttaaaccaatccgctagcagcctcggaggtcgtcaggaaggcagggaggccctgcctttcactttccctcaatcctgtggggggtgggggggctcctgagaatccctcgggctctgccacaccctgacttggaaatttctccgctgccttgggaggagtgtgaaggccccggagaaggaaccgcagagtccacccgggaaggagggtgggattgtttggcgggatggggacagcaccttggccaccgacttcagggttttgtgacagaggctgtgtagattccagagagctctgtgccgtccctcgcttgcctgtgaaatgcagtgttggcatttgtccagctgagaactcaatgcttaagactcagccgtttcagaagtcgatgtcctttggttggcctctctgttggcagctttaggatcatgtttgtggactcctcattcgattcactgactaaccattccccaaaccaacgccagagttgggggtagggcgaagagggacatgggatgtgggcctgagcccagctgattcttgtggacagccagctgcctggtccctgccctcaggggcccagagtctggcttctgtgtagagagaatccaagggtttgtgggagcttaggaagggcttcctggaggaggtggccattgagctggaaggtggatgggaggtggatggggaagagaatggcacctactggctagggatacttcgcttgtgaggtacgggtggaaaagtccatggagtgcctgacggggtgggccaatttacttggataacatcattgggtcattgaaactttgtgtgtgtgtgtgtgtgtgtgtgtgtgtgtgtgtgacgcagttttcgctcttgtcgcccaggctggagtgcaatggcacgatctcagctcactgc

SEQ ID NO: 104106 - DNA, 1332 bp, Homo sapiens
tccagcaggcaaggggcagctccccgaagggtgtgaacacagggtcccagcctgggtctcgctcctgtgcccctctccaggccctagcaagctgctccctggcgcagggaggactgggaagaggcactggggctccgcctggagaaggcaggcccaggggcctcggctgggacacgctgggcctcccctgcttggcacccggggtcctgcaccctgccagggaggccaacctgatcctgggtctgcatgcgaggccctgccagctggctccaccacctccacccatctgcctcctgccctcagaagccgtggtctggtctccgggatcaggtgattgtggaaaaacagaggaccaaagcccggggaggctgtggggcggggcgggcagcaggtcatgtacctggtgtgagaggttgtgcgtccctggagggtgctctggaatcagttgtctatactggaggaggaaggagtgtccttgaggaacttgctggagtctgacggcccagaactgcaggtgcggaggagtcagagtgtgtgtgggcacgtgtgtgtgtgcatgtctgtgcacacgtgtgtctttgtgcatatgtgtgtctctgtgtacgtgtctctgtgcatatgtgtgtctctgtgtacgtgtgtctctgtgcatgtctgtgtgcgtgtgtctgtaggcatgtgtgtctgcatgtgggcatgcgtgtctgggtgcatgtatgtgcatgtgtgtctctgtgtgtaagatatgtggaaagtacgcacatgattccaagaccccgcctgcctgtcttcctggggacccttccgggggctctctctgggggtctttgctgccctttcttccttcctctccccagtcctgggctctggcaatgctctggaatccctcaggtgcttggcaccaagtcggtgagtagtggggcagggttcttgctccatctcacagcccagagagagcaaaactcctggccaaggccacacagcagtctggcagcagaatgcagcctgagggagcagatgacaggggctttggggaggccttggggtgggggtggggctgccgcaggtggagtgaggaggctggttgaaaatggatatcaagtctgggaaaatggccactgcttggctccaaaaccaaaaagtctgggcttacctgtgtcaaggtaaaagaaaatgcagagccgggagttacaggagccatcctcaggctggtttgctgtgtgaccttgaataagtgtctgcccttgaacaaatgtctgtaacttcaccggcctttgtttgattctctgataagtggggaagttggatgtatcacggtaatggagctgtgga

SEQ ID NO: 104107 - DNA, 1062 bp, Homo sapiens
ctgccaagggcttctgcatccagggtgggcagtggcagcttgtcacccttgcccgattcccacatcccagtcctgagggactcagcacaacaggataagcgtccaggagccacgggctcccaccccgagcatatcacatggtgccgaattgcactgaacacgcgtgtgtgcatcgcacgcggccacgaccacagacacgcatgcacacacgcagaggtgcagagcgaggaggccggcaaatcccgcagctgccacggtccctcctgtcattctcacgactccgggagaaactgtgctgtatgatacagatctattttaatacacttaccactgggtgaacaagatttttatattcttttattgatgaacaaagtgaaccgtgtgaggcacacgtcttctatattggctactctgtgccaagtatgcattaccgcgtggcttgcgatgtccatgtcttcagcttccttttctgttggtttggttttcttcgcggatggattgagttacatgttttaacagtgtaatgggaggatctgaaaggttggacccgggaggggtagctgccgatgtgtcttgagattgttaggttttttttggaccaaggaggaccgtccagtgggtagtgaggatagagaaaaagtgtttgtcttaaatacgccaatgtagttttccttctttacaatgtattaaactcgatcgatgatttcaaagccctgtggttttggtgtccttgcgttgcggagaggcccccgggagtgcccagggcagccaggtgggcgttggaggggctggaaatcagggtcttctcccatcctgaggagggagggatggagggagggaaacagggagagagctcagtgccctccactcactcacccccgattcccagtcctcagaggcggcgggtgaccctttagggctaggattgagggtggaaagtcttggaaacccagcaggtctgtcactgtgcagagcccaaggtggtgccctctgctccctcatgggttcctgcctctcagcctggcaacatcaccgctgtctctctcccccagcagcgggtac

SEQ ID NO: 104108 - DNA, 2024 bp, Homo sapiens
atgccttcacatgaagaagggggtgttggcacccttcccctgtatccatctcacccactcctgcccacatgggccaagagtttgcctctagtccctgagccttgtccagctgaccggggctctggaaggtcccagctgttggggttagtctgcctcttccttcggccccttcgccttctaggtggggaagcaggtgcttcacagaagtccctccctcccagttatttttatttgtccaccaaagtctgagagcagtgttctcttatcctctccccatccttccccacccagcactgtttctctgggggccatttaggcagcctctcaggcggcctccttcagcccctgggatcattcctgatccctttcagttgtccctcataacttgggaccccaaaatctgaaattaaaatcctcctgcatcctgttggcccccgctgcgcggtgaagcctcattattccggcttattaacaggaggactgcatggacaaggggtgcctgtgatggggctggcgggagattagcaatgctaatgctggtaattagggacgtggcattggcgctgggtgcaggcttgctggtgaatttaagggccagatttcctgttaggaatgtgggaataattaaggtggctggagggtgtggacaggcttgcccggaggcaggttcaggccctcttgccaagaggaggtgcggaaaaactggtgatctaagcccgtggcacctgccctggtggaggtgcggcatcttaagcacttctgcatttcacagattgctttcagattgctttttacagaaggggaaactgaggcccagggtggcagtggcttgcctgagtccccaccccactggcccctggctgtattttgaggatggggactttattgttgtccccaccacctaactctgggctttttgagtttttgatagatacatcactcttcctgcttaaagcccagagcccaaccatgtcttactcatcctcacctccctgggcctctgcaacctcctcctggtctccctgcctccgtgggcagcctcttattcatcttggattactgggcagctcctggactgctgggctcccatctctacccgtctccctcttcctcagacccaccctcctgcaggtggcctttgctgccttcggccctatcccttcgcccctccctagccctgctcccacccatcccctgtggccgtgacttctcctggtctcctcgttgatgctgggacaggacgggctgggtgtcccacagttacctccgccccatgtctgggaaccctacttaacttccaagacagcgccagcatctccttcaccctttcctggtccccactgtgctcacagatgcgttgagccccctctgccgcccccacctgggaagctcgtgggaggtccagtgggagaaccttggcatttgctcagtgcgcagtgcttcctgcatttcattgaaacttcgcggcaactttgcaaggtgacaggtaaggcctcaggtggggacaccagtcacacatggcagtcctggggcagagctcagacgtgttctacccacagccctctctccttctccacttacctaactgcaccctggagcttcagagtctccccagccgtgggtgaaggagcgtctcctgcctctatgggtcgtgcagcttcccgcagtccctggctcatcacagcagcctgcttttggctcagcgggagtctccctcttccccagccctgtctgagccgatcttgagttttctactggaggctcctaaggggtcttggcagaaggcaggaagggcctgcgcttgtgcagctgctgcagatggtcggtgccggctctgagctcacgcactggaggcgccgtgtgtgtgcagcccagcagcctggtggaggttttgtgaagtccttggtctttttcagtcctcaaccagctcctgcttttctgcaggtccaggtgctatcaatgcatagcagagaagcgagacacgagtccttccttagtgccttcctggtcatcagtgaggccag

SEQ ID NO: 104109 - DNA, 1964 bp, Homo sapiens
tgggatttcttcctctgagctctaaccctgtgcacagcctccccaacttcacctctcaggtcccacgttggacccttgttagtttcgtaagcttgagcctgttattaagcacccttgcaccgctgtgtgctcacatgcaagatgaggtgatctgagtgcacgccttgtagacctggaagtgtgaagcagaaccgtggctgttacagcttagcttaggtcctggtgcctctcagcctggccgttaccttctgctgctggcttcagaaacattggtctccccgggggtcccactggccttccttctcacctctttgctagttcccaccctcatcttgccaatgtcacctccatgccaatgttttcattattttttcctacctctgccactattcattcacccctcagcagctttcaccggaaatattacagcagccccctgactggtctctttactcccagcctctgtccactacaccgtgaccaaagttgtttgtctcaagtttagctagccttttatgttactcttctgtgcgtaaacacgaactttcattctccttggccaatggcagaagtttctaatgtcttcttagcctctctcgaggtatgaatctgatagacaagctgctctgcttggagctggggcaggggcctggatccccacctgcatctgccctttccccagctccaggaccccacctgcacctgccgtctccccatctccaggaccccacctgtacctgccttccccccacctccaggaccccgcctgcacctgccctctccccagctccaggacccccaactccaggaccttcacctgccctctccccagctccaggaacactggcatgtgggaggcatctggggctccagcgagcacagtgtagaagccggtaacttgaggaataaaattcaagactgttgcagtggacagatgggggcttttattatctggcctcaaatcctttcttcagtctcatctcctgactcaaaactgcagaccatttcccagacatactaaacatgtgggggtcactgagcctttgctatcctgcttgggttgcccttttttttttttttttttttttttgaaataagatccagcccatccaccaagacccaaggcctggagcatctccttaccctcaagaaaggacctctggatgcatctggattggatcatgcggatgcaggtggtaatgaggatggtgatggtggtgctcctggtgatgggtgtcatggtgatggtggtggtgctgctggtaatgttgtcatggtgatgatggttgtcgtgataatggtgatcattgtgatggtagtggcggtggtgctcatgatggtgctgctggtgatggtggtgatgatggttgtcataatgatggtgataatggtgatcattgtgatggtagtggcggtgatgctgctggtgatgggggtgctcatggtgatggtggtgctcatggtgttggtggtgctgctgctggtgatggttgtcatggtgatggtggtgatgaggatggttgtcatagtgatggtgataatggtgatcattgtgatggtagtggtggtggtgctgatggtgatggtggtgctgctgctggtgatggttgtcatggtgatggtgatgaggatggttgtcatagtgttggtgataatggtgatcatggtgatggtagtggtggtggtgctgatggtgatggtggtgctcatggtgatggtggtggtgctgctggtgatggtggtggtgatggtgatcattgtgatggtagtggcggtggtgcccatggtgatggtgatggtgatggtgttgatagctacggtgataacatcagtggtggtcatggcagctgtcatttactgaccacctcctatggtgagtaaaagtgttttccatgttgctttgccatcacaacacatccctgtgaggaaatattatctcccatattatctccacagtggaggga

SEQ ID NO: 104110 - DNA, 1103 bp, Homo sapiens
tggctgtgtaattacaacctgaggttcccagcctcggcagggatggcagacaccgaagctgtgggctggcgagtggtcctgctgagggctgggcgctggagagaccgagcccctcagctgggggcagcatggcccagcacccccctgttgtcatgtggcatgggccctgtgccgctggctccttggatttttcaagagaagccagaaatgaagtgtgatgtttggatatgggcaatacagcctttccacatatccccggccagaagggacacccctgcagatcgaggtgaactgtcccctctgcgaccatctttgagccccttgccacgtcccctccgctgtgccctcaacacctggctccttcctctgcatcgtctggggcccggcggagatgggcagtcaccctgacctcagggacagagtctgtctttcccccgaatcacgtggggggatgggggggtggaggtggggggcgggggggtcatctagtaatttcctccctccctcatctctgtctccactcaacatctcggaaggtgccgacataccgagtgctaaatgcagtgactgagtcagactcgacgcgccgaagattctagaaccttagcatcctaagatgcaaagagtctgtgttggtgattcccgagattcaagaccttggttctacagtggtccaagctcccaaggtttagcgattctgtggtcccagagtgagccccagactcctgggaggggaggagctggtcacacaaccagagtgcctcgggactcttcaagggtgcttatctctcatttagataagtaagtggaacacaaatgcatttctgtaaatagactcgtcccccagccccccacacactccagccccagccactgcctcgttggagttattttattaacgtgttctgctgagtggacttgaatggggaacgctgcctctcatattgtggatctaattataagcatgagggacggtaccaaagaagcggctttgaagggagaagagtctggcagcttggttgaaagtgtcctttaatgaacttctgtggcacttgtatcttagcaacacattttattacatcctggtgcagctggacttgctg

SEQ ID NO: 104111 - DNA, 1053 bp, Homo sapiens
gccactccaaagagtccgctttgataccttagagtcttaaaacacctgctgtcggaaccgtacaattgatttcaattaactttgaattttttcaatgaaatgactctgataataactttggtagtcccatgatgcctcattagagctgctggctatgatgattagccttgtgatttaccaagtttttcctccaacgcctttgtctcttcaggaaccgaatcatgggctgtgtctttgatttcacttgtgtgagcagcgaacacacgaggctgctactcgccccatctgcagacacactgctggtcctgagggcgccacactccttcttcagcagccgaggctcttgatatgtatggggcagtgtctcggggaggctctggtcacctctagggggttaaggagctttgagggtgtccggtggcccagccttggaggccctgccccccgatttccctcccgagtactgtttagaaggcttttaactttgtctccgagaggcgtgtgacaaagtgatttacagtgcaggctttaaaactggacagactggagttccaatcccggctccatcctttgccggctccttccgcttggggcaggctttgccgccttggaggctctggttccgtagttataaaaggggattaataatagttcatggccagccaggcagcagagtgcctggtgctcggtgagcactcaagaaacaatcttcgagaggccgcaggattagtgagtggtgcattaagctctgggcccacaggaagttctcacccagtgggactgatgacgtgtcctgacgcgtcctggtgttcctgtggggcgctggctctgagcaggtgccttctggttctctctgtggactggctcggcccagagaggttgggggccttgttgagatcacacccctggtgagtagagaagccgtggtccagttctggaccattgggtgcccagcttcgtgaccttaactccaacactggcacgtgtagggggagaaatgacagcgtaatggcaccaataagaaaagtgaggtgtggactgttactccggggc

SEQ ID NO: 104112 - DNA, 1842 bp, Homo sapiens
aacatttgaaaatcctgtttgaaggttgcggcagcttcgggaaggagctctccgactccgggctgcctttgcctttaaatttgaactccgggaaggaggcttgcttgcgaactgacctccatctttttgtgtgtgtgagtgtgtgtttaaaaagaaagaaagcaaggaaaactttttttctccggccttttagaaatgtttcccttttaaatgactaaacaacattgggtaagcagccaggatttggcctggccattggaacttgtgtttttaactgcgagggtgttgtttttccatttccctttgtggcattttatataacaagggctcataaaagagggaggggagggggctgcggccgtggttcagcatgctaataaagccgccttgtctttcccaggctctgcgttgaaatctttcagaggtcacctatgaaatgagttagggagacttaacatttactcccctctccctctccttgggagagtttggtggtgattggcagcttagctggggaaaggtcgatgaacaagcctttggaggtgactctgggctgaactagggttttgaagaggcctctacttggtcaccccagagcctgcccagaaggagccgaaatgggggagtggaggtgaaaaggcaagtgtgtcacagtttgtttatttaactcaacagaaaattaaaggtagaattcttttagagagtcgcttagggaaacgcttataccatctccacctccagagatgttttctgtgctggaacatcggatataaaggttaagtttcaattaaaagtgcacatgtggatgatgaactagatagtaaaatgaacagatgaccccgttatccaggtctgttagcagtacgccagcagcggaatcctgtctttcagggcccaaccatgaatttctcattcatgcccttagcgcgatgtttttctcagttactttaagaaacatggacaagtgtgtaaaggtgtttaaaggactcatagtggtagatagcttattggtcagggtagatagagatatgttttctgtgtaactgtctagtttttgtcctaccattcggagactagggaattaacaggaagtgagtttacataggaccttgctatttgaaaatgaagttcatattttccactaaaaaaaaaaatgaggcataggatagttggtcagagctgatgagttgtggccaggcccaggccagctaagctgccttcccaggtgtggctgcactttgctgctgggctgtgattcagatagtggagggccctcttctttaacaagatatgatgtgtgaagactccattagctgctccagtggtttacaccatgagattgcagcacatgcaggggcagtaacatttttatctaaattgtcaagcaacaagcccttctgtgtaagttaaagacccagcgtaaatactgggtgggtggaggtcccctcttcggagttccgagcacagcatttagatgccatgtgtgagctggcatctccagacctgaacttcatgcaggtgcagctttacagtcaggttgggaagagccttctgtttgaaccgcagtccatgctgctgtggtctcatgagaaggaccccggaggtgagcttgggaccttgtgcactaccccaagagtccgtggagctgatgaactctgggttctgagaggctgtccccgagtgcagcagtaaaagtacgttgtcttgaaaggtgttgtgtgcgcgcccagcgctgagacgtgtcttcaccatgacttaccagctgtgtccagcaatgggggattccaccttagaagcagccactgaatgaagctggggggttatccacagccccaccccaca

SEQ ID NO: 104113 - DNA, 1006 bp, Homo sapiens
cagctgggccccagtcacctacacatggggtctcctgttctgtagacaggccctggcctcggctgtgccatttactctttcagccccactaactctcccctgctggggcccatgtcaccacccagctcattgcccaccagtggaatgctgtcacccctatggaacagtgtcacccatcaatggaacactgtcaccctcccatggaacactgacaccctcccatagaaactgtcacccaccaatggaacactatcacccccatggaacactgtcaccttcccatggaatgctgtcacccccatggaacactgtcaccctcccatagaaactgtcatccaccaatggaatgctgtcatccccatggaacagtgtctcccaccaatggaacactatcactcaccaatagaatgctgtcactctctcatggaacactgtcacccaccagtggaacaccgtcacctgccaatggaacactgtcacctgctaacagaacactgtcaccctctcatggaacagtcacccaccaatggaatgctgtcatctgcatgcaacagtgtctcccaccaatggaacactgtcacctgccaatggaacgctgtcacctgctaacagaacactgtcaccctctcatggaacagtcacccaccaatggaatgctgtcatctgcatgcaacagtgtctcccaccaatggaacactgtcacctgccaatggaacgctgtcaccctctcatggaacagtcacccaccaatggaatgctgtcatctgcatgcaacagtgtctcccaccaatggaacactgtcacctgccaatggaacgctgtcaccctctcatggaacagtcacccagcaatggaacgctctcaccctctcatggaacagtcacccagcaatggaacgctgtcacccaccaatggaacactgccacccaccaatggaacactgtcacccaccaatggaacactgtcacccaccaatggaatgctgctaccctttcatggaacagtc

SEQ ID NO: 104114 - DNA, 1009 bp, Homo sapiens
cactgggagcctaacagcaccaatgtaaagttctcattaaagcagtttccagatgctttttttccctgataaaaaaaccagagatgtttttatctcacttcatgctagagtgaatttttaaaattctttataagaatttattcttctagaaaaataaactcttctgttttctataacttaggttcgaaaacatggccaaaagaaatgccgagaaggaactgacagataggaattgggatcaagaagatgaagctgaagaggtaaaaagcagcttccctaagaatgatttcctgtttcttttgccttttacattcattttggggttcctcatgaagacttgtgacagaactaaaagacctttctaagaacatcatgaatgggagatgacaagaaattatatgacctgtacttagtgtagatatttattaattacatttctgtgacctctagttagtgtagaaatgtattaattacatttagatgtgcttttccactagtgcctgctccttaaatattctccttagtagaagcacttttcctcctgagtttcgtatacttgaagcattctgaacccatgtttgcagtaagccattttagtcatgactgaaggctgagttaagtgatgtagtcatgaacttagcacactgcccagatgtgaaagtggtacaccatcaccatcttggtctgtggtactccgtttccctaatgcttcttggaggcctgctttatttccttttcttaatggtagacctgagacccctaacaattgcatttataggaatagaattgagattggcctagttccttttccagcagaataaaaatggtctcccctgaggaaatctgatcatttttcccttataaacagtaggactgggcagcatagagagatcccggtctctataaaaaaaatttttttttttttttttttttgagacagagtctcaccctgttgcccaggctggagtgcggtggcacaacctcggctcactgcaacttttatctcccg

SEQ ID NO: 104115 - DNA, 1016 bp, Homo sapiens
catctctactaaaatacaaaaattagccgggtgtggtggcgggtgcccgtaatcccacctactcgggaggttgaggcaggagaatcgcttgaacctgggaggcagaggttgcagtgagccaagatcgtgccacggcactccagcctgggtgacagagcaagactgtcttggtgtggggggagatacagtaaaagcagaaagtatgaaggcagagtggcaaaaaaatctagatgatttaatcaaattaggctaaataaatggttcaattattaactttctataggttctcttgctgcaaatggccctaccaccttggttgataaagtttcaaatcccaaaactaatggggacagtcagcagccctcctcctctggccttgcttccagtaaagcttgtgtcggaaatgcctatcacaagcagttggccgccttgaactgctccgtgcgggattggatagtgaagcacgtgaatacaaaccccctctgtgatctgacacctatctttaaagactatgagaaatatttagcaaacattgaacagcaacacgggaacagtggcaggaattctgaaagtgaatctaacaaagtggcagctgaaacacagtctccttccctttttggctcaacaaaattacagcaagagtcaacgtttttgtttcatggcaacaaaactgaagatacacctgacaagaagatggaggtggcatctgaaaagaaaacggacccatcatcactaggagcgacaagtgcctcatttaatttcggcaagaaagttgatagctctgttttgggctcattaagctctgtccccctgactggattttctttctcccctggaaactccagtttatttggcaaagatactacccagagtaaaccagtctcttcaccatttcccactaaaccattggagggccaagcagaaggtgacagtggtgaatgcaaaggtaagtaccagctttgtcgttgagtcgaggtttgcataagattcttgtttcttgggaaacccagagactt

SEQ ID NO: 104116 - DNA, 1020 bp, Homo sapiens
tacttacactggggctttggaatgatttttctgacaacttgtcccctgttaaaaaaaaaaaaagtatttttctatctttggctattactgatacttgtagatgtagtcacaggaatattcaggggtgaaggtgttaaaaactcatccgagatggaattttccagtgggtaatttgcatatagagtgttgattttttttttctgtcataagcatggagatttttccattttaaggttttctatatattggaagttattttagaattaagaggtatgttcccattaaaagggattcttatttttcacaaaatagttaaaatcctgcaggtactcccttctggcatccccccccccccccattaagtgtgcattttagtctgtcagtttacatggagtgctccggtggaggtttagggtgttacgtaacaaaacttcagtcacttctttaagctctggattggaatcttactgaattattgtcatttttataaaaggtggagatgaagaagagaatgatgagccacccaaagtagtagttaccgaagtaaaagaagaagatgctttttactccaaaaagtaagaatccccacaacctgctggcgcatgtgttttgcaggcatggtggcatgcttcaggctggagaatgtcctcacggcacttgactgagcttccagtctcggggtcaagctttgcctgctctcaagtggaacaggaaagaattcttggccagtttatttaaaaatccagttctagaaatgtcctggtgggcaggtctcactcttttctgtcactttagctcttttaaagtgctttagagacaggatcttccatgatcttcccaaccccatcccatcccatcccattccatcccgtcttctctccctgtgtctttctccctccccttcctcctccccaacaaagaaatcgcagagtcagtcagtgatttcaggtttggcctcagaaggcatctctcatcccttcctggagacttggttggcctttctggattttctcatagtca

SEQ ID NO: 104117 - DNA, 1393 bp, Homo sapiens
gagggctgacggttctgagcgaggctgctggctctgagagaaacgctgtgtgggtgcagagacccgggctggagggaggacggaaggccactcctcacagtgagggcaagtgctccccgaggcctcccagttctcagggaaccagtcctgattttgtgctgtcctgttggctccctgtcttagatgtattaagttatttcagcatttaatgtttagcatattacagactcctttggtggagctatagcttctataattttgatgggttttgtttgtttgaatgcaggcaacatattgctgaacgttctgattccacccaatatgccatgtacgcgaacagggaagaataacgttcttatcgtctgtgttccaaatccaccaattgacgagaagaatgccaccatgccagtcaccatgttgattcgggtaaaaaccagcgaggatgcagacgagttgcacaaaattttactggagaaaaaggatgcctgaacacgcaaagtcggctgcagaattattgccaagttgctgctgcttccaccgccccttaaagttagtcagtttttcttctcttctttgacattctaagaacttatagataacttaaaacttttgtgaggaagattaatgtggccaataaaacctttaaatgttaagtgtcaagaaactgcactctcccttcttaagaactgcctaaagtgtaaaatacatttgaatgcaatttttggaagattttttaatgttcgtttattaaactaaccctaagtgatttcttcaaggactgcaatcagggtatcaatttgctttcccaaaggctcttccaacccgtgggttttggggtccaccgccaccacgagagaggcttttgaacaggtgcctggctgtgttcagaaggaagctggcctgtgtgcttctctccggtgggctcagccgacgtgtgagacttgttctgttaccaaatgaaccgggctgccacgctgtgacaggcgtttgtcctctgctttatttttactttgaagctcaaatgcgagtactaagtgttcacctcagcgttcgaatcattggcctgtaaccctgtgggctgcttcacgagaattcaggacctgcattttcattctaaaaagaaatgaacagcttgtgaaggagttttttggcttcatagtttctattcatgaggtagtgttacttctttatccccctaaagacaaaatgaagataaagggggattgccaggaatgggtttaaaagcacaaatgtggtagcttatcatctacaccatggagagtgaacccttacgaaatgaaagtcaaatgagaccatccgagaaaaagatgcgcataggcatttgtaccatgatcaaccccacgcacatgaaaactgtgaccaagtgacgtgc

SEQ ID NO: 104118 - DNA, 1783 bp, Homo sapiens
cactgaggtgtgattgggccaatgttggcatgaggttcttgctctacttccagtgttttgattccactgggagaatttggcctagtgtgtggctttggatgaatccgtgtagagagaggtgagcttgtcctgttacagatgctgtcagacatagcgatagtaggcacctagggaggaagtggccgttagttttacactgactttttaagaatggagaatgcacgtgggtttctgttgcggatgattcatagtaagcaagcggttgatgctgttaataccggccccacccgattgacattaagtttattcagcttttaaaaagatgaagaactaaggggaacaaatttaagtttgttgcaacttagccacacatgcttccctggtaccagctggaatcagcagctcacaggcatcttcaggacacttcagtgtatatgacacagtactttgttagcgtctgcgtgtgtatggaaagttgacaaaaaatggcatgaaaagatcatgattggattttcttttaaacctgcccttctgtaaaaaatagtttatatatttttaaattagtaggtatgtgtggcttccttttttcctaacattcccagcaaatttttgctgctaagactatcactgttaaagtgaaaattacagggaaaaatgtgatgaatataccgtaactcaaaatgtgatattttcttaaaatcactcttttatgctttaggaactggttggtctccactttgattattagtgtaaagagcctgagtatacgtggatttcattgtaaaatttaactccttgtcttttacttggggcacggggcccctggagggcttccctactttccccactatgttaacaggtaattctgatttatgcgtttagtttgacttatttttaacaaaatattagaagttatgctttaaaatgtttaatgtggactgaaattttcatcttttgtttgagaatctatgaagtgtatcatatacgtggcctaaagcaaggtgtgtattttgttattctgaaattgttttgcatctggacaaatactaaatatcccagtggcctttttttttttttttttaaaacctgtgtatccatctcatccttttgcgcattcctagtaagcaaaaaaatttgttatgccatcttcattattcgaattacagactgaaaaaatatggccagtttttaaagaagtttagattatgttttccatggaaggacaagtctgactgttcataggctgattttctttaagaggattattctgttttacaatttcaattctagatcacattttatatatgctgcatgccaaaaaaaaaaaaaagagaaaactgccttttctggtgtggaggggaagaaaaactaatattctaccttactagtagagttcaaaacaagttttcactgagagccttttcagtaaaagttaaacaagtttgttttttgagcatttgtcagttattctatttcagaagagtcaaaattcaagcacgatacattttgaaggctttgcaaactcctaaacccctgatgagtcctctcattctggaagtgggaatttgagtagatactgatttgtcccgtagtatggcagatgacagggaggtcttttccaagcaggcactcagaacacaggtcaccgtatgttctcagccagtaacaatcatactgaggacgaaggactctccgtttgatgcagacacaattgtaatggagatgtaaaacttcttagcaatcagatggataaattgtttgctttttactttaaataggaaat

SEQ ID NO: 104119 - DNA, 1067 bp, Homo sapiens
cacctggtttcaccagcccccagatacagagtgtgatgagaacaccgaggccccttcaccccaccccagggctcaacctccccctgggcagctgctgctctgtctcctcaaacttcccgggcgggttctgcctgttctcacagctcctgcatgtggagtcggtgggttctgcctgttcttacagctcgtgcgtgtggagtcggtggttctgcctgttctcacagctcctgcgtgtggagttgggttctgcctgttctcacagctcgtgtgtgtggagttggcgggttctacctgttcttacagctcgtgcatgtggagtcggtggttctgcctgttctcacagctcatgtgtgtggagtcggtggttctgcctgttctcacagctcatacattggaatcgggcagtatatgttgtttcaggcttctttctccgcatgtcatgtttgtgagtcatgcctgttgacacaggtggttgtaatctggtctcactgctgtgtaatgcctgcagagtgtaccatggcggcctggccaccctcctgtcagtgggtaccgggcagctcccagtgtcctcttgggcctggctttggtgcgcacacggacacctttctgatggggaacctgctctttcgcctgcctgtgctgtggtgctgccccgaacagccgtgtgatcgtgcccccgagcctttcattcactgagtccacagcgctttgctgagcaaaagcaaatgaacaggtcaatgaagcgagaccaggaggaacagcagagtcttgtgaaccccaggactctcagctcaggggctcggggtgactgcagaaccatacaggcggtggaagtggggccccccgacccggggacgtctgtttctcgctcctaggcaaggttggcctcttgcacctctttccatagatcccagctctgcctttggggggtgcaggcctgtgcacctgcaagagggcccagcagtgcccagcccctcggagcccgagtcagtgagagcacccaggaccgggaccagaggcccccagtcagcacagctgcttcaaaattgaaagccaggctgggcgcg

SEQ ID NO: 104120 - DNA, 1088 bp, Homo sapiens
gccggtgctgacctgggccatccctgagaccatgcctaccaggggtgtaggggtctaggattccaggtttctcctgatccagggaggagggagctgcccccgcacacagtgggagctcgttagctgctgctcagctcccgggagccctctccctgcagcaaaccccgatggatccgccccagccggagctgcttctgctttagggtacagggatgaggtcatctctatcagaggctgcgacaagaagaaggctctgcgtccaggatccttccctgaagttcagtggggcccgttctctcccggggacagttggagccagaaccactgcagtcccctttacggaggggacttcatttcctccagtattgtattggcagcgtttcattccagtgacagcccggtgacgtgaggggtgttgtccctgttggcagagggagacagtgggacttaggctaaggcacttgtgcagggtcccatagcagcaggggatgttggacctaattgtcctggattcgaggctggcgcttcccttctcatgctcaaacatatccctttctccagagaaggatgttcgatgccctttttttcctgggtgggcctgtcctggcatagtgtacgaggcagagcccagccccctggttttcacaatgcagtgggtctcagaagtcagagtagaggagggctaggaatgagggttggtgtgggagtgggcatttccaaggacgttgcctgcggagagcatgagatcgagcaggggactgagacccctgggaaggcagagccgcagaagggcccagaaggtgctttgcatccttgtcctgtgtggtgtgtcgttgccttgcacctagtacatgtgggcctgcacactgagcacctgccgtgggccgggtgctgggcacaagggtgggtggcattggcggatgggtccagctgtgtgcctggctcctggctcagggcccgggcagggagtggaggagtgagggagcagctgaagcacatggcctgagttcctctgccagggtttggcatctctgcagatatcgtgagctgggggcgtgggtgggcctcaaggttcaagggttctgtga

SEQ ID NO: 104121 - DNA, 1025 bp, Homo sapiens
cagatgagagatttgatgttcagcgaggggtgagcttactaggaacttgatgcccagagtggagcgcacctctcacctctcaggtgtgagtcctgagaggagccagaacaccagccccggagcacttctgcgtccactgaatcatcaacactctcaagctgtgggggcagggttgtgtttgatcatctccacttcacctctgtgacagcctgttagatttatgaatgaatttaaatctcccagatttttgttgttgtttagcaaaagcttgggttactcagaaacctgctgtgtcctctgacgttgttttgaaggtgtcaagggagcctcaggtggaggcgctgggctttggttgagtggttgtcattctctgagtcagtgtctgtctctgagatgggactaagctcctggccctcctcactcaggggtcatcgctcagctctcgtgatgaaaggcaccttgtagatttcacatctggcttttgaggcttgtctgtggcagcctctgcagtagaaggggagttgagcacttgctctgtactgagagggggcgggagtgttgggccctgatccctgccttgtgggagggcacagtccatgggggagacagccaggagcacaggtcactgttagctgaagtacaaaccctgctggaagcagtggggctgcggctgcccggagcaagattttggtgttgcatccacaggacactgctcatgactccaggtcacagatgaaccaggtgattcaggacccaggtgtgcgatgcagacatttggactgaagggggacaaaccctgccacttcttcccggggcttgggccttctcctgggccctgggcctcagcccaagcacacaggctccctttcaacaggggcagcccacccgacagttggtcaggtaacgtggacgcgacctgggcccaagacctggtgtgagtcctgagaggtgccgtgagcaggtgggacccacatccggctgcttgtctctgtgccctgcctcagctgagcattcttggagcaatt

SEQ ID NO: 104122 - DNA, 1678 bp, Homo sapiens
aactgagtcccagagaacaagtgcatccccctaaggtcacacagctgcagggacatggcagtcccaggcattcagggcccctcagcaggccacaccctggaggctggagtggagagaggaagtaaatttgaatcccttttgtaggaggcaggcttagcatgggaggcttcccagtgagcaggccccagcctagcctgcccaggcgagcctttcctcatgcaggggtggggtggggggtgcttatgaagtgaaatggacaagaacttcaatggttgacaaggtttcaatggtttctttctgaaaaggtgtcaagatttacttttgagcagaagttggagcgtgcttattcattcattctgcaaacattcattgagcacctactgtgtgccaccgtggcaggcccacctgtcagctggcaccgaatatctgagctgggatgcatctgaaggaccatctgctgcaggtcacttggccctgtttgctcagcagcttcaagcagtccctccccactcccctgtccacacacacctattgtcctctgaccacctttacctgtgagcaccttctctcctcttctaggcagcccctcccgcaaggaggctgcagggccattcccagaagaacagtgaacagtgaaaatggcacctagcatttactgagcacttactatgtgccgggtgctttactcatgctgcaaatttaatcctgacacaatgctgactttgccagggagcagtattatctccatatcagcgatgaagagcctgagggtgagagagagagagagagagagagagagcctgcccagggacaaccaatgaggaagcagcatagcagcatagccgggactgaccctctgccagcctgacctcagagcctgccctccactccctgaatatccccagccaggtctttatgtgcctacgatactcacgctgtttccttgtctcttctccaggcctcccgcacgtgccaggtctcccctcttcccctgctgctgaactcagtccctgcagggctctgaagcagagaaaacctgctgttttctctgcccggaaagccgcccctactcatgtgccccacaagcatctctaagttttcctttaagtctcagctccagtgttgcctctccgggaactctttccagctcccaggcacacagtcctgttctgcctgtgttctctttgtgccaggcacatgtttgttgggacaatcaggatgattgtggccttgtcatggtctgtgtgctgtctccccagttagcaggtgaggccttcaaaggcattacccagtctgattcatcttggtgcccagcatggggcacatacggagcaggtgcccagtaaacatttagtgaacaagtgagaaaattattatctggactggcagatgaagggcgtggagggccacggagatgggaatcttagcttcttagaaggcctcatttttggccgggcgtggtggctcatgcctgtaatcccaaccctttgggaggctgaggcgggcggatcatgaggtcaggagtttgagaccagcctggctaacatgaggaaacccccgtctctactaaaaatacaaaaaaaaaaattagccaggcgtggtggcgggcgcctatagtcgcagctactcaggaggctgagacaagagaatggtgtgaacccgggaggcggaggttgca

SEQ ID NO: 104123 - DNA, 1092 bp, Homo sapiens
ccggaccggggccgggccgggccggggcggggcgagcggagccgggggcgcgcgggcggcggcggcgcggaggtgcgctcgccggtgctgtgtttggcgggtggtggcggcggcggcggcgacggcgacgcgcacagaggcggactgtggcttccttggtgctcgcggcgggctgcgggccgggccgcccgccctccccgccgccgccgcccccgagcctgcgggcggcgccgaggccgaggagcgctcgctgcagcacatgctgcgtgccatagcggaggagcgcggccgtcttagcctgcgccgcgaggtctgcggcctcggtgagtgggacccgggggcgaggccgggccgggagaggtgagcgtctccggggccgcctctgcgcgtccgtgtttctgtgcgccccgcgcatctctgtctctgcgcgggtgtcgtggtctctgggtctgcctgggtaccctgtcttcctccatggccccccccccaccgtccctgcatctgggtctgtctctgctttccgtccgacgagcgccccgcacccctgtgcccgggtctcattcggcgtctccccctgtcagtccgtccgggtgtctgtctcatcttcctccttcttcttcgtgtctctgcgggtcttcttccttctccaggaagcccgccccgggccctcagcaccgcggtagggagtgtgggcgtgggatctgggtacacccttagcccagcgcggcagggtcgggccctcgttgggctctgggtggacctcgctgcgagcgtgccctggccactgtctcctgctacccgaagcctttgtctttccgcacccaccggcccctctcatcccttagctgtatccagggacctgttgggcaatggccccccgaacccgcccgcttggctgaggggcagggcctgctgcctctcggtgtgattctgggctttaagtcatggatctgctggggggcgtgggatgggggtgcctcgtattgtttggaagggcctgggactgcaggtgtgggtggggtctcccagccagtgaggtaatccattactgatggatcatgcccagactgaagcccaggagaagccccctct

SEQ ID NO: 104124 - DNA, 1056 bp, Homo sapiens
tcactgtatgtttgttgaaattgccccatcctcagtccactaagaaataaaagagcatccatgttcatggattgagattcccacagatcgttgcaaatgtaatgtcatcatttgcttgatcccctgatagtactgataattacacaaggtcatttccagacagtggctactgtttccattgtggaggggttttcaaagtcttccgtacataagaacaattgtaaagcagtttctgaaatagaaatctattgcaaataacttcttttagctggactttaacccttgggcatttcattcttttatttaaacagatgatgctggagggtcttgaaatctttacagtaaaacctgcaacttgaaaactagccttctgtaaccacagtgcccaaacgaagaggaatgtatggagaactccacgtggatctctgattgcgaaaccgtcacatacaccaagagagccacatgggcatgtggccctcaaggctgggtgagagggctcccctgtgtgttgaactatgcaggagggtgacgcggacacatttcaggtggactttgcaaggactgatggatagctacctcagggaccagaatccgtgggaagggatggacctggtgttcccgttcccatctgacaggctctcttttgtcaaggtggtatttttcgtaataaaaggggaagagtaaagactgtccaagcaacagtagctgccaaagagaaaatacgaaatagacactttttttttttgagtcagagtctcactctgtcacccaggacagagtgcagtggtacgatctcaagctcactgcagccaccaccgcctgggctcaagtgattctcctgcctcagcctcccgagtagctgggattacaggcgtccaccaccatgcccagctaatttttttatttttagtagagttggagtttcaccatgttggccaggatggtctcgaactcttgacctcaggtgatccacccgccttggcctcccaaagtgctaggattacaggcatgagccactgcgcccagcaaaataaacacattttataatttgtatgt

SEQ ID NO: 104125 - DNA, 1033 bp, Homo sapiens
aatgagagctttaaaacattgaggttaaattttactttgttgaatttccccattctagcttttccaagtctttttcattcttaattctatgccccattccacttgttactatactggcaaaggtgctattgtattactcatacataaagaatctttcctttatttatgtagaatgtaatatttttgtgggtctaaagtaaaaggaattcttccagttttatactaaacattcataaagccaaagcacttaataaggccaattatgatctttcttagtttttttgaataagaaatttgaaagtagatggcataatttatggaattaaaggaaaaaaaagtactggcttctcagaatacagtaatgcttggtgggattagtttttggcctaattcaggaaaatcttggagggaaaaacatatttaagattatatatttcttaaaattgcttattaaatcaattgttttaaaataatttaaaaggtagaagacgatatcttccaacacttctgtgaagaaattggcgtggaaaatattcgtgaatttgagaacaaacatgttaaacggcaacaagaaattgatcaaaaaaggtatttttataaaaagatgttggtaaggagcttacatatttataaaaatagttattatttcataatttagaggaattatgcctgagtttcatttcatcaagaaacagctaggccgggcacggtggcttacgcttgtaatcccagcactttgggaagccaaggcaggcggatcacgaggtcaggagatcgagaccatcctggctaacatggtgaaaccccgtctctactaaaaatacaataaaaattagccaggcgtggtggcaggtgcctgtagtcccagctactcgggaggctgaggcaggagaatggtgtgaacccaggaggcggagcttgcagtgagcggagattgcgccactgcactccagcctggacgatggagcgagactccatctcaaaaaaaaaaaaaaaaaagaaacagctagtaaaaatttatattcttacaaag

SEQ ID NO: 104126 - DNA, 1148 bp, Homo sapiens
ccaatgatgggatgtagttcatcatgttcttatcaatcttttatggtatgtaataacatacttttttttgttttgttttgtttttgagacggagtctcactctgttgcctaggctggagtgcagtagcgcgatctcagctcactacaactactgtctcccaagttcaagcgagtctcctgcctcagcctcctgagtagctgggattacaggcatgtgccaccatgcctggctaatttttctgtatttttagtagaggcagggtttcaccatgttggccaggctggtctcgaactcctgacctcaagtgatctgcccacctcagcctcccaaaattctgggattacaggcgtgagcatcacgcctggctgggtacatactgttgatcttttgctgccatgcgtatatatgttttgtgagaaagaatataatgaacatttggtttttatttcagtgtatgtaacatgttaaatattttaaaaccctttagatcaagccaatcaatgaaagactaagggagcttaaaggctgtaaaatggtgattgatgtcataaagactcagtttcctcagctgaagaaagtgattcagtttgtgtgtggaaatggtcttgtttgtgagactatggaagaagcaaggcatattgcactcagtggacctgaaagacagaaagtaagaaaagaggcttggatcacacctttggataagttgaagtagtatttataagactagcatacacaaacacacacaaatatttacatatgcgttttatgtgttcttttttctaaagagaaccaacatagaacctaaggtggttatggcttcagtggtttttataatgttctgttgaatttagaaaaaaaactcttatagcatttctcaacatcataaattataattttggaaattagatttcttttaataatatcttaaagcagttagttgttgttgttgttgttgttgttttaaaccttatatggaccctggatatggtacctgtggttttgaataccaggaaagattttgggtatttattttacaatgtgggctaattcttccatactttagtggagatactaactgtccttttgcatattcaaggtttaacatatttgaatttctagaaaacacaattgaaatgagattactaaa

SEQ ID NO: 104127 - DNA, 1001 bp, Homo sapiens
cattttaaagcaccttaagtaatcagtttccttcttgtcaattaagtgatcatgtctcctcaaagccacatgtatctttaagtgtttatgagaggaaaaaatgattaccttatgaataataagataaacacttgagcccaggaggccaaagctgcagtgagccgtgattgtgccactgtactccagcctgggcaaaataaaaataaataaataaataagtttcaaatataaataaataaataaataataaacagtttttttaaaggaagctttcatgctcacattattttaccgggggaaggtggtcgattatgatttaatttatataaagcaagcttttgggaagattaattatcttctagtacaggatttcatacaaagaaatttgctctcatgcttcttaaggtgaattagcaatttttcaatactgtttatgcagctggatcgttataaagaacttaaggaacaagtaagaaagaaagtagctacaatgactcaacaactggaaaaactgcagtgggaacagaagacagatgaagaaagactggcatttgaaaagaggaggcatggagaagttcaggtgtcttgggttgtacagtaatgatttagaatcattcttaatgaaattttatttcctttttgtacctgtctccagaatgaatctccttaaccttacactatactgtctcatttcatttatttcatgatttggcagatgaagatacaaatataatagccataatctgtgatagttctgtgagtagaagaggcattttgtgcaaggagaaaaacaaaggtggtaacatagcaggaattacttttaaaacatttgtataattgtgtaattgatatgttataaaattatacactgatttatgaaaatacacattggacatttttgcctttgtacatgctagtttctttttggaataacctattcatctttacatgttaaaatctagagttaccaacaccgcaaagccttccctggccctcctttt

SEQ ID NO: 104128 - DNA, 1021 bp, Homo sapiens
gaggaagctgatgccagaaatactgattgagttgtgaaactcacaggtccagacaaaagggacccaggctaatgcatgccacttctttgttctcatcatcataccactgagcgcaagaacacaaaatcatttgctggtgtattgggttatttaaaaagtatattcagaaaccctcgccaaattatgctacttttggcaagaacattatgtcctaataaataaacattcattagttaatttgttggtatagtagttgagtttatgaaaggccaacttaaatacactcccttttaactgctgttgaattatactcttttataggcagaacgttaccagagtctccttgaagaactgaaaatgaacaagatacaactgcagctttttcaactataccataatgagaaaaagattcatctcctgaacaccaagttagagcatgtgaatagggatttgagtgtcaaaagagagtctttgtctcatcatgaaaacatagttaaagccaggaaaaaggaacatggaatgctaactagacaactacaacaaacagaaaaagaattaaagtgagtttttaaaagtagatattaacagttgggttatatgtagcttgatagagggaataatataagtgacactttgaaaattgattttaaaaataagctttttactttggaatacttttagatatacagaaaaattataaagatagtataggccaggtgtggtggctcatgcctgtaatcccagcactttgggaggctgaggcaggtggatcacgaggtaaggagatcgagaccatcctggctaacacggtgaaaccccgtctctactaaaaatacaaaaaattagctgggcatggtggcaggcacctgtagtcccacctactcgggaggctgaggcaggagaatggcatgaacctgggaggtggagcttgcagtgagccgagatcacgccactacactccagcctgggcaacagcgtgagactccatctcaaaaaaaaaaaaggtggtgtagaatggtcc

SEQ ID NO: 104129 - DNA, 1044 bp, Homo sapiens
caatatttgttgactcattaaatgcatttattcccatgtatattattatataactggccatttcaataagaaaaataattttattaaactttcggtggattttgaggtatatctggtatttatatattttttaacagggtttatttttttattttagggggatgctcagaatttcgctttaatgataatcttgtgagtcgttctgtttacattgcagagttggaaaagataggcataatagtcaaagcacaaaattgtttggtttttcaggtaagtagctatagtagtttatttgattcagagttttgaaaatacatcactatattttatatgttgatgtgcattactgtttttaaaagggaactgtagagtcaatttcagtgaagaaacccaaagaaaggacccagttttttgaggaaatcagcacttcaggagagcttataggagaatatgaagaaaagaaaagaaagttacaaaaagccgaagaggatgcacagtttaactttaataagaaaaaaaatatagcggcagagcgcagacaagcaaaattagagaaggaagaggtaagatgtcatgaagatgtaaccattagttgttggatataaaactttctatgttagaatcactaggtatgggcttgggcttaccaagaagattaatttaatagtataagacaattaaagcccaatattcattaagataaactttttgatgtatttcccactatttgggtttttctttccgaataggcaggacagcctgaactagaaaaatgtctgattttcccaactaaaaacaagcttgaggggtttatgtcttatgtggcaaaggctctcagatgtttggatattaaaccccttatgctcttaaaaattattgaggaccccaaagagtttttgttcatatgggttatatctattaatatttattgtatgtgaaattaacactggaaatttaaaaaatattttaatgatccctgtaaaaatagcaataaactcattacatgttaatataaatagcatttttatgaaagataactgtatt

SEQ ID NO: 104130 - DNA, 1007 bp, Homo sapiens
cttgtaagtaggactttcaaaagataacagtatcaagcctgctatataaattttctgtagcaccatctcataccaatcaaacaattttaatctagccctcgatcctggatttagttagcttctcttgtttttatttatttatttatttatttatttatttatttatttatttatttagagttggagtctctcctcgttgcccaggctggagtgcagtggtgcaatctcggctcactgcaaccaccgcctcctaggttcaagcaattctcttgcctcagcttcctgagtagctgggactacaggtgcgtgccaccaagctcggctattttttatattttttggtagagagggggcttcaccgtgttggccaggctagtctcgaattcttgacctcaggtgatctgctcaccttggcctgccaaagtgctaggattataggcatgagccaccgcgtccagccttagcctctcttttttagagtataagaggatttggtgctgcaccaatgctttaggtagtttccatatttataaaatgaggataattgaaactcagtgaagttaaatgatttgccatggtgtgatacctaacaatggaagagagctgggatttagataggtgtatttcagtccttaaatttagacctcttaatagtctacaatagatgcatagaagaaatgagttatctacatcaaatatttcagtcatgcattttgaacattgattaaaaaggacatgtcttttggctatatttcacttcgattggtggcctgatttcttcagctctgggtagggctttttatcattaagaatgaataatgttttatctcttttcttccccaggaaaatctaatgtaatggatgcacttagttttgtaatgggagagaaaatagctaatttaagagtgaaaaatattcaagaactcattcatggagcacatattggaaaacctatttcttcttctgcaagtgtaaaaattatatatgtggaggaaagtggcgaagag

SEQ ID NO: 104131 - DNA, 1059 bp, Homo sapiens
acaaacactaaattattttgcttaaaagatgtactttttattgtggtaaaatacgcatcacatgggatttgccattttaaccatttcctttttttttttttttgagatgtagtctcactctgtcacccaggctggaatgcagtggcataatccctgctcactacaacctttacctcccaggttctagtgattctcctgcctctcagcctcctgagtagctgggattgcaagctcaccccaccaaacccggctaattgtagctgggattacaggcgtgagccactgcgcccggcccattttaaccatttctaagtgtatggtccaatggtattaaatacagtcacattattgtacaatcatcaccacctccatctccagaacttttcatattcccaaactgttaaatactaactccccgtcctctcccccgaagcctgtggcacccacccatccttttccttcctgtctctgacaaattccctacaaatttaactcctctagggacctcataggtactcttatcctgggtcaccatacgtgccttactggcctttcttttcataaccagagtaaagcttgtttattttattttgagacggagtcttgctctgtcgcccaggctggagtgcagtggcgtgatcttggctcactgcaacctctgcctcccaggttcaagcgattcttctgcctcagcctcctgagtagctgggattacaggcatgcaccacacgcctggctaatttttgtatttttagtagagacggggtttcaccatgttggtcaggctggtctcgaactcctgacctcatgatccgcccacctcgacctgctgggattacaggcgtgagccaccgtacctggccaagcttgtttatttaaaaggggacagagacaactttttttcgtttctaatcggaatgtgtcttggaaaggatatgtctgaggggtgggagtggagttggttttgtgcttcagggaacctgttcctgccctgtcccaaggtaagcttgtaaagaggtcggtgcccttgttttggaacccaagttaatgacgcacctt

SEQ ID NO: 104132 - DNA, 1058 bp, Homo sapiens
cagctctgggtgcaaaattcccagggctacgggagcctgcccttccctgtgttttcctttctcagagtccgaaggaggctctggggccacagctcacctgcgggggattccgcacaccagcacccggctgtgtctcccccatttcttatgagcagcgataagtcaatccccttcgacggtttaatcctccagcgactgtttacagagaactttctgtgtgcttggaactttataaagtgcatccctcttctcagcaaccctgggaagacagtgcaagccccgttttcccactggggaagctgtgattcagagaggcggcgctgcctgcccagggttagagagcaagaaagtgctggagctgggattggaaccaaaggctgtttggctccaaagcttacactgtttctactcaactctgtagctgccacatgctggcatggatgtcgggggtatacaaggacaggagacagagcctgccctcaagacatttgtggctatgagggtaaggcaggcaggcagggctctggaggatggagagacatgcgccaggcacggggtgatatgggagcagaggggcacccgagctatgcagggtgggcaggcaggcggccaggagagggtgacagggcatgggaggtgggctaggataggagacgggctgtggaagacacgagggtgaaactgcaggtgggggctgagtgggcctggccagagaaggggtgaagggagtgtggggacagacatgggaaccggggttggctgcagaaagggtgaagggggtagggggacagatgggaactgggcttggctgcacaggggagagcagcctcgctgtcaggccacatggctggatcacatcctgttcatccaggagtgcaccacggcctgtctcgtctgtaacagataaggtccttggcttagtgagtacttttgcttttcttaatgaattagagcaagaatgaatgaatgagtgaatggggacattcaaggttatccccatgataacacggttgtcactcctgatgacttttcctctggtgctgggaggcaactccaga

SEQ ID NO: 104133 - DNA, 1037 bp, Homo sapiens
ggagggactccgtgtggaggagttgggggtcccgagtcccctgcccaccttggcctgtgtgggctttcacagggcagggctctggcccaggagagagctgggtggggtgatggtgggggtgcctgggaaccaggactttgggcgtttcatgactgcccccgcaccctcccacccaacacccaatgcagggctgggccttgcagatgccgtcggtccggcacacagctgtgcccatgtccccagacttgagaggtgtggaaaaagcacagaacattctagcaggagtgggaacagatctctctggcagatgagcgacttgtgtttccaggaaggattactcacaccccaaaagatggatgaggtgactgatgctccctacactttctggcagcggagggcgtagaataagcagcctggaagacccatcagtgccacataactgaggcaaagctacacctcctggctcctgctggggactgtttagaaagttctgtgctcctcttaggataaccacttaataaagactgaagcagggcttttcgtgtgtcagggcaaatgttgcttctgggactcaggtgtgaggccacagggacttggaagtaactattgggacctgggcccaggtggcagacagccaccctgtcctttgaccttgcttgatgactcgtcttgaagttcctgtgctttcaaatgcacggtgcaattcctgctgccagaacccctctaactcaaaaacggagaggcagcatgcatgtgtgtcatttttccgggcatggtagagaaatctcagaccatgcaaaaggaacagaactttggagctggtgcatggtgctataagaagctccctcttcctggatgtgtgcgagcagagccgggtggtctctgggcggggcagggatgttgaggggtgcaattgcatgttggggtggggaggggaggtggatgccaggccctttaagcttcctttcaaaactgggacctagatgatttggagtagggggatggccttgctttgctatttgttgctgacatttaga

SEQ ID NO: 104134 - DNA, 1056 bp, Homo sapiens
atcctagtactttgggaagccaaggcaggaggattccttgagcccaggaggttgtggctgcagtgagctatgactgcacctttgcactctagcctgggcaacagagctggaccccgtctcaaaaacaaaaaaacaaacaaacaaaaagcaaaaccaaggaatctcggtgctgatctcactggaagttggaatccaggttttgctttggtttaccctgcaaagtaccctttggctgggagccagccatgagccacttccaccctgaggagtcgtggactcccagctcctccttccctttccccttccagatctagggctggctggggaggggaagggtgggcttaccaaggaggggccctggtgaggccctgctggggagggtggcccaggcccagggccagagctggtgtggaaagcctgcacgttaccgagcccccaggccttgtgaaggtgacagaggcctccctcaggctctcaggggagaggagggggctcagcgttccctgcctttgtgcccctggagccccagccacggttctgtcaccattggtgatattcatttgcctcacagggagatgtctgcacatttaactaagggcctcgcaggtttgtttttcatatgataaaactgcttttctttcatggaacattctggcatgtctagacctgcagatctgcctcacaagctctttcagtggttccccctgtggttagggtgttaattaggggccagtttaattcttaaatgatgcagtcagtgtacagtgacagttggtccaggggcgctgtccaggggcctggtggagggaggaagggagtgacctagagccccagcaagcctcagggctatgggaggagctttctggggaggggagagctggtctgcaaggaggaggtgggattagctgggaaaataaccctgaaacggtcctcagggagacctgaagccttgtaaagggcacggacccactgtagcagggtactgggaggcagtgggctggggaaggaggtggggttacagggccagagagaggggccctagaagcaggcaggctg

SEQ ID NO: 104135 - DNA, 1043 bp, Homo sapiens
catctgagggccacagagcaaattctgtcctccccacccccacacaccagctgggtggtttggacccctagagcccagtggccaagccagctgagtatacacatttgaccatttgacagccatgaacttcaagggaagggcagcccatcacatcccatcatgactgtaacccttgttaatatctggattattgtgaagacttcagaatggatatgtttatagagactgtgtttgttgccactaagataattgctttatgatctaaactaaacatacacttagcctgaatgaatactaatatatatatacctgccaggaaaatgccagggtgatttattataacagacagtttgcctcataagagccttgggaaaaaaagtcagctttttaagtctttagcaactggagcacgatttggctcagtgaagtcttttttgtgtatgatttctctattagaatgttttgggttatagtctgagtaatgcgcattagaaaaaagctttcttgtgattttaaagtgttgtaagatgcttctggcaggactcttgctaacaatttcctttttttatgatgtaccagatattgacgagtgtgagagtggtattcataactgcctccccgattttatctgtcagaatactctgggatccttccgctgccgacccaagctacagtgcaagagtggctttatacaagatgctctaggcaactgtattggtaagaggtgtgccgccaggattagcgggttattccaggaggggccagcgacctagccttggggcaggcctctagaatctgcggggccgcatggtatacagaacaggggttggcaaactttttgtgtaaagggctggacagcaaatagagcaaatactttagccgttgtgggccatatggtctctgtcataatagtcaactctgctgttatagtctaaagcggccaagggccatctgtaaacaaatgggtgtggctgtgttccaataaaactttatttacaaaaataggcagtaggctggatttggcccaaggaccacagtttgct

SEQ ID NO: 104136 - DNA, 1029 bp, Homo sapiens
agagatgtgtccactcaaggaaggagactgccgtgcagtgagctcagggagccatggcacctcccgggtgggcctggctcagcataggccctgtgaagcccagtcatcggaggggcctagagccttgctgggagtcagagttgctggcaccacgtggacagtcacctgtctccttaataccgtgcccagtgtgtggagtagatgaatgcaggagaagccaggcaggcaggtcccgatttggcgcagcgaacgatggaggtgctggagatttagggacaggaagaagggccagagaggtggtgtttgaggcggtatgcagtgataaaatttgggagccagctgggaggcggctgtgtggtccagagtgagggggttgagcccctccatttgtggttttgcaaagaggtgggaaggggagtttctttggagatccagtttttgggttctgggacaccctccaggtttaaccacatggtctctgtcttttcccgctgtagatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttggttggtattaagaaaacaaatctgaaatccactttcctgtctgcttccagcatgcaccctgccttctctggaagcagaaagttgatccccaaagcaaagccatttctatcagcccatccatcccactgtcagttcccaagcatggggcttcattgtcttgcctggactggtgcaccagcccgtctactgcctcagccttgtctggcttgtcctgagcccaaagctctcgcaccccaccctgtttacagttccatcagctccccgttggtgacaaaggatggatgcctctgcttacagtccagtcccccagagctggcccaactccacaaaccttgtaattcaggcaatgtgggtctgccactccccacacaagcactgtcctttcctc

SEQ ID NO: 104137 - DNA, 1051 bp, Homo sapiens
ctcaaatcggaggacggacggtgtgaggggtcctgggcttagttcacaagaacgtgtatggacaaggaacaagattcacgagttgagtctctcaggcttgtgttcaaacctgacttctgccatttccatggccttgaagaagtaactcagtctttcctgggccatggtgtcctcatctgtaaaacgggcatagtaggaccaaccccatagggggttgtgaggatgaaacgagattaagcatgtgaagagcttatcacagggccaagcacaggatgaagagctggcggtgtggaggctgctggctttattattatttagtagaagtagtgggattcctggcttgtgcttcctctagtcattcataaattgctgaaaagtcggcattcatatccacattagtggacaatattgtggatatagaaccagagcctggccaaccttgctatgtgaccttactaaccatttgttagggtcctgccccgggtgtgtagcaagaactcggtcctgcactggggagtgtctctagcgggggatgagagaccacactggacaggtggaggccaggcctggtgtgtgggggccacagagatgaaacacggggtggaaggctattggacgttctgtgacagccacatagtatagatttaaggcttttccagccacaatctctgttgcaaccgctgaactctgctgtggtagcagagaagtggccagaggaccatggtaaaagaatgagtgtggcagggcacagtggctcacacctgtaatcccagcactttgggaggctgaggcaggtggattacttgaggtcaggagttcgagaccagtatggccaacatcgtgaaaccctgtgtctactaaaaatacaaaaattagccgggcatggtggtgcacacctgtaatcccccagctactcaggaggctgaggcaggagaactgcttgaattcatgtccacatttagtggacaatagcctcccggaggtggagattgcagtgagctgagattgagctacttgtactccagcctgggcgacagacaaagactttgtc

SEQ ID NO: 104138 - DNA, 1033 bp, Homo sapiens
tgcaatgtcgtggggctgaggctgggctcgggggctgtgcttccccaacccaagggccacagcacagatggaatgcattcaggaaaaggaggcccaccccatccaaggggtgtcctggggtctgcagcaccctggtctcctacacccaggccccagcacacttgtcctctggattgtctgagcctgtggcggctgcatccggcaggaacacttcagccctcctcccctcccctcagcagccccgtaaaggctggaacagaggcctttaggaagatgcccgccagggaggaagcagtccaggccaggggatggcgtggcctggtgtgggatggcccagggatactcatggctatgggtcagctccagcatcggctaagtaatggtggccaatggcattggttctgcattcagcccccttttctacgaatgctctagggggcagtgtgtgtcccccagagccatctgataaccatccattcaatcactgacagcgggtgctgagtagatgtttgtgagcgcgtgatcctcagtgtacacactgcgcccagaagctgagtcatggaggtggggctgtccagccagttcctcgggagccccacacaggactgtggatcctggggctctggaagccccctgggtcccacagatgtagcttctggtcatgaggaaggtgactttgatgaaaggcaggcaggagctgcggtgtttcctgggaggccccctccgcttgccctgggctctggatggaaggctggttgtgtctgcatttctgacggagcaaatgacttttctcctggccaggctccctcaccacagcctggggtcccgcccagactcagcataaacacattcctgagccgggcctttgaggctggggagtgttgtttttgccaccgatgctcaggcatttggcacctcttaatggatgtctcccagggttggtgacagcccctgagccccactgtttggctgctccagagtctatgggagttgggctgctcccccatctccaggggcctctcagtgtggtgcc

SEQ ID NO: 104139 - DNA, 1054 bp, Homo sapiens
tcccaggacccatcatgtagtgtttacttttaccatcgtcacgctccctccagggattgcgaatgataagttaacactctataaatgtaaataccctataaatgtaagaactggcacaggacgctgctctgaagatcagccagtggagggcagggatggcctgatcgccacccctaaccctagttgatgggaggcctgggctcctccgtctccagatgggtatggctcctgcagcctctgccttcactgtgctgctgtggggtctcttgcagacattgatgagtgtgtgactggcatccacaactgctccatcaacgagacctgcttcaacatccagggcggcttccgctgcctggccttcgagtgccctgagaactaccgccgctccgcagccacgtaagtcccttggaccatgccatcgtcgtctgtctgtgttggccttcctggtgacccagttcccgggtgggtgggttatcaggctgtgacctcggtgtcctcccatgagggactcagggcactcaaagatcacctgatccctggccctcaagcccctaaatgctagtgacactggtctcggaaagtcaagggggtaactgcaaatgagtctggggtctatagtcatgttttcaggccaaggctgtgcacagaaccaggagaaaccacagccctcttttttcctagggtggaagccttgggcaagctctctgggcctcagtttcctcatctgtaacatgcagatgtcagaacgtgctctgactgagatgcataggtagcaatgtctccatgtcagcccaaagccagggagccgatgtgacctgttggacgttgttgttaggtgcccacctgaaagccagaattcgtccagcctggtgaccgtgtgggaacggcatcaaagattccagatcctaaacgtggggctgcgtgcccctatgtctttgtaagctcactcactcctaggccatcacggcgcccacttgagaccacggttcccacttcctatcccccttgcccctaattgtattcagaaagtctcatttagtgccacagtcagttg

SEQ ID NO: 104140 - DNA, 2236 bp, Homo sapiens
tgggtacccgagcagccccgttgtccctggcagccctccatattcttcctggctttgcgattctcattggctggcccagccatttccctgtttcccagcacggatttctgtctgcttgaaaacccaacatcttgtttccttcctgagcttgggttaggaaaaagctgccccaaaactgggtttgcaagtctgtagcatcccgaagagctcatggttatgcaacagcctgccccaggcagtgacactgcttctctgagccattaagaaagttcgatggccttggctgcaggctgtgcagccgtctgtcattgtaagttcactctctccccagcctttgtcagcgcctgggcttgaggattccaggaggctggctgtggttgtgacctcgatttctaacttgcgcacagtcgtgaaaccacctttcgaagagggggaggctgccctgcacaggggccctggcgcctcctaagcctgagggtgggcgggttggccatgtgtgctgaggtcatggctgaaatcaggggaacccagctccacccctcatgttggctgtggaagcctctgccacccctcagtgctggagaaagtcgtttcttcctggacctactgcgtgcaggcacctgggtagacagcccacagagggctttgtccccgcacaggctccgccttcggcgtgtgtgctaggagggaggaggggaccccacctggctgggcgtgagggtgggcagggggctgtctggagtgggccatgcctgcatggaggtggaagggggagcgaattaggcagaagcggcgggagtatggacacatgtgcggtgaaatggggagttcagcctgaaacctgggccctgtgtgctgtgcagtaagggattgagctgctgggcgcctggcttgttccagcccttggactcccgggactgatagtgaggaggggccaccccctctcagcactgctaacccctcagactggagttttgtattttacagccccttttcctgctcatcaaaaatcgaagctgcttaacacgttttttcatctaagcttcagaaagcaatttttaaaatctaaaagagccatatttaggagggacccatggccggcgcttctgtggttaacaactcagcaagagcgcctccttcgggagccttgacagacaggactgcagagtccgctgctgtgcctttctctctctctccactcagacggcttccatctggggaacatcccggcggccgagggctggtaactggagcatgacccaggaagctgggccgcaaaccacagggctcggccttgtggacaggaccaggctgttacagtcctgcccacacaattcccttctgcccgcaggaggaagtgtgcaaagctgtcccacagccttcatggggccggacacatcctctttatcccctcagtggggccggcgcctgatgacctgtggtctagaaagctggagcaaagccgggtggccttggttgccgcttcccggggatgggacacgagtgaacagctgtgggcctgagggtgtaacacggtggacggtggcagagatagagccgtcgatggcccccctgccttggccagttcctggggcttgtctcccggacgacgagcgtgtgaaagtcaggaaaatgccggcagggatatccacaagcacctggggtggccagaactgccgtgcctcccaggagaaggagggggcctagagggccttttttctctggtgtgtggtggcttaggatcatttccatagagcttgaggtgttagggtcaaatgtgttgaactggcaagttggagcacattgtcctctaacgcatgacatggcccaggatgggtggcctgctgaggggacatgtctggaaaccagggcctgcgtggcagggggggacggggcgggctcgcctatgccctgctctgtaatacattcagtgatgacaacccgtccctgacctagacacactggctaaaagggatttttgggccgttcccagtctgacaggcagtttgccagacagttatgtttctggtgttttaaaaagtttgagtagagcgaagtacgatcattgaagccaggacttaccaggaaaatcaaggacatgtttatttttgtgcattagtcatttgcaaagcacatagcgggtgccccaggccctgctctttgtccagaaggagccagcccagaaactcctagtgtagagaaggttttggggtgctctgaggaatgactgtgtggg

SEQ ID NO: 104141 - DNA, 1052 bp, Homo sapiens
ctctagcgccacctgctgaccagccccatccaggctggtcctgaagttgctggtgtgtgtgcgtgtgcgcgtgcttgtgtgtgtgcatacattgtgtgtgtaaaagctttgaagtaagacaggccgactttgaaagccaagcttgccccttacgacacaccacggagctatcagcaagttctgcatcctcaatgggcgtctgtcttccagccagtagagcgggaggacgatgggagacagtggagggagcgagtggaaggaaagtctgctgcttgcagcctgctccctgcacccggaagcgcagttcacctgcacccggaagcacagctcatgggtcccatgctcctcccccagttcacggacgctttggtcatagctcctcagaggcccccctgggggagagctctcagatcgcctggagcactcccgtttggcctggacctgggcatctctggggcaggccaccgccagcagcacccgtgcccaccttctttcctgcctctgttttgggcccctcccaggcaggactcccccgttcagtgcccctgactcccaggccagtcctttctaagagcttggaatgatcactagccaagtaaatgcaaggcctcctgtcagtcctgacaaacctggaaagaggaggtaaaaggagaccccagtctcgataaatgcctcaagcaagtccaagtaacccagcacgagacatggaaacttaaaaagccaaaagggagatgtgatagaaggccaggacgagaggatgctcctgacctcagaatccagacacagcccagatggcagggcttcctggagcacctgggccaggtcctctggggctccgcacctgggccctgcttcctcaggcagccaccttcagagtatgatgggccaggagttcagtacacaggagacgacccctgtcccatcttgtgacaagaaattagaacttgttactatcctgtagcggaagataataccgatctccatcctgtcacaggaggttagaatctgtaacaggaagttggaatctgtgctcatcctatacaggaagttag

SEQ ID NO: 104142 - DNA, 1060 bp, Homo sapiens
gtccgagtcccaaaactgaagaacttggagtccgatgttcaagggcaggaagcatccagcacaggagaaagatgtaggctgggaggctaggccagtctctcctatcacatttttctgcctgcttatagtctagccgtgctggcagctgattagattgtgcccacccagattaagggtgggtctgcctttcccagcccactgactcaaatgtgactctcttttggcaacaccctcacagacacacccaggatcaatactttgtatccttcaatccaatcaagttgacactattaaccatcacaggacctgtccccgtctccactgcaggaagttaggacccatccctgtctccacccaggaagttaggacctgtctctgtttctatcacaggaagttgggatctggccctgtggacccagatgggttactgagcttggaacacgagggcttagtgacaaggaactgggaactgacctcaatggctgagtagcgatatggctccctcactcactctgtgaccttgggaagtgggaaggccacattctctctgagcctcagtgtcctcatgtgaaaaatatcaccgaagccactgtcatggggtggtggcagtgatcacactagagagtgcatggtgaggaagagctgagcacttggtaaacggcagcagctctgattgctagtggcagagatagtcatttcatgggtcacctccgagacacaaccaagagccctgcgtagccctggccactgtctgggcaagggcctgggaagggcagggtgtgcctggggagtgcccctggggtggggctctgccagtgagcaggggacgcacctcactccgggcacagcctttggcccccggccacccagcgcccgagatggtgttggaagaggctagtgcctgaatcagcagcctggaggtccacggcgcctcccgcaggtgagtgaggtgtgcccttcgtgttggctgaatcggccagaggggcggcgggaggccccgcctgccagccccgcatccccgcgctctgccgtttctccgcttgctggaccggccctaacc

SEQ ID NO: 104143 - DNA, 1037 bp, Homo sapiens
tatgcagcccagacacctgtcccccttgcttcccggcttttatggcgtttctcagccaagcagagaagaccaggtttcgggagctcagtcccttcaactgcaccaccagcttctgatgcgattctctctaattgctttctgctgtttttgccgtgtgtttatgactcagctaagggcagtacagtcgggaagtgtcctgcgcgccattttgcagacaggagggaggaagtgtcctgcgcgccattttgcagacaggaggaaggaagtgtcctgcacgccattttgcagacaggagggaggaagtgtcctgcgcgccattttgcagacaggagggaggaagtgtcctgcgcgccattttgcagacaggagggaggaagtgtcctgcgcgccattttgcagacaggagggaggaagtgtcctgcgcgccattttgcagacaggaggaaggagatgtagtgggatgggaagatctgggctctgaggtcagtccccgctggacggaaacctgcggccctgttagctccgtgatctggaaggtgctactagtagcgcctcatttttctccccaggagaaggagggcgaccgtgtctcatccctaactgcgatgggggctgaatgcggctgtgggcacatagggtctctctgtctccacccatgtctcctgctgtgtggcctctttccagcccatccacactctagttggtggctttgtgagtgctgacaatacttccatgtgcttttttgttttttcttttttgagacagagtctcgctcagtcacccaggctggagtgtggtggcgtgatctcggctcactgcaacctctgcctcccatgttcaggtgattctccctgcctcagcctcccgagtagctgggattataggcgcctgccaccatgcccagctaatttttgtatttttagtagagacagggtttcgacatgttggccaggctggtctcgaactcctgacctcagatgatccacccaccttggcctcccaaagtgctgggatgacaggcgtgagtcaccacgccc

SEQ ID NO: 104144 - DNA, 1041 bp, Homo sapiens
tttgcaaaaccgatgagacaattaagtaacatagataaggtttctcgtacagaagagacatttagtcagacatcagttccctttttataacttggagaaaatccaagcccctgagccagtttagaaggcccttcttgactctatctcttgtgagggaagaagttacagagaaccattgatggtttttgtcaagggagtggcgcgataagatctgcctgttagatcttcctggccgcctccgcctccattgtggggaataaatgagaggacgaagctagagacaggggggacctttaaggagtggtagcggaagcccatgtgaaagagaaaagtgcctaaattaggacattgtggggatgagtagaataaatactgagagatacaaggttgaatggacaggactcggaccagttggattgtgggggggagaatgaggaaatgaggatgcttcccagatttcatctgagttctgggacagtgtccttgttccaggcagagattggagaccaggaaaggtgaactgatgtgcaggtcctggcatggaaagacacagttgtgtggtggtgcagagaactcatgatcagggtttataaggacaggcttctggtcctggttctgtcactgcttctctttgtctttggacaaattataagggtcttgtggggctgggcccagactcctgctcctctgagaggatccctccagttctgatgctcagggagccagtgtttgtccttgggggtctcctcttcagagaggacatagggctgttgtctagtatgaacaggaacacagatggatccagggggaggatgggccaaggtgttagaaggtggacgagacaaaaagccaggcaaaatgagtcctcagtgtagcaaatagaaaacagcagacaaaaagcaaaaacagtgaggaaagtaattaagagattcttctcttttggtggaatacattatttctctaggattccattttatatttgaagaatcatagacataatgtagttggtggtccttctgagctcttccatgctacaaaaca

SEQ ID NO: 104145 - DNA, 1015 bp, Homo sapiens
acacacaaaaacccaaaaaacaaaaacccacacgagtcgtcagcttggctgaggacgccatatggcgttttgactcaaccatgattcagctcaactttgttgagagagaacatcaattaagttacactataaaaagcatattttagagtgtgctggcaatttcctttatttttacctatgccatgagctggaatgctacatggaattgtttggtaaggtgttctgactcagcttcaaaatacagaagtggtcagtgtgagccacctcatacattcaattatcttaaatgcatgaagtagacaggaaagagtttgagccagccgaaataaataaaaccaatcgaaataaataaggttaggattgtgaccaccagtaccctcagagcagagtttctcagctctttcattcttccagtcttttgtagtggtcactggacccaagggcttggtcactggactgtgggcaatgacactcaaaagcaaaggaactgtgggactaccagtagggtgagctgggccctgtgatggccacaagcttagagaagttattagagttaacgagatgatccataagtgggggatgctctttcattatagctattgaggagtttgtgtactgcttagaacagtgtctggcacctaatagacacagtttaagtgttagcgttttcgttgttggtgtcattgtcatcatcatcatcaatgagaatattataaaactatcaaaagacatttaaaaagacttaagtggtaagatacaccattgtattataggaaacctcaataacaaagacatcaatacctcccaaattgacctgtggattcaatgccattcataataaaattgcagcagggtttttgctagaaattcacacagattttctaagttatatgagaaactcctaggttttctcttactctctgaactgtcatccctttaaggcttttttgtttttttgagatagggtctcactgtgtcacctaggctggagtgcagtggtgccatcacagcgcca

SEQ ID NO: 104146 - DNA, 1030 bp, Homo sapiens
tctctcctgcactcagtacaatgcttggctcaaaggtgtggtagttctccttgattgtcattgctgctttcagacctttttcctccatagaccactccaacttttaatctcatgacatcagagtatcccttgtttaatcacttttgtggttaaaagagacctttgggtcagtctgcctcattccttgaagagtttagccctggctcacttttcactctatttcttctcctgtcttaaatcttcgttatttcattgtttatatagattttcctttcattatcctgacctcgaatttctttgactttctctcccttagtgagcttgacctccatcccatctcagacacacattgccataccttacttagactttatccataactgtagctgccttcccccacaatctcgagtcccaatccctgttttatcttctctttagggcccttgcttcatcaagtctttaacctcaccaggacctacagtcttttgaccctatttcctatttactaccccttttgtttttcattccccttcttaatgttcacattcccatcttgatctggcttagatccatggatgagtaataagagcattttttaatgtacatcctcaactccactgcctcctctctaaactttgttatgtttgcctggtaaaactccagctctggtcaaatccaacttgttacctttgcgacagtacccaaatagctgaacaaggctagagaaaaacatacagccgtgcagactgctctcactttaacttgctgatcactaactaacgtggcccttaatgctacctgtcagtcccgctgtttgccctggtcccttgactctcctgctccccgagtcaggtatttcatgctccaccctcttcaaacctccatcccatctccctcatcctcactctcagctctctgaaaataggagcaactagaagataatttccaggaactctcatcaccctctctgcccacctacttgtatctgtgcccgtagcctgcctttgcttctggtctgtggattagcgat

SEQ ID NO: 104147 - DNA, 1105 bp, Homo sapiens
gggactacgaggcacagaccatcaagcccagctaattaaaacaagtttttttgttttttttttttttgtagagatagggtcttgctatgttaggcaggtcttgaactctcctggcttctgcctctcaaagcactggaattataggcatatgaaccactgcgcctggccgccttagttcctttcatttagcacagtgcgtttgttctgatgaaagatgaattttcaatgtgatgaggacagtgggaaagaggaagtgtgtggtttttggggagtggggagaggactggtatgtttggagccctttaaagcaggggttgccagaccatggccagatctggcctactacctgttttttttatgacccatgagttaagaatggttttttacgtttctaaatggttggggagatgataaagtttcatgacacatgaaaattatatgaatttaaattttagtttccacaaacagtttcattagagcccagccatgttcacttgtttaggtgtttcctgtggctgcgtttgtgcactgggggagttgagagtgtgacagaggctgtttggccatcagagctggaaatattcactctctgaccctttacagaaaaagtttgtgaccctgcaaaatggattggtctgggttgtcaggacggcttcggaatcctggatgtgacagaagaggagagaagagtgtgaaaagaagttttgagttctgcgcagatttcaaaattttaccctaggctgtttgtggcaggagatacagatgtttttattttctgtttttgttcaatcctgcccagtcaaatcagcaagattatggttttagataacaaccagtgattgttgttttaatctgtgaacttgtgtggattttaatagtttttctcactggcagttgttaaactactctaaaccacatatgccagtttttaagtaaatctaaggtattagaataaatcttttaacaagtatgaaggtcttagttgtagcattacaatgactagcatgtagcttttttttttttttcagtaggaggtcccacctgatgattgaactgtaaaatgtgtgtgcatacagtatattagacctatctaacctgttacata

SEQ ID NO: 104148 - DNA, 1016 bp, Homo sapiens
tggccttgtgtctctgccagttactggctgagtgatttgtgcaagttacttaccatctctacttcacttaccttatctgtaaatggagaggacagtgttggcctcataaggctgttgcagagactgagataatacatgagaagtgacaagaacagtgtctggtgcatagtaagtgctcaatatgtgtagatcttttatttggtgttgtaaattaaggagctaaagcagataaacgtagcgtacctccccacaatagtagataaaagcagttttctgaataggacatttggaaatcataatcttttttttctgattcgtgataattttatcctttttcagagaaacagcacccaggactatcttccaaagagttctggatatcctaaagaaatcttctcatgctgttgagcttgcctgcagagatccatcccaagtggaaaacctggcttccagtctgcagttaataacagaatgcttcaggtgtcttcgcaatgcttgcatagagtgttctgtgaaccagaattcaatcaggtagttacacacgtaccttggattctgtttctttgtatatgtgcatgctggttctgtcatttggtttatctgttagaagttgttttgggctgggtaaggtggctcatgcctgtaatcccagcattttgggaggctgaggcaggaggattgcttgagtccaggagttcaagaccggcctgggcaacatggtgagaccctgtctctacaaaaaaaatacaaaaaattagctggacatggtggcgcacacctgtagtcccaactgctcaggagactgaggtgggaggattgcttgggccagggagaggcagaggttgcagtaatctgagatgatgccattgctgcaggctgggccacattgtgagaccctgtctcagggaaaaaaaaaaaaaaaaagttgttctggcatgatagtatcacccactgttattgcaggattgccctttacatctgctgggagaggccctctacaggccttgccattggag

SEQ ID NO: 104149 - DNA, 1029 bp, Homo sapiens
tcaagaaattttttcatttttacaaaagatgaaactgtaacttggagaggttaaataacttgtctgagagtcacttgttaagtgagagaggctgggaacattctctccatatccagacatctgactctaaagcttaagcttaacaagcagtctgcccttactgttctgagcttaagctcaaaagcagtctgggccaggcgcggtggctcacgcctgtaatcccaacactttgggaggccgaggcgggtgaatcatgaggtcaggagttcgagaccagcctggccagcatggtgaaaccctgtctctactaaaaataaaaaattagctgggtgtggtggcacacacctgtagtcccagctactctggaggctgaggcaggagaatcacttgaacggggaaagcggaggttgcagtgagccaagattgggctactgcacttcagcctgggcaacagagtgagactccgtctcaaaaaaaaaaatgcagtctacccttgctgtcctgagccttacacactggtcttgttgtggatgactgctccatcttgaccctggacaggtgacttggtcttcctgagtatcagttttgtcctctgtaaaactaggtaagcaatgtcttccaaacaggctggttatggggtgtaaatgagattacttatgtaaatgcctaatgcacattgtgtgctcagtaaacattaaatgtttctgcctctgcctcaggaatgaatgtacaacacaagtttatgttaatactttctttcaaagcagtcaatttttattttcttttttgagtaatatatgcaaactataaaaattctaacattacaaaaataaatactatgacaagtaagttatcggtggtcttttggtagggccagcaaagcaagggctgtgctgtttgtgatatctttttattgcatgcaacttatggttgggcggaaatgaaaatgaacatttaagggtgttaatttttctgcctcttcccttctaggattgtattattattcactgttgatttttaaaggaaaat

SEQ ID NO: 104150 - DNA, 1046 bp, Homo sapiens
ggaagcagttagctctgcatgtaaatataacctctactgctagggttgctatatttttcctgtaaagagccagataataaataatttaggctttgtaatctctgtcagatttctcagctctcccattgtagtgcaaaaacagccatagacaatatatgaatgaatgaacatgtctaattttgtcttttttaaaaaacccaggaacttggatacgattggtgttgctgttgatttgattcttctgtttcgtgaactgcgagtggaacaggaatctctgttgacaggtagcatgcaatataattcatggattatttatatctttataaagggttcaaaaccagtactttgagtattaacatcattcattgaaacacatgttctgtatttcatgagatagggaaactttaatagtgaattattaaagaattataaagttgtatcaacttcccttcctgaatggctgaattttgttcctttcacatttgtatgttgaagtctgtctgttccagttgctataacaaaatgccttaggctgggtagtttataaacaacagaaatgtattgcttacagttctggaggctggaaagtccaagattaaggtaccagcagattgggtgttttgcgggggctgctctcgtcttcatagatggtgcctcttgctttgttctcctgtggtggaaggtggaaggcagaaggcataaacaagctctctgggccccttttataagggcactaatcccattcacgagggctgcaccatcatgacctagtcacttcccaaaggccccatcttatactagcaagttggggattagatttcagcataggaatttcggaggggcacagatattcagatcatagcatggtcctaacccccaatacccagaatgtgactgaatttggagataggatctttaaagaggtaattaaggtaaaatgagggtatatgactggtatccttataggaagaggaaattaggacatggccatgctcagagtagagaccatgtgaagacacagggagaagatgaccatctacaggcca

SEQ ID NO: 104151 - DNA, 1048 bp, Homo sapiens
ggaagcatcagtactcaaaattggggaattataaattagcagtaaagtccgtgtttcacagtgtcacttggaagggcagctattttgaggtctctgtgtggtatagtaattgagaaagaaagttgagaatgtactgtgttttataattggtgatcctgatggggcgggcagtgtggcgctccagagctgctgtgctgtggtgggcggaaggaggtttctcttttaatgatatatgctaaataaagaagcaaaggggaagtgctgtacaaatgctgtgattaaataactattagaatggagccagcccctccaccatgtgctggatttcatcgccacttgcccacgcagaagcttttctcctgaaattatccccttgctctcaggcagcctctgtttttttcctctttactccatcattttcatcagcaagtaatatgccctcccatttttcatttaaaaatatcttcttttgactccatgtccccgtcagtccagtatctcgtttttctgctctatcccaaatgtgctacaaaagatgtatttagtttttacaatatatggtaaaagattatttcatccttcacaggattactttccactgaagcaggtagatgacctaagaaaaaatttaacggagcagatatctgaaactacttttatgaaccagtttgtcattgaggagtaaattggttatttggttgttagcttggctattcactcatattcactaggcagagagggcagattcttacagacctgttacatgttagctgtattaaatgttgttcttaatttaggtagttgcatttgtatgagtttaattgttttttattgatgtgagattcacatattgttaactattttaaagtgaacaatcgagtggcatttagtacatccacagtattatgcaactaccatctctacctaattaaaaaaaaaatttttttttttgagacggagtttgctctcgttgcccaggctggagtgcagtggcacaatctcggctcactacagtctccgcctcccaggttcaagcaattctcctgcc

SEQ ID NO: 104152 - DNA, 1020 bp, Homo sapiens
agtcatcctggtgggtgtgaagtgggggtacttcattgtggttttgatttgcatttcctaaatgatcacgtacttattggccgtttgtaaatcttctttggagaaatgtctatttgagtcctttgtccagttttcaattgggctgtttgtgtctatttcttgtagagttgtaaaggttttctatacattgtagatacttgggataatattgaatctatagatcaattggggaagaattgccatcttaacactattgagttttcaagttcatgaatatggaacatctctctatttattcaggacttatttaatttttcagttgtgttcctatttagtagatagcttgtgtttcgccacagatgttattggaaggatattattgaggcaggaaggaaaatggaaaggaagtaatatttctcatcaccttgaaaacggcagctagtgaaatgaccgaattttagttggaattcagcaatgaaatttggattcaacagtgaaacttagaaaaaattttatggtgtgttagttcaaacctaatacaaataatcttttaaaaagtattctggttcctaacaaagcgcctgtacttttttgactctttctctgtgagaactttattctaggtagattttttagcagggtatgtgtgccagttttttgttaccacacttgaggtaagaactgtaattacattgtcaaaataatatttagagtattattttcagggaataattgcagtggtatgacgaatatattatgcccatcaaattttatgtaaacacaagcatgagttattttaattgagttattggtgttgtttttggcctttattctttcttactctgtaaaaataatgttgggatttttgagggtcttcataacatttgcagtatttacataaagatcagttgataagctgtttggtaaagtaaactgtcatttgtacctgtctggagttttcttttcttgtgtctgggacatctttaagccttttccttttcagaattgtgttctgatcct

SEQ ID NO: 104153 - DNA, 1617 bp, Homo sapiens
ttatatattcgttattcctgaaggatttcattctttggttggggaagtaaaggaacaggcacataggttgtgatgtaagaactaaggtaattagggcaaatccagggtgtaatagaaaaacaagggagaggcttaagtgtaggtcagtcagagaagtcttaacagtttacatgttgcttttagatgatctcatttgatcgtcattaaaaaccctgtgaaatagaggttttgttattgtattttattttttataccagaaaacatattaagagaggttctttgccttcactttttatgcatttatgggacagatataaccaaatttgaattccagttttgtcaggtgctggctttgtgctattggccaagtgaagctaacaaattctttatctgaaatagatgaataatacctccttcagaagagtattatgaagtttaaatgaaaaaaaatcctgccatattgcataacccatgatataattgacaatcaatatgtcagtgaccttccccaggtcacctggctgatagctagaggagctaggagttatagcgaggctcctgactccaaattctatttcttgccccactataccatctctcctgtaggcatcttgtccctaaggactattaaagcagtgccagcagtcattgaggtatcattttgtacctgtcgattttttctttctaacaagaatgaacattttaatgttttataaatgtaatcattctaatctttttctctaatggtaagttatttgccttttgccttctgagttctatgtcaacttcaactttaatattttggatactttttattgtgactaagtttatatttactatttttacagtaaataatctacttattttaaagtgctataattctaaatcctcaaaagtattagcatgtagtgaatttgacaatggtattactgttatttttgtgttttatcatgttactaaattgggctaacaatctcatttccttgtttggaaggtcttgcttaaatcatccggacaaaaaaattgttgcctactcttcaatgattttgtttacatcccttaatcatgaaagaatgaaagaactggaggagaacctcaatattgcaattgatgtcatagatgcttaccaaaaacatcctgaatcagaatggccgtaagtatcttgttagaaatttgattgctttggggcatcctgacagatcactttccttgcagaggttttaagtaaaaatttggacattgtgataattgaacgataagttaaaacttaacatgtgttgacagaattagagaagattttgagcagaatctagagaacttgtgaatgaggtgaataaagtgaggcttgaattgagcctttaaggacaaagagaattctttaaggtggtgaggagcgggaaagacattcttggtgtatgaaaaaacagtgtgaaatgcccaggcacctttggagtgcacagataagactgttgtggctgcagtagctagttcattagatcagaggttggtgcgagccttgtaagcatctgtgcagatgagatagagactgccattcaaattgccccccgatacataatgtactgccacccttcatacataatgtgttatttctctgtg

SEQ ID NO: 104154 - DNA, 1049 bp, Homo sapiens
tgaaaccgtccccccacccctgtctatggaaaaattgtctttcatgaaaccagtccctggtgccaaaaaggttggggaccactggtctaggctgtctaatttgttggcacaaattgttaatagacccttagaatttttttatttttgtaagattggtaggaatgtcccctcttcattcctgattttagtaatttgagtcttctcttttttcttgttcactatagctaaaggtttgttagagtttttgctcttttcggagaaccaacttttggttttgttgattttctttacagttattctctatttcatttctttttgctgtaatctttattatattctttcttctgcgtgctttgggtttggtttgctcttctttttctagtttctcaagatggaaggttaggttactgatatgagatcttctgtcttttttacataggcatttacatctacaaatttcctggtaggaactactttagcatcccataatttaggattctgtaaattttggtgtttgtgcttttactttcatttatttcaaattatagtccaatttcctttgtgacctattggttatttgggagtttgttgtttaatttccacatatttgtttctaattttattccatgtggccagagaacccactttatatgatttcattctttttgacattacctaggcttcttttatggcctgacatgtggtctgtcatagagaatgttccatgtacacttgaatagaatgtgtatgctgctggttttggtggcatgttctgtagatatctattaggtctggttggctagatggttgatagtgttgtttaaatcttctgttttcttgctgatcttctgttctagttcttttcattattgaaagtgaattattgtgcattttttccttcagttctgtcagtttttgcttcccttattttcatgctctgttaagtacacacacacatgtttatatttattattgttataccttcttgatgcattgaccctttctcattataaaatttatcacaaattttgttgtttatgttttaacaa

SEQ ID NO: 104155 - DNA, 1099 bp, Homo sapiens
ttccttttgaagccctaatagtattttgttgcttgtagttccccagacacactgctgttctttccttcttgctgtttttctaagtcctttttttcccctcctaatttaaatgctatcttcttttccttcttctagggattggcgaaatacctcctctagcctgtttgatcttcttgccccctgtctgtcacccctcttgcccccagcctattggttagatacatttgtttctattatataatccttaatgtgtatctgtcagcacttaacatgttcttctgtaaattatctgactaaatatgggtctttattgtttggagaatatatttggcaatatggcttgtgacttggaatattgcgtttttgctattcttatgggaaaatgctttaaattctaagtacctgaattatgaatgagctttaagatctcaatttagtttgtgtatccatctgggattgcatagatttctattgacctgcccagattgataggaatactgtttgagaatttcaaatattatccattatttttaggaatattttacatcagagtgttgatcagctattttaaatgctgtagaggaaatagaatatgtatttggatttcgcttttatgtgaagtgacagtgtattgtagtagttaatatgcttcatttggttatcagactgaatatagttttattgtatttttgtattgttaagtgattaaactatgtgtcaatatatttaatgcttgcagtcaatttttattactataacctggttataatcagtatattccttagttcttaagtcttttcctcagatgccctctggtaaatataattcataattaattaataatagtgttgaatctttttagttgtcacaggggtactttgaagaactatgcctataatctttgccttggggtttccataagttgatctcttaagtttagatgagtgcattgcttgacaatgaggatgttttcttggtaacttgagaattcttaaagagtgaataatcaagccagtaatggaagtgtgacaagtctttctctggttcattatagcagttagcttctgactaaaccaatttaatatgttttttgtttata

SEQ ID NO: 104156 - DNA, 1045 bp, Homo sapiens
acaataaactacaatgaggtaccacttgatacccattaggatggctactatcaacaaactgaaaagaggaagtttgggcaaggatatggagaaattggaacccttgtgcactgtttatttcctactggtgggaatgtaaatggtgcatctactgtcttaatctgttttctgctgccataacagagtcctggagagtgggtaatttataaagaaaagaaatttatttctaacagtctgaggctgggaagtccaagaacatggcactggcatttggtgagggctctcttgctgtgttatcccatggtgggaggtgagagggcaagtgagtgcatgtgagcattacagagacacagtccctgcccttactgtgagggtaataaccatgtgttgttatgtacaagaatgacagtgctgtgtaaattcttaagcttttttcttgtgctagttcttttcattgttgtcaaaattagttgacttcttcacccagaggctggtagtctattcatgcagattactcggtggggaaattttggatatagactcatcatcaattcacgtggcatgattcagcaaaaatgagagcctacatttacatacttgtctggtctcctttccaggtgaattggagtgaatattaacaaattggactagctgctcgtggtaaacagcttgtgtagttttcaggtttatgatctctgtgtacggcatagtagttaaggacagatgctagtgctgccgcttactactttggataggttaatgagaataatagtagctaccccatgaaattgttatgataactgattgaaatgtgtataaaactctcagtgcctggcatgtaatggtcacccccgtaaacgtgttgcagggaagaagataattgactttggcatcagaaagagttcaaataccacctcagtacctctgtaacccagggcaaataccttaatctataacctgagctattgctatttctgcttccatgctcttactactattactgcaactacaagtctaacaactactgctactatgctgatgacct

SEQ ID NO: 104157 - DNA, 1560 bp, Homo sapiens
ttccatgcctaatttgagtgtatttacccttatttgctaataagcagtttagatgttcgtaccctgtcttctatagaaattagaattatacgtataatcccaaatcaaaatgtaattttgagcaaatgtgctaattgatttatgctagacagattgacctatgtgtgattcatttttcctaggagaaggaaagagatggttgaaaagaaatatttatttggtaacttatatattgatgtaaaaatggcacagtcttggtcttcagatttgtgtttgtgtaaactaaaataaatagtaaagtttcacagtaaagactaccaaatgagtggttaaagcacctggctcagggcacagattgaatcctagcttagactctcagtggttttgtgacactggacaagttaattaacctcaccaagccttatttacccacctttaatgtgaaactaatggcagtacctgcctcatggagtttttgtgaggattaagtgatacaatgtgtgtaacatgcttagctccgtagaaaatggtgaatgaatgttagcccgtttcactttgctgttgctagtgtcgtcgatgtgttcatacaaaaaactgagcatgtctaaaatgtccaattattttaatgttgaaagtaatggacataaaaggtgcattaagcaattctagtttctgtggccaagacacatcaaagaaatgaagaatttaaaaaataggtgattgatgaagattaactttattcatgtttttcctagctagacattagaagcaaggtaaggaatttaaaataataatattcccttaaagttgctttcctaggtatttttagcattgtataatttaagtattatagattcatgcagaaatcctttatgttttacagagttacactgttagaccttatgatagccaagataacgagtgatgagccactcaccaaggatgacatccctgtgtttttgcggcatgctgagttgattgcaagcacctttgtggatcagtgcaagactgtgctcaagctggcctctgaggagcctcctgatgatgaggtaagggaggcagatttcccaatctcgggtaaaagagaatggacagattttctaactcagccaagtcctgtatgagaattcttttttaaaagctttaaaaaatattatgtaagtaatgtatccatatatgagaatagttggaaaatttagataagggaaaacagtgtccttattcctaccatccagagtcaatgacttaggcaaattctggttaattttctagacagatgacatcagatacatgcacacagacgtagacatgtgcacatatgtatctattaaaagtggagcctttctgtgccttctgtttgcaggttcccattttttcttcggaatgtaagctctaggagggcagaaattttgactgttgtgtccatagtactatgtatatggtaggcactgaacaagtatttgctgaatgaataaataaataatacattgtaaatgtctttttaaataaatgccaacataggctgggcacggtgcctcacacctgtaaccccacttcttt

SEQ ID NO: 104158 - DNA, 1036 bp, Homo sapiens
acataaagttacaaagtttcagccaggcgtggtggctcatacctgtaatcccagcactttaggaggtcgaggtgggcagattgcctgaggtcaggagtttgagaccagcctgactaacatggtgagacccccgtctctactaaaaatacaaaaattagccgggtgtggtggcggatgcctgtaatcccagctactcgggaggctgtcccagctactcgggaggcggaggcagagaatcacgtgaacccgggaggcggaggttgctgtgaactgagattgtgccattgcacttcagcctgggcgacagagcaagactcccatcttaaaaaaaaaaaaaagttacaaagttttcccctttttgcccagcctccatttgttttctatagatctgcatatccttttttttttgttttcttttcaaaggtctttttttgtatatacacacctatatgttttttgttttcattttttgcactattcttcaacttgctgtttttacttatgatgtaacttgtacatctttgcactttagcatgtgtatattcattgtatgtttttaatagttgaataatatttaactatatagactcatcataattttttcatttgttccctatagactttccagctgctttcaggttgctttttttttcttttaacctttacaaataatgttatagtgaacatccttgtacaaatttcggttaagtaaatcaaatccaggttataaattcctggagttgaattgctgggttgaagaattatgtgtatttaaaaactttagagagatttctaagttgcacatcagtgcaacacaagattgcacgagttgccttttgcagatctgatttaattactatttctcgttaatgtttttcagtgaccattatgtttgtttttgcatattaggttactctttaaaatgcatttattaaaaagcattttctggaaattagtctttctgtcatacatacagtaaactattgtttacgtaatttttgtttgaatttatttctgatgttctgttagccttgta

SEQ ID NO: 104159 - DNA, 1177 bp, Homo sapiens
tggtttctgtcatatgcatcattatggatagatattgtgttttagacttcattgactgaagttattagaaaagttctttcataaagaagttgagattggaaacctttttgtaagaaggatgctagcaaacttttagctaactttttttgtagataaatagaaactctgagttggggtagtcattatggcttatctccccaaaactagagtcaaaaaatttaaagcaaaggcagaagagccttctaatcattttttgaagcaaaggcagaagagccttgtaatcattatttaaataaagctttctgtgctctacctttagcctattacaataaattagatttgtctatggaaaactattagtacaacatactaaaagttacttttctgtggaaaatgaagtttactcttttggttatagatcttttgcgggtgattcatgtagctggaaaagaaaccacaaacatcttcagtaattgtggttgcgtgagagcagaaggtgacatctccaatgtggccaatgggtttaagtctcatctcattcgtctgattggaaatctgtgttacaagaataaagataaccaagacaaggtaagaggatttcttagtatgtattatacatgtatggcttcatttagaatatagtccttggaagacattcactcttttggagtgaaagcttgaggtgcttagaaagtagcttggatagagagatatatattttatatgaatacacacacacacacacacacacacacacacacacacacacatatatatacacacacacacgtgtgtgtgtgtgtgtatatatatatatgtatatgttaatatataggctctttggagcctagacaaatttctaacacacagtagatatttaataaacactagttattattgcctattatcttaaaaaacaaagcttagatctatatcctatgtttatggacgatagcatcataagccttttcttctagatgttttaaaatggatataaaaggaatataatatttaagtatgaagtctttgaggacctagtaggctgcttttagaaacctcttatgtgcagaagagcttaaaggtagttatattgagaatgtgagagaatggtaagaaagatctcagggcagttggaccacatgcttcagattgatctcgcctttctgtatttttctgg

SEQ ID NO: 104160 - DNA, 1159 bp, Homo sapiens
tgagggcaaccatggcattggaaagtgaggggggaattgtggaaagtagaaaacagaccccaaactctgggtgtcagctacctaaatctctgctaatggctgaatcacacgtgtggggcaggctccaggcagctaagctaaggatgaagtcattgtattgagatttgagctcccaccctagagtttatagtattaagtccaacttacactgtagataattaataattgccctctaaaaaaaaaaatcaacactctttagaggaatataatataatccagaattgccacagcataatgtatcctgtaatgtccaggatacagtttacaattgcttgacgttcaggaaaatgtgacctgttctcaattgaaaagatgatcagcggagactgactgtgagaggacacagatactgggcttagcagacaaggattttaaagtaccaaatgtaaccgtgctcaaggatgtaaaggagatacgcttcataagagtgaaaaggtgggatatctcagcagagaaatagaaactataaaaaagaaccaaatggaaatcctagaactgaaaaatacagtatctaaaataaaaaaaaaaaaataccgaatgtgcttaacctcaagaaagatcacagaggaaagagccagtacactttaagatacatcagtagaaatcatctagtctgaaaaacaaaagcggggagaaagattgaaaataaaacggccgctttaggatgctaaatgttagggtaatttgttatgtagccgttgatagctggaataattcctgtgagacatggcgcagaaccaaacgctagacaacttgcacttttagtatatgggcgcaccattttggcaatcctcatcttcaggagagtgagactactgattccccccttgggaaattactggactgatttttgcaaaagaaagttgatagcgaataaagcactttacctttttaatgaccaggactgcctttcttgagcacaaaagaggtggtttttcttgtgtttaactattcttttgttgctaatttggactggcctcttataggaacaaaatgcagtaacccttaaaaggcttgcgaaataactcactgaagtcaggatcagattgcaccataagtaaatatggagtgtgcccaagtgctgctgtgcagaggtcac

SEQ ID NO: 104161 - DNA, 1618 bp, Homo sapiens
tttactatgtccttgcattgtgcttagtgaattacatatattatcaactttaatctttgcatcagccttgcaaagcaggttctggtaaccacattttaaggagaggccatccagttaggtgcagagcccagggtagaatttggatttgtttgcctattgagttcccaggcctgtgctcacttcctgccccatggtgagaacttgccaaaaggttggagaaaagggtttaaaatagacttcctgcaggacttcaggctggaggctggtcagtctgcgtctcctaggccagccaggccccttagactccctcctggttgaagttgggagctcttgggggtcctcttatccttgtttctgattcacccattcatcaaatacgaatgtttgctggcttggggatcctttgacgggtaattcaggcaaggtattaatatcttctgtggagcttccattctggcatcatctggggaccatgcttgcctctttgaatcagaatctcaaaactactcatgacacagattttcctaaaatctttgtgtactgcctgattcctctgaattttgagcaagactctttcaagcccaactgtgtctgtgttgtctgtgtaacttcatccattgcagtgagtatggtgcccacctgctggatggccctcttacacttgtgtggcactttccattttccagagctcttttcatctgctttagtttgttggagccttatgatacctctgtggaaagggctgaaaagatatttccaccatcattttctaaatgaagaaaccaaggccccgagaccaagtgtgatttaactcagctagcacttgctgagtgagaattgccgtgtgctgcatgctctggagaagacagtcgctttagtggtggaatgacacatgtccactaggagctgtagcaaaagtccgtgtggtgaggcctgtcagaaaggaacaggggggtgatgtgtcctctgggctggctgtgccaggagcatttctctctaaggacaggcactggactgccaggagcatggtatcaactggaaggatggtcatctttctttgagatacttgtctttgggcaagatttaagagaatcaaggtacgttgcctcagattgaaaatctgcacagaaatgtattttatcccaaattctcatgagtctttaatgcttaagtctgtacacgtgatagatgtagtgtttcctgaattgtaaaggaattgctagacttccctttacctcgtcatggtagggaggtgtcaaatccttactgacttctattcttaccttgtttttttgttctcgacttgtgtagtatttccttgctacaactgtagtgattagtttacttctaaacttttgtggacctaaatggagattctgttttggtttctattgtaagaagcacaaagatactaatgctataaacatgaagaaagcattcttcagcttcttctttgttagaataaggaatgtatggtttacctttttcttccctattcttcttcttttcactattgtcataacctctttaagtgaatctttattagaagaaaaaccaaacgtttatttcataaagctaagtgcatttttcaaatcggacagacagatgatctagttta

SEQ ID NO: 104162 - DNA, 1195 bp, Homo sapiens
atttacaaagactagtaaaaatagataacttttcaaatgaaaattaatgttcctttaaattctgagttctgtatttttgaaagtctttttttatgtttgaatatattctaatttactgtaatttgccatcgttttatttgatccaaatcatatatattttagattataagaacatctgtattgtataatatttgcaagtaattaaaaaatattttttaaatcctaggtttaggcttcgtagatctgaatgcggttttttcattaatcttaaataaaatttaagactgaatttacagttgttaaacattcataacatgatcaatttttagtgggttttttggtggggtgtactattttccaccctttttgtatctagttgcaaggagccaagaacaggcaaattattaactcctttattatttcctcctgtctgaaatgttttcaagcagcgtatttgtctgttaaatcatgaaaaactgaaaaaaaaagtctatggctatttcctaatgattttatttaggttgttgctcttaatgaggattagtacctgttttgtacatcagtactggctgacttgtcagttactcggataattgatcgagtgattgctctgcagagaaataaataaatgcttaactaatatgtgttagtgtttttctttttgcaactgtaaaataggccggggtggcatggcccttggtgctcaggcagggccagcttctatattctcagcctatactagcactgtgtggacttcccaaccttcatactttccctgagtgaccttaacttggccttcagaactcaaggtcacaggtaccctgttgacctgtgcagaaacactttctcttctacgctcctcactatactcttctgccctctgctcaccccctgacttacactctacctataatcagtttctgtgggtaaataggttatgggttgttgattctgatgcatatttcagtatacgtgtgctgttgtttttggttttacttaataagtgtttagtgtgatacacatacgtaaactgatcaccagcagaactgtgacatatgaaacactttatttgggtatcactcaattttactgtagcagcctccatcccttcttagttataccaccgttaccaccacttttgtccttgctcctcccttgatgttttgtctttcatgaaacccatctcccaaggtct

SEQ ID NO: 104163 - DNA, 1001 bp, Homo sapiens
ccatgcccagcctctttgttcttcttttatactttgtacacctcttaacccttctttggccaagatctgggggctttagcaatgacaatttcaattatactttcagttgaaagatttttaaaagtaaaacgttagcattggatctggagaattttgctaactgagataattaatagctgggctggtggtgatagggtttgtgtgtttttgagagagagagagagagagagaggaagagacagacagagatggaaatataaagatcattcttccactgttatatgtgttttttcccctttaaaggaataggcatttgaatttcctctctgttgtcaggtgttctgacttgggtacatcagctcttactgagtgcttgaatgttcaggatttctatgacatatctcaatctaatgaaaatctgactgtgaaatgtctatatatctccccaggcttcgttttcttggttaaatgagaaaagtgctcttatttcaaatgttggaaagtagctctacctttttctggaaaaaaaaaaaaaataaaaaaaaaataataataataataataataataagatgggaaatgtctgtcccacatctaaagcagttttgatctttagcatatttagtttttttttttttttttttcctggcagcagctgaaaattaagaggatcaaagttatgttcctataaaagacttttttcctgtcagtgcttgaaggcattgtctgactccccccacccccacgttttaaaagctgattgcttatcttattcaggtagaatttaatttcatgcccatcatattctaatagaacaaaaatgatacttagtttcagactgtggattttagtttgaattcaaacctactgctatattgcagttaaagttgggaatattttttactccaaatagaaatgaacgtgctattttggcatagtggtaagagcttgtagttcaattcaacaagtatgtgtttgccatatgctgtgtaccagccagt

SEQ ID NO: 104164 - DNA, 1032 bp, Homo sapiens
agctatagccactgactttgtgcttggaacaaaatacataattctttttggttcaaaagattagattcaaattattggtcatcagaaactgaagtttcctaaggcatatcacacgtaattcaaggttgctttgatgtgttattctgctaatccacaaccatggaagttcctggttagtgcaatgtttcatgctctgacagctatctttaagatgttgtttttgggttgccaggtgttcatttaaacacactggccatgtgtttgcacacgcacatgtgcatacacatagccactgcggagcgccaggagctgtaactgaacgtggacttgatagagcagtatgcgatgtttttgtcttcagggcaagctcttgatgcatagcttcatgtgacatctcgtttataacagcctgaggcatcagtaatctttatagcaagaattctagtgctgtgttatgcataccaagcttaccgtttattctgcccagtaaatacatggcttttatggagtcataaatcatgacagtaggagtcatacctctccaaaaaagaagagatttaaatctttagagttaacaagatttaatgtaatttagacattattcttacttagaagtaccattcttatttaaaggcagtatatctcatatctttaaagataactttagaaacttactgccagagaaacaaatattgattaagagcacactgtgtgccaagcattatgcgaggtgctggagagaaggaaggggaagaaaaggtcctcaccctcaagtaacttgaagcttagagggacaatgataaatagtaaaagattctagagtccgggcatggtggttcacacctgtaatcccaacactttgggaggctgaggtgggcggatcacctgaggtcaggagttcaagaccagcctggctaacatggtgaaaccctgtctctactaaaaatacaaaaagtagccgggcgtggtggcgcatgcctgtaatcccagctactcgggaggctgaggcgggagaatcacctgaactcggga

SEQ ID NO: 104165 - DNA, 1114 bp, Homo sapiens
ccctaagaaaggaaggaggaacagggggaatcttgaattacattctttccccacgtggagatagatttgtgctaattccacaacgtggaacatcctccttcgtttgcttagacttccctgggagcagtagcccatgtactggtggcctagctcaactgtggcttggttctgggcctgtaaagccatctttcccacctacagatgacattccctatcttcatcatgtgcttttagtcaggtttcctgcgggccagatgcatctgagagtgtgccctcattaatatgggactctgtgtatgtccagcacatgtggggtttattcacgtaccagtgattattattcaacatcgttccctttagtgcagcaagcactttctgagtgcttaccatgtgccactttctgtgaacctctgcagttcaacagtggagtcagaggcagtccttgttctcaagtagctcatgatctactgtgggagacagatggctagatgatagggtgtagtcatatcccattatttctgataccccaaatcttgatcagaagccttgatcagaagctaggaaggcttctgatcaagatttgtggtgtcaagaataacaacgattacagcaatagtagttgcttattgagtgtgtcctgtgtcctaggcacagttctgagtattcgtctcttacctcatttaatgatgatacctctcccatgttgcagatgaggagactgagggccagaatggttcagtagtgtacccaaggccacacagctgttaagtggcatgagaaagaaagaaactttcattttaagcctcttagatttttgtggattgtttgttactgcagcacgaaccagcccatcctcactgataagagccccagtgtgcggagtggattcctgagccagttaaaaggttgctacagcagtggaggcctggttggagggtggtgataagcctggaaataaaaggacatatgtgagagacagtaatttgataaagagtaatgaaagaggaagctttctttcaggtagcttattctgtttcattattgttgttttccttttgggaaagaagttgaattttcattgttggcttatgttttcaagggtgacctcagtatt

SEQ ID NO: 104166 - DNA, 1105 bp, Homo sapiens
agttgtggtcttaactgaagcaggtgaatggaccatattcgcctttaagagccttctgactcccaggttttctgatttttaaaaacttcctatttagtcatatgtttttacttcactttatggtttaagtgagccaaccaacaaaagttactcataaaagatagtattttacttgtaacaattgcagaaaaagtgaaaagcttgacattacaggtagaaaggaagtcagtctctgtcccctgtgcgtttccgagactgtgtttctatttatttgccctttgtctgtttcccctgaccagcgtgcgtttctttctggaggcgcagggacctcggcttatttttctctgtctttgcattgcttgacagagggcctgacccagggtaggcactcccgcttcatgactacatctcattttttatttatctttgttatgatagatagcagataaagcagttgatttcagtcagaagcagaccacagcagcaggattctttccacggtgcatgttctggctgagtgttggtgggctccaccctagccgaacctgtgtctgcacacctgttgtgtcttcctgggaggctcccaggcatgctcctgtctggccagggtgcttcctcctcgctctccagctggctgaagggaagctgggcaagagtgtatgtgtttaggccacagggagagcacagactcccagagcatgaaccaaggggcttccaggcctcagggactgcctcctggtcccccagaggccacctcactcttactcctgtctccaggctggtgacctcacatggccccagccatctctccacatcctcccctccctgctgtggagcccccactgacagatgccttccccctgtgttttggctccaaattccaagtgagagtaattgcgtggcttcccttgggtctgtctccatccctgttgtagtccctcacagcccagactgtggactgcagaggcatcacctaggggcttgtctgagatgcagagtctcaggctctaccccagcatccggaatcagaccatcctcaggggattggaatgcacagaagcatttaagaagcgctttgtaaagccatggcctctcctgcgcaaag

SEQ ID NO: 104167 - DNA, 2012 bp, Homo sapiens
gtttctacttgaaggccaagcagcctggtttggaagcctgcatggctcagctgcccactagttgtgtgatctggggcaagagtaattgagccctagctttctcaatagagaaaatgaaaatcatgcattatgtcttgctgcattgctataaacacaaacgataatatatgtaaagtatatcacgtgatgcttggtatatgaatatcacccaaaatactaactgctgctgccagtttttttaagcattggtattctaattaaattatgtttttgccagtgattctgagacaagagtttttaaaagtttcttcatggaaggatctgtaccgttttcagctttttattcctatgcatcatttttgcacataatttctcaataaatgtatcaagttgaactttttgaggcaaataatatttatgtcatttgaatagtggacaacgatgaacttgaatgactttatgtatgcatgagcattaattttaaataaaccagaaagctacttttatatttcgaaaaataattcatttgggttttcctgttcaaactttgccatgttactcctaagtgataccttacttactgagatggatcagccttagggagaggtttgtcatactttgttacacactgaatagcctataattatcaagattatatccagttagcataaagtgctgtttagtttctgttatgtcgttgttaccatagctggagtcgggtgggtgtttaaacctttgtgaactcaaaattctttaatgatgatggaatatttcatgttttagtattctcttgatctagagtatatgttcaaatgttttaccaggtatgtgttttttacaggttcatataatatataaaatgcatttctgttccaagaaaaatacaagtggtaaacagttgggagagagcttgcatattttcctttattgtcctgtctgatgattaatgcattcagctatgttcagcctcacgtttaaccaggttagtgtttagtttggttaggctgttttccttatgagaacagaaatggccaatcctgtgccctgcctgtcttccagatggagtctttgcattgtttccagatcacagtgcttaatgtaaggtcagattttcttgtgaaaacagattttggattaactatgtctgtgcacttgcacgcacccctccgcacctgcctgttcacttaagctctagctgcctgctggagtcatggttctgatttcaagatgcaaatgagaattgagattctgctttatagcctaaaaatgcaaaagcaaattcctactgcatgaatggtctgcaagtctccctttcatagagaccatgaggtgtagtggaaagagcttgattcttatgaggatttaatgtaggggtgagcagactatgctgtgggcctctatttgtaaataaagttttattgggacatagttgtgttcatttctttaatattgcctatggccattctcacactacaacaacacagttgagtagttgcagtggagaccgtatggtttgcagagtcttaactatttattttctagccctttacagaaaaagtttgctggcccctgacttaatgcaataaaaaactcagtagtttgaatcccagctgtgttatgcaatagctgtatgacattgatcatgttctgtaacctctttgtaccttaatttttcccctattaatgtcatttatccatttactcagtgagtatatattatgaacttactatgtgccaggccctgctccaagctcaggaaatacagcagtgaacgaatactggcctttatggagcttgcgtctcagtgaaacttatcttcatgaggataattgtacatgcctcctagggaggatgagatgaattaatatatgatacctgtaaagcataagtagagtacatgctcagtgtgttcgttattatgctaactatagggttgttaatgtgtaaaacaaagtagaacctctgttcagagttggaacccttataagtccgcgtttactattcttgaggtt

SEQ ID NO: 104168 - DNA, 1034 bp, Homo sapiens
atatagctagcttcttaaaaatcagctaatttcattcattatttaaacaaagattttatctgctagttgaataattcatgagaaaattgcactaaattcagatgtgaatgtttgctaaagaaaagatagttgctaatttttctggaatttggtagttgaactcagagaatatttgtattaatcacattgtgttttgtacttccgggtactttaagagcctctgccattactattcttgaaaagcatctttattttgtcacaaaagcttggagaatgctactcactactttaccctattgagttttgccatagaactgtagtatcattctctctggattcctttctttttggaggtgtcatggggagcagggttagtttatgggatgcagtctctgacattctcggcctcactgtgttcccgtgtggccactgaggccccgtgcagtggtgcagtccttgtgtgcgaagctgggcgccagtgcagcccgcactttatcacccttcctgccagggcattgctccctggtcggaaggattgttggttcttccttacttaggtctcgtacccactccaagtgcaatgctgcgggcacatctcagctggtcagcaaaacttgtactattaaatgcctttatctcataaaatcttaatttataaaatgtaggcagctggaggaatgctcagccttcctttatggcaaaggaaagccccaaagaacattttttacctatcaaaaaagcaactttaaaaatctgcagcatcagtaattaaaagggaagcacggacagttctaggggtggtatgaattgggagaaccctcctgggaggcattttaacagtatgtctcaaagacactcaaagatggttttgttttgtttttgtccagtaattcttttcggaatttctccaaaggaaataatcagtgatgaggttaaaaaaaattgtctatatggatgctcattgcattgttggtgaaaatttagtcatgatgcaaatgtcctgaaatgttcagtaaattatggtaggttatagt

SEQ ID NO: 104169 - DNA, 1036 bp, Homo sapiens
atccttgatttctagagatagaacattttaaacaaagaccttttaaaattatagtattttattgaatttatttttctatatcagtgccaggagacagtatccttgtgttttttttctggtcttagcatctatgtaaactttcctttacctatgacatttactatgggtttctgacacatagcctttttgaagttaaaaaagttctctagttttctgataatcaaaaaaaatcataaataggggctaagcatggtcgggtactttttctgtgatggttgatattattatgagtacattaatgaggttcattgtagattttctgatccacttgaatctattcttgcatttttgagaaaagtctgcctgaacatgatgtattattgtagcatctttgatttagttatgctaatattatttctagaatattttaggggaaggggatctattttcataagttaaaaaggcctttaatttctttacagtggtctgtctttcctggttttggaacaaagtcatactagccttgtaaaatgagttggaaatctttccttatttttctgttgttttggaacaacttgtatacaaaatacatgttctgtttcttgaaaattgggtggaactcgcttgagagctatttgcgtctttgtgtttgttagtgagtcttggtcattttagtatctttaaaaatttttgttcttttaatattttttcttattttcttcccaggcacagtttattttggaattcagataagaactgacacttataagcattccaaatgttaataaacattttttcttcaaggcaattaccttttcttaagctcaatcttagcactatcctttgcaaaaacaaaaattttaaaaaagtctaaatagattaaaatagaagtcaattctacccttctcatagaaattattctgaaagaattagaagattcaatgatataaattagattaagaggaggtagacttaaatttagtacctaaaatataattatatttcactaaataagaccgttattcttctaaagagg

SEQ ID NO: 104170 - DNA, 1034 bp, Homo sapiens
tttcccaaaggagcttggttattaaagttgggcctgtacccttagcggagtgcctactctggcattattggctaatgtgggaaagaacagttcccaaatctatttgttgtcctctgtttacacttcatttccagaggctaaatgttaatttgtttaagccaggcttattgtctcctggagatgcactaccacgggaaagtgttgactgagcttggctcctcagtgtgaactgtaacttgtgactcattaattacgggcctacaatcaactcccaacatgttagtaaagaaacaaacaactttcttgtttaatgaagtgctgacagaagaaaacttaattgtttctctcctgccccaacattagcttgacacttgtagttatagcagtaaacttggactttgtaaaaacaaaattgtatcgtcagtcacccttcctgaaggtgctgtattggtgtctgcttttcccagtgaccttaacctgtgttcattcttaagtatgtaattgtgtatttgtcataatgccgctgtcatccttgtccagaataggtcatttatgttgtaaacgtttaatgaacttctataaatggttcccttgtatcctttcctaatgcagctgtatgaataagaaatatttatccaggaacgcataccctcagttgacacacaactccagtggaaccatgatttttaagaactctttagttcacctttattgcctgcttaaatttcagtttttaatgtgtgatttcatttccttcaaagaacatcttacccatttagcatatctcaagagttctactttttttttgtagaaagtgaggtgttttccatgcattgaataataaatcccgaatacttttatttctcactaatcaaaaaaaacctggtttttgaaaataaatttgaaactttgcctaatgcagagaagaagtgtaaattcagccctgttgaagtaattattcagtttcgtcatgcatttaggagctactgcccaaccccttgttcctaaatgaactaattgcatttaacagtgtg

SEQ ID NO: 104171 - DNA, 2224 bp, Homo sapiens
tcaaattttaaaacctttcccctgttgcttccggattgaatcatagttaggaaagcttttcctattcccagcttagaagaggaattcacccatgtttttttctagtactgattttctttattatttaagtttagatctcatatctatctggagtttatcctggtgaacaatgttaggaagtgatctacttagattcttttttatatggctacctacttgccccaatatttttttttgaagtccagtgaaaataaaataaaatatcactttttgtttacatgtctgttttatgtagttctgggttgatatagatatttcagataatagtgcaaacaatattataacattgagtaagaaaacacaaaaggaacaagtcatctgtaatctctgactatagccatgctgttttcagtgtataaacttatcttctttctctctaggtaaatgagctggatggtatcccgttgatcctggacaactgcaacatcagtgacagtaacccctgtatccttgcatgtgaattaccatgcacaagtttacagccggggcccttagcaaaacaagtcccttgcctcatgttcattcagtatgtagctggctgccttgcttgcttgtttacttgttcctgagaaccaaatcattttctcagagttatggtgctagaatatcatttctgtaacctttgtagtatggtaagctagttttttcatggtgaataagacattccaaatgagcatgtggccaaaaagcactttaaaacctggggcacaggcagcccatgcaaggcactgtgctgcgcatcaccggtgtcacctttccagtgtgtgtgtggtctctagagtagacacgaactatggcatattgttttgctatagagattctgagtacccagtcttttggaagtactgttttaacaagggtttggcaacgtagaaacatgaggagcactctggctccctagcaagaggaaggagcatctcagtggtgctgaattctcatcttcggagggtttgtcctgcagccctctgcggcagaagctgagagcactggctcttgccctggcttgggttggccacccttgctggagggtgttctgcagggaccctgcttttttcctaccagttcaactagttgtactatacaaaactgtacagtggtgactaaccagggaccggatacagcttgtttagatttgagataaaacctactgtttaatttcacgaacttccctggtgaaagccaaacttagctgtgtcccttgtcctggtcactgcttggctggtggtggggcaggggtgaataaggctactgcaaggactgggagcgtagcctgcgggaggcagtgaggagcctagcctagcattgaggagactgaggaggggggcattttaaaaataaaactatggcttctgccaagaagagaaaagcagctgatgaaaatcatgtgtttcaaagtaagtagactgagcgatgcttattatttgtgctgaagatactgtcatttgtctgattagcaatagaaaacaatcttattttaaagagcacagtagcttgtaagttcagtcaggaaaagacaaatacacagcctcagaagactcctctgcagggtaaagcaaatttggtttagtgcgtggcattatcatgagtccctgaaggctgtgctcattaaagagtgttgacatttttttagccccccaaaaaggaaagaaaaaagaagaaagcttctagtcatgggaaagcagtacgagaatgttcaggtacaattgcagatgttgcatttcccaatgaaaacgatgatttattatgaaaaaagaaattcactcacagtttacttttacattccctgaattgaccttccagtgaagcagggtgttcattgcgtctttggcttttagcaaagaccagaaaataaaaagactgttgtacacgagcacattgtaggcctacagatgctcgcagcaccttccaccttggtgtcctccttgccagatggccatccgttcattcagttcttccttcaggaaacattcattcagtccctcttgtgtgtttacacccattgccttattgaaccctgacaacaccatgaagcagatactatgattatcatccgtatgttgtagatgatgaaataaaactgagtctctagcttgcccagaggtcagaaccagattttatacatgtgagtgcctgaccttagccacttccccacactgccttctta

SEQ ID NO: 104172 - DNA, 1039 bp, Homo sapiens
gcttcctaagggcagggatcaagttttctgtgtttcacctcaatataaatataccattgtcttgcatgtagtagataaccaaaaaatatttcttagatagatacctgaatgggaaaaggaatgaacaaataaatgagcaaagagcagcttggtgaaatatgtgtatgtgtgcgtgtgcatgtgtgtgtatttatttatctggggggagagggtggttctaagctcaagagaaatgtctcccatgagttctttgactcgggtaaattaagtattcttggtttgtcagtcatattatttaaaatttggtttaacccatttttctagtaattagcaccatccaagttttattgaatttaattttagtattttgtgttaaaaagcaatagatattttgggcatgctgagactaggaattagtgctggtgtcgaatatccactaataacaccaccactcttctctgagcactctggataatgtccttcttgggacaggagtgaggcctgggatgcctttggataggagtctacccgtgccccatgggacatctgcagtcaggactgtatagaacattccacttttgtcggccaccctacgggttaggaaatccaaactggcctgtcagagcagattagaagcaaaaactgccccacagtaggggatggggctggaagggttccttttccgtttcttggaggtagcttttagagaccaccagggatttccaaatccagggaaaaggcaccagctacaaggggaagcttaactctgaaggaccgccctgactgctgcctcctcagggacacgagcccaactagtgcccagctgttcactcgcccaactcacttttgggtcacccacagtaatgacacagtagccaatgccatcggaaaattccagctccgctaccacagaggcaatttcttatttgtcagtttattgtgggattttttgttgttgttgtttccaaatagaaacagctgaactttatttgaagtgttttttctttcattcttttttgatctgtgttttgatcggttg

SEQ ID NO: 104173 - DNA, 1641 bp, Homo sapiens
aaatgcagatacatgtttattagaagaggagtcctcatcccctcagccgcagacctggtactgggcagcacagctggaggtgagcaagcatcaatcaccacctgagctccgtctccggtgagatcagcaggaggtgagtgagcatcagtcaccacctgagctccgtctcccgtcagatcagtggcggcattagattctcataggagcgtgaaccctattgtgagctgcacatgtgagggatctaggttgcatgctccttatgagaatctagctaatgcctgatgatttgaggtggaacagtttcatctgaaaccacacacccccatccgtcctggaaaaattgtcttccatgaaacaagtccctggtgccaaaaaggttggggactgctgcattaggagacacgtgcaagaatgctcacagcagccttattcttcagagccccaaagtagaaataacccagatgtgcagtagtggaataggtagttaaattgtggtgtgttcatgtcatggaataccatacggcagtaaagaggagtgaactgctatgtgtaacacatggatgaatctcactagcatgatactgagtgaaagaagccagattcaaaaagaccatgtactgtacagttcatctacctgaagttcaggaacaggcaggattcatctatggtaatagaagtcagaataatagttacgtggggtagaagggtagggattggcaggggaggaggatgctggacatgttttcagtcttcctgtggtggggagtcacatggaagtacacgtgaaagaacttacctaagatgagcagtgcaggtaggacattctgctgcactcgtattaaaattgtttaaatcatttattgagtgcttttggtatgccaaatcctgtgctacattttcagaacagttctctttgggtttttctgttttgttttcacttttttcctttccctccctccctccctccttccctgccttccttccttcctttttcatggtgtcactggaagagtcctctttgttggaaaaaattgtttccattttacaagtgagaaaactaaagctcttgagagttaaagtagctggtccaagctctcctggcttgtgatgggaccagggtgtaaacccagctttctctcactccaaggctttggtcctaattcagacgtttaaactccacacaggtccttcatccatgtaaaggatgaatgtcagtgtttctttccattgtaattccttgagggacaggtgactatacatctgtgttggatacaaaatctttcattaatcctactgagcatctagcacgtagtaaccactcaataaaattcactgtctggccaggcgcggtggctcctgcctgtaatcctagcactttgggaggctgaggtgtgtgcatcacttgaggtcaggagtttgagaccagcctagtcaacatggtgaaactgtctctcctaaaaatacaaaaaaaaaattcgctaggcgtggtggcacgcacccttagtcccagctactcgggaggctgaggcaggagaatcgcttgaacctgcaaggcgcaggttgtagtgagctgagattgtgtcattggcacgccagcctgggtgttgcagcaagactctatctaaaaaataaaaataaata

SEQ ID NO: 104174 - DNA, 1087 bp, Homo sapiens
gaacgaacacaaagttcggtagtcacaggacacccttgccgtgctgcataatgatgtctcactctgtccccaggtggctttaccaagccacatcactgacgtattcattgtagttgactcagaaccactagggcacttctgtgatcacagcagtcccatgcaggaagctttaccttcaggaaagctgctggattgagactggagggaagtgtgactgcctgtgcatgaagtgctgagatgagttcttggcctgtggtctgtgcttgtatacattattattatcatttaatgtatgtattttcttatgaagttaattatttgccaatttttctttttgcattagattaattaaaaacagcagtgacttttggatacgttgagaaagttaatacctttttaaattgcgaaacttaaataccattgccacacagattatatattttgtgagacacttgagagactgggtagccaaagtttggcataaaggaacatgttccagtaaccctgataattgtcaggatttttgtctaaaaagaccttagtcacatttagcagtgaccaagggcctggtcaaaacgtgagtgtgtcacagccattcagcactgttggactgtaactcctgggctgttttattttgagatgatcatttctatcaggatcaggaagtgttctattctctgtaccagttattctaggaccaatacattaaaaagcaaaaacgtattgggcctgttggattctgtgaagggttcttcgaaggaaaatctctaatgggacttataagcaggcactcatttccttatccaggaaatgaaaaggccgtgtgctacggtgggaccaccaacctaaggaagatgcaagctctgatcaccgtctagttggagaaacaggccattgtgataatacaggacagaacgctaaggggtggtagaagaaaggatggcctactcagaggctctgacccaacctgcacatctctcatttgtgtttcttctaatgataagtgacttggactctgagcaacttggagggaattcagaggtctgcttttctgcctggagttgactgcttcttatggagtgagatg

SEQ ID NO: 104175 - DNA, 2889 bp, Homo sapiens
cccccacaactgtctcctgcagcatgaaggctgacattgtatcgtggctgtgtatccacatgcatttattaaatcacacctccctttcagcccagatctgacagaactctgggagctaccgcctcataagtagatcaaatccaggcaccaatgggcaaatattttaaacactcatactgtagccaggagctacaaggaccagtaagataggagtctgagcacatggtgagcacacattctctggagtcagagctcgtgcaccgtggcctgaatgtctgcggtgtgcatgggtgtgccaggcactctgctaaccatgctgcatacagtggctccttccgagtctcagatgtgacattggagtgctgccccaaatccaactggaactacttcatggccccaaaaccctttcgtgtggtttaagttagaagtggtattggttgtttctgaccctgaaacctgtgtgtgatggggctgccagactgtgactgcttcgtaccacgctttgctttgaagtggtcagtaaaatgattccagagcatgtcatgtacaaaattagtttcattgccacaggatccttcaccgccaaaaccccgtgaatgtgaggtacctgtgagcgcggccctccatcggccacagaagcttttggagtgggcagggcacaggtcatcttcccatgacttcactgccagatggacgggctcatgggtcctgctttgcctggcgtgggctcatgggtcctgctttgcctggcgcgggcgcttgagctttcacatctgggactggtgagggatggagagtacacgcccagcaaggcctggacagcgcactggtgccacagcccttcgctcgggcccacggggtgcagtggaggaagtgtgagccttgtacagagagaggtttcaggcttcagagaggaggcctgtgaagtcaggaacatctcccctctccctttgcaatttatggaaagtacattgtgccaagcaaggacagtgaatgggccttcgtttcagcatctttaataaagtactgatttgggttatgcacagatataaaatctctagtggacagaggtgtgaaatgtagttctgtcaaactcagcagtgttttatggggcctatgtaccacttcccttacggcctagaagccgattagcagcctcagctttcagtgcaggggtgttgctgagatggctttttccctccggaaagactgaaactgctctttcttatagtgtgtattaaatgcaaatcttactctatattcttcagattgtaacctataatttccaaatctgacaattatttctctgccttcttttagtattttttttaacactttcagtattagcaattagccattaattggtaaattggagggtatacatactcatgattttagcttttatttttaaatgctattaaggcataacaggctacgaaacatagaacagtacatacagcattgcatggaaacctttgaagcacagatgttctgtcgtattaaaatataaaaactcagagggaaattagataccagatagaccaacaatttagggaaggaagagggagccaaaatgggtggtttgtggtgggtattgaacacatagtttccagcgtcatgcagggagaccctgtgtagaatctgcaccataaattagacttgtactttaattttctgaatgagaagagtatgcagtgggaccactgacataaatgagagttgagaacaaaagatcatcatagcagatgaaggtggaagtaaagtgaactttagaaagcaatgaaaatatctcttgacattcgagtttattctgaaaaacttgtgaccccttgcaaaagtaaggggatcttcagatgtcctgtcccaggacctccatcttgcctggccccctccctgtctcctgcctcctgccttgctctccagcaccctgcgagcgggagctcttctttttggaggtggtcccaacaggtagcacaagtcccatgaaactccaggaagcccagggctccctgggcagcactttgggaagtgtcttttttcctctcagtaagaaagttcttagagaacagggccaaggtcaatgaggactcccccctggggatgcactggggtgagatggggtgaggaggttgccttttcagggccacactcttggcatgttttcttctttggctgacagaaattggcatattttaaagtattttggtttgtgcaatataacgcattttgagagcaatttttaaactgaactactactttgcactctaaaaaactctacattttaccatggtccgagaagatatttgtttagatgtgacaagggatttgtgaagcatcttcatctaggaaaacctttttctaacagggcagataattacacaggtttgtagaagcctgggtggaggaggcttgcccgtgctgaccatgctatgtgcaggccccctctgggagaggttctaattgtgcgcccctccctgctccacagcgtactttggaaagccctgcagcacacaaatcccttgccttcatgggtttgttatctaaaaagagttttaaaatatatgtcctggatgcgaaaacaatgcagatattacatataatatatgtatctgttatacagatattataaataaagtccatatatatcagaacattatgaaaagtcttttaacacatttaaatcattttaatttacataatgcatattttttcagtgccagtactttttaaggttggtttgtttatttacttatttttgagacagagtcttgctctgtcgcccaggctgcagtgcagtggcgcaatctcggctcactgcagcctctgcctcccgggtttaagcgatttctcctgcctcagcctcccgagtagctgggactgcaggcggct

SEQ ID NO: 104176 - DNA, 1281 bp, Homo sapiens
ttttgatagctggaagaatagtttagcttgatgcaatctgtctcatcagacaattccagttttaacatttcagcttacctgactgtactttaaaagtgagcttggcacatcaatctgctggttattaatacccttactgtggattgtttttctgtatcatgctgtttcccagcctttggtcttctcccctgctaatatcttatcaccttgctggtacaaggccacccagtttagtgttaggccctgtgttgaaccagctgaggcccagtgcagtgctgcctcggccattgagcagtacaaggtgctttactgacgctgtggtcttggtggcctgggtcaagaccccagagccccctgctgaagagctggccagcactatcaagtcccgctctagtgctgattgcagggttctttcaaggcagttttgcaacaaacaggctcatgccttctatttgtagtagctatggaaacgttagaagctctctttctaaagctaagcatacaataaagcacttcagatgttggtgggattagagactttagaagatgtttaattttctcccctactctttctttctctctgtccctttagagagggaacaagagggcaatgtgaatattaactgagacttgctttaatctctctcgtgacacttcagactgtctaggtctgcacaggctgcactctaacaaggagtggcatgcatattcatgacccagggctgtggaccagacacgcttcctagggctatattttacagtgtttttattttctactcaaatttcttgaaagaaacaactatgaaaaattgattttgtgattatgattaagtctagaacccaagacagcagtgctaaaatgttctcactggaaataggaacagattagaggaggtttgtgtagtatttgatttacagatagacaacacaaaccccaaaatgttggtgctcacttagagggggcagtggagcaaacttcacatctgcctaagaagaatgcataagggttctaccttcgtgaagtcctccttaaaccggaaggaaagatgaatttcacttaaaatatgtaagagtattaaatgtatatttaaatgaaaagtgtggaggtttactattattggcttggttgttatttctgattctcaaggccgtgaaagggagttgactccagagtggtcttgtggccttatttcttgtcagccttccacacttccttgacttacatctttttgcactttggatactaattttggaagaagacaaaaatgccttttctgcttt

SEQ ID NO: 104177 - DNA, 2734 bp, Homo sapiens
tctttagctctagggtttgataccttgtggggacactgactccctggttctggcattggcagtgcccgagtgggaagcatctgataatcatcaggggacaggacttgtttgtcttgctgcctttatctgctcgtgggcagggaggtctctttctttggataggtatttgttctaccctaggttctttgttgttctccctggatcagggtgccaggcccagtagggacacagcctctcttggcagtctcttacatatgtccctggatccaaccactgaagactggtccctgcagtagtttttgtacagtcctttatagaactacatataatagcttaatgtttgcatgaggtttacatggctcttggtgattaaatcaaatgccctactcagtgatgtggcgatgctatcccagtcttcgtaggttgtctctggtctcctgccaagcggaacgtgccaggtgaacacttgggcacagtgagccccgatgctttcaggagcctgagtattcaaactaaacacagcaaatccttcaaagcccttccagcttcatctttagaatactgaatgcgggaaattccacagtgactcctaggaaacaattcttatttctaactgggctcccattaaaacaagatgattttcctgattctaacctgacgtctttgtgactgattctttagtgctcttcttattctttccctagtgagtcagtaacataattattcaacaaaggaatgtgtgtgtgtgcacgcacacacgtttgcctgtgtgtgtgttcttgggttcataaacttcagtttgagctactctaagtctttgcttccttgttcattcattcaacaaatactgagtaaatctctctgggtgcccgtggctggacatcacacacacatgctggatgtacatgtgcatatgcctgcgttgcctctttttaatgtgtttgcacttgagatgcatattcagagaatgcatcctcaagaaaacttgtggattgatactggatgttccgtgtttctgtgctcctctactccttttctgataattcttatgtgaagttatcaaacaggaaagtacgttgtcacattccttcactctggctccagttctgacccagtgggtgatatatgccatccgaaaccttaccgaagacaacagccaaaaccaagatttgattgcaaagatggaggaacaggggctggcagatgcatccctacttaaaaaagtgggttttgaagttgaaaagaaaggcgaaaagctgatcctgaaatctactagagacacccctaagccagtaagtaccctcgagggaactgtccttccctttggtttgtagaaagctgtttccacttccccattgcttcaagcacgaggctctttgtaagaatatggatgggagaattgtgccctctatagtggtttaccgaggaaagccctaaagatagctgcaaacggtttttttgttccggctttatgctgccattttcttaaaagagggacaatttcaaactcattctgggtgagaaatacaaaaggcatatcaaaagttatacatggtctaaaagtaagttactcataggaattagattttctttaaaagatagttaatgttcactatagtttaaaaaacagaactccttgaataatattgcatgaattgttttaggtttctctaagttatttgtcaccactgaccaaagttctgggttttttccccttttgtctgatgaatcttgtgaacagatttgctacatctgcaattttgtttctttcttcttctttagtgaatgaactacatccaaatacctgaatttttggaatctgtttcatggatttttcatcttctaccgtatgtgaaattgcaagtgtttgaagatttataagtacaaatttgggaacatacaaatcttttaggtagtagagtttaacgtgtataagctaaaagtgaaagtaactgagtgttctcttgtttctttgcattaatgtaactgtgtggtttgcctttgtccccctggatagaacgtgcatttaaagaatatattgtacttactgtgacagcagataataaaccagtctcttggagggcacaacccttatttgacaaaacttggatgttggcttgactgtgtttgtcccttcagatggcaagtcagcatcattctttatattcctcttctcattgggttttctgaactctggcaggcggttgaagtagtttctcactgtgattaattctagcaatctcttttcacccctctgcctttccaaaacattgacaagactcatttccagttaattaattcgagaaccctccctcttcattttgggtactgggctgtcttgtcactgagccctatccctttggaatgtggcagggagtgaggttggtgagagaacatgtgggcacttaactcttcatgttccagttcatcccagaagtagacatcccaggacccattctgtgtcaaggtgaatgcctgtgtcctccccagcttcatgcctctgtcatgggggaaggaatagcttatgttctgctctggtgcagtgccgtagattaaaggtacatttctatcttctttgatttaaaaagcaccagtctcataaaggtgccactcagttttagccatgtcttcactgaaattgcaaaagtacttttagggagcaggagtttatttgacatctagttatctgtctgtctgttcatctatctatctgtctgctgtatgagaggtagga

SEQ ID NO: 104178 - DNA, 3092 bp, Homo sapiens
gtgaaggctcatatcagagacttgagcatccatagattttggcatccaagcgggggttcctgaaaccaatactccacagatttcaagggccaacttactaaactgttaggatttgttaatatttgttcattgtcctcctgccccagccgtgtaagacatgcctgcttcctcttctgccatgatcctaagtttcctgaggcctcccgagccatccttcctgtatagcctgcagagccatgagccaattaaacctcttttctttataaattatctagtctcaaggagttctgtgtagcaatatgagaacgcactaatacaacgtcctgattttgtggttctgttcttgtttttgtttttaggagctaacattgagatgcatttttttgttgttgttcagtaacttcacaatctaagcatagggctttggaaactgctaaaacatgtcatttgcaaaataggatatagaaaaaatgattgagatgatttgggctaccaattaatacgtctttaaatcaaatttttttgtgtgcatcttacatccattctctcttgaagtcattcatgtgctgccctgataacacatggcatttaagtgttatttaaatgatttttttttttcgagatggagtcttgctctgtcacccaagctggagtgcagtggcacaatctcagttcactgcaacctctgcttcccaggttcaagcagttctcctgcctcagcctcctgagtagctgggattataatttttgtatttttagtacagatggggtttcaccatgttgccaggctggtctcaaactcctaacctcatgatccgccctccttggcctcccaaaatgctgggattacaagcatgagccactgcgcctggtcttaaaatgatttttttactgtcctttagtttctgtccttgaatgaataaacaaagatgttagaacaaaaattccagtctttgcaggaagaaaactttttaaaaaatctttcatcatcagtaagttctacacataagtgcttcacatgtgaagcagtagaattgaggcggaatttttaaatgcagaaaagttgaggaagaaccttaacatttaagatctaatataaaaccaagcctgtggggtgggggggaaccaaaaaaacaacaacaaaaaaacaccctctcggtgctgtccaaggttctgatcgtttcagccatattggcttgtccacataaaatcaattaaaaaccttgttttcaaacttcagattttttttcttgtgtttgtatgacacaatatctgtttcctctttcctacacactttatatatttatttatattttgaggtcaaatattatgtgatactttgcaatatgaatttcatataccatccacaatataaatgaatttgtaagcttttgctgtaaacatagtggttatggtattaactcatccatcagactttcctcatctcaaccagagacattcctgtcagtggaaattaattttcacagttttccataattatttattcttgcttaaattagaaacattatattaaatgtttctttttgtttaaacaacgtcatatacattattcatttactcacaaatttctatgcttatttcacatcattgaagcaagggcttaggcaatttttatcatacggatttaatttttccaccactttgtaaagtgtattggccaagaatatcagctctgaagctagaattcctgggtttcagtccctgctctttctcctgcttaacccatgggcaggttctataagttctgggtgtccccattttctcattgtcagccccactgaaaatgcggctcataataccacctgcctgatgagagcacatgagagcacaagcaagtggttgtgtgtgaagtgcttagtcctggtattaatcccattatatgaatgaggaagttgagtcacagagaagttatgcccaaggacacacagcagttaatgcttagtgattaattgctatagttaattggaagagaatgagtgagaaaaaaatagatagcttcttttcccagaatcgtggaaaattaatatagcagaaatgcctggactatggctttggacgttgtgttagtgcattctcgcattgctatacagaactccctgagactgggtaatttataaagaaaagaggtttaattggctcacggctctgcaggctatacaggaagtatggctggggaggcctcaggaaacttaggatcatggcagaaggggaagcaggcacgtcttacatggctggagcaggaggaagagagtgagggtggtggagaagtgctacacacttttaaccagatgttgtgagaactcactatcatgataacagcaagggtgaaatccacccacatgatccagtcacctcctatcaggacattggggattacagttgaacatgaaaattgggcagggacacaaatccaaaccatatcagatgtagagcaaggagagtgctatgggaagaacatacgcttgcaattagaaaaactcaagttcaaatctcaacttcacttgccagctgtgtggccttgagcaagttacttaaccactctgagcctacgtttccccctcgaggactgtaccatgcactagggatacaacagtgaacaagacagacatggcctctgctctcataaggattatcttctggtgagggtgacagaaagttattaataagtgaacaaatatgtaaaacgagagcattgcatattgtagtaagtgccatgaagaaaataggcaagttgatggtaactggggtgttctttttgagtaaaagccagaagaaggttgaaaaggtgccagctgtgcaaagaatcagagagaagtgttctggaagagggagcagcaagtgcagaggccccaaaattggaaaagcttcacctgttcagggaccaggtgggtggccagtgggcccagtgcctggtggccaggggagaacatcataagaccaagtcagaggggtcagcaggaatcagatcatgcagggtcttcaaggccatgggaggaatttgaattttgcttgaagtacactgggaagctattgagccatttttagcagaggaatgccaagattctgcttgc

SEQ ID NO: 104179 - DNA, 1098 bp, Homo sapiens
ggcggggtggagtgcacagagaatcctgctgcagcagaggatggcagagccccacctgcttccattggcaggatctgtgtgggtccttattctgggcttttattcacattgttctcccccaccaaaaacctgctctttctttaaagcccggccacagtgccctccccctgtcaggaaaccttccaaggacttgggtccgcctcgatctgcaccttccactaacccctgggacgtgttcccactgccgtagatggtttcatgcattatgacgactcactcagagcaggcactgggagagagatgaatggtacgcctgtgggaagcaggcagcaggtcactgcagtcttaggcctggtcatgacagcccaacctggctttctcacagctgtgctttgatgatgcctgggctcacgtgtccagcaatctatcccttcaacaaataccaagcaccagaccctgggctgggcactgggaaaagacagtggctctccaactgaggcactaaagaagcgcagcttcaattgtgacaggggctgcaagagtgtcgaacagtctcctttcatagcgcgtgcatcatgccttcagcacccttgagctccgcaggggctactgaaaacctgaattctgcccaaacatctggccccccatctcctctcacctcctacttcaccaggaccttcagacaggaactccctcaatttctcaccctcaatccttccagcctgcacctgcacccacctgctcctgtctccctcctggacagtgaaagaagcccatctccttccaaggccagccctccacctgtgagcgacgctgcccattccacttccacagggacctcacgctcaggcaatcctcagtctcctgcatcttccacctctccctccctgccacctcctttcccgtaggctcaagcctgacccatcctaaaagaaaaagaaaatgcccgaattccagataccttgttattcattattcagctaagttatcttcaaacattttgttcacatctccccaaagaacacggaaaaaaatctgtatcaaactatcaagttgatttctaaattttttcatcttaagtatttacagatgcaaata

SEQ ID NO: 104180 - DNA, 1013 bp, Homo sapiens
ggatggaaaggccctgagccccagaagctgggtagccccagcctcctcccctcaaggaacaccaggacagggctgggcacagggacgtccaagagacagcctgggcgggaagcacccactccggacattgtggggctgtgtgaacatagatgcaagccgcttagcctcccggcctcagtttcttcatctttaacatggaaatgagaagacaccccgtgagcagggagggcactgtcactgtcacgatcattcccatggtcaccactgctctccggggaacagctgccacgggggcgctggggccgggtggcatccaagtggcccggactcactgacttactgcagccctcctgggaccggctggccagcggggtgctgggagccaccaggaggtcaagtttaagcgaaggcctcgctcgcttcactggcttaggcacgaaaaacccaaacccaaacaaaacgcagcaccagctccccacaagcgcctttgtgtctgcagaatcgtccactctgctctgggacatctgcggctgcccaggcagcagactcggcgagaacaagggctccgctctgaatagggattcacgcgggcgattctcaaccgcggctgcattcatcagggcccgggtgcccggggacttccttcaggccctgcccccaggaccccggctggctccagcattctctccccggggtggtccctggccctcccatccccagtgcctgccactgcccctgaaggctgcccggggggccggggggtattgtcccggggacacctgccctgtgccgagccgtggccgctcgggtcacctcggctggggctcgttcacacggcctgaaaggcgtcccctctatccgcacttgcccttctcctcctcgccgcagggggaggggccgggcggaggcaaacagtattttttctgttctctccggcacaaatggaattcaattagtgaagaagaaacccaagcccagccaaactgcgctttaaaaaatcccgcaggagagaa

SEQ ID NO: 104181 - DNA, 1050 bp, Homo sapiens
cgggagatcaagaagaacgcgcggcgcctcatgaacctgcataacaatgaggccggcaggaaggtagggtgcgggtgcggctggtgggggccgtagctgggaccgctgtatcacccgctgacctctcggagcctcaggctcctcttctagcagaagcagttgagtctccgtaggtgtgcagggggtggggccgtctgggtcctccacgtgcatggctctgagcctcccagcaccgggaggaggctgtccccatccagagatgtgagagccgaggctctgaatgccaacgcgatgctcacggcccccagggaagatggggactccatttccatgcagggtgtgagctgggcttggctggggaccccgtggcggagggtcccaggccacagcccatgtccctgcccttggcgttcctggtcccggaggtcacctcggcacaccaggaaagacttcctggcagaggcagcctttttgctcagcaaggaagggatgcccccaggaggcaggagcagcctgaggaaggtggaagctgtgagccgggggctgctggggagcaggccgctcctgcatggggcgggacggagtgtggtgggtggcaatggaggaaattcaggcagggacacaccggggaagaagtcagagcaagccgggccccgcccactggagatgagggccccagatactgggctgggaggagcagctgcacggcggcaagatggcctgagatagggtggccagccaagtggaacgcccagccggctccggctccgaggcctgggggctgcacccagggcagcagagcctagggggcttctcaggtgtgggacagacttgccgttccaggcaaagtggagctgaagaatccctcgggcccagggaccatagctgaggccactggtcactcactgcccttttctgtgccaggtgctaggctgggcacggggcagagaggaatcagggccctggctgtgggaactgggtccacatgaggggtgcaggggtcacacccaggacggtgagggcttggttgtgtaggagagtgtcagagtg

SEQ ID NO: 104182 - DNA, 1062 bp, Homo sapiens
accggcgtaaggcatttctgggacctaaatttcaatggggctctgttttgcctggaaactgttcataaaataaaataagcctatgtgtgtatgagtatgaagggatggatggtgatgttttccttaaaaaaacaaaaataacaaagtgcatgtgtgtacacagcagtcggggtcccaagtctgtgtggtatcaggcctagtcacggcaccactcacctgggcctcagtttccccagtctttaaagagctaagagagttctcgttctgtctgctgcacgggccaggagagtcacgtgaggcgaggtgagaacacgttgtgtaaatgatgaagtgtttgctctgcacacgtgaggtgctgtctttactaccttagggaaaaaccctctactctgaggccgttgttttaggattcaaatggttagtgattgacatggtgccgggcacttactaagtgatcaggatgattttgttgacttgaaccgtggtgtcaaaatcctctgcattggctgtaagaaagaggtgggctgagcacggtgagaaatggagtcgaaacagagagcatcccaggcctctgaaggccttcgaacatgacaacgagttggcccccactttgggggattggagtggacggtttggagatccccctgggacatacgcctgagagccctaagtgtttgtcccggggtccaagcctgtcgtctgcagcccttcattgccctgcctagcttggactgcgtaagcgtctgctgggcccaaaccccagcccggtccacacacttgggccatctctcctgggggaccggattgtgcggcctccagagctgcctggcagagggcacaccttctcggcgccctggtgccgcaccgcgccgcgctcccaacaccggcttgcttatgctttgtcctgatgatgatgaatgaggtcagcctggcttaccattcacaaaataattctttattgcagagaaagcttttctctatctgagatctgcccttgttatctacagcagttatgctttccctggcttttggtgtttgcctacgtgtaatgaagtagggagt

SEQ ID NO: 104183 - DNA, 1057 bp, Homo sapiens
tccttcattctggcatttcagatggcaggaagagcatttagctgaaatatttacctgctgatttggggttcttaaatttagaatcccctttcatgtgtttaagagagatatttacattcaaatcagccttttataattacattttaaattataataaaatgatggtgccggcgctccagttttccgtgtcttttaactgtaagagaagctgccgtgaattgaatgggggctacccatcacccagagtccccgctgcccaccgtgtgggttctggcctgcccgggcacacgtgtcctgagcatggcagctacatgggtgttacctgtggggacctccccgcactgccaggagaagggcctgacggggattctggccccacacagtgcgatggttgcccagcctcaccgcctgcagctccatctgagaagggcctgatacgggctggggtccaggcccactgccctcatgtcctgagccccacggtggcctgcaggcctggtttggaggccattatctcctcggcggccagccgggcacagcagtggccacttctggtcgaggcagttctgtgggtgaggggcgagcatcgcctcctgcaaccgtaacccaggccctgcctcccctgccatgcccctgtgggtcccgtcgttgccatctcgtcctcagtggcttcccgatgttgcctgctggcagggcaggccccgtgccatggagcatgagggacccttcccctcccagggccaggcttttggcagccaggccaagccgctgctggaatggaattcccggcgttcctggtggggcgcatggcatcggaatcctacctgctttgtctctggcatcagctggtgagccagtcacgtggccgtgtgcgtgagaccagagcccaggactgagggctcctcccgggcgcttcctcctcgctcactcacccccaccccctttttttggctttcagcaggactggctctgagcaggcgtaaaacagtgttaaaactgaatccgggcagcagggagctcctgtccacggcggcaggctctcacagtccaccgggct

SEQ ID NO: 104184 - DNA, 1013 bp, Homo sapiens
cctcggtctgagcggccggcctcggcagacagcaccaaatctgtaaacggagctaagctcacacgaggactctcggcggctgcttttgttcgtagatgagccagcagtcgatactggagggtctggggctgcagaaacaggcatatatagcagagataattaaaacatttcatgattatgacagccacattctgctgctgcaagctggaggattcatgccacccaaatatttagcaagcatcaaataaaacactggtggcaaaataaaagtaatagaaaaaaaaaacagagcgtaatacatttcaaaggcaaaagagtcaaggggatggatagggaatggatcgggggaaaagtggggagagttcagcattttaaaagaattcacatgtttaatagctggccactcatattttttttttggtataattaatgtaggcaaatagacccttaattctaagtcctggaatgagagatggtaaaatttcctgattattaatttatcatttttgttttttgtacagggtaggggcaagtagcagaaaaatcaattaattcacataaaggaacattttcattctaaattaatattgccactgcaattaaatttatctagtatttttaacatgtatggataacacactttcctgtgtacaccttggatacctgggaccgttatatgtgatcaactatcatcttagttttttagcttggttaacacttgacccctccccccacctcaaaatcagtaaaatgctgtggattctgctttttaaaaaaatcaggccaaaatctcagcattctccatggctcccagtgcttctcggcagtttttttttttttttttttttgaagaaagtaccacgcaaagcacttttcacatcatcgcttctatataaattccactatagactgaaattatacattctcgcagcacagatgggctggtctgtcattacggctgctgggtacttgttggaacacacagcatatttcaattgtggagtcgacaattt

SEQ ID NO: 104185 - DNA, 1053 bp, Homo sapiens
ctgctgggccctcttcctccaggaggccctcacacactgttgggccctcttcttccaggaagccctcacacgctactgggccctcttcctccaagaagccctcatatgctgctgggccctcttcctccaggaagccctcatatgctgctgggccctcttcctccaggaagccctcacgctgctgggccttctctccggccacctcatggcagctgggtccttggcccatctggtccctccggaaggaaccgtcgaagctaccatggcctcgtctttccacgttccaccttctcgggtgcaatgaacaagtgtgtagatgccacacatcctcctggggcctggcatctttgtccagagggcccgaggcagctcggggaaggcctttcaagtgcgtcttgggaagctcacggctgaccagtgagcagggcctgggtcccactcggccgtgtgatcttgggccagcccctccccggctctgagcctcagcttcccacagtctctctgacccccacttctgacatgtagtggatctctagagggttctgagggttcaggtgtggaattggctgcctcaggcataaaaacattcctgggcttcaacctgggatcccacctggaggacagaggagagatttattgcagagatgttcatgcagtgcctctttaaatgtggaaagctcgacgcaccagccgtgctcctggggttgggcgtttgaattgaggagttgtgataacatgacctgccggactctcgtgtggccgttcacaatgggagaagcctctgtgggcaggtggaggcggcccacgtccacacgcacacgggagcccctgcgagccaggcctggcacagggttgtcagtatttgctgccacgttctctctctctcaattttccagaactttgttgaatgagcacccattccttgtgcaatgggcagaaaatgtttaagttacaaaacttatcatctggccagagtgaccctagcctggctaaattatcgcaacatgttctcccccaaaagagagacatttgcaaaatgctcaggaggtcatg

SEQ ID NO: 104186 - DNA, 1980 bp, Homo sapiens
tgtgagggcatagagcttctaggagcagcagaaacaggagattttgcacccactctgggcccttctccaccagcgttcactgggggcttgtggtaaagaatggggcagagcaggagaccggaacgcttttaccgtggtgcagacctggaagaagagatgggtgctctggcttgatcctgtctggatccttctctctagcagtacaaaaaccttaaaccattggaatatggacagcaaatcctgtcactctgggcaccggtgaaaacctgtttcagctggggatagagaaaagggtacggtagggaggcaagaaactgtgctaggactatatggttagggtcttcatagctgggaaaggggcaggattcctgagaaagcctgtgacccagggacaccccatctcttgatcttgcagatggcgtcccatgtagagtgccgtcctctgggagtgtttgagtgtgaactctgtaccttgacagctccgtacagctatgtgggacagaagccccccaacacccagtcgatggtgtgagtgcatgccttttgggccagtgccggggaggcctgtgcccagtgctggttggtgggtggtgtgcctaggtctgacaactgtctcaggtgtggagctttagaccccaccctggccaggctctgaatgcttctggtgtaatctctggaggcctgggcaaggcttgaggtctgactcttccagaaccttcctccacacctagcccagagtccaatacctgctctagctgtgggggagcagctcagcagctgggggacctgtggtggcctccccctttggggctgcacccttgccatgacactttcttaatgggaggcctgtctcccctgcagacctggattagagccagtgggtcagggggcttatctcttgacctccagcttgtccttcatcaaatgccactttgttggaaagctggccggtgtgttactcacatgggatgcagtggcaggggcatggctttttccttctggctgtcgtccctctgctgaccaggagcctgagtgtcatcatgtcaccctggggtctcattctgatgtgtagcatgaggccagctggcttccaggggctgtgagggtgtggcttggggtgtagggaggcctggggtattcaggtggcagccttgtgcccccactgtggtgaatcagtcagggtctgggggcccatgttgcagcagccctgcttttggctgagaacaaggggttctctctaccatggctgttacagaggtgagagcaggttcaatttcagtgccagtgtggcccccaattgctgatcctttctgtcactgccctgcagcacgggtggcctagtcccctgccctgatgagcccacgcaggtatgcaggccctgcagaggtgcaggctgctgctgcctggccataggtcatggctgattttccgacggcagagatttgggctgttctgacgctgcattcactctcctgcagcctcctggaggaaagctatgtcatgaaggatcccttcacctccgacaaggacagattcctggtcctcggctcgtgctgcagtttgtgcagcaggctggtgtgtgtgggcccggtgggtaagcagcgtgggctggggccacctgtccttgctgtggttatcctggagctctccctgggtagggagggctgggagagagggagcagcgggttcaccccattatagatggggcccctcagctgatgaaggggagaggtgagagggcaagctagggtcagttagagggtctcagcctggtgtaggaatggaaataggtaattggtggctctgcacccaccccagtggcccctcagggttcctccccttcccaccaacagtgcagacagtccttgtgcgccctctcaccaggatggtgacttactttctagatgttcttggagggatctccaggagaagggactgtcctttcatgagcacttgttgtgtgccaggtcctgtgcttgg

SEQ ID NO: 104187 - DNA, 1054 bp, Homo sapiens
atgtggcctggaggcacctagtgcagaatattgtttcctgcactcaaagatgatggtttctgtggctaggcgcggtggctcatgcctgtaatcccagcactttgggaggctgaggcgggcggatcacctgaggtcagaagttcgagaccaccctggccaacatggtgaaaccctgtctctaccaaagatacaaaaattagccgggtgtggtggtgcacacttgtaatcccagctactcaggagactgaggcaggagaattgcttgaacccgggaggcagaggttgcagtgagccaagatcgtgtcactacactccagcctgagcaacagagccagacttagtctcaaaaaaaaaaaaaaaaaaaaaaaaaaagatgatggtttctgcattagcacaaaacaacatttgtttttttcccataggccttcagacttttcataaattctctttttttttttttctccaggactctgatatgttggcttgtcataactattggcactgggctttatatctgattgagaaggtaaggtgaccatctgtttgcactgtcttatcctataaagatgtctagagggagaaagatttttctagcttttgctatgtattcacatccgttggagccctgatgcaatggagcattaacatttccaaagagcactctaggcttcaacctttttagggattttttcactgtggaggcctggaaatcacatctgtggtgtataacttgcagagaccattcagagcgagtgcctgtggctggagtggagagccaagccccaactccgcagggtgtacctgcctgggccatgagatcttccaacgggagccaggctatggggcagctgctcaggacacccttgaccccagtgattccgccacagggttccatgtacaagactgtcacttgcagtgctccttatcgtgcacaaaagctagaagctccctgaatgtccataaagtgagaaatgctgagaacatgagggccttgtcatgacatgagaatgtgatgatacagtgtctggaagacagcacagaacccagctaaatg

SEQ ID NO: 104188 - DNA, 1299 bp, Homo sapiens
taatgtgtcttatgtttaaggtagatatgctaaagacagcataacttctgtgtgtttgttaaatagcttcatacttttataataatgtgatttttgtgtgtataccttctagctaaatcaagtgaatttgcaagtattcctgcaaatagctcccggcctctgtcaaacatcagcaagtcaggcagaatgggacccgccatgctgcggccagctctgcctgcaggccctgtgggggcatcctcctggcaggccaagcgggtcgatgtttctgagctggcagcggagcagctcacggcacccccctcagcatcccccacccaaccccagactccggaaggtggcggccagtggctgaactccagttgcgcttggtcagaatcttctcaattgaataagactagaagtatcagacggcgagattcctgtctaaattccaagacaaaggttatgcctactcctacaaatcaatttaaaattcctaagttttctattggtgagtaatagatacattttaatgtgtctttaaaaaatactgaagaaattgcatttaaagttttaaacaattattgatggcattgatggtgtttttagttctttcctccaacagtgctttcaggtgtgacccgctgtcttctcgcccacgttgttttggggggtcactggaggctccctgaatgtcttacgttcgttcctgtgtgtgtgacaccccaatgctcgtaggctgcttgtaaggttttctctttagtgttactgtcgggaatttgattattatgtgctttgaggtggctttctttgcctttatcccgctgagggtttcttaagcttctttgatctgtgggttggtttttttcagcaaatttggaaaacgttggccattatttcttcagctatcttttcctctttccactttatttcctaggactctaatcacatctatttcaggcctcttgacgttgtctcacaggacaccgaagctctgttcttttttttatttcagccttttttctttttcttatcttttttcttttctttctttctttttttttgttttttgttttttgagacggagtctcgctctgtcacccagggtggaatgcagtggcgcgatctcagcgcactgtaacctccacctaccgagttcaagcaattctcctgcctcagcctcccgagtagctgggattacaggtgcccaccaccacacccggctaattttttttttgtatttttggtagagacggggtttcgccatgttggccaggctggtctggaactcctgacctcaagtgacccacccatctc

SEQ ID NO: 104189 - DNA, 1237 bp, Homo sapiens
gaattattattatcccagtaaagtcatggttcgggaaaatgagggaatgtgggctctgttgcgcgtgcctgggaagctaaacccctgcggtgttgttcctgtgggcaagtgtctagcgcatgcaggtgccgtctgacaagtcgacttcgctctgtgaaggtcgtgctcggccctgatgggatatacagccagggtggggcggcgcagtgaagatggctcttctctttctcccccgtgtccatccatcagaccacagcctttgcctgggcaggggtccccgtgtaggggtgaatgcctctcatgtggctgcctgcagcagggtggccctttgtgtacttgtctgagccagtgccacctacactcaagttgggacagtggagatactcggagaattgcccattcggtgacgatcccccaacagtaggtctccccctgatcactttacctgaccgcacacttcctttcttggacttaggtgactccccggacagctcaacaccaaagctttcgcgggcacagcggccgcagtcgtgcacgtcagttggcaggtgagtgacgttggtccgcttcctctctttattgctgtagaatgactcacgcatctgcttacctcaaccatttggtaaccctgcagcctggcctgcgcatctggcttccacgccagtctcttgggtgcaggccgagctcctgatgtgtaccagccccttttagatctactgcagacttaagacatctgagacttccgcgatgcagtacggcagctcccagccctggactggtgtggttgccatgccaggctgcacagcagaagtccctccagcgctcttaggactgcccgtgcccagcccaccccaggggttctgatttggttcatctaggctgaggcccagcagctggatttcctaaagctcctgggtgactgtgacttgtaccgcagttgaagagcactggcgtggcaccttgattctgacttggctttttttttctttttgagatggagtcttgctctgtcgcccaggctggagtgcagtggcacgatctcggctcactgcaaactccacctcccgggttcacgccattctcctgcctcagcctccctagtagctgggactacaggcacccgccaccacacccggctaattatttttgtattttttttagtagagatggggtttcaccgtgttagccaggatggtctcgatctcctggcctcgtgatccgcccgcctctgcctccc

SEQ ID NO: 104190 - DNA, 1060 bp, Homo sapiens
tgggcagatcacgaggtcaggagttcgagaccaacctggccaacatggtgagaccctgtctgtactaaaaatacaaaaattagctgggcatcatggtggcatgcgcctgtaatcccagctactcaggcggctgaggcaggagaatcacttgattctgggaggcagaggttggggtgagccaagatcgcaccactgcactccagcctgtgcaacagagaccctgtctcaaaaaaacgaaaaacaaaacaaaaaaacatatataatatccgtgtatttatacacaaattacacatttttatatatcttatatgtttctgtgtatgtacatctaccaacagtaggtgttgacactgtgtgtatctatgtagttctatgataatgcagaagactctggaagaaaatatgctggcatgtgtgtgcattacagagggagagggaaaggcatggaatgccaaagagaaaatgagaaacaaggcctcactgaaaacaccagatctgatatataaataggaatatgtgtttaactatcttgtatgtttgtaagtgtaaatgtagaaacaaaattctgcttgtttttggaattttcttatgaaacctctgaagtattaaaaagaaggtactgtgtgttagttgatggacctgcggctttgctgggtttccggaaggaattcagttttgcgtggcaggtactcgaggacctgtgggcagcaggcaagcccagcagcgcccgtgcagggtcctgtgggagacgccattggaaagctggtgtgggcagcctgtacctggggcctcagccctgatcagggcactgggcagcaggggagggggcatctggggcagaaggagccagctgcatacccacctaggcctaggagaagccccccactagctgcatgcgaggaggagctggccgtggctcaaggaggggtccctgtgtgtggtctgggctcccttcaggaggtgacgggcgtgcgcattaccttgtgtttagtaactagaaaggaaggggctaacatcagcccctggtgatgctggacagctaagatttgtgagctgagag

SEQ ID NO: 104191 - DNA, 1148 bp, Homo sapiens
cgtggattccccactcctcaagttctaagccgaaccaaatcctttgccttgaaagaacagccctaaagtggttttcaaccctcagaaacaagctttaggctggtcgcagtggcttacacttgtaaccctagaacttgggaggctgaggtgggcggattacttgagcccaggagttcgggaccagcctgggaaatatagtgaaactcctgtccctacaaaaaatacaaaaattagccgggtgtggtagtgcatgcctgtagtcccagctacttgggaggctgaagtgggaggatggcctgagctcaaggagatgcaggctgcagtgggctgtgattgtgccactgcactccagcctgggcaccaatgtgagaacctgtcttggaaaaaaaaaaaaagaaacatgttttagtagaagttttatttgaaaaagaaaaataagcataaatatattcccagtgctggagagggtgggctgagggactggggccagcacggaccacccaaggcctctgcttcccgccgccaccctcctcgctgccattctctgggctggaatgtgaagcctcagtcactctaaatgaagaattttcttttgaatgttttgtatgtaaaatagcaagtggctatttttaaagttaagtttgtataaatagttagatattctagatttacattaaattgtaaaataaatggacttattgaagcatatcttgatttttaagcttatcttgattttcaaacatgcatagctatttttatcactctaatcagtaaggctactatctagactcgaatgctttcatacaagtgattttcaaaaattagtcaataaaaattgatgtcagtgcaggcccaggcccgcccccagatacactagtttctaggtctggggccagcctagtaattgttactaggcacacaggtgatgctgactcgatggcctgagacacaccccttgagaagaagctgctctggggagacgagggtatgagtggaaagaggatgggcgaggaggccgggcttacctggacactaaggtgatggacggcgtctgctgggcaggcctcggggaggacccctcagctttgctctcagcaggggcccgacaagctcagtgggcagtggcaggaactgagtgccactggaaa

SEQ ID NO: 104192 - DNA, 1085 bp, Homo sapiens
aggctgaggcgggcagatcacttgaggccaggagttggagaccagcctggccaacatggtgaaaccccgtctctactaaaaatacaaaaattatctgggcatggtgctgcgcacctgtaatcacagctattcggaaggctgaggtgggagaatctgcaagggaagtctaaaggatttcatttccactgtcactcaggcatcttctcttcctcacctaagccctgctgtgttggaggagtcccagaggcagggttttagtgagaccctcacggccactccccactcctgaccccataagccctgtgagcctacacagagacggtggctcctgagccgtagtggcagagaataacaccttgtcgggtggcccatgcagcaggttataaacaaatgttcgatgactgacgttctcctgttttgcagaaaattatagttttggtatgacaaggggaaattacattaaacaagcaatttagtgaactttttttttttttttgaggaatgtttcacacttggaactgaagtcattttcttttattctagtgactttttgaatgagtatgaaaaaggaaggactcccaatcctgacatagtttgcaacaagcacatcaaatttagttgcttttttcattatgctgtggataatcttggtaagtaatttgggtttaaaacatttttttttttaaagacagggtctcgctctgtcacccaggctggattgcagtggtgcgatcatgactcactgcagcctcgacctcctgggctcaagagattctcccaccccaggctcctgagtagcttggaccacaggcatgccaccatggtggctaattttttgtggagatggtgtcacaactgtattgtccaggctggtctcagatttctggccttaagcagtcctcctgcctcggccttccaaagtgctgagattacaagcgtgagcccctgtgcctagcctgtttcttcttgtggaacctcctgatactgaattgcttgcttagaccacctcttgatgtctgtggctatgctttatgaattttaggttcttcttcctgtcccctgccattggggtcaccataatgagt

SEQ ID NO: 104193 - DNA, 2716 bp, Homo sapiens
gaggcccacaggctggtcctggtcccctctcctgcctcccaagggcagcctcatccaacatgagcttgccctccctggagcccccagacgccccctctaccctgatggggtgatcctgcccccccgtgtgacaaccttgggccccaccaagccgctaccctcactgacccttcacctgcttgctggcttcttcccacgcgcagaggcagtaatgaaacttcaatttgaaccatcagtaatgaaacttcaatttgaaccatcaggaaaccgtgaggcaagcccgtcaccccacacaggctgcggcatcaccctcagaccttggagcccaaggggccactgcccttgaagtggagtgggcccagagtgtggcggtccccatggtggcagccccccgactgatcatccagacacaaaggtcttggttctcccaggagctcagggcctgtcagacctggtgacaagtgccaaaggccacaggcatgagggaggcgtggaccactgggccagcaccgctgagtcctaagactgcagtcaaagccagaactgagaggggaccccagactgggcccagaggctggccagagttcaggaacgccgggcacagaccaaagaccgcggtccagccccgcccaggcgggcatctcatggcagtgcggacccgtggctggcagcccgggcagtcctttgcaaaggcaccccttgtcttaaaatcacttcgctatgtgggaaaggtggagatacttttatatatttgtatgggactctgaggaggtgcaacctgtatatatattgcattcgtgctgactttgttatcccgagagatccatgcaatgatctcttgctgtcttctctgtcaagattgcacagttgtacttgaatctggcatgtgttgacgaaactggtgccccagcagatcaaaggtgggaaatacgtcagcagtggggctaaaaccaagcggctagaagccctacagctgccttcggccaggaagtgaggatggtgtgggccctccccgccggccccctgggtccccagtgttcgctgtgtgtgcgtttgtcctctgctgccatctgccccggctgtgtgaattcaagacagggcagtgcagcactaggcaggtgtgaggagccctgctgaggtcactgtggggcacggttgccacacggctgtcatttttcacctggtcattctgtgaccaccaccccctcccctcaccgcctcccaggtggcccgggagctgcaggtggggatggctttgtcctttgctcctgctccccgtgggacctgggaccttaaagcgttgcaggttcctgatttggacagaggtgtggggccttccaggccgttacatacctcctgccaattctctaactctctgagactgcgaggatctccaggcagggttctcccctctggagtctgaccaattacttcattttgcttcaaatggccaattgtgcagagggacaaagccacagccacactcttcaacggttaccaaactgtttttggaaattcacaccaaggtcgggcccactgcaggcagctggcacagcgtggcccgaggggctgtggaacgggtcccggaactgtcagacatgtttgattttagcgtttcctttgttcttcaaatcaggtgcccaaataagtgatcagcacagctgcttccaaataggagaaaccataaaataggatgaaaatcaagtaaaatgcaaagatgtccacactgttttaaacttgaccctgatgaaaatgtgagcactgttagcagatgcctatgggagaggaaaagcgtatctgaaaatggtccaggacaggaggatgaaatgagatcccagagtcctcacacctgaatgaattatacatgtgccttaccaggtgagtggtctttcgaagataaaaaactctagtccctttaaacgtttgcccctggcgtttcctaagtacgaaaaggtttttaagtcttcgaacagtctcctttcatgactttaacaggattctgccccctgaggtgtaatttttttgttctatttttttccacgtactccacagccaacatcacgaggtgtaatttttaatttgatcagaactgttaccaaaaaacaactgtcagttttattgagatgggaaaaatgtaaacctatttttattacttaagactttatgggagagattagacactggaggtttttaacagaacgtgtatttattaatgttcaaaacactggaattacaaatgagaagagtctacaataaattaagatttttgaatttgtacttctgcggtgctggtttttctccacaaacacccccgcccctccccatgcccagggtggccgtggaagggacggtttacggacgtgcagctgagctgtccgtgtcccatgctccctcagccagtggaacgtgccggaactttttgtccattccctagtaggcctgccacagcctagatgggcagtttttgtctttcaccaaatttgaggactttttttttttgccattatttcttcagttttcttttcttgcactgatctttctcctctccttctgtgactccagtgactcagacgttagacctcttgatgttttcccactggtccctgaggctctgttcacctttcttcattcttttttctgtctgtccttcagatttggctatttctggtgctccgtcttcaagttcactgattttttttcctctgtcgtcttaatt

SEQ ID NO: 104194 - DNA, 1014 bp, Homo sapiens
gctgacgtatttcccacctttgatctgctggggcaccagtttcgtcaacacatgccagattcaagtacaactgtgcaatcttgacagagaagacagcaagagatcattgcatggatctctcgggataacaaagtcagcacgaatgcaatatatatacaggttgcacctcctcagagtcccatacaaatatataaaagtatctccacctttcccacatagcgaagtgattttaagacaaggggtgcctttgcaaaggactgcccgggctgccagccacgggtccgcactgccatgagatgcccgcctgggcggggctggaccgcggtctttggtctgtgcccggcgttcctgaactctggccagcctctgggcccagtctggggtcccctctcagttctggctttgactgcagtcttaggactcagcggtgctggcccagtggtccacgcctccctcatgcctgtggcctttggcacttgtcaccaggtctgacaggccctgagctcctgggagaaccaagacctttgtgtctggatgatcagtcggggggctgccaccatggggaccgccacactctgggcccactccacttcaagggcagtggccccttgggctccaaggtctgagggtgatgccgcagcctgtgtggggtgacgggcttgcctcacggtttcctgatggttcaaattgaagtttcattactgatggttcaaattgaagtttcattactgcctctgcgcgtgggaagaagccagcaagcaggtgaagggtcagtgagggtagcggcttggtggggcccaaggttgtcacacgggggggcaggatcaccccatcagggtagagggggcgtctgggggctccagggagggcaagctcatgttggatgaggctgcccttgggaggcaggagaggggaccaggaccagcctgtgggcctctgtgttgctggtctttcagaagagcgcaaggaatccacgttagaaaccggccatctctacagtgacttttggaaggg

SEQ ID NO: 104195 - DNA, 1038 bp, Homo sapiens
gaccagagcctggctgagagtgacagtgaggaccccagcggcaagccccgcctgaaggtggagaccaaggtcagcgtggagctgcaccgcgaggagcagggcagtcaccgtggagagtaccccccggaccaggagagcgggggcgcagccaggcttgctagcagccagcccccagagcagaggaaaggtgcctggggaggccggggctgcagtgaaaggctggaggacccagaagggccagtccctggtctggaggtgggagtggggctggggctggtggggcaagtcagggcctgggcagaacagacgtggcctcctggcctagccctgggacccggggaaccaggaggaaggacaggggctgaggctggctcagctgcacacggcccagcagctgcccccggcagcatcacccggacttgaccttgccgtgtctcctcctcccaggcatcttgaaaaataaagtcacctacccgccgccgctgacgctgacggagcagacgctgaagggccggctccgggagaagctggccgactgtgagcagagccccacatcctcgcgcacgtcttccctgggctctggcggccccgactgcgccatcacagtcaagagccctgggagggagccggggcgtgaccacctcaacggggtggccatgaatgtgcgcactgggagcgcccaggccgatggctccgactctgagtgagtagcctgggcctccagggcggggatcacccacttcccccttgtcctgagtcaggagagagagggggcagtggtcagggacctgacacccacctcacctggagccctgagtgcagaggaagcccaggcggggatgggggaggggggaggcgctgcagctgaggtcaggaggataccccggagatgggcagaccccctatcctggggacacgtctcaggcctctgggactctgaagccctggccagccccaaaatgctaggacctaaggtgctgggctctgcgtttgatcagcattgtctccgcctgggaccactgccacccaccttgcagt

SEQ ID NO: 104196 - DNA, 1038 bp, Homo sapiens
cctcccagggctcttgactgtgatggcgcagtcggggccgccagagcccagggaagacgtgcgcgaggatgtggggctctgctcacagtcggccagcttctcccggagccggcccttcagcgtctgctccgtcagcgtcagcggcggcgggtaggtgactttatttttcaagatgcctgggaggaggagacacggcaaggtcaagtccgggtgatgctgccgggggcagctgctgggccgtgtgcagctgagccagcctcagcccctgtccttcctcctggttccccgggtcccagggctaggccaggaggccacgtctgttctgcccaggccctgacttgccccaccagccccagccccactcccacctccagaccagggactggcccttctgggtcctccagcctttcactgcagccccggcctccccaggcacctttcctctgctctgggggctggctgctagcaagcctggctgcgcccccgctctcctggtccggggggtactctccacggtgactgccctgctcctcgcggtgcagctccacgctgaccttggtctccaccttcaggcggggcttgccgctggggtcctcactgtcactctcagccaggctctggtcgggccagccggccggaacgtggttggccacagcgtcccctgaggcacgagagcggtgctcagcaggcagcggcactgccactcgagctgctcccttgagagccatgggtctggtggctctgacccacctctccccaacctgcaggcctggtagggctgaaccctaaaggtggggaaactgaggcccaggagggcgagtcctggcagcagggcccttgttgggagcccccgccgcatctgtaccagtaactatacaggctaatcccccactggcagcctcacctggaccttgcggtgacagtccacagagacccccctgagagttcctgcctccgctcagggggttggcctggaggagccctccagaggctgtgggggagcccaaccagagtccccccaccccaggctgtcctttc

SEQ ID NO: 104197 - DNA, 1341 bp, Homo sapiens
ccggctgtctgtcttgggcattcatctgcgtcctggcaattagctccagctctaatgacctgctctctgctttatgttgcacttattattcccagattgtaaagtttgtgccaaacatattaatgctaacatcccattttacagattagcaaagtaaggatctgagaggttatgtgatttttcccagagtctgcgagggcagggccctgtctgaagctgagacacaccttataacaccttgttatttggggcttcccatcagtaaaacgggagtcataatggggccctggcttctgggcagttcccataaaacattgtgcaatctgaagatgaaagtgtcagaggaaggtgagatgtcctttctgagagcgtctgccctcagaaggagacgggaccgcatcgcagctgtgtgaaccccgggcagtggttccagcagcggggcggacgcgagacagccccatttgagttttgctgctagatggcacgtagaacttgaacttcagagggtgctccttggaggccctgaccagacacagaagggaagggagactgttcccatggtcctgcctccgcggcagtgaggctgctcttcttacagccaggtggctcttgtcttcggtgtagggggctggtgaggaacacggtggggagcagcctgcgagggcgctgggctttcagcactcacggcacctgctgtttggtttggccaggatggcctgggagcccccagggctgggcaaaggctgccctttacagactcatgggcagagggaaccgtcttacccctgccccttctctgtcctctccgcagcgttggtgggacgggagggtggtctgcccggggctgcgagctcctgtccaggaaccggacacatgtcgcctgccagtgcagccacacagccagctttgcggtgctcatggatatctccaggcgtgaggtgggcatcctcccgtggccactgtgccctctgggcctaccgccaaacctgcccctcccccccaaacctgcacctccccgccaaacctgcccgtcctcaaacctgctgagcctgcccccaaatctgtcccctcctcaaactaaatcttccattctaagtgcttggaacaaaacaaatcaaccgattaaaacacatattcgaggattggccagagtctgaggatttccataacaaagccccattataagggttttcagagagccctggttatgtattaaaccccggaatggcagacccaaagctcaggctccgaggagctctcggaacctgcccctcacttcagtgcgggtctgttggacggtgccgctccccacctgctttgatcctaagggaggtgacagct

SEQ ID NO: 104198 - DNA, 1020 bp, Homo sapiens
atgagctgccattattttggtgtcttttgctggacactgaaaccatcccctgtgattctgccattagctattatgggctgtgacatctttgcacctgtgccttctctttctttttaaatttctgaagtcccaatttgacccaaaggtgacacctctctctgtgtgccctgtcagtgataaaacctgctctagggatgaagatactgtggggtccgtgggtccgagctctcggagtgtgattctgtctcccctagaaacacatcatggcgtgtcctcagggcatttgtgcgcgggatttaagcagatgtttcctcaccgtgtttgtccccatgctctggcttcttgacctcaggttgcctcaccggcccatcattaataccccgatggtgagcacgctggtgtacagcgagggggctccgctcccgagacccctggagaggcccgtcctggtggagttcgccctgctggaggtggaggagcgaaccaagcctgtctgcgtgttctggaaccactccctggcgtaagtgtgacgccaggagccccatgtgagggctttgccaaggcagagtgcccccgcagggtcgggggctcagtggcagagcgccccaagaggacggtctcttgtggtctgtgtttcccctttaagtcccccgtgggggcagtgagcctcctgctctgcttctgtgggaatatcagagtcctcccctagatgtccacacacagatgcacacagacctgcacgtggagatacagatgtgcaggcgcacagagagatccctcaaggctgacacccaggaaggggacccctcacctgcgggactcccgacatgcagcggccaacactagtgtagtgcccagttcaccgccggataagacaggcccattccggtcacacacgggagacagaacccagagactggcctaagagcccatctgctgacggtcttgcccgagaggctgacacagtctagctgtggggactggcttcacccccaagaggccacacctggccgcagcaca

SEQ ID NO: 104199 - DNA, 1055 bp, Homo sapiens
ggcccccacagctccccaccgccatgccagccacctgcccctctgcctttgtgaagtgtcctgaatcgagccccttgccgccacccccacccagtccaaccacagacgtcacccaagtgggccccgtgcctgtcccctggagccaggggttccagctacggccgagggagctgctctgagtcgttcagctctcagccccctcggcagggacatccactcctcacgcccccaccgcgcaccccaggagctcaggctggcgtgccctctgagctcctcacccagccctccactgcactccggccagcaggccgtggggcaagaggaacaaccctgcccgccccagctctgtagataaatgaggcatcacagatgaatgcctcgcaagggaccagagaggtctcagggttcccttaacccctacatacctttccgggctcctgtagccccagtgccgtttacttaatgcagggagtgaggatgggggggacgcccaccaacgtcgccaccctgaacatgaacaacgcactcaaggtcagggtgaaggacggctgtgatgtggacgacccctgtacctcgagcccctgtccccccaatagccgctgccacgacgcctgggaggactacagctgcgtctgtgacaaaggtgggaccgccctcccggggcccttcagtgacagggaggtctcttatggctgaaacacaggaggggggctcagtttagacattagcgtccccagccaactccctgtggttccgtggagccctgagctttattttataacaagcgggcccctcctagagagagactctgagcctcttccttactcaaggcacagagtgccccaggcgctctcctcagcacatggggtgatcagcaaagaaacagtgaaaagtaaggccgggtgcagtggctcatacctgtaatcccagcactttgggaggccgaggtgggtggatcacttgaagccaggagttcaagaccagccaggcaacatggtgaaaccccatctctacgaaaaaaaaaaaaaaaaaaaaaaaagcaaaaattagccagg

SEQ ID NO: 104200 - DNA, 1285 bp, Homo sapiens
gggacagccacaggcccttctctgtcactcctaaggacagcccatctagaaacagttctgtatagccaagattggcatgagggttggcgggtggacagagggactgcccagcacatgccctccccatcatgagtgcctggttggagtgtggcgggggcaggaccgagagtgctcccagcaggctggtggaggtcagtccctcagcagatcagcgagggctcaggagatgggtcggggctgtggggcaggggctcaggcctggacagggagcctcctgttcctccccatcacagctcgggagcattttccagcacagacctctcggattgcctggaaggtgtggtgtgcgccagggatgattacagctggcctgtgggcccttgttaacctgtaatttcatgagtctcccaggcagccccagaagcttgctccaggccaaaacttggcaagtgcggtgctgcctggggatggtattttctgtgtggtggtttcactgtcagaacaaattaaattggctgttggatgcaggtgatgaactggagcttgcaagttgtcatttggcagtggggtctctgtaggaaaaaagtgcgctttcagtaggaatggtgctggaagccacagactccggtgctgtttgtgtaattacatcatggagggctcatccccagattaggaattttgccagggactacagccagccctccctgtggaagtctgggtggctggaggggtggccttgaggggatgctgcagaccccactgggcacccagaaggcccccagggcagctcgcagaggccggtcaaccacacgttaccgaaggttctgggggatttctccttgccattatcagcttgcaggcctcccgtgggcctgtgagctccgtaaagcagcagtttggctgtccctcaaaggatgtctcctgtgcccctgccactgtggtgggacaaagaagactccattgtaatcccacagcccaagcaatttggataattgctctcgggcacccaaaatccacccaccttgtcaggtgggataaccttgagattgctgaatgcctctctgactgagagctggggacacactctcagttacctcccataaaacaggttcatcctgtggatatcacttttgtttgtagatataacatcacttttatcactgatctgctcactttggagttctttaagcaagaacaatgcaagagatggcaaaggaattttttttttttttttttttttgagacggagtctcgctctgtcacccaggctggagtgcagtggcat

SEQ ID NO: 104201 - DNA, 1050 bp, Homo sapiens
gggccgtgcctcctccgaaggctgaaggggaggacccttcctgccttttcctagctgtcggtggcccaggtggcccttggcttgtaaacagctgctccagcagctgcctccgcggtcacgcagcttctccctgtgtgcctttgcatctcagcatctgtcctcttaagaggacaccagtcatcttggatcagggcccgcctactccaggacgtccgcatcttagctaattccatcagcaccagctctttgtccagaccaggccacgttctgagattctgggaagcagaacttgagggggcattgagcagcccagcacagctagtttggggaactaaaggccgggggctcctcatcccttgtctacgtgccgcccaccctgtgccatgtcctcctcgctctatgagtgacaggtgcgcctgctgagggcactggtggagaaaacgctgacaccttctgtgctttctcttcttacagcccaatattggccacctgggcctgccccatgggccgtccggggaaaagatggccgtggtgacagtggatgattgtgacacaaccatggctgtgcgctttggaaaggacatcgggaactacagctgcgctgcccagggcactcagaccggctccaagaagtgagcatcccaggaggggaggccctgggggtccgtacccccaaacatgctcaccctgcggccttcccagggcagggccccacgtaggcactctgggtgcagtgccctggcgacctcattccaggctagagtcagacatcctgtccatggttggggcaccttccctctgaccttctagaataagtctccctaagtatgtgtcaagagtggccaggccgaccccagggttgtgatggccagcttgcagaccccgagacggtctccagccccatctccacggatcactggctttgtccccgcaaattctggtacctgggactccaggactctgttaagtgaagcactgtgtcagccagctggtcccagaggcttatgtttttttgttgttgttttgtttttttctgagatggggtctcgc

SEQ ID NO: 104202 - DNA, 1051 bp, Homo sapiens
tagccaaaatcgtccactgtacctggatgtaactggcgagccagaacactcttcaaggaagtgccgtgaaggctgggtggttttggtttcactttattttgctgttcgttggcttgtaaggaaacacattgttttttgcatcaaaatgctgtgctttccacggctgtgattttgcaaatcccttttctcttcttgggaagctccagggtgtgcccccgcttgctcgtgggtctgcgtgggtcttaccggctcctcctggagcctggccacccccgctgtgccccgcttcccggacttcacaaggctggggcctaagcttggttggcagacgagggctcctctgtcctccaggagaatcgacccagtccttctatggagagagcatcttccttctttcacagccactgtgcctggctgcgactcaccagcagttggggtccagccactgggcctgaggtcgtagtgtcgcctccactggctttcactctcctttccatgctggccaccggcgtccctccacctccctggcccgcccctcccatctgccttgaatatcccatcatctcccaggcgtgccacacagactccaagtagtggtcacctgcacagagaccatagtttttgtcctctgtcccatcagtgccaacccagggcaggtggagcttgagcctcatttgggaggagggcagatgggaggtgctggtgaggtttgggagctgagtgcttgctcggggtttggggggatattgagagaaggctggcaggtgtctgggcagggtctgggctgccgcacattggatgtcacccctagtggggcttggctgatgtttggagaaccatgtgcttgacagaggtgcaggggctggtggggtgaggggctcagggctgagcaagaggaagagggtagccctcacagacgcggatttatttgctgccattgtccatttcaaagaccgagtcttttcttgatacggtgccgtcctgtggctgtgtggggcagtgctagccagtgtgaagcgcgttcacctgggtgagctgcacgggtggccgt

SEQ ID NO: 104203 - DNA, 1012 bp, Homo sapiens
gggcaggggccagggtgctgaaggaggaagggtcaaggtggtggtcatgggtggggaatggggagtggggatgcccaggctctcttctcctttgccaagcatgcctgaggctgctcctgggatggggcctataggacctgtgactcccgcagcatctgaatgaccctgactttccttgtgtctgcagatggcatccacagcgtcacggccttctgcaccctgcgtgtcaccatcatcacggacgacatgctgaccaacagcatcactgtccgcctggagaacatgtcccaggagaagttcctgtccccgctgctggccctcttcgtggagggggtggccgccgtgctgtccaccaccaaggacgacgtcttcgtcttcaacgtccagaacgacaccgacgtcagctccaacatcctgaacgtgaccttctcggcgctgctgcctggcggcgtccgcggccagttcttcccgtcggaggacctgcaggagcagatctacctgaatcggacgctgctgaccaccatctccacgcagcgcgtgctgcccttcgacgacaacatctgcctgcgcgagccctgcgagaactacatgaagtgcgtgtccgttctgcgattcgacagctccgcgcccttcctcagctccaccaccgtgctcttccggcccatccaccccatcaacggcctgcgctgccgctgcccgcccggcttcaccggcgactactgcgagacggagatcgacctctgctactccgacccgtgcggcgccaacggccgctgccgcagccgcgagggcggctacacctgcgagtgcttcgaggacttcactggtaggtgcccgggctcaccctggctttgtgtacatgtccccaggtcacatggccgagggtctcaggtggtttcctctgtttacttccctccggggaaaacagctggaggatgggcgctgggcccaggtgtgggctccacgaaccttgagatgatctcagtaacggtacttttttttttttttttaa

SEQ ID NO: 104204 - DNA, 1071 bp, Homo sapiens
tccaatctgtaccctggactcccctcccccgcaccctggactcccctcccccgcaccccccacctgcaccctggactcccctcccccgcaccccccacctgcaccctggactcccctccccctcaccccccacctgcactgcaccgtggactcccctcccccgtggggctcaccatgctaattggccccatttgtcttttccaccaggccaaggacaccttgagggcaggactgtggttttccctcttggcatccctagatctcagcctcgtacacacagggcccgcaaatgtttgttgaattaatgagtgacagcaattttaattagagtttctttgcgtttaggttgcagattagaatctttaaaaagatattataccaaatagtttttaattatgaatgaattgcagacatcgtctgcaattagctcgagaactgaaatcctctttcaggacccttggggtactctaagagggaaatccaatttgttacttgtaagtcatctcttaatcatgcaatagcaggatatgtgatattagcgtcagctcttccatctctccagatctgagccaaaggtgccatgggaagaatttggagctgctgttcttgagaccttgggtgtgtggaagtgggagtgggagtgggagtgggagtgagggcaggaagtggagggggcagggggcgggagcagacacacagtaggtgctcagtaaacgtgtgatgagtggggagcaggggccagaacagaaactgttggagagaggtgggggaatatgggcctggaggcatttcagaagacatcctgtgtggacgtgtcctgatgcatgactttattttaatttttttgttctgagacagagtcttgctctgtcgcccaggctggagtgcagtggcacgatctccgctcactgcaacctccacctcccgggttcaagcgattatcctgctgcagcctcccgagtagctggaattgcaggtgtgcgccactacgcccggctaatttttgtatttttagtagagagggggtttcactatgttggccaagctggtctcaaactcctgacctcaggt

SEQ ID NO: 104205 - DNA, 1048 bp, Homo sapiens
aaaattacccgggtgtggtggcacatgactgtaatcccagctacttgggaggctgaggcaggagaatcacttgaacgcaggaggcagaggttgcagtgagccaaaatcctgccattgcactctggcctgggcaacaaaagtgaaactctgtctcaaaaaaaaaaaaaaaggaaggggacaccgtgggaggtgtgtaataaacagaatatggggacacagggtggtgggtgctttcagatgacagctcaccctccctttccctctgggtctcaatgccaagtgccatagccatgggagtcgcctcttcaatgcagccctcgcttctaagcatggaaaattctaacacataatcgcaagttctcccaattcttcaaagaggagagaatggaaaatatgaaggtttattgttctgtgagacttcctgtctgtcctgcatgtggccgtcagaggtcaggggtgcgtctgtgtgtgcaggacgggaagctcaggggcgtgttttgcggcgtgtctgcaggggcaccttactgtggacagaggtaccaagacaagagccggcctggggcgccgggacagtgcacatcagccattgtggttctaccctccagataccgccttgtgccccgtggaagatgacaagtgccagatggagtctgttttgggggaaaaccaggccgggatgaccccgtaggcaggaaaccggtggctttggtgttggacggccgtccaagtctccggtttggcccgggaaacccattgcatttgtggcaggaattctctcttccctcctgtttttcctgcgggtcatcggcccagcattttttgccagagcaaaggtggagcagtgggaaaatgggccaagccccttcaggggccaaacttgcacctggcagctccatgctctgcagctgggaaaactgaggcagtgggggatggggaggtggtttgtatacctcaggggaatgatccattggggtgagaacctgccctggccagagccagaccctctggattcttcccccagagtcaccagcctcaggaagtggatgag

SEQ ID NO: 104206 - DNA, 1030 bp, Homo sapiens
gacagtggcaccatgtacaccatgatggagctggactatgagaaccaggtcgcctacacgctgaccatcatggcccaggacaacggcatcccgcagaaatcagacaccaccaccctagagatcctcatcctcgatgccaatgacaatgcaccccagttcctgtgggatttctaccagggttccatctttgaggatgctccaccctcgaccagcatcctccaggtctctgccacggaccgggactcaggtcccaatgggcgtctgctgtacaccttccagggtggggacgacggcgatggggacttctacatcgagcccacgtccggtgtgattcgcacccagcgccggctggaccgggagaatgtggccgtgtacaacctttgggctctggctgtggatcggggcagtcccactccccttagcgcctcggtagaaatccaggtgaccatcttggacattaatgacaatgcccccatgtttgagaaggacgaactggagctgtttgttgaggagaacaacccagtggggtcggtggtggcaaagattcgtgctaacgaccctgatgaaggccctaatgcccagatcatgtatcagattgtggaaggggacatgcggcatttcttccagctggacctgctcaacggggacctgcgtgccatggtggagctggactttgaggtccggcgggagtatgtgctggtggtgcaggccacgtcggctccgctggtgagccgagccacggtgcacatccttctcgtggaccagaatgacaacccgcctgtgctgcccgacttccagatcctcttcaacaactatgtcaccaacaagtccaacagtttccccaccggcgtgatcggctgcatcccggcccatgaccccgacgtgtcagacagcctcaactacaccttcgtgcagggcaacgagctgcgcctgttgctgctggaccccgccacgggcgaactgcagctcagccgcgacctggacaacaaccggccgctggaggcgctcatggaggtgtctgtgtctggtg

SEQ ID NO: 104207 - DNA, 1316 bp, Homo sapiens
tcaacgccaacttgcgttaccgcgtgttggggggcgcgtgggacgtcttccagctcaacgagagctctggcgtggtgagcacacgggcggtgctggaccgggaggaggcggccgagtaccagctcctggtggaggccaacgaccaggggcgcaatccgggcccgctcagtgccacggccaccgtgtacatcgaggtggaggacgagaacgacaactacccccagttcagcgagcagaactacgtggtccaggtgcccgaggacgtggggctcaacacggctgtgctgcgagtgcaggccacggaccgggaccagggccagaacgcggccattcactacagcatcctcagcgggaacgtggccggccagttctacctgcactcgctgagcgggatcctggatgtgatcaaccccttggatttcgaggatgtccagaaatactcgctgagcattaaggcccaggatgggggccggcccccgctcatcaattcttcaggggtggtgtctgtgcaggtgctggatgtcaacgacaacgagcctatctttgtgagcagccccttccaggccacggtgctggagaatgtgcccctgggctaccccgtggtgcacattcaggcggtggacgcggactctggagagaacgcccggctgcactatcgcctggtggacacggcctccacctttctggggggcggcagcgctgggcctaagaatcctgcccccacccctgacttccccttccagatccacaacagctccggttggatcacagtgtgtgccgagctggaccgcgaggaggtggagcactacagcttcggggtggaggcggtggaccacggctcgccccccatgagctcctccaccagcgtgtccatcacggtgctggacgtgaatgacaacgacccggtgttcacgcagcccacctacgagcttcgtctgaatgaggatgcggccgtggggagcagcgtgctgaccctgcaggcccgcgaccgtgacgccaacagtgtgattacctaccagctcacaggcggcaacacccggaaccgctttgcactcagcagccagagagggggcggcctcatcaccctggcgctacctctggactacaagcaggagcagcagtacgtgctggcggtgacagcatccgacggcacacggtcgcacactgcgcatgtcctaatcaacgtcactgatgccaacacccacaggcctgtctttcagagctcccattacacagtgagtgtcagtgaggacaggcctgtgggcacctccattgctaccctcagtgccaacgatgaggacacaggagagaatgcc

SEQ ID NO: 104208 - DNA, 1048 bp, Homo sapiens
ctgggctgggctggagccgaagcctttcttctcaggtcctgtcatagctgtggggcctggggctggtgacccagcctctgccagcgtctccccaccccctcccacagtaaggttggtgacagcagagttctcttaaacatttgagatgtcctgtgctggcccgtggcagtgcaaccacagctcgtaactgtggcgctgggcagagggctgggtacgcagcaggtgcttcgtcagtactgatgggagaagcagggacggcagggggcggggggacctggatgggcgacactccccagcctgctggtgctccagggaggaccttttcagagctgggagaccctggctcagtgtccttgtccctccagtcgctgctgccttcccgaaagccctggagccttgttaaagagggcagccctggctcttggggggagtcctgggtttgggggcggctctgatatgggggagccgtgggtgtgggggcagctctgatatgtgggggagccctgggtgtgggggcagctctgatatgtgggggagtcctgggtgtgggggcagctctgatatgggggagccgtgggtgtgagggctgtgcctcacgtggcccgagggcagatggcccagtgtggggctgggctgtttggggggatggggagggctgcccagggagaaggtgagtgggtggccctattatctgaagacctgctggggccaggggatgtggggggtggctgccacctctgcagtgaccctggaagggcccatgctgcccctgctttgcaggtgagtaagcgggtgtctgagagttcccagctctgcctgcagggcccatgccctgtggctaccccccagtcccgctctgtttgctttatttaagtattttggaagatcactcctcagcctcatggggtggatccttaactcttctggcccagcccactcctcaggtttctaggtgacccacctgctttgtgtgcaccctgaggcctgctgcactgccaggacctcagcccctgccctgctccccagcagcctgactgcctcccctccc

SEQ ID NO: 104209 - DNA, 1027 bp, Homo sapiens
acaatgactctgctgcactgagtttcaagaattttggcaataaaaagagcctatatgacctatttatgaagtattccagaatcacttacatgaatattttgtcctaaattctgtataattagaagatataaaccccacattgtgattatttttgttcaccaacataacctaaattagaactctccatgcgggctttcagaaaagaaagcatttgaacaaaaacataaaaggaattggttttatccacaccgttctcaaatacttgagagtaacgtgtttgcttaagtaacatcgatatcttgtttactgttatttgatttgcagacctttcctctttaccagtaccagtagcagaaaggtaaattgtactgaaacgtttaaaaagtcgtaagttctgactttgaggcctgatgaaccatcacgggattctcccctgcctggttccttttccccggaacctcacatcaagcagaagcttccttgcgggcggcccttgttgcaggcggtcttggcgagagacatccccatttctgcagctggacggtgaaagggacgttgttgttcttggccatttggcaggtgttctctgactgcctcttctccgctgggcctgccgcacagggagggcaggtgggaccgccccccaacccctgccgcagggcctaccgagagtcccatggcgggcgggcagaggtgggctagtgttgcattaagtgacttcccgtagcaggctgttcagtgctggggcagccttctaagggaggaggcttgtgggctgagacctcttccctttttcatcatttgggcttccggggcatagaatgggatgcgtcattggcctggggtctgtgctgctgttgggcgtctgtgcatagtcctcttttgtctattttcattatttttatttatttttttgagatggagtcttgctcagtcacccaggctggagtgcagtggcgcgatctcagctcactgcaacctctgcctcctgggttcaagtaattctcctgcttcagcctcccaagta

SEQ ID NO: 104210 - DNA, 1040 bp, Homo sapiens
tctgtgatgcgcgggccacttaaaggagcacgtgcgtgcctggtgagggctgcggttccctctggtctgccctgtccctggcgtgggttagtggggacatgggcttctgtgagcgttcttattctgctaggcatctgtggaccccggacagggacggtcagtgacagcccacggaccacacaccacccactgccacctgtttctgcctgttttgtaaatggtgtctgatttgtacacagccgtgcccatttgcaccacagcagagttgggaagttgtagaggccgtgtggcctgctgggctgaaggtgttcaccgcccggcctctcacagactgggcttgctgaaccccacctaggagccgctccctgtgccttcgcgatattgcagtctttgatgcagaaacacgtctggggaacagcctgctttcagacagctttcagcttgtgggaaattgggcaagggcagtggcaggaagacatggcgaatctggggaatccagaaggggcttcctttcggccatctcattggctggttattctcaagccctggttgctaggagtgatggagagagttggaaaaagaatgtttccactagaaacgcatccctccgtgtgtttcctgtggcttagtgtatttgcttctacaacacagtagtttttgcttgcctacctgtgcctacacttaggttttcttgccagctttgttttctttaaataaacatctttgcaggccgggagtggtggctcatgcctgtaatcccagcactttgggtggcagaggctgggggatcaagtgaggtcagcagttcgagaccagcctggccaacatggtgaaaccccatctctactaaaaatacaaagaattagccgggcatggtggcaggtgcctgtaatcccagctactcggaaggctgaggcaggggaatcatttgaacccgggagacagaggttgcagtgagccaggatcacgccattgcagtccagcctgggtaacaggagcgaaactccatctcaaaaaaaaaaaatattaaataaaaaata

SEQ ID NO: 104211 - DNA, 1197 bp, Homo sapiens
tgcgaggcccgcttaggtgcagcagagctgcatgcgcgcactgctctcagctgtggcttgtgacagttgtgtggggactcatggggctcagcccactgcctggggccttccttggctcttgagtcccatcagtaaaccttggttcccctgccaggtgctgccataggccctgggggtcccgagggagctaggtcagcaaaggccctgcccttgaggacttctgttctggggacacaggcaggagatgaggggacgatttcattggcgagtcgcccctgccttcctaacttggggagtggcactgagggccatcccggcgcaccctgctgtgctgagccgccgtgcatggccattctgtgcactcaaggggtcccaggctgttgagacgtcctccctggcccctgcagagccaacggaaccgggcagtggggactgcagagccggcgggtgcattaaccctgggctcccatctctccccttctctcttaggttaactgaaaatatgagacggctcagtgagtaccagcggctctgcgtggcgcccacgatgctcagtgtgggtggggcccatggcggtggggactctgggattctgagctgaaccgactctccagggagacgtggttaagcggcctcctacccacagtgctgaccactgtggtctgctctgtccccagagcgcggtgccaagccggtcactaactttgtgaagaacctctctgccttatccgactggtactccgtctacacgtctgccattgccttcaccgtgagtgggtcctccaggggccgagcagggtgggtgggatgtgcctgccagcattcaccacatgatcaggcaccttcccagggtgggaggtggcccccaggtggcacttcctcaggccccagggacatgctcatttctccttctgtaaagtgggctcactgatgccagtgcccagccatggggtggcttcaaggatcaaagatgttgggcgtggcccggggctagcctgcagggctccctggacagggatgtggtgcagccttgtcccccagggtgcccttgggaaaggcctcttggcactcaccgtgcagtgcggtggccacgctgctgaggtccacagagtacctggtgctggggccaggagtacctccaagggcatggcagcacgaggggcccagcccagcccctgtgagccatgagtcctgagg

SEQ ID NO: 104212 - DNA, 1008 bp, Homo sapiens
ctggcgctgagaccaggcagtttgagaagggcccccttggagccacagcctggcactgggccatatttcattcacagtcacaggccctccagatgtgcagcacagcatcccagccaggaccacggggaatgagcaggcctcggtgctcccttcggggtggctcagatgagtcaggagggttgctgggctctccccactgaggtgaggtggccctgcctggaagaaggagccgctctgggccggaagggacctcgggaacgtcttcccaaatttggatcccagcttttggggaggtgtgtgtgcggccagcacatctgggtgctgcaggcgtgggcagcgggcctgacctcgacgctgtttgccgttggcagctgcagacgacctcgtcacggagctacgtacccagcgcaccggccggcctgggtaaagaggaggacgccggtcgcttccacagcaccaagaagggcaatttccacgagatcttcaatctgacagaaaacgagcgtccgctggcgggtatgtgtgccgtgagtctgaggccaggccgagcgccgacacagactgaaggcccgtgaggggggcgctgtggatgcaggacggggtcgccctgtgacaggccagaggagccctcaggatggcattcacatcccactgccccaggaggagtgcaggagccaggggtcatgaggactctgcgggctacaggggaggagggcgtgcccgtggggagagccgcccacgctgcagcactcccctgacagcaggcgtgcaggcaacacactggggagagagtccagggcgaggcctcagggcctgcagggcgctggcagggggtctgcccctggttccatcgtgtctggagaaacaagagccaccaggggacaggtgactcaggatcctggggacaggtcagctttcccaaagggagggcctgttaaactaaaccgggcagctcgaggtgtgtgatgagcggctgcagaggcagctgcggagaacggagcttcgtcc

SEQ ID NO: 104213 - DNA, 1147 bp, Homo sapiens
agctagagcctggggctgcgtccaggttgggttggaaatcttgctggggccatcgagtcaccggacagacagggatgttgggcacaggggtcccctgactcagtgacttgggaggagggaggcacggggctaaagcctggctcccctctgcctcttggctctgttcccctgaaggctggagcctggctccgggtggtggggagacacctgtcttttgcacccagacccacgtgactagcgtgctggcctggggctggtgttggacttcgtctcggtcctggtcctggcgccagcctggctgtgccatgctcactggtggcatttcttccctgccagccgctcgtgtttggtgccatggtgcacagggatgaggccttcgagaccattctcagccagtacatcaagatcacctcagcggcagcgtctggcggggacagctagtattgacttgcccaggacgttgctggaattttctttttctttttctttttctttttttttttttacgatttggtagtggaaacaattggacatcctcatgagcttttgcaataattctcctggacctgtggttctattgtgttgacctctgcgttttatcgaccaagaaggggccagggctcacagggacgggggtgcccctctcccacagggcacgtcaggtgcctctgagggccacccgcagactgggggagggggcagaggccctcgggggcccgtggagaagacacacaggacccctggccctgcccttctccgttccagcctggacagagaaacctctccagccaccccaagaggttctcgcaaccttgtgtcccgctctccagaggccagaagctcgtccaccaccaaagccatagctgaagagtgcggggcccttcctcctggggacagaaagatgtcgtcaaggagggacatgggggcctttcaccaaccaccgagaaacgggcctggcggccctccttcctcttacatgagaccctcctgtggcatttgcccttggtgccgggctggggccgggcgcagtgaccctgcctgcgctccacactcgctccacgggaacagagagggtgagaagggcccacccctcgcctgccctcagtgtctttggtggcaccttccttgctggcctccagggcgctca

SEQ ID NO: 104214 - DNA, 1783 bp, Homo sapiens
cgacagcgttccctcccccgcgtgcctagccggtgccggtccgggcacagacccccccagcccccgccctgccccagggaagcctgggcttcccgggaacaaggtggcatttgtggagggagcgcccgcaggcctggtctgctggggccgcctgcgctgggctgaagggagggaaaggcggcttgggcctcctggaaggaggtggccaccccgcgggcctgcgtgtctgctggggcggatcccgcagctccctcagcttgtcctgagtcccttgggtgtcgttgagattgttgttttttgaagaaacagaagattctattttttacagcgagcaagctggttttcttatttttgtatcctttttcagatgtaatttttatctttgctccgatcctcatttgctggtgtgggtgagggatccggcggcatgggctggtttcacccccttcacgaggggccgcagagtcacacgctggtgccgggggtgctttggggggagctgcgccgatcaccagattaagcacatgtcctatcccaggcggtggagcggagcccccgtggctctggactgcgcggacgttggcgtcaggatgaccacacggcggcctttcccgaatggggacagaacccgctctgagccgtgggtctggctcctgtaggggactggctctcttggtgcaccaggggagggggacatatcccagtgaaccccaccttggcgcctgaggcaacacagggtgggcactgacccacccccaggggcggctgcagaggcagtgcccgcagacaatggccacacctctctccccagggcccggcagtgcccaaggatgggtccggggcctcggggccaatgagcgcctcttcctaggtgctgggattcagtccccaaacacagcgggaggggtccctggggcagatggggctttaccagcgtcgggtggtttagttcgagtcccttttgtggagaaagggagatgaaaactgaccacgtgccaggtgtggccgaagcccccagggagggccacattcggggagcggggggtcgggggagggccaccgactggctctgctgccagcacaggcccctccctggaagtcctcgggagcggagcgcggatcggcacgggctctgggctccccgtggagagaagctgtagtttttaccaaattgtgtacatctgggcagatgtttaatttctgtgactaatcactgaactagacgaatgttaaattttttatgtctgaagcctgagtctattttggatctgtaaataatcattgccagtgtgacttttgttcaacaaaaggattgtactgtattaagaaccgatgaaaaaaattctcctgtaacatttttttaagaaaactttgtttgtttaaagaaaaagtattgtataaattataatttttatttaaataaacctaaaatgctttgtgctaaggctcagggctgtctgcctccttggcagggccacacgcattgtaggcggcctgagccagctgggccaccaaccccaggccctcagtgccgctgccagcccgccactccctggggccccacggctgccggcggcggggcgtttgggtactgatgcggcctgagtgacggctgtggggtgaggtggggctgagaagcagagtcctgttggacgtgggcattggaggctgggagcagggggcagggcctgagttccagaagacaggaggccaggtggcgagggacgcggcctgcagggagggtacccagggctggcacagggcgaagtgggggaggttgagg

SEQ ID NO: 104215 - DNA, 1001 bp, Homo sapiens
ccaacaaaaaaaaaagtttcccatacactggcctgccccaaaacccactaacaattttagcaaaacagtccaggccaaagaggaagcatttcatgttcaataagaaacccagccattccgcatggctggttcctgagtggctctggtgatactctccagccacctgctgacattcagaatctcagacctcgggactgctgttgcggtaccgtgtgtctgacacctgccagcagccctttgctatctgcgcgcaggatgggggtgactgcccagacattcccgctagataggctctgatttccggggcagcctttcagatgcggcagacatacaacacctgtactttagagttttaagggaaaaaaaatcagaagtgctggttagatagtaaaaacttaggataacttagaaaggctagttttagcttcctttgtggctccctggtgcaaaacaattagcagttatgcaatggacctgattctagtttattctaattaagaagtgaggccgagtttgacttcgttcctgaatacaatcttgagtaactgggaaagtctgagtgaaaggatggcctcattctctttctaatcttgctggtttcaagattagaaaatggcattatttgatctgaaatgtttgagaagacacgaataaagttacttgggcagacttggcttgctttctttcctttacacatacctgttattttcaaagcagaatatttttcatgaaaacacacacaatttaaagaacaagaataaaatgaagcaaggtgtcaccaccacctatgccaggcaactgaacgccgccccgaagccttctgtgccctgctctggagtccccccgctccccctgggagggcgctacgaggtcacgccaagcgcatcccttcctgcctctgtccatggctgtatctgcaacagcgagtttagttttgcaggttttgctccttatccaaaggaaacgtgttgttttctgtaacttgcttctttcactccaca

SEQ ID NO: 104216 - DNA, 1035 bp, Homo sapiens
gagacgccagacccttacagggcatctgtgtgggaggtcagtcatcactgctttctgccttggcgtccccagccagctcccattatggtttctggtcccccaggtcagggcttggtgtggtgtggcgtctgcttttgtccagcctgctggggtttgcctcttggcatgctaattgcttcactcttgctaagccaaggtgcttttgtgcgggttcatcctgagctgcctgactggcctgccaggagcttggtccctcttggagagggagggccctggtttgtggggccatggatggtggggccctggctggtggccctggctggtgggcttcctccaggaagcagcctgccctctccacccaggagtgctctcccatgcaatgggaaaacatcaacaagttgggaaacgctaagttgtgaatgagttcaggaatacagccacactgtctctagtttttttctcatagctttacagtccccaaaaggaatcaggcccaggttcgattcttctatgcttgaggtcagtagggccatagtagggcagaagaatgtgaaccagctcacaggacatttaatttggtcagcaaggtggcattgcccagccctccccattcccccaggtgtatctgggcacactgggattgattaggttgaggaatgatgagaggtggagaattgtgcaaaaactggccctaggaggacctgtgagatgaggcaggagcagccctggagctccaggtgaccaatgggctaaagacaaagccaaggccactgtgtgtgccctgctggggtggccgcttagttattccgactcctttgttttctccgtagcatcacccctatttcagatgtggacagtaggagtgggaattgactgggcccagaggcagtgatgtacagagggagctggctttgaacccaggcacgtgcactttcgtcagtgggtcatcatgctgggacagtgactgactgtacaagagcacagacaaggactagcaatttggatcgctgcagcttcctgggcctgggtgaggtc

SEQ ID NO: 104217 - DNA, 1031 bp, Homo sapiens
caccccagggaaggtggagagagggaggtgtggtcctgtggagccccagctccacctgcgctcgctgggagccttcgcctcacctgttggagcctccgttttctctcacacgtgaaacgaggatagtgatcgcagaacagagtggctgagagctcaagattcaagtccaaactctgcgaggaaaggcggtgagatcttgggccagggtttcctaggacggcactgtggacatttggagccacatcactcttggtggcagggactgtcctgtgtactgcaggatgtgcagtagcatctctggccttcacccagagacaacccaaagtgttccccagacattgccaaatcccccatgagaacctccgccttccagaaatcactcgatttctctgtgctttggtttcttcctctgtaagtgaagatactaaaaccaacctcatgggatgttatgaaggttaaatagtatcgtaaatgcaaagtgcttggcataataagggctcattaaatgttagttcataaaatcagagcgagcagccctggctgactgttgagcccagcatctggggtactgtcggcgttcagtcggtggtggcagtgatcatgtttctctgaggctggggagaaagcctcaggggctacctctggagggacttctgtccccaggcagcagccagaggcacttggagggctgtactccccactcagggtctggctgatgctaaggggcagaggggatccctgctggactctgcatcccctatgctgcacgcttccttcccatcctggcaggaccaagctgctgggtctgagttttggggctctgggaagtgggctcctgtgactgccatgcactccccatagtgggagacacacccagacatccctgggctagcctctggtgaccaaatccccctggtttgctggactttcctagtttagtgcttcaagtcccacgtcccgggaaacctgtcacttttaggaggtggattgctcaagttgtcccgattccaggttgtacagccttccccggg

SEQ ID NO: 104218 - DNA, 1105 bp, Homo sapiens
aaaaaggaaagtttacttttaagagtgatctgggggttagcagcgtgagttactgacagctcagacagtggctttgagaatgaagggagtcatcaaaggtggccggagaccctattcgactccacaggaccgtgcttgattcgagaacagtaagacctttcaacaaaaccagtgtcagggtccaaggtgagtgaagattctggaatggtggtgggtaggaggtcctggtagtgacaggaacaaatgctgtagaacataagagtccagggaagaggagccacatgacagtgtaacttttatgtgttacttttaggtcttaaggttttggttcctcatcagtctaaactctaattcttaatcagcttagatgtaagaataacagagctgctgtgtggagttacagcagtgactcaacctttggattgaaggctgtggctcttggtaatttgtccttatactgagttgaatttatgtccatctggaaactatggatgtgacatttggaaatagggtttttgcacaagtaatcaaggtaaaatgaggtcatactggatgagggtgggccttagttcgtcaactagtatttttataaaaagagggaaatttgaatacagagagacacacacagggaaatggccctatggagacagaaacagagattggaatagtacatttacaagccaaggaaagccaggggttgctggcagccaccagaagctagaagaggcaaggaaggatgctcacctagagacttgacagagagcatggccctgcagatgaccacttgattttgggtttttggcgtttaaaactgagagagaataagtgtctgttgtgttaagccattcagttggtggtaatttgttatggcagccacaggagactaatacagtctccagctttcttctgtgtgaacctgaaataccgaacaccagctttccttttcctctgactttgatgctattctgtgtcttaggcacttttgagagcagcttctgtattacctttgtgaagttggagtcttggagagttcgaggctgtcactgaagagggcagaagaagaaggagaggttgggtgcaccaggaaggcctgtgaagcctctgt

SEQ ID NO: 104219 - DNA, 1085 bp, Homo sapiens
actcaggctgctgcctgctgggcctgcctgcccttggagccctgctgagctcagcctgaggcctggctcctccaggctgggggaaaaccaggcttgctgtgctcggcagcagagattcttctggagtgaggtgagcagcttgttctaggtcccccctggtgttctctttgcagacaagaggcagaggtatcaggaggcccagagggaacagggctgcctgggctcttcccatttctgggccccgtgctgtggggaactttcattttgagtatccccagactttttgttccccctttctgaaatgtttcctcttttctggtgataaacatggaaattccaccccgagtgctgcggttcatgaaggggcacgtaggccctttgagtccagttgcttagaatacctgtgggtttccttattaagtaggaagtagaggctgagaacgtctgtgttgttactgatggcagccccccggggcagggccaggcattgctgggcgccctctcctccctgagtctgccttccgtaaacggcctgcagtggggaaggtgggcctctgctcaaggccccgagctcctaggggaacgggttcaccttcaggcccatccaaggcagagccctttccggcttcggggcccctgatatttctgggcccccgactgcatccgctctgttcccacgggtccctcctgggtgttcttgctcatgcttgggttcatttgagcgctgcctcgccctccgccatcctcttccttctcatgtgcgctgtgtgcaccggagcccggccgatgctgatagaatttttaagtgtgccgtgcagctttctgcacctgggcctctactccttgctgtgctggtttgaaatgggccttcttttatcaaacatttttactaaactaaaaaataaaataggcttgctggctctaaggctttcacctagatgaggcgagtgatgtttattgcagtcgtctggatgagctcctgatccttggctgaaagccatcagtggctcgggatgtgtggagaggacagggcagaggacccggtcttggaaagggggtgggtcccttggtgtcactgtggctct

SEQ ID NO: 104220 - DNA, 1723 bp, Homo sapiens
ccaggagccacgcaggagccatgcaggggccatataggagcttgcagcagccgggccttcacgctcaagcccagggcagggagagggtttccgggcagaagcagcggttcaaagggcatggctgaagctgtgttctcgaggcgggggagggctcttggaaggtctcctggctagaaggacacagctctgagtagagttctcagagtgggtggttgtttcttccttatgtttgtttttttttgaaacagcaacacttgcatgtgttataacatgacacagcacagcagggtgtatgtgaaaatgaggcctgtcccagcccccaccttcccttcctttccacagctcgaggtgtctccttccagcgatggcccatgcatctgttgttttaaacgtttcgtgttgatgcaattcaaacttgcagaacagttggcatgaatagtgccaacaactcccatatgctctgtacccagaatcaccaattgtttacgtttgcccattaccattctgcatgtgtgtgcctgtttttgtgtgtatatatacatttttttcctgaaccatttgagagtcagttggagatatatccctttacctctgaaaccttcgctgcatatttcctaagcacaaagacattccctcagtatcatcacagcacaggggtcacaatcaggaaatttaacgttgacacagtactattttaacacttgtattattttcatccacagtccatagtcacattctgccagttgtcccagtaatgtcctttccctcttttttcttagtccagactccagtggggaccatgcgttccatttggatgtcacgcctctgtcttctccactaacctggcgcagcagctttgccggtctctgcatttccatcttgacactttagcagagcacgggccagtgattttgtgggatgtcccttggtttgtgcttgtctgatgtttgcccacaatgagattctgattgataatttttggcaggaacatcactgaagggattcgtgttctccttggtcatcacagcgggggcacgtggtgctggtgggtcctcacgttgaagatgtggactccgatcacttggttgaggtggcgtctgccagctctttccactgaagagctcccctttttcctttggtgatgaagtgctctgtagagagatgctctggggtctgtgcatttctacagtgtatttctttgtccccttgcacggcaaggcagttgtgcacctcactttttaagggaatgatacattttcccatggcgtacgtggagaaccgccttagtctttagagtgccctgtaacatgccatcctatggatttcccccgacttgactgcaccagcccctgcggttgggcagcgggttattcctaacttgctattattacaaacaacttgagaacgtttcttcaggcgcctgaacctccttctgtgatggtgacacagagcatccctagccatgggtgaggcgagaaggcagtgtgggggatgggtctgtgagttcgcctagagcaccaggtgtggaggtgtcacccaccaagacaggagataaaggtagatcgtgcttacgggagtctagtcttgtagttgacgtacccatcttggccacttcctcttctagcatgccagtgccccttctctgctggctctcctgcctccagggtggtgtggagattcagaaccacgttgcacctgggagagtgggtcctggagccgggct

SEQ ID NO: 104221 - DNA, 1080 bp, Homo sapiens
gtagtgagctcctaccaggcgaggcacaggggacccaaaggcttctgctccaatggagaaagagatctgccgcagataatacggtagaactagggagggttagggcccttaagcatatgtcagaagttccgtggaaacacagaggaacgagtaatgaattctgctggggatttggctgggggtgggagcaggtgggccttcaggggccagaatagctgcagagaagttatcctgtctgtgctgggccccggaggctgagccacctcctcagcccaggactggggcaggggttccatgaaggcaggggcacctgacggacaagaaatcagatctaaaaatgcagacagtatttgggaaagtggcgtggtttggacatctgaatctctttgtcagacataggaggctgagccctggtgctccttccaggagccttggtggcgaccagaaagctgttgctggtttctgcctttccgcagcccttgcatagtcagcgcacaccctggcctcttcacccacaggctggcgtggcaggagcaccagccttaccttcttagagaatatttacttacattcatctttgctattcttaaatattatttaaaattacagatggtcagtgtttgaaatttagaaactactgagagtaataataagaaaaataatagaatctaatgctatgtgccaggtgtggggtgtggagtccttgatgtatattttcttgatcatttctcacagtagtcctgtgaagtggatgctatttttattcctgtttgacagatgaggaaactgaggcttgaaggggttaagaaacatgcctgacattccaagattttgacgtcacagagccagggctcaaacttaggaatgtctgagtccactgggcacaggctctcctgcctgctgtgcaacctgccaagaccagtctcaggaagaaagataaaaacccatgtaaactaccaccctggattccccaggacgttaaaaaagctgatcttctttgtctttttgtgagggctgtgtgtgtgtgttttccttttcacgtagacttgagattaagcagtgtatctaattatatatctt

SEQ ID NO: 104222 - DNA, 1106 bp, Homo sapiens
aatcccatagcacccacgcagcagagtcaggatttgaacctgggcagacgcttgccccatccagagtgaaacttgtggacgctgtgcaggacggttcctggcttgcagtcagcactcagatagctgttgaatgaatacacgaaaacgtaaatctggttttagtttccgtttttttttttttgaaagacagattagctcactgtaaaatctgtttttcttcctttgccaggaagccatcaacagagactctttcctctatcctgttgtagagttgattgacagggttctttgtgcctggaaagcaaattatgttaaaattatcttcacgacctatttataagtgccacgattcctcagcactctttggttataatctgtgtcctcaggtgagtggggtctcccgggtcccatggcgccccctgcctgttcaggtcaggcttctaacttaccttggagagtgctctgcccgccgtcaccacgcgatggtgttgtgacctcacgtggggcaagtcatgcaggccgagtcggcgttcctgagctcccatgcagcgaatgcatcacctcgggagaaaactgtgttcaatgtcctcttaatgacgttggcattttcaccatcggtgcagcttgtgtttctaaaacatgactacctcacccacattgcctatccctaaggcatttcagccacccagagccccttcggaatctgctttcctttctcacggacttaccttttgaacatgcgtgtaccaaatggtattttataagtcgtagtcttctcgtatcaaaacgagtcctggccgccagcagaacgtctgatcagcctaggtgatcggcctgcccagagagagctgctgtcatttccacttgaggatgcgtgtgggcttggtcactttgtgcagcctggtggtgtgagtgaggtctcagccttaggtgggcttctgaagggtgacctatgactcctctcttctctgagagtacctgggtggagcgtactggggtcccaggatgatggatgatgggccactttctactggggcgggcagtgaagacttcatctggaggtgcttgtcttatccgcagggactgtctgtctcaaccacgtgagc

SEQ ID NO: 104223 - DNA, 1051 bp, Homo sapiens
aatatgctgaaaacaaggacatatgtttgaccaagtttttttttttttttttgtaagtattagtagcgctgttaggaaaagagaagaaatggatgagacaagtggtttgtgtttctgtgggtgagagaagtggtttgtgtttctgtggtggagtgtggagttctggctgccgcagctctggcgctcagctgccggtctggaagtccttggggaaaggttggggtaggcggtggtgacatcagcaatgccctcgtacacttagctcaggcttgccgttggaagtgagtttggccctgcccaccatttcagaattgtttatagacagttttcttctcttttcctttttcattatttttggagctaagtcaatagggagctctaagtgtttactctaaactgggtctgacttttagtatttaagactctttctggctaatgagccttaataagtttgcagcttagtacctcgtaatcctaaatgcagacgcagctctgaacagcgaatatttattgattaaatattcttttgcaattaaaattagacttgctgccattgcttatgtttttgttttgtgcttttttattttaacctagttttccagtttatatccagttttctaaatgtcccctaagataggttgcagacttctcaggttggtttgtaggaagttatgatgaaaacaccgaattgccgttttctatttattaaggatgtgccgtgtctagggggaaagtctcatgtgagttattttatactgtgctttctcctctaattctcagcctctgcgggttgtggttccgcttccctaatgtgtgtagcacaggggttgatgtggacatggacactctgatttcagtagacagaggagcacaaggggaggtgacagccccactctgctggttgtggacaggagggcaggtgggtgtaggtggagtctgacccaggaaccccggcgaggcaagtgagagtgtgaacccaggagatctgagactggtctcagttgatttagaaagtttattttgccaaggttgagggcgcactggcgacgca

SEQ ID NO: 104224 - DNA, 1007 bp, Homo sapiens
gtggggcgtacctgtagtcccagctacttgggaggctgagacaggagaattgcttgaactcgggaggtggaggctgcagtgagccgaggtggcgccactgcactccagcctgggtgacagagcaatacttcgtctcaaaaaaaaaaaaaaatttgtcttgtgttggccagtagaaaaaattgagttatggtttctggcattgtagaggtgcagaggttagatttcaatacatctgcaagtgatggcaaatcccgaatgtgccttcacaggccagaactcgattactatctccagtacgaggtcattgtcagcacattgtttgttcctctatatgcttggctttgacctcatggtccaaggtggctggcctagcactctttatcacatttgcattccactagcagggataataagacgtgggtagagaatgccatacccccactttaaagatgtgtcccagcagctgctcatagcacttctgcttgtttcctactggctgtaacttagcctgtcatccaaagtgacatggttgtatacttagctgtatggatcagggaaaatgtaactttgatttttttagttgtgtgctcccctaaagtttgggctgctaataggaagaaggatttctgccgtaagcatccctccaaccccctgcatctatcgaaacatttgcttatccattccacaggtgatggctgggtccactgtgatcagtttctactttccttcttcctccttttctccttccctttctctttctctccctctggtcagctttatcgaggtctaataaaattcacgtattttaggtttataattggatgttttgacagctgtggtttttttttttttttttgagatggagcctcgctctgttgcctaggctgctggagtgcagtggtgcgatctcggctcactgcaacctccgcctcctgggttcaagcgattctcttgcctcagactcccgagtagctgggattacaggcacccaccaccatgtccagcta

SEQ ID NO: 104225 - DNA, 1086 bp, Homo sapiens
tccaggccaccaccatcttcgttgcgctatttcaaggcctcgtggaagccatgggctgctgctcccgcttgtctgtgttgtgttcgtctgtgttgcacgtcctagtttctttcatacattccctctggcccttgcaagtgtgatctctccctcctgtctccctccctttctccctccctcttcctccctcacgctgttgccaggagtgggaggtggcagagacgcctgcccaaggaacctggccagagatatcatgaggactgcctggctctccatatcaacctgttcagtagtctgcctgttctttctgaggattctgtggccacctttccattctgttgctaactttggggacctgtttgtttagctctttctcatcaagagagattcagaaaaattgccagggcttttagaatcctgccctcacctgataaactcgccttttaatgccagctgtgaatgagagaaggacgctctttgtacacttgcataaatgaggtgctctgagctacgttgggttgtctaggaaacatgcctttggagggcggcaaggacggagggctggggtattagaggcgaacaggagagatttgcaaaacaaagcaaataaaaacaaacctgcatatcttcaaataaaacattttagctgaaagagagaaaacaagaaatcaaagccccttaagcaggaaagattttcattttcattttcagtcttaaattgacaagtaagatggcatgcagacctttttcccctttgttctacgccagagcaagactttgttaaagaaacagtattagagtttcccaccaactcttgactgctcaccatttaagagtcatttttatacagggtcatgcctttgtagtcaagagcctacattcttggtaatgccctttgagattttcccacatgctgggtgcccatgggggtagagtctcctccaccaaaaccttggttgcagtcatgagctttgctcatccccccacggtgggtttctcactccgggtgtgtattggtcgataaccctttgagtctctggagttggtctctctgtgttccgtggcaatggtttgtgctcagcttgg

SEQ ID NO: 104226 - DNA, 1033 bp, Homo sapiens
gactgattgtgtcgcattttgcttctcttccatttttgagtcctgtcttcacacctgaccctcaaagaagacgcaacatcaaggtccacccgaatacctggaaccaccatgagcatgacaacagccggtcacactcgtgtggttcagggagtcagaggctgtgagtgccagacggaacctcgggatcatctgagtcatcctccccattctcagggaaacctatgccagagaaagaagttggttttccgagggccccatctgtgatggagctgagcctgaccccgtcccccatgtctgctctgatgctcccctccagccctgcctcctgccacaatgtttgtgtggggccttgaagagggcatggcctgctttaaatgttcccatgtagatctggggtatgtctggcagttattcctactcgtttggtgatagagcaaatggaggcttcagatggaagcgtctgaatggatctcttgttagcaaatttatatcatttcatccatctgccgaccaggtatctctgcacgcagggaacttttattcttttggtggggagagagaaatactaagttggatattggcaagcactaagaagcactaagaagaaagaactgagaaaggaaaagaaagtgttgcagtctttaatgctggctcagcaaggcctcactgagccggtcagcagtgacgggagtggtgagcaccatgcgcaagggcaggcaagtgagtgcggagacttccagggggccctgaggcctgagccgaggctgctggggctggagcagcctgagcaggggagggctgtgctcagtgtcatctgagcagcaatgacccccatggggcctggaggccagtggagggacattggttaacgtgggttaacatggccttttttgaaaagggtcgccttgggaacgtactgagactaggttgtagggagaagctgggtggactccaggagaccagttaggtcattgtgctaagccaagttggagtgatcggtggtggcttggagcaagagggtggtaatagtggc

SEQ ID NO: 104227 - DNA, 1044 bp, Homo sapiens
aggaagttgcaaggaacaacaggaggatggtggtggtagctttcctagattgaggtattcacggtagatgtgcgcgaatgacgggtgagtgtggaggagaatctgaagaggtagagagagcgccttttacgaacccttgcgtctccgggatggatgtgtgcatggataaccggggacaatacaaaaccaaacacaccccacacctctgcagttctgttatttttctccagtttaccagtgtagttttaattctgttccttttctctagagaagttccttataaataatctccctctcacattccttgtaagtgttcgggatatgtgtttgtcctgaaatacgtgtgtgagtctgcatccatccgtagaagtgtgtatgcataggcgcatgtttgtggacagaaacagcccagcacttccggagctttcagctgtccctgtacgtggcattgggcctacctaacctttgcttctttgccgtagactctccatctgcaaaatagagacaatccttgcagcttttcttctctctgggaggttaatgattgagtgtatgtatagtgctgggaagcctttgaagtaaaatcacaaagtacatgtgtattatttttgtagctctaatggtatttatatttaaatcattattattacaataataatacactggtttgccaataaaacacaaaccacttcagaagaacgttctaaaatggtagcattttctgaggccgggcagcagtgtctaattttgggccttcacagtcagtttcgcgattcatgtgttatgcattttcaaagaataatcaagagcatgcaggattgcccggggcagtgagtactgaaaatgtacagttgggccagttgtgctaagagagtgatgggacatctgcacggacatggctgtatttcacgccagttaggggctgtcactgcagccggcgccatcttggagccctcggagcttgacttggtgataatgcgtcatcagagctgagcaccttgtgtcagctgtccagttacagcgaggtgtaaagtggacgagtgt

SEQ ID NO: 104228 - DNA, 1004 bp, Homo sapiens
cggttctggtgcccaggattgccatggacctctgattcactctgattccgcttggtcagagccggccaagcccagccgcgcctcctggctttctgggcagcctggcacccgtcagttcactcttgtcgggaggttttcctatgacttactgtcagcctggacttggcttttccagactccacgttttctaatgacctgccatcggcatttgcttttttgacatttacttggcttcttggccctcgaaactgactgggttcacttagcctttttagcactgccttcagacacctctgaaagtctcctttagctttgtccacaggctccttttgaattcttctggcccaaacctgcatcagctaagagccctggttccttgtagcagaggatggtgtcaaagactaacatctcgttagttagcaggggaatcacacagtgggactgactgctagtgatggagcaggcaaaagggcctgagtctcttctgttacctccaatttaactaagtgcttcttacctgcctccaacaggaatgttgttattagtgcgtttttcacggtctttggtactggcctgttatatagtgccatatcagacattatgtaggaggtacagtgttggactcatcttttttttttttgagacggagtttttgctctgttgcccaggctggactgcagcggcacgatatgggctcactgcaacctccgactcctgggttcaagcgattcttctgcatcagcctcctgagtagctgggattacaggcacccaccaccacgcccagctaatttttgtgtttttattagagacgggttttcgccatgttggccaggctggtcttgaactcctgacctcaaatgatctgccggcctcagtcccccaaagtgctgggattacaggtgtgaggcatcacgcctggcctcttggcgtcttttggccctttggcagtgtccccaaccaggcagtctgctctgccactaccacacaggcatagctgaggac

SEQ ID NO: 104229 - DNA, 1011 bp, Homo sapiens
tgggggtgccaggagcccgggccgtttcctgtcgccttctgccctgggcctgtgtgctgcattcgattttttcttccaagcgctctctccattgaaatgcggtctttaaaaagtatactcctggccgggcgcggtggctcatgcctgtaatcctagcactttgggaggccaaggtgggtggattgcctgagctcaggagttcgagaccaatcatgggcaacatggcaaaaccccgtctctactaaaaacagaaaaaattagccaagtgtggtggcccacacctgtattcttagctactcagaggctgaggcatgagaattgcttgaacccgggaggcggaggttgcagggagccaagcttgcgccactgcactccagcctgggtggcagagcgagactccatctcaaaaaataaataaataaaaataaaagagtatactcctggcatgctttttatctgagaagatgtaaaacagggaaaagaacttcaggccgttctctttgtggctgagtttcattctgcctgcgtggtgacagcagccttgagctctctgggaattcacatcctgagcagtgtgctaggaggatgcgagggatgctggtgactctgctgtgagtttgagctgcttctgccaaaaaactcacgctcaggactcacaccttgtctatattttgagttacatataataaagattttttaaaaaatcacagattcagtgtgtatgaaattttctactcttcaccaattctgatgaaattcaattcttcaggaggttgagttttctggaacaagccacctctcttcccttgagtgtcccatcacttattctagcaccttttcattttgttcgagatgtttgctgaagcggaggcggtgctgtggggggtttacgcgccagcctttcatcatcagttacaaatagcaggcaccattatgtgggattaggaatcaaatctctacagagtgctaaagaaagaagcgtatggctggttttcatcccggcacctcaag

SEQ ID NO: 104230 - DNA, 1028 bp, Homo sapiens
cagcctgttctgctgccgctggtgcatcatcatggcacctgatccttgttcagtatcttaggtgaaatgtcttcattttattttcttcagcatggccagtgcaagcctcgccatccctggggagggtgcgtcagaaggtcgctggaggtggggcctgcactttgcagatgtccctgatatctctcaggacagagcttgatcctgggcaccttgggccccgaatcactcagcccacgtgcagttatcagcgcctgctccgggttgggccctgttctcagccctcaggcatagcaacgggaaaggtgggcctgctgtcgagggctcttttctcagagagggatcctgacagcaaaccagcagcatctctcaggcacctttcaggtgatgaggccatgtggtgggaggccacaagagccggccctcaggcagggtgtccatggcagggggtcctgaattgagatctgtgctgcatgatggggccccaggttctagtaggaggattctggcttggagtgcctgggccaggacagagcaggcgaagggtgtggggagcagcaggtgggccggggcgacgggcacgaggtcagggccaggatgcggctgtccccgggcttgctggagaggctcagcacacctgcagtgctccaggtgagagacatagcatggtcaggaaaagctgttgtggggactgagcgagtgagggccctatctaaggcagcagcccctgccacctgcaatttcgcagcccagctggtggccagcagtcagcaagagtgcgatacaggtgcccaggtgtgctgaggacgtagggaagatggggtgtgttcatctttccaggggaggaggaggcttcctggggagacatgtgagcagggtctgggggctgagttgcagctgaacaggagggtggaagggtgcaaagagggtcctcccatagggcatagagcaggtgtccaggaaatgagtgagaggtgggttgcaccaaggaagagcattccaaggctctgagggcaggggggcgcagtgtg

SEQ ID NO: 104231 - DNA, 1058 bp, Homo sapiens
ggttttaactgaagaggagccagagagccgttgacatctgagttgatcatctccagggacccctctatcccagagccctggatccccccagatgccagaccaaggctgcgggaacagcagtatgccaggtgcagggcctgtgcaggcagcctgggagcttgttccccaggagtgtaagaaaggctggcgggtctgccccactccaggccacaaagagtgtactttctttggggcatttttggtaagctttcagatgatgtattcattaatattttatctgcagtgtgaccttaagcaacttgtctaactgctttaggcctgttgtgggacgaagccccagaggagggcttggtttcgtttgctgtgaggatttgtgtttctcctgatcttagcttgttcttagtgcgagggtgtggcggaggagggctcggggaccttccctgcttgcatgtagcaattctgtgatataccaaggccagccctaccctcttgctagaaatgcatggcctgggaagatttctgacaagattagaaagaaaggaatacacatagcctattaatgaaggctgcatattaaatacgaatcatacatttttaggaaaattattgaattgtatctttgtggccggtgattgaaatcatagtcctaaagagttgagtagatcacctgtgcagggcagcgtgctgggcgctgaaggagaggggcacagaggagaagttcttgccttcaaggcaccaaaccttcagcacagctggttgctggaaatagatggagacagccccgagcggagcagcaaaggagaggacccagagaggagtagtcctggggctgtcgggaagcaccggctgccccaaccctgggcaagtggctgaggcctactgccccaggttggccccaccagtgatggtgaccaagaggtcaggcctgcagtttgatgggactttgagaatgaacactcagttgacctcatccttgatggtggaagaagcttgccccatcctgtgtggagggttcagagctggggtctttcagagcctgtcgggtgccctggcaaggc

SEQ ID NO: 104232 - DNA, 1101 bp, Homo sapiens
gcaggcctggctccctgcccctcccctgcctgcccttgggggagagttaagaaacaagtattagtgaagatttcattgtgtttttgctgtgggtctccacgaggacttagcaggcctcggagttgggactgggttggattgagggagacctgcgtgagtcacatcctcagtttccccatctgacttgaggaagctgcaaagttctaaggtctagaagcagctggtttttagtgttgtgttttgtttcaagtgagtgacttcaggtgaggagatgcgggttccttggccacgtcgtgaatcctgctctgagttcctcagttccccctgtgtccagctgtgcgtggggtgggaaggaaggaggatcgggagaaatgcagtgtccccctgggaatacactgagtgagtggaccttgggcacactggacccatgcctagcagacaactggacatgtagatccaggaaaagagccctcctctgagtcacgccaccctgtgcgtcatgggagataaagacttgtattaaacaagctggtggaaagaaacacatttatcgaggatcgttagggaaggtgattgatgtcatcaaaacactttgcattgcaacatgccaacagcattttgggaactaagctgctggggactagataaaccaaggcatatgggtacagctcacaggcgtttcttaaaaagctggttttgttgaaaaggaaatgcatcttaaaattcacacaaacaatggcaaagccacctggtgctcacgcaggaggatgtggtgctgcctgaatcctgaagtgggtggcacccacgaggggggttcctcggaatgctggtggcgtgtgccgggacgtacgtgcgggactagagggcacatgaggggatgctcgagtcaggggaggtcgggagggagggagggccaagctttggctgcccaagggtgcacagtatatcatggctcagccccgcgaagagacgctcctcttgagggcacctgtccctctgtttgcatcccttggtgagggaccaagcgtgtgcggagggaggctgggaagcacagcctggctgtgtgtccactataaggtattcccgtggaaggcaaagcac

SEQ ID NO: 104233 - DNA, 1034 bp, Homo sapiens
tgcctgacctggctctacatcccacaccctgtgcagggggcctagcatgctggcagcctgctaagagctggataggtatgtggtgagcacatggcaccccgatccgatttacttggtgtcctgtcgggcacacttgtgaatacccgccaggcctgtgtgtgggtggagacagaacctgccctctggccatcgaggctgtgcctcttggccatacatgtcatggtcttgttcatcagacctgccctgcctgtctgctgggagggcccgcatggagcctcttgcccagctgcagacaagggagggtgaccggccccacactcctatatgaaggatggatagctctgggcagctttttggttctggggtcagatttgaatgtaaaactgaaaagtcctaaatttattaaaggctttcttttggggctggaatatgcaatagattttctatccctctcaattccctcttaaaatttaatactgccataaaaatgatggataacaaattattccaggaaaaatggtactgaaagactcttctaactgttgaagcagaagtacagacttggcgaagaaatagacatgacccagaaaactcacgaggaaagaggaaatcgtgtactttgtggaaaccatatccacgtaatgttgttccaggctgtagaaagcaactattgttattccagatactgaagcacagagtctattttgtgccgctggcggtttcattaacatagtaacactctgcctttctagaattgggtgagcagccttccctgtttggaacactgcagagggagactgaaccccacaattgatatcagaaggccccgtgtggatgcctcttcagggtgccttccacagagctctgccagcatgctgaggctgcggggaaaaaccatgaagcctcataaatatatacaatgattgtgtgtacccataatcattagaaataaaaatttaaaaaaacacataaaaccacaagggctctgattgctgggtctaggacttccccactccgacagtgatggtagcaga

SEQ ID NO: 104234 - DNA, 1065 bp, Homo sapiens
ataaaatcctagtagagaagataaaatggagtactgcaagatatttgattgatccgaaagagtctggacatgtaggaaaaaagaggagtacagaagagaacatcaaaagcaacagcaatatagtagacttacacttaatcatattaacagttatgttagatataaatggattaaatacttcaattaaaagatagattgtaagagtgaatagacaagcaagatccaactatgtgctgtttgcagatgaagcactttacgtgtaataacatggatagaaaaaatgatttaaaaaaggtgtatcaatgcaaatactagtcagtagaaggctggctacattaatatcaaattagggagactgcaagacatactttggcatactaccacagctaaagaaggacttttttcttttttaatgataaaagatctgttaaccaaaaacgtataaactaccctaaatgtgttaacaggacttctaattacatgaagcacaaatggacagacttgaagggagtagataaactagttataaccagagatttttacttttgtttctcagtcattgatggcatgaagagaccaaaaatcagtaaaagtatatttgatttaaataaaattatgaagtagcttgcttgatctcattgacatttatagaatactacattcaacaatggcagatacccaacaacattctttgcaagtactcagtaacgaatcaccatgatttcctgggccgtaagacaaggatcaaagttatatggagtatgttatctaactctaatagaattaagttagaaattaatcagaaagataaaaatctcaaaaattttgaaacttaagcagcatgcttttaaataatccgcgattcaaagaagtcaaagggaaaagagatttttttttaaccgaatggattataaaaatgtaacctttgaatttgtgggttatagctaaagcagtgcttggggagctaaccatatacctgtaaaaatatatatatatatatatgaatgaaaagaagaaggacttaaaatcaggaattttagtttttaccttcagaagccagtaaaa

SEQ ID NO: 104235 - DNA, 1044 bp, Homo sapiens
tcgccgctgacctcctgctggttgaaagctcgtccagctgaggagatgagcctggcagtggtcacgtggtcacagcagtggaaacgctgcccacgttatgagttattagatgtggctgtgtgacaagctccctgcagaaccttccctggggcagcgtgcccctcagcagcacgacccctgcagtgtgcggcttgtgacctctggtccctggaaccctctttacagcacgtggactgtgatgctttagggacagggctgggcaagaaatcacacagcctggggtgccttccagccaggccactggaagctctgtgactgggggcacattgttcagcctcactaagctagtccctggcgacttagcaggagagccctcctcgcatgccacgcgtcagaggcacgccctgctaggctccgtgcttgacctgtgggactccctgtggactagtgtccagcccctgacccaccccacgtgttcctctgtgaggcgtcccgggcacactgtggactgttggccccttcatggggtgatacccactgttccccaaggtgcgggctgggaagtccttctgcccagtgttcacccagcagagggctctgggtgcagcaaggaagaccccagcagtgggaaacagaccaggctctgcaccagctggctggggtcagccacacttcaccgctctcccttctcgaggctctcgtctctcagataaagggacggacctaggtccccagggcagtgctctgcgcagctggcagcctgttgttccccagctctgtgcttggcagaggctccaagcatccctattccttccgagggccttgggaggagccagggacctcctgccgccccgcttcatctcggccccaggagagaccagacaggtgagggccataccgaggccaagagctgccaacagatcctggcccagcagatggaacccagcccgggtgttcgcaggtggatgggacaagacgctccttctgctaacttagctcctgcctttttgtcagtgtggggctcggttgtgccctgcggggagc

SEQ ID NO: 104236 - DNA, 1005 bp, Homo sapiens
gaagtggatgaagttggcgtaaagcaggcatgctgtttcattctgatgaggggtgtgatacacagcgtttctgcagagctattaataatttatatcaagagcctttcctcgatccagtaattctccttgtttataattatggaaaaacaaattggcagcagcctgcatatccagctctcggggtacagttacctaagttatggtacatggctggttataatgtttcataactaccaaaaattacatcttcaagtaatatttactgaaacgagcaaatgttttcattgcgtttctatgtggaggaaaagcatgacctgaaattgtatatatcgacatatgtaatacagataaaaatgatcccagatttgcttctattccacgcgtggacagaaagaccgaacagaaacaaaccacggtgctagcctgacttagttttcattagtagagttatggatattttattttcttgtttgaaaaaaaatttttttttttttgtattttgcatgttcttttcaatatgtgtaaacatggttttctcactagggttaattcccacgttaaggatggttgtggggattcggctgctttgtgaggttcgtggcttggagctggagctcagaatgctgggctctgggttctctgcccttcttctaggatgtcgcactgcgcccgcccctcgggtgtcctgccgtgcctgcccctcaggtgtccccaccgcatccagccttgaggtgtcctgccatgtccatccctcagatgtcccctcagctcgctgacatgcacatgtgcaaacacatcactcaacacagagcacacaggcccatggccctcaaggcaagaggcgtgccctgctcgtctggtggagacttagttagcagatgcttccctggtaacacatgaggggcactggggatgaggagctggggatgagagtgtgagagggtcagaggggctgtgggaagagagaggtgggtggactctgcaggtcaccccagctcctaggct

SEQ ID NO: 104237 - DNA, 1001 bp, Homo sapiens
tctttgcaaatggaaaattcttggttagtgataaagaaaactactccttgccccatgtggaattggcatggatttttttgtctttatctttttttttctttttctcttttttttttttttttgagacagagtcttgctctgtcacccaggctgaagtgcagtgacgcgatcttggctcactgcaacctccgcctcccgggttcaagctattctcctgcctcagccccacgagtagctgggattacaggtgtgtgctaccacgcccagctgattttttttttttttttttgtatttttagtagagacggccaggctggtctcgaacccctgacctcaggtgatccacccaccccggcttccccaagtgccgggatgacaggtgtgagccaccaccacgcccagcctggatttcttttgacgtgggcctcctaggctttcattattgcagcgagagtcttcatttgaggggctcttgcctgcacctgtggccagcttgctcttccactgccgtcggggaaggcggccccgttcctgtgtggagagagaacatccgcctcgtcattgttcactgagagaatgtgagtggcaggcactgagcacttttcccaggtagcaggaggagctggggccacagggagtgggcttccacgcatcagggctcacagatgtgctgctcttggcgcctgcttttgtggcaagtgccttatgttggttctcttcagggcaagtggtcttcgccttctcacctgagccatcctggcccagccttgaggagccccctgaggtgagggtttccggcctctcccacccacccatcctctcctccaccccacccgtccttccctccaccccacccatccccccatcctccctccaccccacccatcccccctccacccaacccatcacccccctccaccccacccatcacccccctccacccacccatctgctccacattttccccagctcctcacctatttcagcagggagccccatgg

SEQ ID NO: 104238 - DNA, 1359 bp, Homo sapiens
gcctgggctgagctgcgctcgctaagacccaagttcaggagtggcggcaggagaagccccgctctcactgcctcaccgccctgcttatgtctccagataatcccgttgtaataaacttaattcctgccagtccgtgagaaccagcctgtggacctgttgcgaagtccacatcatgtgactgctcctattacactgtcagtcttgattaagatcccactctgaaatgtcaagctgtggtcttgtctgcgctccctgattcattcatatctttttataatcattatcagatgacacctctgtcactttggagatgtgtagctaggagcactggtgacacccacagtgaagcccagcaatttttgaagtgatttctcctcattgggagccacagacctaatgttgagcaaaaactgagctgtgtgtatttagaaatcaattgaaaacatcacattgctcaggctctgaatgcgcgtgctgagtctgcctattcttctcggtggcccaggctgctccgcttattttaagatagagctcatcggttgtgaaaatgctactgtgggccgggcgtggtggctcacgcctgtaatcccagcactttgggaggctgaggtgggcggatcacgaggtcaggagatcgagaccacagtgaaaccccgtctctactaaaaatacaaaaaattagccgggtgtggtggcgggcacctgtagtcccagctactggggaggctgaggcaggagaatggtgtgaacccaggaggcagaacttgcattgagatcgtgccactgcactccagcctgggtgacagagtgagactctgtctcaaaaaaaaaaaaaaaagaaagaaagaaagaaagaaaatgctactgtgtggcacccatttcaggagacaaggctcgtttatccggaagctggccttgcttggcagccagccaggcctgcaggggatgcctgcccctgcctttgctccttctgcaggccctgaaagcctggccctggcggcttgggcctgggggttgtccctggggctcagttgctgccctggcttctgcagcctgtgagcattccccatgctggggcggcttatcacaaagtgcaacttgcccctaccccaaaaaaacctgcctcccacaatcggcagcacacagccttgggcaggtgctggagttggaagggtctggcatacagactccggagccctgactctaggaccgctctggcttgttagcatgtatgttagtccattttcatactgctttaaagaaatacccgagactgggtaatttataaagaaaaagaggtttaatgaactcacagttccacatggctggggaggcctcataaacatggaggacggcgaa

SEQ ID NO: 104239 - DNA, 1047 bp, Homo sapiens
gcacgcatttataatcctcggaccagctctcccacagagggcagttgtccccagatcagagctgaacttgcttggagccacacagctggtatgtggcactgtgagtggaacccagggcagccgactccacgtctgggcttccagcttcgtcggctgccctgactttcctccatgtcttccggaaggccctcccaactgcctcactctgaagcagggcaccatgattctgtaaggaaatgagatttgagccacacgcctgtttgtgccacacacctgctctttcctacgttgcttgtagtgttttcccagaaaggtgggaagaaggaagaagggaaggagagaaggagggagagaacaaagaaggaaatgacgtggataatatcttaaacactacagttttttaatatcaaattccactagttccaaaatagaacttagctggataatattctgagttgtggctggaatttctgttctaccaaatggttgtctggcatgaaacgtatttggatttttatggatcaattttatcagtaacagtgctagttggacataagcaacatcagcctcctgtgtgctgggcccactagtaggcactgagaattcttcccacatctgccacagctctggcccctgtggctctttgccaaggtcagctcctcataggactagctccctccaggttcccagtaggaagatgggacctgtggagcctactttcaagcctaccccagaagctgtttactttcccatccatccacccacacacccatccattcacccacccacccattcacccaccaacccatccatccattcacccacccacccacccactcatccaccccatccacccacccattcttccatccatccatccacccacccatccattcattcagccacccacccatccatccacccacccacccattcttccatccatccgcccacccattcttccatccatcctgccacccacccatccattcacccacccacccacccatccattcacccacccacccacccatccattcacccgcc

SEQ ID NO: 104240 - DNA, 1034 bp, Homo sapiens
cgcattgacctgtcataacacaccagaggacgggtaccaccctcattccaatcgcacaaatgagaaactgaggcttggatacatcatccagtggtttgctctgtgtcatccaggtggtagctggaattagaaccccagttttgcaggctgcgtatggtggctcatgtctgtaatcccagtactttgggaggctgaggtgggtggatcacctgaggtcaggagttcaagaccagcatggtgaaactccatctctactaaaaatacaaaaattagccaggcatggtggtatgtgcctgtaatcccagctactcgggaagatgaggcacgagagtcgcttgaacctgggaggtggaggttgcagtaagctgagattgcgccactgcactccaggctgggtgacagagtgagactccctctcaaaaaaaaaaaaaaaaaaaaaaaacaggttagtgacacctgacccggcgccctttccccagcaggctgtagccacatagcccactcagtgccatctgcaaaaaacaggctgtgccccactgaaagcaggctctgccccgcagcccccccccggaaaatcactggatgcccctggccagccactgcggaccaacgtgcagcttcctcgtatggatcccctctttgttcacaagttactccattaaagggaaaggttagataaatgctgtgctttgagtcaatggagccaatctttcttttcccactggctctgagctttgccgcttgccccatgagtgctctaaacgccttttactacttcataatcacccgcattgtgctccatgctcaccttgttatttaaactcccataaaaggtaaaattaaaaaaagttaatagcctaaaacttgcttcttcgaacaacctaagaggacattttactcataaatgtaagcaaggaaacaggattccatttctctggttatgagacaaataaatatcttcccaaggctccaaagccatagtacccagcgacagcctgctcaccgcctcgtgctcagtggctctggggagagcc

SEQ ID NO: 104241 - DNA, 1044 bp, Homo sapiens
atccatcaactctgttgaccagttgtgatatgaaatagataggacgtatgttggtcctgttttaccaggggtacgcctgcagctcagagaggttaagtctgctccagggccaccagccagtaaggagcagagtggaaccacacctgaaaccaaatctcatgattcagacacctgagttagactcttcagatgggccttagaatatgttctgggcacaagggtcacatcttatgtcctggtatcagtcattgtacctagcacactactggtcatggcatgtatttgcataaattatttgatgaaggccgtctgggagaaagctgactttgcacatttcaggcaggggctgtggctgaactcattctgttgggacactgagtgccctgctgacccctgaggggcaccagcccacaggacctgcaggaaggtctgcacctgcagaagtatgtgagggagaccaggctgcctgtgggctcctcattctttaactaaggaggatttatgacccagccgcagtgataggaattcaagacctctcaacatgttcacattcaaaaaatcagtaggtatcgattcacattactgagttgactgaaggcagaggcagtatttattctgagttgtgttcctgatgtaatagtatttagattacaatattttctgtaattacttagaaatgacaatgcatactgggttagtgataaatcagaggcaatttaaataatgtcatcaggaatcgagcataaattctgtggatctcatctcagccaatgggccattgctttgaagggtgaacagtgtctctaacagccagcattgcccaggggaggtggggtgctgagggccctagctctgaccctggcctgtggcggcctgtcatctcatcccggcagctctgggtgcagctggcgagctctggctggagcctgcagtacggatcatgccaagggtgcagtggaggcaggactgcgggatagacatgactccgggcagcaacaggtgagggaggagagcgctcagccaggtgatctgtgactcatgaag

SEQ ID NO: 104242 - DNA, 1356 bp, Homo sapiens
cagcacacgacctccctgttctgaccctgagagcccaccaggacttccccttctctccagccctcattctgcaagcacaacctaggacctggtttaacttgggattctctgtcgtggaacacacctgagtggagcccagcaggacaggtgttcctcttcacttccattttgttcttctaaaattgagatggaagaggctcttttcaggctggagccatgcagagtctcaaagaggaaagaaagaagacctctgctgtgatagaaacccttaagagacagtgaaggaatttcacagacctgaacatcaactgccggagaaagaagtttgcccaaaaagtgcttcaaaaggtaaggaggaagcttatctatgagaacactgtgactaccacaaagaacacagaaggaggcacagagctggggtctggatggctgggacaacaaggaaaaccttgtgggtgcctgcagaagccaggctgaccttcgtcatcgggatcagaggtgtcagaagtgtgagcctgaaggcctaagaggtgttgcagcttctttaccattttttttttttttgcaaatggagtcttgctctgtcatgaggctggagtgcgatggtacgatcttggctcatgtcaacctctgcctcctgggttcaagcgattctcctgcctcagcctcctgagtagttggggttataggcacctgcgaccacgcccagctaatttttgtatttttagtagagatggggtttcaccacgttggccacgctggtcttgaactcctgacctcagatgatccacccgcttcagcttcccaaagtgctgggattacaggcgtgagccactgcgtccagcctagcttctttacctttgctgtgtcttcaaataacttttgttaagctctgcaaggcttcagttatgctgaggctggagggctcagatgctgtcttgcatggggagacctaaacgcagagtcagtaaatgagctgatctatgggcaaaatcaatgggaagcaaattaccttgacagagagctttttgattgctggacctcttgggaaatacagtatcatctgcatcaagggtctgattcctgagctctatactgttggaaaacgcttcaaagaagcaaacaactttccagggctcttcaagttttctctatgagctggagtgagggaccacctactttatggaaggagctgctggcagcaggaaagaccagaccaacaaactcattagaaggatgagccaaggtgcctcccatggttattgtaaactggtcagttaggaaacagtgactactttcaaatcgaagaaacactgagatgcaggaaaataacttaggttctagttagatacattg

SEQ ID NO: 104243 - DNA, 1024 bp, Homo sapiens
tcacgtttctgttgttgtagaaacagtcatttaacaaaatatttcatgagtattgaaatcacttgctgtgcatctcgggaatctaatcattgtgattaagcctaatgagcatgagtcacctgcacagaaataaacgggggggccgatttccggtgagaagtgcctttggaaccaagtccctacctcaggcttagtgcccccgtgttcccagtgcaaggctgttggatggacaggtgaaatgcagatggaaaaacgcaactcttttcaaaaatggagcggccaagagtggacgcaggctctctctgacaggccttggtgatggaagtctcactgtgtaggggctggagttctccgaagactctttcagtttcacaaggaagcctcaggaaagcagcctgatcaggtcatcccatgacaaagagaaacaatagctacagacagcagcaacttcctgagacaactgacccagcatacaacagacccaaggtacaacagacccaggagacaatcaacccagggtacaacagacccagcaggcaacagacccaggggacaaccaacccaggagaggatcgacccaggggacaatcgacccaggggacaatcgacccagggtacagcagactcaggatgcaatagacccagggtacaacagacccaggacacaagagacccaggggacaaccaacccaggagacaatcgacccagggtacaacagactcaggatgcgatagacccagggtacaacagacccaggacacaagagacccaggggacaaccaacccaggagacaatcgacccagggtacaacacactcaggatgcgatagacccagggtacaacagacccaggacacaagagacccaggggacaaccaacccaggagacaatcgacccacggtacaacagactcaggatgcaatagacccagggtacaacagacccaggacacaagagacccaggggacaaccaacccaggagacaatcaacccagggtaccacagacccaggagacaacaga

SEQ ID NO: 104244 - DNA, 1008 bp, Homo sapiens
cctagaatgtgctaagactcacggcagcagcacaagctgcctcggtgctgggctttccagaagcgggcctggcagctggcagcagatctgggcgactattctcgtctctccttcaccccggcgaatgtggtagagggctccctgaggctttgtagcgtttacttatttattaaaatggctggcaggaatcgggtgtggaattacttttatctccaactaggcgagcgggactcctctggaatcccctggtcctcctggctccagggaggctgagttccagctttgtatgccagcagcatcctgcgggacggtgggtctgggcccagtgggatggcagccccgcagtgattctccctggaagaggcctccctgtcccttggcgtgtcacctgccatggggtgagcctccgctttggaggggcctggctctgcgggtctccttccagcactgctcgaaggaggcaggagtggtggagctggctgcaggcttgcgggtgaagctggagacgtggcttccagggtattcatttaattagtcttgggtgagctctagccatgcgccaagccccgggggcagagatggtcactctcctggagctgacattccagaggggaggggacagtcagtcggcacaaagcaaaggccgaagatgatgggggagcagcctgggctaggcccctgtgttctggtgggttcttcatgctacccttctgtgtcccaacccagccgccacctcagaatgtcagggacctcccagaggtggtgagaggcagcccaagatctagctctggatctggtttccatctggggaggctcctccatccttgttctcccttccctgggctccctgtgcccctggccctgcacccagccggcatgtccattcgttgtcccaaagacatcttgcccgtcctctctctgtctgggctgccgtcacttgagacctcacacctgctctccctcctgaatgtagcagcgtcatcctcagtggcttctccgcctccaggc

SEQ ID NO: 104245 - DNA, 1031 bp, Homo sapiens
tcccactggctaaagcaggccacatggccaagcgcagcatcagcgcaggtgagagcgtgcatgagagttttcccaacagtcgcctaacaaccgaagtctcttatctcctggcccctttaatccagttccctatactacctggcatacagcaggtgcttattaaatgcttggcccactgctggactaaagtcatttggtttcactgaactcattgtctttttgggaattatatcacaagaagccttcacacccatgctggaagagccttttggccaaagagaagttctttatagcgatcagattgacctaaagaagagttttcccacataaaatgtgaattcattggcatgaaatgacacagtttcatcatacattgtctcctgagtagaaataggaagagtaaacacataccacacctttctcaaagggaatgagcctcgcttccagccaaaggcaggattcatgatcccatttctctgccttgattctctttagacagtcaccaaaaaattaattgccaagtagtctgcagtgtgtagacacagagggcttccagcccaggcctgatgttgatacctgctcatcagcgtgtttgaattacctggaccatcaataaatgcccggaacaatatgagcttcagggacatggaatccattcgccaccaggcagctggtggtcagcactgagcagggagatgggtggctagtactggatccgtgctcttctgaactttggtgcagcaaatgattctgcatgcattccagaaagtggccctaatttgaatttaaatcttattcatggtattcatgtggtggcatttggagaaggggacaccatgacaataccaagcaggatgcagggactcagcaaaagcaggcgcaggtgcctcccaagggaccacctgctcctgtaaaactgcagtggtcctgcctatcctgcttttggagatgactgcccctgatggtgtggcagggccagggccaggctttgggcttcaggaccaggcagtgccgggttgggcttcatcttc

SEQ ID NO: 104246 - DNA, 1038 bp, Homo sapiens
gcaagcccagtcctccccaccagggtgagcatctagggagggagggggggaatttagctcctgtggggacccccggggcccggtcacagcctccaaggccctcgggactccactgacactgccaggaaaagctgccttccacccctcctaggccatcattgactggcagatgggacagccaggcccccacgcccagtctctggttaatggtgggtcagggcgggtcaggcctgagcccctgacacggcttctcatgagaactccacccccacagtgagagaggactcactcgtgaactttggaaaactcccccaaaccacacggggccccacttgacagctcggagaccctctttcctctcacagccccgggaccccgggatgcccgtctgtgcggaggccctggggggtgatggcactggaggccctggcggagctgcaggctggtgccttggcatctcccacaccagagctgggctggaccgagccgcccgcttgctcctgcacagccgcaactgaccttcaagagcctcggcccttgaccttccaccatttctctgacatttagcaaacagtgccggccgcccctcctcaggtacttggccaggtctttgcgtggcccccaagagccctgtggacaagtggccccctcatcccctccaagagccctgcagacaagtggcccctcgtcccgggtgctcttcctgtttattctccagcggggaccaccgtgggcgcttatgtcggtttccagagacttccatgactgtacccaccccacactcctctagagctgtcctccagtggggaccacgggggccgtttctcccagcttccggtggtctgtctggcctcactcaccggcagtgtggaggctgggccctgaactcctctgggcacaggtggggctggtgttggccgcatatctgagtgtctgaaggcgggtggcgtgtggggctcctcttgtctctatatgggaagaggggcctggctcccagagggtgcctgcatctgccatctgagaaggggctcttgctgc

SEQ ID NO: 104247 - DNA, 1581 bp, Homo sapiens
agtgtgaatcacctctaccctgtgtagcccaacaggcttctcacttgaccatgagcacttactgtattccctgggaatgagcaaggtgtgtagacagatgggccaccctggaagtgggcatgcagccgatgggcaaacagggtccccacatttgctggtgctggcggcttgaccctagggacaggtgtttttgtgcatttcactcttgggaggaattgtgctacctttggacctgctgaccctgcttctcatgagtgaccaaagtccttaactctgctctgccctggttttttcttagaccttgagtttttcactccagaagcaggttcctggctttttttgtgtgccatgggcctgtttggaagtctggtgaagcctgtgccacccatctcaggacaaactaaaaatacctgatgaagaagatcaattatatccacatgcagttagcaaatggtaaaaagcctatttttgatacagtaatgtgttttctttatgaacacattacatacaaagtctagtagtgggacgaccataatttgaagtaatggtgaaaataagcaatagactgagatagctacaagagctgtaatgtgatatgaaaatacctgtgctttttgttggtgacaaagtcatagttatggctgaagtattgtgtttactgcctacatgcctaactgaaggcagtgttaaatttcgtttagagacatgttaaatgctcactttctccatccaaagtcccacacctcaggcactgtggggactgtccccgggcagaaggcaccccctctgtggacagctttcctctggccctggtctgagctacactagccttaaagcagcagtttgcaggggtttgggggaagacacacccacccggcactgtggaagtgcagctctttggccaagtgccctcctgcctggacacctggccatgcccctggtttgtttcaccttctcgggaggatgtgggcatccttctgttggttcccaccacagttttttctcttctgtccagagactgggcccaggaccccctcaccctttctggcttgcttagattttgattagcattttgattcccaacacagtaatggtttcagtatttgtaaagggtttttcctgtcatgtcaatgagaaccctaggtgtctcctcctgagatgtgtgttggttttatctggttcaggtgttcacactgccatctggagctgacttcccaatggcacccagggcctctttggtctgcactgttaactcactcttcggaagccctacacgaggttcttgagtttgcagctgtgattgcttttaaaagtgtaagcaatgccacatgcatttactaacaggaagccttggtgcccggagaagtgtgatggtggtcccccaacattaggtatggaggtcctcctgtcccacctgttgaaagtgaattggtgggcctgcctctatttatgaactttcttttttttctcctttatcctctttaattctctttacagaaggatcttccaattgtagttcttaaatattcccttggtgaacgtagcacacttttctattttcagaatttcaaatgatatgca

SEQ ID NO: 104248 - DNA, 1030 bp, Homo sapiens
cctagtgatccacgcgcagttcctcaaagaaggtaattgtccccgggcgcgcggaccggtcctccgcgctctgcccggctcgcggcggctccggcgcccgacccggcttccagcacgttccgctgccgccgcgctcggctgaggctcgtggagcgccactgcgggcccggagcggccggcggcgcgaccctaccaggagcccgaccccccgcggatctcgctgccccgcgcccatcggggctcaccggcagggcgcggggtcggggcgcgctgcgttctcggtgcctctggcgccgccccggatccccagcccaagccgaggctgccgttcccatcccctgccccactgggctcggtggcagcggcgcccgcccgcacgccgccgggccctcggtagatggcaccagcgctccacggtggccggccgggctggggcgggagcggagctgggacccgccagggtgggcgccgggctgggacccgcggacgtcgggaaaccggcctgcgcacctgttccccagggcccaagccgccttccagagacccataggtttgggaagcaggggcttggtcaccggggtgcgcaggtccccgcgccaagttctgcccctgctctcttggtctttgctggactgcagggcagtctgggactattgaggcgcccaggataacggttggaccctcgtggctggagaggccctttgtactgggaagcatcttactgggggttgggggcagggccacacctcccctgatgggcggtcggtcggctccaggcaccccagacacactcctggaaacttcctggtttcagggccaggctccctttgcagggctcccggtgcaccccgggatcagcctggcctgtcatatcagactgggggcaactgaggcgttggcctccccccgggcacccctgctcatggttactagtgctctggcacacaggctgggccagctccgcctggtgctccccttggtccgctgggaaggctgagcaccggagggcgcctgtgtggctggtaaggcg

SEQ ID NO: 104249 - DNA, 1017 bp, Homo sapiens
aggtgtggagcaggcctcgcttagtggagtactttttgtggatttagcccttcacagagatctccatgtttaccttgaagcagacacacgtgtgtcggtgttgtggaagacggcgcagtcataggaaggtgggatgaggatggggtcagctgtacgctgagggcacaggtacctttggaggagcgattgcgggtcccagtgtttgcgcagccctccaggactcctgaagtcctgtctccctgtccggaagcggtggccttcaccaccctgggttgagccctgctgcctgtctgtctggaaggtcaggacttgggcagcctccctgtccttgctgagacggccttttggccccttggcatcaggagccccaggggaggcctgggggaccagcagtgagaggtgcagggaggggggtggccgactctggttcctggctgatgggctcggcctggggccactctcctcccagcagccgctgtccagcaggagggagggaacaaggcaggcgggtggacaattgtgacttgttgtctgggcctgagtgggaaagagctgtttaaatagccattttcatgaatctgttttcttcaggggtgaagaatgggggacccagggagccgtttttccacacttctccttttgtgtggagatagaggccaccccgtggctaatccgtccccccctggccactctggtcttccagtgtttgtggagatgaatagggctgtgaaccgagagagaggcaaattgcggtccataattgcagcctcggtatgtcccagctttgtgagaacaggtcctgcccaccgcaccaggcctggctgggcagccacaggcccaggaagaaagcagggccgcagcgtggggtccggcactggggcctgggcagctgctcttcttgccttgtcatccttaggacacgctgaccctcctctgggaggggagagccgtcctttcttctgaactgcctggtgtgtgcacgtgctgtgtctgcatggggtgtagttaaagtggggg

SEQ ID NO: 104250 - DNA, 1045 bp, Homo sapiens
ctctcagtgactaactcggtcctgggaaggttggttcttgcctgccctcctgctcagaggcctgagccagtctagagcaaggaagccctgtgctcccgagaaaccgagcagaaacacagttttctggggcatttgtaggagatgcaggtgcggggagcattcctggagcttccctggaatccctcctgtgtgttccgtggtggtcccaggggtctctcagaaagacacctacctggggacagagggcttggctggctggatcagggtctttgtggtggacctgtctgtggggtttggtcctgagtcctggaccagggcctcttcagagctagctgagtggggcgggggggtctgtaggagggaggcgtccctgcagccgtcggaactgagatgtcctccgggaatcccgacaggagccgcagcagacgcgggatgggaggtgcccaaagtcacgtccgcgaacagtgtcacctgggagacgccatcactctttcccagcttgacgtcctgaggccgaggccagcccaggaccccacctgtgtccccagcagcctggtgtataaagcggagcattggagctgggagaggagggctgcagaggctgagatgcagctggtcgggcccagcccctccattttgcagatggggaaatagaggcacggggcaggggagggactggcccaaggccatatgggtctcaaattactgatggtgaccgatgtgaaggggacgtgtcttttcaggcagggagactgctgtgggcctggcaccaggtagaggttctgagctggctgtctgggctcggggggtgtctcagggcacaggactgatgggggtggctggggtcggggattagggactgctgggttgaggagggctagtgccaagttgagagaaacatccccttggcccagcaccccaggtggctgtgttggtaccaattgcttaaaattgcaccttcattttgcagctcctgttgggcgccttctcaccgcgcgctcgggtgcagtgaactctgggagccgtcgcagcccagggagtcccc

SEQ ID NO: 104251 - DNA, 1033 bp, Homo sapiens
cattaggtattttttgatttttggaattgagccattctgggaggtgtatggccgttacctccttatttcaatttgaagtgtcctgatggcagatgatgttgagcaacttttcatatgcatatttgccatttttttggtgaagtgttcattcagatcctttgcccatgttttaattgggtcgtctgtgctcgtattgttcagcttaaaggtttccttgtgtgccctccagataacaattcttcatcgcatttgtgtttgcaaataacatctctctgtctgcggtttgtcttttcatcctcttcacagtgtctttgcagagcagatgtttgtaatgttagtaaaatctaatttatcaaatggttttctttcatagagtatgcatttgatgcttatctaaaagctcatcacccaattcaaggctccatagatttttctcctgtgtttatttctacaagtttcatattattgtgtttcgtctttaggtctcaggtccactttgaagtggtttttgtgaaagtgtgaggttggcgtttagataccatttttcctttttgcctgtggaccttccagctgctccagccccgtgctgagacctcctgtcctccgtgggattgccggtcttgtgggtttgtgtgggctccgtggatgttggaaggatggccgcggggcccctttccttcactgtggcagcagcccctcctggtgatcctgcagcttcctctgtttcctgtaatctgccgggatacacaccaaggccagaagacatgatttccactcggcttggcattggcaccacgtatgtgtgtctaaagaaggttaagcagaagaaacctgataatagttgaatttttctggaagttcagtcttttctgtaccatcctggacctcccaagttggctcctcccaagacaggaaagtctgcagtaagagtcttggtacagtgaaggatgtgttgtctccgtcactgtccccggagccagcacgtgcccggcagctgcaggtctgggggtggcgggggaggcagccccacagg

SEQ ID NO: 104252 - DNA, 1041 bp, Homo sapiens
gacacctgggctgggcctgaccctgggcagaccaccaccctcccctggggctggggcgctggtgtcctggccccctcgaactcttgaagcctgcccgtggaaggcccactgcacgtgggatgcatcgtccacgggcctacagggtttggaaggagcacgcctgctccactcgtgctcctgccttgaacccaccgtcactccttcccatgaggatggggacagcttatgcctgctccacaaggcccccactccgtgtgattcggggacagagagctgcagggtcctgggcaatgggaccccaggctgtgctgcccaggcacgtcccatccctcgtcctgttgggcccctctgccaagtgcaggcctcccggcactgactttcccatccgaatcactcccaacaaacttgggtggggttttaattttttttcgaattctgtcatttttgagccgaatgactcaaatgactaataactgtctggcgtggaggaaaaggaaggggagggctgggaggagctcctgtgtgaatttgaccttgatccagcacccactctgcagcctcccaggcagaaggcccctgatggaagctgggacagatgtggggagagcaggggcaagcagggagcaacctccttatccccacagtcatttcaggagcactgagggctgggaggaggggccgtggtggggcagcctaggcctatggggtctgcgggcccagagctgagtcaggcagcgtgtggtggatctggtagtagctggatgcatcagtgtggcaatccaggaaggcttcctggaggaaatgggcactgtgtttaaaggggaggccacacccatctgtcattgtgtactgggcatggttgtcatccaggatgccccagggtccttcagcagcaggcatgagtgggggtccactccacatccagccctgcccagaccccctggctgctcctggagcaaaccgtgtctgaaggggctggcaggatgcagagtggacagcagccctcactcttctgcgggaaaagcttttgtgtgcttcagt

SEQ ID NO: 104253 - DNA, 1015 bp, Homo sapiens
tgagatggagtctcttttttttttttttttttttttttttgaagatggagtctcactctgttgcccaggctagagtgcagtggtgtgatctcagctctctgcaacctctgccctcccgggttcaagcagttctcttgcctcagcctcccaaatagctgggattacaggcttgcactgccatgcccagctattttttttcttctatttatagtagagatggggtttcactgtgttggtgagtctggtctcaaactcatggcctcaagtgatctgcctgccttggcctcccaaagttctgggattacaggtgtgagccactgcccacccagcaggttagttctttcaaagataaatgaaattgacaaatctctagctaggctgatatgagggagtagagagggatagagaagaaggaaagtgaaggaaggctgaaattaccacatcataaataaaaggggacattagtacccaccatatgaaataaaaaggttaaagggatactatgaacaattgtatgccaatacagtagatagtttagatgaaataaacgcattcctagaaagacacaaacttccagaactaactctagaggaaacaaacagtttgaatagacctatgttaagtaaaaacaaggaatgagttatcaaaacttcccaacaagaaaagcccaggaccagatggcttcactggtgaattggtccaaacgcttaaagaaaaattaacactggatcttctaaagctcttccaaaaaatagaagaataggggccacttcttaactcactctatgaggttggtattgccctaataccaaagtatcagacatcacaagaaaactacagatctatggatacggacatagatgtcactttgggtttcgtgcattcccacagtacgcctcatccctgaggcacgtgtctctcctgcagcaccaccgtgatggggacagtgacatccatgcctgcatctccagcacagacctgtgccctgagtatgtaaaggcgctctgtgaatgtc

SEQ ID NO: 104254 - DNA, 1048 bp, Homo sapiens
aaagactcggggtgctggttgcattgctgcagcaggagagactcggggttctggttgcattgctgcagcaggagagactcagggttctcgttgcattgctgcagtaggagagacttggggttctcgttgcattgctgcaagcaggagagactcggggttctcgttgcattgctgcagcaggagagactcagggtactgcttgcattgctgcatctctcaaaagctttgttttgttgttggttagatttggcactgtgtagtcatggccatgtggcttcaggttctcacaggacacagggacatgtgactgatgaggtttcaagagaggaggattggatgagtgggggattgcagcttccctcctcccgacacctgggaccctccactcacagagagaatgagcttctccagcgtttggaggagagaggagaagatgggctcccctgcaagtccatagaagcctccgtggctttctggattaatgcagccacacactcactccttgcacagcctctgcccagtgtccagttttacatatgctttggaaataagaacaactgtcaataacaccatgacctaaagaaagaaacaagtaagcgctgaaaagcactggggaaagccccctggggctcaaaggagtggaagcccgtgccttatcctctgagccccagctatgacagtgacctcctgtaatgcacaaaaagccctggacttccttctcaggcctgggtctaaccgtaggacttagaaactagtgatcagagggttcacaggcaggcagaggtggaatcctacccacccagggggcatcccctgctcggtcctgcagagactcagctcccagcctgcggcatggcagggaggaaaggcagtgggtggaggtaagtttcacagaagaggcacagagatggcagaagagcctcttagctagagtaggagtaagcaagagggccaggggcgcaccaggaactgtgttcttccgttcagctctcattcccaaaggagcagaaaactctgcagcttagacagaagtctgacctcccaaaag

SEQ ID NO: 104255 - DNA, 1049 bp, Homo sapiens
aggctgcagcccagcccgcctgagacacgacgcctgccccaggggactgtcaggcacagaagcggcctcctcccgtgccccagactgtccgaattgcttttattttcttatactttcagtatactccatagaccaaagagcaaaatctatctgaacctggacgcaccctcactgtcagggtccctggggtcgcttgtgcgggcgggagggcaatggtggcagagacatgctggtggccccggcggagcggagagggcggccgtggtggaggcctccaccccaggagcaccccgcgcaccctcggaggacgggcttcggctgcgcggaggccgtggcacacctgcgggaggcagcgacggcccccacgcagacgccgggaacgcaggccgctttattcctctgtacttagatcaacttgaccgtactaaaatccctttctgttttaaccagttaaacatgcctcttctacagctccatttttgatagttggataatccagtatctgccaagagcatgttgggtctcccgtgactgctgcctcatcgataccccatttagctccagaaagcaaagaaaactcgagtaacacttgtttgaaagagatcattaaatgtattttgcaaagcctaaagttatatatttaacagtttttatatgttgtatatttgtagaaaatcctatttaacaattaacgtggcagtcccggccgtcctgagagtcgggccgagccccgtgtgtttctgaagactctgggggtgggacacggcggggaggtggtgccccgcggaccccggggtgccaggcacggaaggcgggactctgggagaagcgtgcggaggaccgtggcgtcggcgtcccggatgtgtcggtcgtgcccggggaggccgggttcccctcgctgcgggccaggcttggctcctgattccctctctggtccctgtattggtcaacacttgagcgtacaatatcttgaacatgcttcttccaatgggttttgtttcccatttcctgcccctttcgccactcacggaccttgaggccagttgacg

SEQ ID NO: 104256 - DNA, 1018 bp, Homo sapiens
ctgaatgagagctgcccgtggctgctcagtctcccccgcacctgtggccaggcagggaaaacccggcctcggggggcgggggcgcccactaggctgagacacacacggtgagagctcacaggccaggcctactcccgccaaggcatctgagcctcccagggcagggtgtcccgctggctgggcctctggaggcccggcctgtgggggctgagctactcctgctggggccaggctggtccctgccttccgctgggcccctgccgcatggggtacctctgccatccctggagcggaggggagctccgaggagggcacgctgttgtctgaattctctcaggtatcccatcccaggcagcgggaaactcatcaccgccctgggagaggctggcaggtatcgatccccatttgctaatagaaaacacagctcagaggcggaaagtgactctccaaagtcccccagttcataaaggctggaattaataaggccagatagataaaggaacacttagaggagatcccggaggtgcagttgctctgtaacctgcaaagcccttaccgacatttaatttttattagttgtattaatatatgagataccgaaggaagacctttgtaaattaggtgcagaactaaagtattagttatgaatatacatgataataacagaaatagatgagttcacagagctgtgagctgggggtcaaagcccaggccctggtcactcagcctgctcaaaccttttggtggcctcagccactggcccttcctttttcctcctgggccttagtggactgactttttccagcttgctttgcagatcttacttggctggtgaatgcgaacaaggagtcagtgccatccccaaccctgacccctaagtctcaccaggagctttcagctccgtctctttccatctgctggctgagccccgagaactccagggatggcgaggagcccgggctgcatgggaaggaggttggccctcgggatgaccaaccaggggtggacgacactgccc

SEQ ID NO: 104257 - DNA, 1063 bp, Homo sapiens
cacacaagcgtcagtaatccacaattgaatgatgctgccattcacaaagatgaactaaggtcattatctaccctattaaggtatttacaacacgtgccttccaaggagaatgtggctcctcccactgtcccattgtccaggccagggtgatctgagtgttggaatcccagggttgaggggagtccaggactggcctccctcctctggctgctgggcaggctgatggatccaggctgattcgcagaagatttggaaaagatgagagctcttagctgctttctggtctttgcagcaaaaacctgacctgcaggctttcttcaggcttctccagaccgaccaggaggaggtcatgcatggtcaaggtcatgtctcagaagaagcctcttaaaagaaagttggaagggtgggttttcataaatatcttttggtgaaggcagatgctacaagtctctttgaaaatgaagacttcttttcctgagaattataagaaaagatatgaaagatattagtagattaacttacaatatagaagcccggaaaagccattgaaatccacgggtacaggcacaaggaagtataggacaatgaggtgaaatgagctgagatgatataacaactataagagggagaaaagaaaatcccagcctgctatcagcgctgctattactagttttgacaagagaaatatgctttcatgatgggatattgtgttttcagtgagtctagtaatgaaatttttaaaaacccagtgacgatccaaattttagctaggaagcctattattaaaattgataacaccagcctaatgtattctaagttatgggtacaggagatgataaatattgagcatttgcattgtataaaaatgttttagtagatggttttgtagtcaggaagattagctgactctttgattggctgctacagagcaggagaataaagataaatgctgtaaaacgcgtatgtacctcaagggaagtgtttgaaatgataaacggcttccttgtactcctcaaaagcatttacttctaatcattgcatcccatttcttatttggacctga

SEQ ID NO: 104258 - DNA, 2066 bp, Homo sapiens
ccaccctgactctgggcttggtgtgtgcatgtcttgtcactaagcaggcactgggaaacgttttggaggtggaggaggaggtgatggtttttatgccttacttagctccccgtatccccaagtcggggaggggaagggaggggtgcactcctggcctcgggcctgtccctgcacggggcccagctgtcttggtggtgctgagcagggcccctttctatcggagggcagtgaatttgttagatgattacatggagcctgctgaaataccatgtgcaagcaatgattttccgcttgtttttccttttaaaaaggcagtggcttcctaagtccaaaatggttccccttggtattgacgaaactatagacaagttaaagatgatggaagggaggaattccagcatccggaaggccgtgcggatcgcttttgaccgcgccatgaaccacctgagccgcgtccacggggagccgaccagcgacctcagtgacattgactgacggcccggccgccagcgcgggtcttgtccatagtgttgataagctgtacatgtttgtatattgttcaaaacttaacttattctgatttttagttatagctctttaattctttttccccggggaggggggaggttttatttccaagttttctaggaacccatctccgtctgggcgctgtgagtggggtgggcacgtccgggcagcccagtgcgtctgtcgcacgtccccaggccgtgctgctggcgtcactttctttgatatgtagctttttcttaaagacttttgaatgtttaataattttgtaaatcatgctctttacacagagtaccacttatttaataagacgggatgtaaatttacaatgacaaatgtgtattttaagaaagaaaatgacattattttgaatggtactttgtggaaagaggggagaataaagttatgctgtgtacatcacttgcagatcaccaaaaacactccgctgcccgtgaccgccggtgggtgtgtccccgctcccgtcgtcccgcccacctcaaaccccgcaggtgtgcctcccagcggattatttattgtagaaagtgtattcatttgctttataatgaaaaatacatttgcaaaggtatattgatatgcatttttatacaggcacataaaaattcaacttggcttgggagcagaatgcattgcattgtataaatgactctggcctgtgtgtactttgattttataacttgtaatcttttgtttacaatgaggggctttctgtaacttgttttaatttagaacactttggtagcaatagaaactttggatacatttttgtatggtacctgtgatgtatatagaattagtactttatttttatttttaagaggtaaagcattatgttggggaaagtagggtgggtttccaaatttgcattttttatattaaaaataaagtcaagatttggacggtgtggccattttattcctacagccctagacggctaggtgagccccaaggacgggtggggtgctggctgcagggggcggggacacgcctttatcttgaaaactgtcatgggatggcattatttgttatttcacctgatcatatttttattttaaaacttcagttacataaaagttttaaatgctttttttaagcctacaccgtttgtaacatctccatagaaacttggaaatcaagtcttccttagatagttgctgtcctgcatctggcaggtgcttcctatctgtcgtggctctccttcccacagccagccccgcccggcaggcccctccccaccacgagcagctggtggcccccaggatcactcaccgcccacgcagaaaggaagcccacgcagaaaggaagcgggtgcaggagccaggtggggacaggccgtggagcactcagggctaccaccgagaagcccagctaatggcgggtgcagtttgcaccccttctctgccacccacagcctgatcgtgctgtcgatgagaggaatctgctctaagggtctgagcggagggagatgccgaagctttgagctttttgtttctggcttaaccttggtggattttcaccct

SEQ ID NO: 104259 - DNA, 1057 bp, Homo sapiens
tagcctggagggcaggagcttccctgggtccgtgggaggctggtggccccaggtgggctgcagggacagtggggatgcaagggcctggaccccacaggggaggcagtggtgctgccggggtggctgagaaaggcctgggagctgggctgtgctcgggggacccaccctgttgctgcaccttttgtgggggggcggggcgtgccccgtgtcctgctgacgcctgtgtcctgctgacgcccctctccgcagaagtcggccagagcagcatgtggatctccactgatgccgccgcctcggtgctggagcctctgaaggtggtgtgggccaagtgcagcggctacccctcctacccggcactggtgagtacggctctcgtggcgcctgcgggtccagaggaggctcacacagctgcggggcgggggtggtccgaggaggctcacggcggtggtccaaggaggttccacagctggcgggggggcggggttggtcagaggaggttcacacagctggaaggggcaggggtggttcggcgaggggggcgtgggggtggtctgaggaggctcacacagctggggtggggaggcgggggggggtgccagtgacaggtggggttgtttatgggtgtgagcctcacaatgacctcagcgggtccttctcgtgcagatcatcgaccccaagatgccccgtgtgcctggccaccacaacggcgtcaccatcccggccccacccctggacgtgctgaagattggggagcacatgcagaccaagtctgatgagaagctgttcctcgttctcttttttgataataagagaagttggtgagttgagaggccttagactccggggaccggctggggtggttgggggccgtgggctcggtgacctgagtgtccctgtggtgagcagcgtctttgtctgctgggccctggcacagctaaagtcggaggtgagtgctccgctgtttgcctggtggagaagggcactgcccagccccctcgccgggactgtgggacgggcactgagcaccgggtctgtctctgcccgatggcttcctctc

SEQ ID NO: 104260 - DNA, 1049 bp, Homo sapiens
tgctttgtaagatgtgttccaagtgtaacgtcgttgagtcatgcttcagtgtgccctggttgtgctgagctcagggcctgcccgcctgtgttccaggtctcaccaacggctttgggggtgcgaggagcgagcaggagccgggcggcggcctggggaggaaggccacaccccgacgacgctgtgcctccgagtccagcatctcctccagcaacagcccgctctgcgactcgaggtgggcaccgcggccctgcgcttcccaccacgcagctcccagcaccgcccgccccgcctggctgtcctggaagccgggacattccagctcccatcttagtgttctctgaaaaattctggcctgggattcatgtgtgctctgcccttgtggacagtttcccatgctgcatattaatctgctttatagaattcaagcagaagtaggaaaaacactgcgtgaaataggaacacaattttagaatctgcaatgaagttttacacttgatctttacctcccagaatctggcaatgagcacagccctgcctgtctgccctgtgaaggccactttggcctcctgagtcccccctgccacaggttcactccctccagacctgcgcacccacaggcccgtctggccgcgggggtgtcaggcaggatgcgtggccagcttggtggcggacagctcacgggacgaagcccgagtgaggctgaaggcaggggcggggcgcctgactccctctgctcttcctcccgaagctttaatgcgcccaaatgtgggcggggcaaaccggctcttgtgcgacggcacacgctggaggaccgcagtgagctgatctcctgcatcgagaatgggaactacgccaaggcggccaggatcgcagccggtgagtcgcccggacctgcctccatggctctccacacctcctggttagcgtcttagggctcgactgctggggactggactccggctcagggagcatggtgccctgtgtggagccccaccctggccaacctcccggggaagggttcatcacacaccgaggggctctgggctgtg

SEQ ID NO: 104261 - DNA, 1974 bp, Homo sapiens
ctgccggccgtggggctggggtttgaggcggcctcccgtcgacactcagcaggatgctcacgtggtggtttccaccaggtggccccacctgaccgggccctgccccagctgtgggctcccactgtggacagttttgccggctggcggccacgtcctcagcaacctctcaggctcgttcatcagatgtcccttgtagaagagcacgtgtcccctccgggccactgtcttacattggagtggagtgttttgcgggcttcccgtggtgacggtggtgtagagcagtcttactgcagaccttcagtgagcgtggcccatggtggcttttgagaatcatggtgccctctgatcctgactgaagtggagatttctgctctctcatttccgagtgacagtggatttccgtggaggtgcggtgagttcctgagctctctcctgagcagccgggagcctcagcagcattaagaccaggccctcgggagtgggaggcattccactgctgtggccgaggcgcccggggaagggctgggcgtgctctgaatggtgccagtcccgccatccgccctcgctttggtttcaccggaaccttctggtgctctgcacatgggggatttcttgcccagagctgcagttcttcgcagtcttaggacaggaattatccggaaccttctgatgttttccatacatgcatctgtgtgctctgaactttagggagttatctggcattttccagcacacgcacaattctgagttaggctgaacagggtcgctggtcctgaggcgacgcactcactgtgggcctcctgcccgtgtcgcccgcgggccggctgtgctgtgcgccaggcttctgttcctgcgatggcccagccccagagtctggccctgactcgtggcttccttcctccgtgactgcacgctcaccagcagtgaaccgtcacctgaagcggccttccactcgccgccgttgcggagacccctgctgcgagtctctgtgtgcacgtgctggggcgtgtgagagcgtgggggtgtctttgtctactcgccgccgttgcggagacccctgccgcgagtctccctgtgcacgtgctggggcgtgagagcgcgggggtgtctttgtccactcaccgccgttgcggagacccctgctgcgagtctctgtgtgcatgtgctggggcttgagagtgtggggatgtctttgtccactcgctgccgttgcggagacccctgttgcgagtctccatgtgcacgtgctggggcgtgagagcgcgggggtgtcttcagtgtccttcggctgttcagggaggaggctgagctgtcctgccctttcattcagactaaatggctttttcactgttttccaggttctcactttaaccactaatgtgctgggtagttcactctttggaccctaatcattttctcttacctcaacttggactggagttctgctaagcggccgttttggaatgcacaaagatcactgcatcttgcctttcacttaattcttgcggatcacattggaatcatcagctcaaacatcctctagacaaaatcacaaacagcagccctggaggagctctcccccaccccagcccaccccctctgtaagtcagagcccggcagtgggaatggtgctggcgcccggtgcacgcctggagctggcgggatgtcgtggcacctcagccttccctctggacagtcacgaaggacgcagaggagagcccggcaccgactgggagcctgctgcagctgacgacacagtggacagcattctgaggctgtcctgagcatgtgcggagccgtcccatagtgactggtggtttgggtgtgacggccatgcccaggcgcgttgtgctgtgtctgtgccatggggtatggaggaacttggctcggcactgtctgaggatgtggcatggacagtgcgtgctcactcactcgctagcatcttctgtatttctgggttttctacctgatttc

SEQ ID NO: 104262 - DNA, 1098 bp, Homo sapiens
tttgacttaagaccttgaccagagatcagatttaatgttgccttccttttatttgctaacttcgtggcccagtagagctctgtgggaatgcccgtttaaggcccctttagttatgtgagataccttttcttcctcaaggtaagtgaattattcattgcagaaactgtcatgaactcgagtgacgtgtttaatattggcgcatgtgaaataatctttcacagtttttttcagagagtaactgtgtgcctgggcactgcacccagggccgcagcctttggcgttagggaagcacacacagtgtggcccgagcccacggggcccacactgccgagcagacagtacatgcgatgccttgtttccttaactgaattagtattttggtggacttcacatttatagtaagttttataatagattttataatcttcagttttcaaaaatcactttatttataattttttcaggagataaatctccccctaaacttgaaccatcagatgcattacctcttccttcaaactcggagactaattcagaaccaccaaccctcaaaccagtagaactcaacccagagcagagtaaacttttcaaaagagtcacatttgataatgaatcacatagcgcttgcactcagagcgcactggtaagcggacgccctccagagcccacccgcgccagtagtggcgatgtgccggcggcggcggcctccgcggtggcggagccagcaagcgatgtaaacagacgcacttctgttctcttctgcaaatcgaaaagtgtaagccccccaaagtctgccaagaacactgaaacccagccaacttctcctcagctagggaccaaaacctttttgtctgtagtccttccgaggttggagactcttctgcagccaaggaaaaggtcgcggagcacatgcggagactccgaggtggaggaggagtccccaggaaagcgcctggacgcaggtaaatgccgcgggcggccctgagaggcgcccttgccgaccagtgcctggagcgtccttcaggatcattggtgtgacgggggggggggggtgtccagcttctgtttttgcagcattctcttaatttccagagaaga

SEQ ID NO: 104263 - DNA, 1009 bp, Homo sapiens
aggacctcgcatggttggagctgcttggccctccgctgtggtgagcgtggctcctcataacacccaacgcttagcaggagcctttggagaccatttttgttgctttgtagctctggaatcattttatttttattttttttctggggccattgtaaggaaaacacaatgtgactgagacacaggtggcctcgaatcacctgttacacccaatgttcacaatgactcaattgatgaaaagggcgtttcctgtgagctgatgggaaggtgggtggagaagcaagtggcctgaaagtccactccgaggtgaggcgggtggggtcctgcccctcagagaagttgggggtctctggagaggtggggcgggcggggtcctgcccctcagagaagatgggggtctgtggagaggcgagtgccagactggaatggggaagtcattagggaagacagccacaagcaagcttgttggttggtatagaaatgtgacttacgatacttataataggatgaaaaccaagaatcagacatttaaaaacccagcatgaacgttctcatcagtaaagcctctccatcatttttcttaaatataaccacaatattttcacacctgaaaagagtaattcctcaatggcaaatacacagtctcacttaaactgtaatttaacagtctgtgtgttgtgtttatattttgcttccacttgaagcagcttgaacaaggctgtagccgttgagtgccaggcccctgagactttagtgtctgaaggaaggagatgcctcctgggctgcactgttggccccggtctgccccttgtacaggccctcccgcaggctctgccgtagccgcgactcagtctgccgagtgcagaggttcgggctgttgctgtgagctggccctgccagggctgacttccccggggctgcgtgtcagctgggtgggggccacgccacagctgggattccagcctgtctgatgagcctgtgggacggatctgcagctggcagagggcttgtc

SEQ ID NO: 104264 - DNA, 1051 bp, Homo sapiens
tgatgtgttcccagaaggtgcgtgggacctgatgactgacagcatgtgtcctttggttcagtggacaggttgctggaccccgccaacagagcccacctgggcctggaggagcagctgagagagctgctggacatgctcgacctcacctgcgctatgaagtccagcggctcccggagcaagcgggcaaagctgctcaaaaaggaaattgcccttctccgaaacaagctgagccagcagcacagccagcccctgcccacggggccaggcttggaaggcttcgaagaggacggagctgcgctggggccggaggcgggcgaggaaggtaagccacggtgagggctgccccgctttcttgccgtcacggctcaggctcaggcacaggcacaggcacagacccagacacgggcagcagcgttggtgtgcacggaggctcaggttagcgccagttccgtaaaattcacaaatcccggaacacttgattttcccactgggctgttgtttccttttaaggagacgttatcatttgtgctgtctgtgttttctcacataatcagttgataaaatttaaggcacagaataaaatttttctctttaacttgggcctgagaaactatttgaaaagaatggtttagatcttacactgtgttgaagagtaaaggtagcctgaatgatgagagtgagaaatgtttttgttgcattttgtaaattggcggggagccatttaattgtgcgctaggccatcaaatgcagcattttgaaagggctgttttagattattggcacttaaacactcctccctgatgttgtgaagggagggacggtacctgcagaggccttgtctgccccgagggtccccggccagctcctctgcagagttggtaggtagcagccgtgatcgttgccaaagaatgtctggggaaaggtccaggcagcaaagatgtttttatgactaagaaataaatgtaggagaagaaatccgcctatctagaaggagaactagcaaaacccagggcaaatgcaggcttggcatggtgaggagggagtttacgag

SEQ ID NO: 104265 - DNA, 1027 bp, Homo sapiens
ggatgaaaacccccaactaagctgctttctgggtctgcatcgtcgagaccggccaccccatagggagccacagccacacagtcctcttggtgggcacccaaaacgcagccagtctgaagtgacaggtgctgagcgtaaaatacacatcagatggcaaagaaggtgaaaagcttatatatcctcagtaacgtttaccgatcccatgttgaaatcaactcttccatacactgagtaaaataagacatattattaaagtaaattccacctgcttcttttccatttttcagtgaggctactagaaaatgtaaatgatgtatgcggttgcatgctagtggctcccggaccatgctgatagggagctggcaacacagagcaggacagagtctgctagaaagagcgtcttccacctcctccggacacggcgccagttcttaccgtcttcccaggagaaaggccgccgcggtgccgcagcaggccgctcaggcaggtgcatccccgaggcctcttccaagccgatgctgtccacctcgcgccgggcctgcctcagaacaacacctccctgatcgcgcagcctcaccgcggctctatagaacacggtgtccctggcattgtacttcatgcagttatctataatgagatcaaaatcctcctcaaactcatggaggtttttatacccttgagcttctaaccgtttcctcattgtggcaaagtccatgggatgtttaatgtgatccaaataatctggtacctaattttagggaggaaaaagaatcatttacaaactaaaacaggatattagttgactctatatttattattccatataacccacaagcccatcctatctgagagccacacacagacacgcagacggtacagacataagacccaagtactgcagggaccttcccgaccccagctccttcagctaaagcacgctggagggtgccgggcggatgctgccacagcccagggtactgtctgcacagggcctcttgcccactgcactttcagtattttacaatga

SEQ ID NO: 104266 - DNA, 1591 bp, Homo sapiens
cgctcaagctcaaaggatggtagagatagaaattgaagggcgcttgcacaggatcagtatttttgatcccctggagatcatattggaagatgacctcactgctcaagagatgagtgagtgcaacagcaacaaggaaaacagcgagcggcctcctgtctgcttaagaactaagcgtcacaaaaacaacagagtcaaaaagaaaaacgaggccctccccagcgcccacggcacgccggcctcggccagtgccctcccggagcccaaggtgcgcatcgtggagtacagccctccgtccgcccccaggaggcctcctgtgtactacaagttcatcgagaagtcggccgaggaactggacaacgaggtggagtatgacatggacgaggaggactatgcctggctggagatcgtcaatgagaagcgcaagggcgactgcgtccccgccgtgtcgcagagcatgtttgagttcctgatggaccgcttcgagaaggagtcgcactgcgagaaccagaagcagggcgagcagcagtctctgatcgacgaggacgccgtgtgctgcatctgcatggacggggagtgtcagaacagcaacgtgatcctcttctgcgacatgtgcaacctggccgtgcaccaggagtgctacggggtgccctacatccccgagggccagtggctctgccgccactgcctgcagtcgcgggcccggcccgccgactgtgtgctgtgccccaacaagggtggtgccttcaaaaagacagatgacgaccgctggggtcacgtggtgtgtgccctgtggatcccagaggtcggctttgccaacacggtgttcatcgagcccatcgatggggtgaggaacatccctccagcccggtggaaactgacatgctacctctgtaagcagaagggcgtgggtgcctgcatccagtgccacaaagcaaactgctacacagcattccatgtgacgtgtgcccagaaggctggcctgtacatgaaaatggagcccgtgaaggaactgactggcggtggcaccaccttctccgtcagaaagaccgcttactgtgatgtccacacgcctccaggctgcacccggaggcctctgaatatttacggggatgtcgaaatgaaaaatggcgtctgtcgaaaagagagctcggttaaaacggtcaggtccacatccaaggtcaggaagaaggcaaaaaaggctaagaaagctctggctgagccctgcgcggtcctgccgaccgtgtgcgctccttatattcccccgcagaggtaagcgtgtccaagcattgagtccacaaggagcctgcagtgtgggaccctgggaggacgtgggcacagcctgcagggcccgtgctgtgtggtcattgcgtttctagttggcgcagcttcctaatattcccctgaagtgtggttctgcttgtttaccacgtctttttggggaatagatgttgtaaaagattttagtctgtaggcttggaataatctgtagttttctatgtttttttttttggagacggagttttactctgtcgcccaggctggagtatagtggcgcaatctcagctcactgcaacccccgcctcctgggttc

SEQ ID NO: 104267 - DNA, 1390 bp, Homo sapiens
aggtcgggccgggcggccggggagacgggcgggaagacggggaggccgggcggggagaccgggtaggtcaggccggggagtcgagggaggccgagtcgggctgtgggtctcggcggcctgggccgcgggcgcctgcccggagtccgcgctcgagtcgggtcgggcctcgggcagccgccgagccggccgggccgccccttatgtaacagacaggcccgccgagctctgccaagacgggaactccctgtgagcagggacgcgccccgagatcgcccaggagccgcgcggcctgcggcggccgggcttgggaaccggcaccgcggcctccccgggcgtttgcagggagacgcctcgcgacgaacgcgaggcttccccgggccttttaaaacgagtgacacgattgaggcgcagttcacgggaaacgcggctcttgtgagcggacgcgggagttctgagaatccgtagcagcgggaccccctgccccgcggggtgcggccccgtctccccagaaagcgcggccgcccgtgtctgtttttgagggtctgtcgccaggtggttgtgtagttagtggaatcggcggatgtttttgtttggccggcccagcgccgtcccgagtgctgtgtgctgcacacaacttcgcacagctcagcggccgcggcccctgtggccttgaccgagaggcccggcgcgtggccggcttctccctgggcgggcggtgggaagatggaagcggccgtcttgtgggcagccttccccgcctgtggcccgcagggctcttcgatgtacttaagggaattattccttgagaagctacgtgtgtgcccccgcggatccctcccagtggaaatgcttgtcccagtggaagggccagggacagaaccggcccaggggggaagcggtgaagcagaggaggtcgtgggtcgccctgccctgctgagggcctactttccccgggtcccagttgcatgttgagggtatggagctgctgtggccgtgaagccttcggttcagttctccccttgtagaaagtgttgcgatgaagagcttcacggctccctgggagagagtgggtttccaggggctgcttgtcgttagggcgactcaggactttgctgtcgaggggaaaatgacaggttcgtttctgatctggtgagtaaccaactgttgcttctgccccacctcagtaatgacgcgtgtcggcgtcccgggtgcactagggtcgctctctgcaggctgtggtgtcacctctgcagggctcacggggccggctggggggtggctgtgctgacagctccccaggaatccagggttgagtgggtacctggaggccctggagatgcagggggtctgaggtttggccgaccacattttctctcctattcctttctgt

SEQ ID NO: 104268 - DNA, 1028 bp, Homo sapiens
tgttggccaggctggtctcaaactcctgaccttaggtgatccacccgcctttgcctcccaaagggctgggattacaggcgtgagccaccgtgcccggcccccttctcagtttagcccagacctggatgttggcttctgtgtgggcagctgttgtgagccatggctcctgctggaatttgtggcagttgatgctgctgtgcacccccagaataggtgaaggctactcaggtgtagccccgatggtagtttatgtcctcaggaggagaaactgccatgtccccgtctgaaccaggcccggagtcttgatgcatagctctttgcctccctgggtatactcgacagcttgttgagagtgcgtgtgctctgagttgaacacgaatatatttctgttgtttgaaggttattataaagtttctaacttacagagttggcactcctacgtcccttgcccccagctggagctaccgtgactgccaccagctgccacctggcacgtgctgaactgtcttgaaggaaactgcagatatctggacacttctctaagtgttctttctcctaagaaagggaaagggacattctactgtctaatgacagtcgcgtcatcgatggcgtctacaaaacgtgactgtgtcccttggcgtcatccagtagccagtccacggtctgaagttgtcccccaacgtctttactagctgtttttcccaaccagaatcgagtacagggccacgtgtcacagtggctgtgaggtctctttgcgttccggtgcccccggagcaccccctgtgatctggcggtgggaggcctgatttgatacaggggcacgtttggggcgcaggtgatgctgtgtgctgcactgtgggcggaggctgtcccatgaggacggatgcgactttgctcactggccctttaaattgtgtccctgccccccacagttggcgagttagatgagggggtgtctcggggtgtgtggacgctctgctcccatcagacctccacatgctgtttgctggtctccccagaacctgtgg

SEQ ID NO: 104269 - DNA, 1047 bp, Homo sapiens
agctcctctgaaatgtgatccctttgtaactgtgctcatcacttcgccagtgcgttcaatgacacgctgatggcaggtggtccctgctgaaacccccacgcctccgcttcagcatctccacgctctgaagctgtctttcaaaatgtgtgcactgacccccttgtttgatcaaatttgtgtaaaatttttttagaagagatggcttattaacagggaagaagcttgttatattccagttgtaagaatagccttagtgtttagatttttttatgatagggaagatgcggccatcactgggatattttcaaatcccaaggacatcagagtgaagtgtcagttgtcagatgattttaaaagttatgtcttcagagaaaaaaagattcattttctcattttaaaccaattaaatattctgagtgagactaatcactcatttgcctacgaccttttagaaaagttgttttgttgaaatactgtacgtacgcttaatctaaatttgcattgactatgttttagtgtatttataaatggtgaactcagtttctgaaattaaacttcttatttgcaattttctagtgctggcagacactggctttttatttttaggataagaaaacaggcatattctttgtggtccattatctagagcccatacttgggcagcatttgaaatttcaccttaaccccagacagggctccagggaagtggagatgtaattcttacaacaacagttctgatcatggccatggtgatgactttccaggtctcgtgttcaagtggtgccagaatgcaggagccggtgggcagccctgaggggttgccttggccgcagcctctgtgcacgctcttcctggtgtcctcttacccggtagctgtgcgcttgttcccgtgagaacagcctgcttccagagtgcccaggagtgctggtcagggacagtgcccgtgaggctgcagaggaggtggggtccatggcccacccatctctccctcgccagcagccctggccagtgtcatcctggtgtagaaagggttgcgcacaggatagg

SEQ ID NO: 104270 - DNA, 1111 bp, Homo sapiens
ggggatggtggacaccgcaaagaagaactttggcggcgggaacacggcttgggaggaaaagacgctgtccaagtacgagtccaggtgggtgccctggagcacccctgtgggtcttggcctggcgctgtcctgggaagtcgtgtcctgcctttggtgcctgtgttaatgacagggagacagaacagcccccgaggcaccagtcacccgtccgagtcacctcggcttctccctgaggactaatggctggcccctctctggccttccagcttctgctctggtccctaccccctcaacagacagtggcttttcaaaatgtaaactggaacaccagccccacttgtgggaaccgctcctggcttcccctgacagtggggtccccttattctctgtgcccggagtcctggctccccggcccctgcacccaggttggcgtattggttcggatttttcttcactgccttggaggcgctgacggtgggccggtgtgggcctgtgtttcagcgagattcgcctgctggagatcctggaggggctgtgcgagagcagcgacttcgaatgcaatcagatgctagaggcgcaggaggagcacctggaggcctggtggctgcagctgtgagtgccttaaaacctcttagaagatactttttattttccaacttagaatttgaaataacctcagacttagaaaggtacaggaacagtagggagctcccacctgcctcgcacccaccttacccctgcattaccgttttttatcaccagagtcagcgatcaaaaccaggaaattaaggagaagattctgtccacacctagactcttgtttcctggaccttacaatactccagagcatatgttacgttcagctgcatgtttgttttaaagaaccgtgtctgctgggattcagtgaatgttttcctccatcctcaggaagagcgaatatcctgacttattcgagtggttttgtgtgaagacactgaaagtgtgctgctctccaggaacctacggtcccgactgtctcggtgcgtttctcctcagggaaatcccatctcctacgtcacttcccctcttcttctcatgattcttgggaggtaaaagcacagaggggacctgg

SEQ ID NO: 104271 - DNA, 1684 bp, Homo sapiens
aaggacgttttctccctggttgtcactgatatgtaggaaaactctgagtgtctcggacgtgagtgtgtggttggccggcagcccctaggctattctgggcagacagacccgtggatcgatagtcaggaccggcctctccgattcttacgcccctcagcagtcaggaccggcctctccgattcttacccgccttgctgtctgtctcttggatgttggcgtggcgtgggccacgcatggatccgtggccggaacacgcacacccagccaggctacagctccagagtatggatagctgccttctctccaggttattaaaaattccttggagtcctggtttgctgagaattttaaattcatgggcactgaaaatcccgtgttgcttttccctcttaaattcctcacttttaaacgagccttgtccccaagctggtacctgagagtggggtttgtacccaggcccgcctttgccttccagcctgtgacgagtcctgcaagacgtgctcgggcctgaccaacagagactgcggcgagtgtgaagtgggctgggtgctggacgagggcgcctgtgtgggtgaggagcggcccgggggtggaggagggcgcctgcgtgaggcgtggggggtgtgagatgggggcgtaaggcgtggggggtgtgaggcatgggggcgggaggcaggggggcgtgaagtgtgggggcgtgaggtgggggcgtgaggtgtggggcttggggtgtggggggcgtgaggtgtgggggagcatgaggtggggcgtgaggtgtgggggcgtgaggtgggggcgtgaggtgtgggggcactcactgtctcactctcacacaatgtgtcgccatcctcatggggcgcctgccccggttggcactgagtgtctaaggacagggcctggccatcgcctcatcccctcccctgccgcgtggggcctccgaggatggcatttgagatgattcctcctcaggggctgccctcctccctgcccttccccagccggccctggccacgggctgtgtcaggccatgatcggtccttccccgctccctggccgggctgtcctgggccgctcacagctgtgccgctctgttccagatgtggacgagtgtgcggccgagccgcctccctgcagcgctgcgcagttctgtaagaacgccaacggctcctacacgtgcgaaggtgggccaggcgggcgggtctgcactccggggcctgccgggtttcgttgctgcctttgtcaacattcatttatggcttcttagtgtcacttccatacatcctgcctgccctgagaacacttagtgtggcaaagtaagtcataggtatttgctgcaggaaaatcagaaaattcaagtcagatgaaaagaaaacagttaaaaacccaggaactccctggagagcgcaccctgctggtgcctccactgctcgtgcccccccagcgcccccgcaacgtgccctgcgtgactttccgcagcgcctgtcgggtgttttccactcagcagcttgttgcgaacgtctctgcgtcctgtggtttctctgtcacgctaatgattttggagccattatttcatacttttacaacaatgtctgttgctggacgtttacgtcataacagtttttcaacttataaactgtgaacacttgaaggtaaacttttcacattccttatgattttctgtgga

SEQ ID NO: 104272 - DNA, 1065 bp, Homo sapiens
gtgccccagaaaagttgtgctgatccccagtcccagcagcagggaggaggccgcctctgccccgtgtgtgtgacagccccaggcagttttcactgttgggagtgcagacagtgggtccctcagtgagccactaatactggaagccatgcgagaggctctggttattcttaggaagctcctggcaggctggcaaaccaatggtcaccgagctggaggtgggtttgtttctagaatctctgtagcacccagtttctcccaaagagttccaagccaggtggtctgcaccatggctctccgggagcacctgctgcacagcaggacgcgagtctgtgcttttgccgggagacagagacagatcgttataaagtcacttggtgatgaatgaggagaaaacccaaatcctggcggcaccggtgccttgtgcatgtcggggtctgacgggcactggtgccttgtgcatgtcggggtctgacgctggctccctgttgcagagtgtgactccagctgtgtgggctgcacaggggaaggcccaggaaactgtaaagagtgtatctctggctacgcgagggagcacggacagtgtgcaggtcagtgacggggtctgtgctggacgctggtggacccttcccaagtgaccatgatgtgaatggccccagcaggtactgccagggatgggaagcagttgagacccgtcctgcagacgtggctcccccagggtcactgtgcactcgccctgaggtccacgtgagacacagaagcagtgggggtgggggacgggctctgcatggccgaccctggtgtggatggcgctgctgcaccagcctctcgccggtggcctcgttccccaggtccaccgcctctgctctccctccagctcctgggtggcgattgccccgaggcttaagtccaggcctgccatggttgtgggctgcctgggtgagcctgggcgtggatggaacccggtggagaaagtgggtttcctgggcaggcgccatggttcatgcctgtaatccagcactttgggaggctgaggcggggggatcacgaggtcaggagatcgagacc

SEQ ID NO: 104273 - DNA, 1050 bp, Homo sapiens
aaatacaaaaaattagtcgggcgtggtggcgggcgcctgtagtcccagctactcggggggctgaggcagcagaatggcgtgaacccgggaggcggagcttgcagtgagaggagatcgcgccaccgcactccagcctgggcgacagagcgagactccgcctcaaaaaaaaaaaaaaaaggaaaagaaagtgggcttcctgggcgcatgctggccttccggccccacctggaggtctcttctctgcattttctaccagttgagggcccaacttggagacgtgaaattcttccctctcgaagcctttcctgatctttgctcctttctgtaacgtgacgtttgtcatcgttgtgctttctttatgtgaatgaatctgaatgaatgaatttcataatccgctgcgcgtctgctgagcaaagtaattattaaaacggagtcttttcattttagatgtggacgagtgctcactagcagaaaaaacctgtgtgaggaaaaacgaaaactgctacaatactccagggagctacgtctgtgtgtgtcctgacggcttcgaagaaacggaagatgcctgtgtgccgccggcagaggctggtgagtggcacggctgccctccacacaggctgccctcccctgggccgcagggcttgcacgtagactggctgcttggtctgaaatccacacagatggtggccttgagatggtgagagggggattcccggaagacaggtgcatgacatctctgtgtgggcacgcttgcgcgagaggtactggcttcctgaggatgaagccccaggttcacagctcaaacggaagttcaggcgatgaagggggaagtctctgaagctcagacctcagcgggcgatgagcagaggagcagacgcaggagaagaggcagctaaagagctggaaaagtcatccggggaagctgcccagggtgccgcagagacagggacaggcaggaagtggtggagggcaagcgggtcccccacacctgtttcctggggctaccttaccaagaaccaggaacttagggctccagcaacagaaatgtgc

SEQ ID NO: 104274 - DNA, 1006 bp, Homo sapiens
acggagctcccagagcctgcagcctctcacccgcagccagctttcttcttgcagtgtcttcattcccagatgaggaacgggcaggccctgcggtttgtgagtggctgtttcctccagcgaagcccccaaagatgcttttcccctgcctgagggtccctgcttgtacatcctttgaatcactgaagagggcccataggttggacccctgaaacccacctggtcacgtcttcaggttctcgcccaaggcagggccctcccctcctcccccaagcggcacgtgagccctgttcagggacagcagagccaccagcccaggaccggacctgctgcctctgcggacctcggcagccctggtcactcccggctctggcaggacaggtgcaaactcagtggtaaaggtccgtcctgattaatgagacaaacccacgcccgttctcctcctgattacctacaatggtcaattttattacaaagaactgtatcaaaatatacaagtctgtttaagaacaaccaagaaatgcagctgtttaagggacaaatgagaatcaaccgttagagagcaggcagcctctccccgccgctgtccactgcaggagacggcatcctcagggccacattttccacgggacatccttctgaataatttaaagggtaagtccggcacattacaggtcttcgcgggagggcagctgtgtcgggctttctccttctgtggcttctgtcagaaaacaagcataggtcgtcaaggctgagcacaaagggccctggggatgaggcctttcccaggacagcagcgcatgtgcagggcctgcccgtccagtcctggctcaaagccccggacgcagccatccaagggcagctcggagacccccgtttcccacaaagcagatgagagatgaggcagacggcatttcagagcccccacgctgccgtgggtgtggaggatgcagagttgggagcggcaaggggttccttgcggcctggcagaatgggagcctgaacaatg

SEQ ID NO: 104275 - DNA, 1071 bp, Homo sapiens
ggccagtcccgagagccacagcctcagaagagctgaacaggggagtggtgtgtgagtggtcagcgcagggacagcgatggtgactgtatagagatgagaggtcagacttaggggaggctggaagctccgaggcaagtgtgtgtgcgcgctgacggtcacaccagaccgcccggggatgtctgccacaatatttagacccctgagggccactgagaacgcctggcagtgccaagaggaccagcccctgggccctctggcccccaactctcaacccactagccctggggctggcgggtggccactcacgtcctggaaccctgagctgctctcaggccggtgactttggaccaatgttggcaatctgtgggtttgcaccaaaccacacaggtgagtcagacttctgtacagagagcagggaaggggcacgacagggtgaagtccagaccagggcaatgtgtaccccggctgttcagcctttgagtgcggctgtcgcagcaatcaaggtgggctccctggtggaggtggacagcagctgctggagagcccggagggcagccaggaccgtgtcagacggcaggagtcgggcggggccactccaggcaccggccagcagggcagaggtaccagggagggccctcgggctgcgggcgtgaggtcagagcccagggtgaggaggaagcatctccagccaggtgcgctctcggcccccgccggggctgcgaggctgggggcgctgccgctgcgagggcttccagaggagccggcgctacctccccgcgcgcccggccacgtgcgcgacgggatgcgcagacagccggggacgcagactggcggcgtgtgtcacctcgaggccgcgggacaagcgcaggtcgcctcccgcactcccacacccccaggaaccctgctcggggccggcgggtgaccttcctaggcactgctgggggcggagccaggaaacggctcgccccgccattggctggggcgccggatttctttaaaaactccggcttccattggctcgtgcagtccctcctcgttctgcccgaggcgccacggccgccacccgcgcgg

SEQ ID NO: 104276 - DNA, 1490 bp, Homo sapiens
cgggccttccgggcccactgcgccgcgcggaccgcctcgggctcggacggccggtgtccccggcgcgccgctcgcccggatcggccgcggcttcggcgcctggggctcggggctccggggaggccgtcgcccgcgatgctgctctccaagttcggctccctggcgcacctctgcgggcccggcggcgtggaccacctcccggtgaagatcctgcagccaggtacgcgcggggccggcggggccggggccggggccagggcggggaccgggggcgccccgggccgcaccaaccccgcccgcgcctccctgcagccaaggcggacaaggagagcttcgagaaggcgtaccaggtgggcgccgtgctgggtagcggcggcttcggcacggtctacgcgggtagccgcatcgccgacgggctcccggtgagtcggaccgccgggcgggcccgggtttctcgcgcgccttgcgcctcgcttggcccggcctgacccccgcgtctccgcaggtggctgtgaagcacgtggtgaaggagcgggtgaccgagtggggcagcctggtaagttggggcacgggcggcggcggcggcggggggcgggcgcggggcttttgctgaccgccgtgtcccccagggcggcgcgaccgtgcccctggaggtggtgctgctgcgcaaggtgggcgcggcgggcggcgcgcgcggcgtcatccgcctgctggactggttcgagcggcccgacggcttcctgctggtgctggagcggcccgagccggcgcaggacctcttcgactttatcacggagcgcggcgccctggacgagccgctggcgcgccgcttcttcgcgcaggtgctggccgccgtgcgccactgccacagctgcggggtcgtgcaccgcgacattaaggacgaaaatctgcttgtggacctgcgctccggagagctcaagctcatcgacttcggttcgggtgcgctgctcaaggacacggtctacaccgacttcgacggtgagcgcgggcgcggggcagggaacgttccgggggccttgccggcgggttaacgcctgcaggggcggcacatggaggggctgatgactgttgggcggccgcgcgccctgggtctgctctcgtggggagcagaggcccacgcgctaccctggggagggctgagcgagggatcaagagcgggatcgtgctgggtgggggctaggggcgcgctcaatattgcttcctccatcgcgttggggggtacggggcctcttgccccggtgtgggaggcgcgtgacatccttccggcccgagagacccccggctgggggcggtagcggaggagtctccgtgcgtgacgcagggcgcagccgggctgggtctgcgccgggagcctggaggcccccgcggcgcggttggagtggcggggcctcccctgcgtgggggcgggagctgcgtgcgtgcggagcgcgggggcgcggcggcagaaatccccgcattgcggagcttgg

SEQ ID NO: 104277 - DNA, 1069 bp, Homo sapiens
gcccacctcccgccctcagtcctgcggtgtgcgtctgggcacgtcctgcacacacaatgcaagtcctggcctccgcgcccgcccgcccacgcgagccgtacccgccgccaactctgttatttatggtgtgaccccctggaggtgccctcggcccaccggggctatttattgtttaatttatttgttgaggttatttcctctgagcagtctgcctctcccaagccccaggggacagtggggaggcaggggagggggtggctgtggtccagggaccccaggccctgattcctgtgcctggcgtctgtcccggccccgcctgtcagaagatgaacatgtatagtggctaacttaaggggagtgggtgaccctgacacttccaggcactgtgcccagggtttgggttttaaattattgactttgtacagtctgcttgtgggctctgaaagctggggtggggccagagcctgagcgtttaatttattcagtacctgtgtttgtgtgaatgcggtgtgtgcaggcatcgcagatgggggttctttcagttcaaaagtgagatgtctggagatcatatttttttatacaggtatttcaattaaaatgtttttgtacatagtggataatcctgtatttatggggctgggcatcctgggggaagagaggggctctgaggaagggctttggctgctgggtgacctgacaagtttcccgtggggctggtagttttgcccacgggggaaacgggggaggcccagctgggtgccagcctccccagtgccacaggctacttcatgtggcttgtggcccaccgcactaccccgtgctgcacccagggagaagagcagctgcctcctggggtgcctctgggaggtggaggcagggagccaggccctgaggatgcagcaacccacactagtcaggaggtcattcctcggtggtcccaggaggatctctgcagcccccacccagggaggccttgccagtggaaatggccatacttgcatcctggcttggtggaaacagagacgtgcgggggggtgggggagggagtccatgctgcctcagagggtgg

SEQ ID NO: 104278 - DNA, 1032 bp, Homo sapiens
cccaataacccatcgtaatgggatttgggaagcctgtttcaggttcatcaaggcatgatcccttgtcaggtgaggagcagactgactggggatggtcttcacaccatcataaagtcaaaaaagcgttaagtcaaaccatcataagccgaagaccatctacatttagcgtcattcaggattcaaattagcaaacaggtattgagcgcacaattgtaccacacgccagatgtgtgcagatgaatctgactctgtttctgccctgaaaggtggtttagaatcttagagagtgcggagaaccttcccacctaacccatgctttggcagcagtgtgatgaggcagagtcgtggcccaggtctcagtgtgttgggggctggcatctgagcccatgcagctgagtccctgcacccgaatgtgtgtgttgaggttagactcctggtttccaccttgcggtgtggatgttgagccttggtctcttgtgtgtctttgatgaaggtacactttgccttgccggacagtcggattttagtctgtgcgccctccaacagtgctgctgacctcgtgtgtctgcggctgcacgagagcaaggtgctacagccggccaccatggtccgggtgaacgccacctgcaggttcgaggaggtgagcccttggtgcaagcagtggggggcaccagaacccctccctggaacataggaaatgccaagtggacaggggagggcaggggtaggagggtgggcacagaggcgccacagaaagctgtgtttgagaaatggctctgccatgggccctccctcaccgctaaatggtggagcttgattgctgactatttcatcacattctcactctgtgtgagttatcacacctattgtgggcattcgtagcattgtaaaattatcacattcctcttttatttaatccccaaacgtcttgttactttttaagtagttttgttttgttggtttggtgttttttgttttgttttgttttttttttttgagacggagtctcgctgtgtcgcccaggctgaagtg

SEQ ID NO: 104279 - DNA, 1050 bp, Homo sapiens
ggtcacatgctcaggggtcaccccctgcagggacctgatgccctcgggtgggagggaccgaggtccaccctcgggtcaaaggtcaacgtgcactttctccttgtcgcctgacagacattttattttactaagactgctgtaccgaacaagcatatttatcatcaggagacaggatgggtttaaagcaggatggtgtgtgtgtgaacgggcatgagcagaggtgagcgtgagcgagcgggtgtgtatgtacgagtgtgcacgtgtgtgcgtgtgcacagagggtgtggtgccagcttgagtgggagtgtgtgagtgtgagcaggcgggcgagtgcgtgagtgcacgccagcgcgtggcccatgtatgaggagtgaaggggcccaacgcaataaccacgtcccccacccgggccccccgccgcggctgaggccacatggcttcctgtgggagccccggccggcacccggctggtcccaccccaaatacctcagccatggagaccatgtcatgcagaattaacaaggtagcaccgagcatatcaataaatattattctgataatcacctgtgctccgccggggacttcgcctccctccacgcccgtcccctgactcggcaccatgcgtgggggtgctgcaggacgtggggcaggggctgccttcagaagcgtgacaaggggcccctctgcacccacagtgagtgtcatacttggagcaggacatgccctggactcaggctgtgggcacggaggcgattcagctgtggcctgaagccctggggcacacaggcttgggagacgaatgcacgacccccttagtcttcctgctcctgcaggggagcgaggagggggagtgtgaggcaccctctaggagaacagagagctggcgggatccaggaaggcttcctggaggaggcgccctcagtgtggtctgggatgctcaaaacaacacagagatcctgagcaggtgcctttgctgggcccaggactccatggaacaaggctggtcccgtgggtgcaccatggaaccacatgccctgtagaccccggcag

SEQ ID NO: 104280 - DNA, 1050 bp, Homo sapiens
cgtgcgagcattgtccccatttcacagcttgggagctgcgaccagagaacgtgggcgcgcctcgcaaggccgtgaccgcggcgggactcgaaccctccctcctgagtgcgcgccgatgttccttaggacccgggagcgccgggggggggggggggggcgggggccccgcgcgctaccccctgggaagtgtagtccgaagttgcgggccggggccaagcaggaggcgcgtgggactacacttcccggcatgccacgcggccgccggcgccctcggcccgtccgccccgccccgccccgcggccccagcccgccccgtccgttgagggcccgcgccgcatggaggccggctgaggagcgccgctgcctcgcctcggtacgccgcgcggcgcggacggcgcgtgcgtgaggacggggcccagcaccgagcggggggcgggcccgggtcagggccgcggggtgactgtggggggcggggggagcgagcccgagtcggggggtgggggccgggggcggggggggtcaggcccgggtcaggttttggggccggggtagcaggtcgtgggggtcaggcccggatcaggttcaggttttggggccgggggagcaggtcgtgggggtcaggccagggtcagattcagggtttggggctggtagaccagggtcgttgggggccgggcccgggtcaggtttgggggccggggtggcaggtcgttgggggggccaggcccgggtcaggttttggagccgggggagcaggtcgtgggggtcaggcccgggtcaggtttggggcgggagcaggccccgcgcgtcccctgccaccgctgccgggagcggcgctgccgaggagcggagccccccagggctggggcggggagggtcagcggcggcctcgcgggaaggcgcgggtcggacctcgagtcccagggtcctcgcgggtcgggagggccccagccacccccgcctgccgcctgcggtggagccggccgaggtgagagtggaggaaggcggcccaggcctgcgggtctctgggggtgctgggggaggccgagc

SEQ ID NO: 104281 - DNA, 1007 bp, Homo sapiens
acacctgtaaccccagcactttgggaggccgaggcaggtggatcacaaggtcaggagttcaacaccagcctggccaagatggtgaaaccccatctctactaaaaatacaaaaattagctgggggtggtggcgcacgcctgtaatcccagctactcgggaggctgaggcaggagaatcgcttggacctcagggtgggggaggttgcagtgagccaagatcacgccaccgcactccagcctgggcgacagagtgacactccgtctcaaataaaaaaaaaatgaggtctcgctaagttgcccagactggtcttaaactccagacctcagacaattctcctacctcagcctctcctgagtagctggggctgtgagcgagtaggctcctcccaccatgcctcactggtgctgggaaaaaacttaacagaaatttattttctcagagttctaggggccggacatcccagatcaaaggtgctggtccctggttgccatgcagcctcctggcttgtagacgggcccccgcggcgtccttacccgggggagcaagagctgcgtggcgtctcttccaggagtactaaccccgtcatgggggctatgcactcatgacctcatccgaacctgatcacctcctggaggccctgccttctaataccttcatagtgggagttagggctctaacctgtgggttttgggggacacagttcagtctgtagcagtgggacctgagcaggcaggtgggatgcgctgtctgaggctcccactggatgtcaggtcctgggacagaagccctgcgggacatttcggatgcagacagccgtctctgacgccaaaggactgtagatgccgctctgattttgtgtcctagggccgcacacctcaggcagagccctaacggatgggcttttgcgcacaacagatgtcctcctggggctgttgggaattctcagaggcttcgtctgcacagaggatcatggtttccaaagccagatatccctttttacagatgag

SEQ ID NO: 104282 - DNA, 1041 bp, Homo sapiens
tggctgaggacgggagcagggtgtacgtggtggggacagcccacttcagcgacgacagcaagagggacgttgtgaaggtgagcgccgccacccgccacatcccggacacgggttggtgtaagctcctgtgtcctgcactcagggacctcccggcagggcccgtgtgcccgtgtgtgcgcaccgcaggcctcctgcttcaacactgtggtccctgggagtggcaaggtgggcttcctgcctgggagccgtgacggccttgtgcgttttcccacttaacaagtgaacaagcctcacagcttcctctctcgtcgcttagagaattgagctgtcactgcagcagcggggttagctagccctggggtgacgccaaggctggctgctcctgggatggggcccctggtgctggcgtcagctgtgctgaggggcagggagcggctgtgttctcgaggtgtgacctgtggctgttgcagaccatccgggaggtgcagcctgacgtggtggtcgtggagctctgccaatatcgtgtgtccatgctgaagatggacgagagcacgctgctgcgggaggcccaggagctcagcctggagaagctgcagcaggccgtgaggcaggtgcgcagccgcgggcaagggtcagggtcagggtcggggtcaaagccacctgtttgcctgttgcccaggttcctctcacagcccatgcccccagtcagtgtggctgtgcctggcctgccctggggattgccgggttagggacctcccctgggccaggagaaatgaaagaggctccattacccggtttcaggcaagggaggaggaaatgggtggctctccaagctgaggcaggggctggtcacccgaggactgggttgctgagcagttgctggggatgggtcaggtctcagtgcaaggttggcccccccggtaccacacccaggcccaaagtgggtggggctcagggctcctcctgtccccacttctccagccttgcagtgaccggagaggcaggactttctcattgctctttgtgttttcggtttttgtt

SEQ ID NO: 104283 - DNA, 1078 bp, Homo sapiens
aggccagcaaggtgcctttctgcaagttccacctgggtgaccgacccatccccgtcaccttcaagagggccatcgcagcgctctccttctggcagaaggtcaggctggcttggggcctgtgcttcctgtcagaccccatcaggtagggctgcccccgggaccctggccggcctgcagggtggtctgtgggaggctccaggccctcctgtgcaggtccaagcgcagccaatcctcactcaaggccttccctgccctttccttccgccacaaatcccaaacaaacgtgctgtggtccctgcccggtgtccacagtgccagccccacccccccagcccgttgcccatccctgcggggctgcagccatccctctccacagcaaggatgacgtggaacgctgcaagcagaaggacctactggagcagatgatggccgagatgattggcgagttcccagacctgcaccgcaccatcgtctcggagcgcgacgtctacctaacctacatgctgcgccaggccgcgcggcgcctcgagctgcctcgggcctctgacggtgacggccgcccgcaggcgtgggaccccctgtgaggctgaggcccgagcaggtactgaccccttgtccttccccacagccgagcccaggaagtgcgtcccctccgtggtcgtgggcgtcgtgggcatgggccacgtgcctggcatcgagaagaactggagcaccgacctcaacatccaggagatcatgacgtgagtgcccgcccctccctgcaagccccaccccacaagcccccaggtggaggctgagcgccctggaggccaaccacatgcggcagtgacccaggcatgggggctggggtatggggagcccacccccagccaggcccagcgccccctccctcccacagcgtgcccccgccgtccgtctccggcagagtgtctcggttggccgtgaaggccgccttcttcggcctgctgggctacagcctgtactggatgggccgccgcaccgcgagcctggtcctgtcgctgcccgccgcgcagtactgcctgcagagggtgaccgaggcccggcacaagtaggagac

SEQ ID NO: 104284 - DNA, 1058 bp, Homo sapiens
aggtgctcctagggctgtgtcctgccccagctccatccctgcagtccaccccagccatgttccatgtgggtgggcgatggggctgcagaaggccgggaggagccgctggggcagcctggtgctccggcatagacatgcgtgggtggtcaaggcaggtcactctgcccctctgagcctcagtcttctgccagtgacgcagggagacggcactgactgcctcccaggagcgtcggtggccttgaaggagagaggtggtgtcaggcctgtgttcagcagggccggtggggccctcagtgcaccctgcaccttgggggctcctggcccccctgttgattggcccctattctcaaggttaccggtgctgggctgggtggggactgctgtctggttggggggggccaggccagcagggtggtggtggcaccaggatggacagtggcctggccctggggcaggtgtggcccctcagtgaactgacccttctctgcttctttggggtctctactgggcctgagtctggggttccctgatttttctagtttgggtaaaagccaaattttgtgagcatattaaagagtggatgctgtgagtgcaacgcactcttcatcgccaccttgtggttgaggcggtgacaggacatcaggaagatcgcccagaaactgcagagtgagagccactcagcgaagcacagccggtttcagggaggggaaggatggacacgagtggggaggtctgggcaggaccccgaggagggagcaagcacactgtcccaccccaggtgacgcggcgcacggcgcggatggtggccgagtggcagtgtgtgggcttctgccacggcgtgctcaacaccgacaacatgagcatcctggggctcaccatcgactacgggccctttggcttcctggacaggtaagtggccctggggcccagcaaagtgcaggccccagggctggggggtgcgggctgcatgaaacctgctgcccccaggcactggcccgtgatgcttgagggggagccgagggggctgggggctgatgtaggaagtagagagtccaggg

SEQ ID NO: 104285 - DNA, 1054 bp, Homo sapiens
ggccacggtggaacacccacggacatgtgtctgacaccagcatcagggttggggagaacgtatcggacgtggctcccatccggtcacggtgcaacacccatggacacgtgtccgacgccagcatcagcttgggggagcctgtgtcggatgtggtttccacccggccacggtggaacacccatgtacccatccctccgccccacatggtgctgggggctctctcaccagaagctgagcccaacacacccaggccccaacagagcccccctggccacacgtcccagtcagcgctcagcctgggagcacagagcactgtgctggactgtgggccacggctgcctgtagaagtggggccatctctgtcctcccccagctcgggctgcggggaggggagcatcagcgtgggggagaacgtgtcagacgtggctcccacccaaccatggtggcccaacaccccgggagacagtgtctctgaagaactaggtcagagtagggtggctggtggtcaggagtgggactgtgggacgcacagagcctgggaggtaggcgggcagtggggttggtggcatgtgaagttcccctcaggcctccttgtcagccaggacctgggctgctgtgggggacatgggaggggctgcttgagccagggccggctcggctctgtacccgccacaggcactcggccctgatgccctcgtgtccacttgtgtccacacaggccctgggaggagcggggacactgaggacctctctccaaattggcctctcaactcacaggttaggtggatgcagcctgggggtcccacagcaggcagggagggctctgtccctctaggttgtcacgcgggtgggtcccacatgcgattttcctttttttggcacaagctggttgtggggacagcgtgcagtggggaggtggttctgaggctggtgttttgttaggaagacacagctgcccagagcagcccaggccgtggtgaggaggcggaggcatcggcggcggaggctcagggtggggagcaggcctacctggcaggcctggcagggcagtacc

SEQ ID NO: 104286 - DNA, 3725 bp, Homo sapiens
tcagatgagaggaagggttggtggtgggcgcccctggggcagctgggctcagatgagaggaagggttggtggtgggccacagcttctggcttcttgtggatgggccgcatttccacctggcccggtggcggggtgtggctcacagaggcccattgcttggaaatggagcccagagctgaggcaagaaacaaagcgctgttcccagcactggtgcccctcaggccctgggcacggctgcgtccatgtgcctggccgccctcctcccagcctctttgcccacaggccttcaccagtggcctgaggaggtacctgcagtattaccgggcctgcgtcctttccactccgcccaccctgagcctcctcaccattggttttctcttcaagaaacttggccggcagctcaggtgagcctcagcatggcggctgagcaggggactttgcgggagcggtgtggggcttgctgggtggtggagggtttgccctgctccctggcaaggagggcctgtgagaacagccctcagcaggcgaccggatggcccttggccggccgagttcaccaggtgcccggtgctgagcgggtgtgtctgccgtgggcccaccacagctggccccatccaggccctccaggtccggtggctcctgcctaattggcacacagggtccctggagatgtggcgtccggtacacacaagctggttagtgagcaaccaggctcgggggctattggcaggtgccatcagagaaggaagagtgaggagctgggcattgggagcagtgggagaggcgaccttccaggctgaggagcagagtgtggcagcgctgaggagacccaagggctgagacactgtggggcaggggagctgggctgtgaagggtgcgagttgtggcagatgcttggtaccactgtgtggatgggaggggctctcaggtgcagcccccagaagtgggaggatcagggtgattcgtgtgttggccagatcctgggagggagggcctgctgggtgtgggtacttcagtggggtgtgtgtggacagcgcaggggcacagggctgcacacgagtcctgcagggagcccgtttctgggtggttggggtgcctgtggtttttaaagcctgcatctaaagttagttgccccagggagcataaagatacgtggagactttgctcacgatctgatccaggcctgggaaccctgagcccggtcacctggtctcatcctgcctctgggtctaggtacctggccgagctctgtggcgttggcgctgtgctcccgggcacctgtggaggaggccccagggccgcgtttcccaccgtgagttgtgcgtccctgccgagtgtgtcagcctggtgggctccaggaaacgggggtggctgagcgtgtccctggagggctgctgccggcagggctgcgcctcactcccagcgctgggtgcgctgagctgccccccaccccctttgcggtctgcagggcgtgaagctgctgtcctacctctaccaggaggctctgcacaactgcagcaacgagcactaccctgtactgctgtccctgctgaagaccagctgcgagccctacacccggtgggcagtgggctgggcaggcgcggcgggcgcgcactcccaccaggcagacacttgagagcggtcccttgtcagacacctgctgaatgtgggggtcacacaggaaggggagggcaggataggtggactgggcaggagcccccaaccccccaccctgcccccactccacaccccccaccctgcccccactccatcccgcccctcatggatggccacaccccactccacctctcacagctacgcccccacttgcccctcactgacagccacgcccctgtcccacccctcactgacagccacgccccacccacctctccgttgaccacatctacccctgcttttcccccactgcaggttcatccacgactgggtgtacagcggggtgttcagagacgcttatggcgagttcatgattcaggtgaaccacgagtacctcagcttccgaggtaggtggcagctgattgcggggcaggggtccgtgcctgtgggcctgggttcagggccatggccatgccggccaccgtggtgttcaccctaccttagataagttgtactggacacatggctacgtgctcatctccaaagaggtggaggactgtgttcccgtgtttctgaagcacattgcccacgacatatacgtctgcggaaagaccattaacctgctgaagctctgctgcccccgggtgaggaggggctcatgtgtggggaagagaggggccggtcttccctggggctgagtatgaggctggggctgagtgctggtggctgtgcttgcatcccctttggcagcattacctctgttggtccgacgtccctgtcccccggatctcggtgattttctcccttgaggagttgaaggagattgagaaggactgtgccgtctacgttgggcgcatggagagggtggcccgccacagctctgtcagcaaggaggagaaggtgcgtggcaccacaggtctcgggggctttcttcgcccctgcctctgcttcctggggtctcaggttggtggggcggacatgagggctgtgcaagatgggggcctcccttctggcattttctgtcctggcggtggcctgggtgggtgccaagggggagttgagatgaagggtgggtgtcaacggggagttgagatgaagggtgggtgccaagggggagctgagatgaatgtccggagccagatgccaggcaggggctctgacttctcctcctgggtctgggtggctcagcctgaagcccaggctttgctggcgtgggaaactccgttggggcctccccgggcccgccagctgtggacagacagtcctggctgcactccagatggccttcgccctttgcaagcccccttcctgctgggaagggacagtgtgtcagggacgggccacgcctctcctgtgtcttctgggaggggctcggtggtacaatcagtgccattcccaggaacaccctttctggcctggtgcctggtgggcagcagggatacttgggcaggggcaggcctaagaggctgagcggggaagccccctcttgaggcctcttggtttccttccagggtgggcacacacagccttggggtcctcagccccagatgtctctgtgagagccggtcagctcccgtccatggcctggaaccagccttgccactgctgagagcctgggggtgggggagggtgggcgggggggcggtgtcctgccatcacctggtccctcctcgaacccttggaccatgtgtctcccctgccggccctgagtccacaggtgtcctgggcatcctaggtgaggggtcagaggattaggttgctttttttttctttgagacagggtctcactgtgtcagccaggaggctggagtgcagcggctcgaacatggctcactgcagcctccacctcccaggctcaagggatcctcctgcctaagctcccctgacccccgccaaatagttgatactacaggcacctgccactacacctggctaatttttgtatttttagtagggatgggtttttgctatgttgtccaggctggtcttgaactcttaagctcatgtgatctacccacctcggcctcccaaagtgccaggattacaggcgtgagccactgcgcccggccaggatgctttgattaccagttgtctttctcaggaattac

SEQ ID NO: 104287 - DNA, 1011 bp, Homo sapiens
tgcctcatggttgtcacacacctttgtgagaacggtgcacacgacctggaagagagaatctcagaggtccttctgcaggaccagagagtctaaaccttttctttccttgctaacatctgaaacccgatagtggctcttgagggatgggtcagtgaggatgttttacctcactagaaacttggggcagatgtgtgtgggccctgggctgtgtgggccctggggtgtgtaggaggcaggtgcagccagcataaggggtgcgcagggcaggaaaggcgtgagtggggctcttgctgcctgctccccagtgggcccggcacattgtggatgactgacagcgcagggccctcctgttgggtgaatttacattgctgggagttctgagccaagtctggctccggaagctgctgtttggtgagtcttgaagctggctcatgtgctgggaagaggcccatgggacaggggctgcaccttgagtgggagagaataggcaggtggatgatggggcatttgggtttgggggattgagaggagggtgttggggaaggtgggcagagagccctggaggagccaggcagcgcagcctcctttgactgttgctgctgcagcaggggctgtcgggtggggtgatgtggtgaggtgtaggttttagatgggctgtggaggtgggcatggtgggagctgcacggggcggggagagcttctaggcagaggctcagccccgggggacttgagagctagagatggtggagaaggggtcagagcaggggacgctgagaagggctggactgtggttcttgttcatctggcaggcatagccaggcggctcctggggtgggtggactgagattggtccagggtgcccctgtcttagtgtgacctgcagggcctgctgctgtggcgttgcccaggatgctggtgccactgagacagctgtggtcggagcagctgcagccctcacagcactagtgtctgtgcacagagcacggccgccatttcccccccagccccttt

SEQ ID NO: 104288 - DNA, 1034 bp, Homo sapiens
tggggtgctcttccagggctgggccagtcggatacccccggccatgcccaggaccccaggaaggtgccctggaacactttccacatgagttgtcctgatagaatcgatcgtgctggtattcacagcagcagcatccacaaaaggctgggtggtgagctgacattcatacctggctatgtttcttagagtttattgttttgaatcacttccattcttctgttcatgcccattcccgagagaaagcaccctggtgctgaggtgcaggtcaccacgtctgctcatggcctctcttctgcacccctcgcagcccccctggccacagagaggagccttacctgacggaggcgggaagggacgctttcgacaagttctgcaggctccaccaaggggagctccagctgcttgctgggggcgtcctacaggccccgcagcccgtgctggtgaaggagtgcgagctggtgaaagacgtgctgaacgtcttgattggggtcgtgtctgccacgttttcgctctgccaggtgagaactgctcactccccgccacagtggtgtggggctggcctgccctccaccacgcagtgcccagccctttatggggcagaacaagccccagtgcagggagtggggagtggcagggaaggccagctcccagggccaccagtgatgacagccagcatcatcccatttcggttctaaaaagtgttaatttattaatgtccttttaaaaaactgcagagaaataacatgtttattgctgtcagcaaagcgatagaaaatgttcctccccgcatttccatttccgtcctgaagtgccaggcgccttccgagccttcccaccgctcgggaggagcatctgcctgccgagagcgtcccgagactggggcctgcgctgctcttctcactggatgcggtgtcatccgggatggggccgggccttactggttctggcaccagctgcagtttagccagccctcttgctgggcactggagaagtgaatggatatattcagaaaaatgaagtcttgctctgcagct

SEQ ID NO: 104289 - DNA, 1220 bp, Homo sapiens
cctggctgcaatgcttcgggggctggcagggggccgagtcctggccctcctggaggaggtaagctgggcagggtggaggtgctgcggggtgggacgagggaaaggaccagtgactgcttccgtcttcgcccctggtccagaactccacaccccagctagcagggatcctggcccgggtgctgaatggagaggcacctcctagcctaggcccttcctctgtggcctccccagaggacgtccaggccctgatgtacctgagagggcagctggagcctcagtggaagatgttgcaggtgaggctgactgcggaggcatggccctgccctggggcctggctctgccgcacagatcggtggggagggcagggcaggggagtgccctgaaccagctccagcgccggaggccaactgcgcgcctcttctcggctcctcctgtagtgccatcctcacctggtggcttgaaatcggccaaggtgggagcatttacaccgcagaaatgacaccgcacgccagcgccccgcggccgcgatccggaccccaagcccacggctccctcgactctggggcacggaaccccgcccactcccaatccccgcgccccgccctctcccacccgtgcttcccccgctccacccctcacctcacctcgcccccgccccacccatcgcgccccggcccgtcccatcgaggcccatgcaacccacgctcggtcccgttccggcccctgcgccccgctgcgcttcgctccccgcccttgcgccgttagtaaacatcgctcaaacgaaacgctggctctgcctcctttactgagcacgctcggcctcggtctctcacccgcggtgccggactcaggccggaagtatgccgcggcccaggcctcaccaacttcacgcgctgccggcgttcccgtgacgtatttccggcgcgcccgccctagtgctcttcacactggcgcggctgtgacgcgacggaggcggcgagagcggcagccgtgggcactttccacgggtgaggcctggagaacgggtggacgtgcaggccagaacccgggacccacccggctgagcccccagactctccgctgcccacgaccctcggagtggcaccctctcctggccgtctcctctcgtgggtcccgaagaacgggtgcaaagccgagttcgtccgctgtactgcgcgggcgcgcgtttcgttcttcggttttgccacggttctgtgact

SEQ ID NO: 104290 - DNA, 1050 bp, Homo sapiens
gtatctctttgaggatgaccccaggtgagcaggggtgcggaaaccacccttccctgcagccccagtttttgggtgcacagcctggcctgggaaaatccaggggtgagatacagacatgtgctcaggggtcagcgttctacagggagctgtagagctgttgagggtcctgacctttgacctctggccctggctggctgttggcagcgtcctttacttctcctggcaccgctatgagcatgggcgcttctggcctttcctgcgagagtcagatgcagacgcagtggggcggggacagggcctcggcttcactgtcaacctgccctggaaccaggtgcccaccctcaagccccaggtccccacccagccccctccccctgggcccctcccctcccccacagttcaccctcaagccccaggtccccacccaccccctcccccgggcccctcccctgccccacagttcaggatgtagcctgggatgtcctgccaggttgggatgggaaacgctgactacgtggctgccttcctgcacctgctgctcccactggcctttgaggtgactgcacggagggctcccccagggcagccgggtgggagggggaccttgtgcctggagtgcgccagtgaaggcaggaggagggttatgagctgtcccactcctgtgtggctggggaaggtgctcaggaggggatgggatgggcctggctcgccctcacctgggctccagcccctctctgtcgaccctccccactccggcctggcctgtagtttgaccctgagctggtgctggtctcggcaggatttgactcagccatcggggaccctgaggtgagggccttgccttgccagggagggcttctggggtcctggggcccaggtcccccatcacacatggctctggttccaggggcaaatgcaggccacgccagagtgcttcgcccacctcacacagctgctgcaggtgctggccggcggccgggtctgtgccgtgctggaggtgactggggagggcacacagggagggtctctgggccagaggcctgggggtca

SEQ ID NO: 104291 - DNA, 1050 bp, Homo sapiens
tctctcagtggttcagaccacattaggattagagaagggccccacgaggcaccgccaggcgtgtctgtgagcgactcccaggatggaaggcaaaggctgacccccctctctgttgtgcccgcccccccacccccgccaggtgttacttacaaagaggtgctcagcttcaagcctccccggcagctgggggccagggtctccaaggagacgcctctgtgaagatctctgggctccggggtggcagtgaggaccaccttcaccttccacctgagaggggactctcgttgccaccttgaccttggctggggcttgcatcccaaggcatccatcagagcagacgcccgggttccatggaccctcctccccacggccatgcctctgctcttgggcgcccatcatggaggagcacctgaactttctggacaagacctctggccgacctggggatggcctctgatccctggagcagtggcccacttgcccggtgctctcagaaacctcagagctggtggggctccagatcaggccttggcctctgagccctgcctgctctgggccatgcagaggaaggacagagggtgggcgcagggcaccaactcagggacatcccctctcctgggcgacgtcagtggaccttcctgcacccccagcctggaatgtaaatcagctgtgtggtgcccgcgtggctggaaggaaatagacccttttgtagctccctgttctggctgtgcgtcctcatgccgggtcccaccttaagacctccgggcccttggcctgcatgtagaggaggctggcctgatagctcagacccttagagccaggaggggggcctgagcatcccatctctcccaggccacaaagctggtgcccacttcccccaggcctgtgccagtgatcttcgaacccccacgttagggcttggcccctccccttttacggggtgacctgctaatggcttagactctaagccactgtgtgtggatcctgaagccagacccaggggcagggcctgatggggaggagtgttaggatctaccctagctctctgca

SEQ ID NO: 104292 - DNA, 1049 bp, Homo sapiens
tctgggtgctgagccacgccctatgcacagcccctggtgggaacctgcctgggtgcccaggtaccttggtctgcccttgaagggctgcagagagcaagggggccaggtccggtggccccatctttaggtgccacccaggctcttggctgtgcccatgcttgggagggtggggcacagtggccacctttcctctgcccccaggacctgaagcccggcaacctggctgtgaacgaagactgtgagctgaaggtgtgtgctgcctggcagggggccctgaggtggggcaggggccccctctggatctgcccatctatccacctgtcaggcctgggcagggggccaaggtcccaggctctgggcagtggctgaggagctggtgggtgggtgagcccaagaggcagtggtacacaacatgccgtacccagggcacctgctccgtcccgagggctgctgggcttggtgcactggccagagggaggagctcggggcagtttggggtccgagggcgtggcctcaagtccttgaaggttgtcaggaggccccagcttgggagcttcaagtccaaccccccggggtctcctggaccgtgggtggcctgtccgctccttgggagtcccctagaacccacctccccaattcttcccacagatcctggacttcggcctggccaggcaggcagacagtgagatgactgggtacgtggtgacccggtggtaccgggctcccgaggtcatcttgaattggatgcgctacacgcagacgggtgagaagctgcccagagatctgggcctctcaggctgcaccatctgcttctccacttcttcacggacagccctgtggtggctgctcccagggaggctgttgagctggggtgggagccgggcaggtgggctgtgttggtgtctcctccctccccgtctcatcctgtccccctgcccacggagctgaccagggcttctatctcagtggacatctggtctgtgggctgcatcatggcggagatgatcacaggcaagacgctgttcaagggcagcgaccgtatcctccag

SEQ ID NO: 104293 - DNA, 2452 bp, Homo sapiens
tcctgagtagctgggactacaggcatgtgccacaacgcacggctagtatttttagtagagacggggtttcaccatgttgggcaggctggtctcgaacccctgacctcaggtgatctgcctgcctcagcctcccaaagtgctaggattacaggcctgagccactgcgcccggcccatagttttcttgatgaaagtgtcaggagttcggggcaggggaagctacccaggggtactctgagcagccccagcctggcccccttggccaggcatcactgggttttgtccccaacaggattctcccagcaacaagctgctgtacgccaaggagatctccacctacaagaagatggtggaggagtaagtctgcctgccctccaggccaggcccccatgcccaccctcgaccccctgcggggaggttcaggccttggtttcccccaccaccccctttgtggtccctgccgcccacactgtatgatgctcccacccctgcagttactacaaggggatccggcagatggtgcaggtcagcgaccaggacatgaacacacacctggcagagatttcccgggtaaggagaccaccagggacgcacccacagccctccccgctcccactaccccatgctgagcctggccctgagctgcagggcaggggtaatgtggtgctgagggggagagagggtggggcgggacctcgaggtgggctcggccatgtgaagtgagccacagctgcgtgtggggagtatgagctgctcctgcttggagccaggccctgcccacagcgccccctccctgcggctgcacccacggccgtgcccacagcgccccctccctgcggctgcaccctcggccgtgcccacagcgccccctccctgcggctccatccacggccgtgtccacagcgccccctccctgcggctgcacccacggccgtgcccacagcgccccctccctgcggctccacccacagccctgctcacagcacccgtccctgtgggtccatccacagccgtgcgtcacacagggagacactgagatggttggatgtgcacaactctgcctgcgtgggtgtctgtctgaggctgtgccacatggggggccccaagtgccagctgtgcccaaggccccagctgcttccccggggaggcctcgtcctgggcgtcccgtactactcctgccagccctggggctcccacagccccttttccaccctgactgtcccgtcaccccccaggcgcacacggactccttgaacaccctcgtggcactccaccagctctaccaatacacgcagaagtactatgacgaggtagggtcaggcccccgggggcgggggcaggtggggtgctgggcggtcccccggtgtgctctgatgcgaccctccctcagatcatcaatgccttggaggaggatcctgccgcccagaagatgcagctggccttccgcctgcagcagattgccgctgcactggagaacaaggtcactgacctctgacctacaatctccagtgctgccttgggacataggtacctgaggtacctgagagcccctcaggggaggaggccgagtggctgtggctgaggcccccaccctcccctggaacgcgccccaagccggagtgggtgcagccggaacccgcccagcgtctagactgtagcatcttcctctgagcaataccgccgggcaccgcaccagcaccagccccagccccagctccctccggccgcagaaccagcatcgggtgttcactgtcgagtctccagtgatttgaaaatgtgccttacgctgccacgctgggggcagctggcctccgcctccgcccacgcaccagcagccgcctccatgccctaggttgggcccctgggggatctgagggcctgtggcccccagggcaagttcccagatcctatgtctgtctgtccaccacgagatgggaggaggagaaaaagcggtacgatgccttcctgacctcaccggcctccccaagggtgccggcactctgggtggactcacggctgctgggccccacgtcaaaggtcaagtgagacgtaggtcaagtcctacgtcggggcccagacatcctggggtcctggtctgtcagacaggctgccctagagccccacccagtccggggggactgggagcagttccaagaccaccccacccctttttgtaaatcttgttcattgtaaatcaaatacagcgtctttttcactctgcgggttggctgagtgttcctcctggggctgcagtgcccctgtccaccaccccttccctgggctctgtgggtcctgctgggaggggagctgtggggaggtggagggggctgggaggggtgctgggggaggtggaaggggctgggaggggtactgggggaggtggagggggctgggaggggtgctggggggaggtggagggggctgggaggggtgctggggggaagtggaggggg

SEQ ID NO: 104294 - DNA, 3922 bp, Homo sapiens
ctgagctccacccgtgccccccgactcggggcccccacatgaggtagagggcacaggatttatcggggacagaggccaggaggcagcactcgggggcctttggatgggcctgaagagaggcagtggaggaggcaggcgtgtggagattgaggggccagtgccacctcctgaggagggagctgtgggggccacgatgtcaggtgggccgggcgatgttctcaggtgtggatgagtggtggaggtggccgtgggaaacccacagaggacgttcagaggcttctgcagacacaggtgtttgggctcaggagtggccgaggggtcagctggcatggtaatctgaggggcgggcatgtgtggggtgaggagagggctcccacactgtaggcacagaggaggggctgcaggggttctgggaggagggccagggtgccacagccgcctgtccagggtcctgacggcatggtctgcagggttcctccctgcacgtgggcagtgacttgctcaagttcatggagccggtgaccatgcaggaatctgggaccttcgcctttcggaccccaaaggtacggctccagggcaggccggctcggctgctggaccccagggccccgggtggggtggggggtcaccttcaggactgtgaggggaggggcagcagggagaccccagggaccagagcccagccaggggctcgccatgccctgtgctgctggggaagccccctctgccctctgcctccctggggacagagtggcacagagcagcgtccatggggttcccgaacttccgacacctgaaggcctcccctgctgcccttggctgggaagggacccggtggccacagggaggctgcccttgtgacccccgccccacgcccctctgtgggggcaggaagtgcagtgtgcccctgcgtgtcccccagctgtcccacgatgccaacgagacgctgcccctgcacctctacgtcaagtcttacggcaagaatatcgacagcaagctccatggtgggggccacgggcgcagtggggggcgggcaggggacgggtgggcacaaggcggtgggtggggggacaggtgggcgcagtggggagcaggtcgggggcgggcaggcacggggtgaccactgacggcagctctccccgcagtgaccctctacaactgctcctttggccgcagcgactgcagcctgtgccgggccgctaaccccgactacaggtgtgcgtggtgcgggggccagagcaggtgcgtgtatgaggccctgtgcaacaccacctccgagtgcccgccgcccgtcatcaccagggtgagcccctcgaagcctggcctacaccttccctcgtccctggcatgagcccctccctgctcacccggctctgtggtttcagatccagcctgagacgggccccctgggtgggggcatccgcatcaccatcctggggtccaatttgggcgtccaagcaggggacatccagaggatctctgtggccggccggaactgctcctttcagccggaacgttactccgtgtccacccggtgagtggacggccctggtctgggccctgtcagctgggtcagtacccacgctggggttccgggtgactgggtgggtggggaggctgagggggtgagggtgtcagggtgtggggtgggtcggggagtgcctgggccacactgcctgtcgcccgccaggatcgtgtgtgtgatcgaggctgcggagacgcctttcacggggggtgtcgaggtggacgtcttcgggaaactgggccgttcgcctcccaatgtccagttcaccttccaagtaagcacccggcctcggggacctgccgaacccgggaggaccgggaggaggggctctgcccgccgcctccccacgacagttaccatccagcccaggaccgagggcgtcctgtgccccgtcctcacccgagtgcccctgcggctctttcagcagcccaagcctctcagtgtggagccgcagcagggaccgcaggcgggcggcaccacactgaccatccacggcacccacctggacacgggctcccaggaggacgtgcgggtgaccctcaacggcgtcccgtgtaaagtgtgggtgtcaccgccagctgctgagtctggttggccctggccctgggtatggaggggggcacttactgagacctgagtggccctgaggggatggcggggccagcctggtcgggctggggctggtcccgggggaggggttgatgcagaccagcaccctccctcccccaggacgaagtttggggcgcagctccagtgtgtcactggcccccaggcgacacggggccagatgcttctggaggtctcctacggggggtcccccgtgcccaaccccggcatcttcttcacctaccgcgaaaaccccgtactgcgagccttcgagccgctacgaagctttgccaggtgaggctggtgtccccccgcccccctctgctccccacacccagctgcctcctcagtgcccttggctgactgtgctgaaaggaatgtggtggggctggtctgtgcagcgggaggcggcctccggaaaaccccactgcactccagatccacttcctcctagaaacccagatgggcacaccagaggctccacgctcaccaggccccgtgtgccccccgcccacttgcggcacagtctcgtgctcagcacgtcccaccgcgttgcccctttgcccaccgagacccacacatgcacctggaagccccgtgtggtcagggccagggtgggcggggacgggagggcggaggctgcagggaccacccctgccagccgagcccacgaaggcactgccctccgcagtggtggccgcagcatcaacgtcacgggtcagggcttcagcctgatccagaggtttgccatggtggtcatcgcggagcccctgcagtcctggcagccgccgcgggaggctgaatccctgcagcccatgacggtcagtcctggcgtgggctcagctctggcaccggcccatgggatcgtgcccaggaagggcggggtctgcgcccgggggctgacagctgggacttgcctgcaggtggtgggtacagactacgtgttccacaatgacaccaaggtcgtcttcctgtccccggctgtgcctgaggagccagaggcctacaacctcacggtgctgatcgagatggacgggcaccgtgccctgctcagaacagaggccggggccttcgagtacgtgcctgaccccacctttgagaacttcacaggtggcgtcaagaagcaggtcaacaagctcatccacgcccgggtgaggacggtgcagccccgggtgtctgggtcctgctcgggtctgggctgagagctggtccacctgtccctggttccctcctcctcaccccgaccactgccgcctccccagggcaccaatctgaacaaggcgatgacgctgcaggaggccgaggccttcgtgggtgccgagcgctgcaccatgaagacgctgacggagaccgacctgtactgtgagcccccggaggtgcagcccccgcccaagcggcggcagaaacgagacaccacacacaacctgcccgagttcattgtgcgtgagcggggactggcggggggtgcccccacgggaccgcgctgaacccggccccccacacaggtgaagttcggctctcgcgagtgggtgctgggccgcgtggagtacgacacacgggtgagcgacgtgccgctcagcctcatcttgccgctggtcatcgtgcccatggtggtcgtcatcgcggtgtctgtctactgctactggtgagcccgccccccggctgtgccaacaccctgagccctcggccctcccgcctcggcccctctggcctcatccgccgccctgcacaggcaggcgtgtagatccacctcctcatccgggcagctgagcggccagccccggcagaacc

SEQ ID NO: 104295 - DNA, 1050 bp, Homo sapiens
cccaggagtcagccccaggggaggcccagcctggccctcggccctgcggccgccaccttgacacctccccctctgctgtctgcagaccacgtggccgtgaccatccagctcctccttagacgaggcaacatcttcctcacgtcctaccagtaccccttctacgactgccgccaggccatgagcctggaggagaacctgccgtgagtgtcttgtgcccatcgaccccaccctgcccgtccaccccagccctgctcacgatcccctctggatgcaggtgcatctcctgcgtgagcaaccgctggacctgccagtgggacctgcgctaccacgagtgccgggaggcttcgcccaaccctgaggacggcatcgtccgtgcccacatggtgaggggcctcggggcctcaggggactgttcagggcatggctgctccgctgtgcccaggcagcacctgaccagccttactctcccaggaggacagctgtccccagttcctgggacccagccccctggtgatccccatgaaccacgagacagatgtgaacttccagggcaagaacctggacaccgtgaaggtgcggagggaggggtgccggctggtgacaggcaggctcaggtgcggagggaggggtgccggccggtgacaggcaggctcaggtacggagggaggggtgccggccggtgacaggcaggctcaggtgcggagggaggggtgccggctgtgacaggcaggctcaggtgcggagggaggggtgccggccggtgacaggcaggctcaggtgcggagggaggggtgccggctgtgacaggcaggctcaggtgcggagggaggggtgccggccggtgacaggcaggctcaggtgcggagggaggggtgccggccggtgacaggcaggctcaggtacggagggagggggtgccggttggtgacaggcaggctcaggtgcggagggagggggtgccggccggtgacaggcaggctcaggtgcggagggaggggtgccggccggtgacaggcaggctcaggtgcggagggaggggtgccggccggt

SEQ ID NO: 104296 - DNA, 1878 bp, Homo sapiens
ccgtgtccttcacctctgccccatgggtgagccacctgttccaacgtccaggggtctgtctgtcagcctgagcctgtgcgctggggccggtgcgtcccgaccacctggagctccttggggtcacaggtcagggggcatgaatgtgagcacttgagagcctttctgggggcgtcaactccttgcctcggggataggcctgccggtgttttcagcacctccgggagggatcctgtagcaggcgatggcagtgccttggccccagtggtcagtcagggtggacttgaggagggctgagaagtggtctccggcgagacctcgaggatggcgggggtgtgaagcaggaaggggcggagctccaggttcctcagttcgtggagtggcgtgaccctctctcccatgttctgacgtttggggcagggactggagagggatttgatcgggggtcctctgggtcggggctcccctgacccttctctcttcccacagggtgcggggggcaatggcactgcagctctgggccctgaccctgctgggcctgctgggcgcaggtgccagcctgaggccccgcaagctggacttcttccgcagcgagaaagagctgaaccacctggctgtggatgaggcctcaggcgtggtgtacctgggggcggtgaatgccctctaccagctggatgcgaagctgcagctggagcagcaggtggccacgggcccggccctggacaacaagaagtgcacgccgcccatcgaggccagccagtgccatgaggctgagatgactgacaatgtcaaccagctgctgctgctcgaccctcccaggaagcgcctggtggagtgcggcagcctcttcaagggcatctgcgctctgcgcgccctgagcaacatctccctccgcctgttctacgaggacggcagcggggagaagtctttcgtggccagcaatgatgagggcgtggccacagtggggctggtgagctccacgggtcctggtggtgaccgcgtgctgtttgtgggcaaaggcaatgggccacacgacaacggcatcatcgtgagcactcggctgttggaccggactgacagcagggaggcctttgaagcctacacggaccacgccacctacaaggccggctacctgtccaccaacacacagcagttcgtggcggccttcgaggacggcccctacgtcttctttgtcttcaaccagcaggacaagcacccggcccggaaccgcacgctgctggcacgcatgtgcagagaagaccccaactactactcctacctggagatggacctgcagtgccgggaccccgacatccacgccgctgcctttggcacctgcctggccgcctccgtggctgcgcctggctctggcagggtgctatatgctgtcttcagcagagacagccggagcagtggggggcccggtgcgggcctctgcctgttcccgctggacaaggtgcacgccaagatggaggccaaccgcaacgcctgttacacaggcacccgggaggcccgtgacatcttctacaagcccttccacggcgatatccagtgcggcggccacgcgccggtatgggcctcagtgtgttctcgcagggcccggactgcaggcgtccgttcgtgggtttgcgtgtcccagcctgctggggagggtgcacgtgagcagtgtggccgtggctctcgccagcctgggcgcttgcgtgggtgggtgccgcatctctcaatgccattcacgctggcgccagtcccaggcctgtgtcgggcactggggaacacaacagtgagcacggtggggctccctgccatgtgggttctgttctcggggacgtgtgtaggacgtgtgccggagggaagggaagggcctgtcccgagtcttggagc

SEQ ID NO: 104297 - DNA, 1097 bp, Homo sapiens
tggaggtgggagaagccagaggccgggcagaggaggtagacttgggccaggaagggccccagactgagggtggagggatcatggtgttattctctgggaggggaaatccatggccgttctccacggtgagggccagggaagaggacggcagaaagcctcctccaggagagtggagtatgggtcttgcctctggcttcctgagtggatcgatcactcaggggaggttgttcgagggcgtgcgggatgggcgggacagaagccagcctcccctgaccttggctgcccccgcccacgcctggggcctgggcccgtggaggctggagcctgggggtgtgctgcagggagtgggcatggggcacacaggccggtgtggcgtcccttcaagatggcaggtctgggggtaccgtgccaccgccatggctgccacctccgtcgggagctgcagtctccagtccccgcgggtcccagctttctcaggagacccggtgctgccctgtgctttggctcctgagtttgccagaggagcagccttttgcccttttcacaaaggtgctgttgagtctcaggtcgaaaggatgccctctgccccccgaaacctcatcctctccccagccctttggccgggttaacccttacctgtgcagcagggtagcacagtccatgcacagctgtggagctcacctcccttcccgccgcccccctgctggtgtcactgcatgtccaaccccgggtcccgctgcacagggcacatgaggatcccggtggggtgggaggagagtggggcctggccctgcgggaggaggtgctttgctggcacacaacctggccaggctgcagtggactctggggcctgagcaggattcagtagctgaaccttggttgtaggggtggctattgagggcctggagagtcacatcttgaggcagagtggagcctaccttcttttctttctttcttttcttttcctttttttttttttttttttttttgagacagagtcttgctctttccccaggctggagtgcaatggtgtgatctcagctctctgcagcctcaggtgatccgcccgcctcagcctcccaaagtgctgggattac

SEQ ID NO: 104298 - DNA, 1064 bp, Homo sapiens
cagattgggccccctgtcagattggcgtctgggggcactgtctgctccttccaggcagctttgaggacttctcagaggaggaacccccctgccctgctggtccaaagtggggtgctgaaggccgaggcagtttccagggggctatgcctcaggctgcgtgggtggctgtggtaggagcgtgctctgtgattgtcactgcatttgcctggggtccatgctctgtcctcagctggggtctggctttgaacctaggtgagttctggggctctgaggacaggccagaagcaggagtgtgggggggtctctcctgggggaagcaagggaggcctgggcctgtgtgactcagacgtggtagggtggcatgggagccacagcttggggggatggcggggggcttgagggtaatccaagtatttcagggacccagccatggagagtggggtttgaggaccagcaggaggtgaggactctgtggatcccagccctgtcaggtgtgttttcagagctggggcctgctttggaggagatggagggcacagaacactgctgagcccaggccctgtgcccagccttgctccagccttaccggcttgacaccagggcctccctcccaccagcgagggggagaagctattttaagtggagccagcagttgacaggggcaaggggcaggtggtgggagggaggtgctccagcatggcccccccgactccctctcagcctcagagattggccaggggagctgaggggcttggcctccccactcctatgttggcaccgagcctgatctggtgaccaccctgagggacttcaggagaaaaggatgttagggaggagggcgtgaaggtggggcgccccaggcaggccgcccaggcccagcaaagctcgctggagggtcccccagttccacatctagacctggggcccagtggctctcgaccaggccctgtggggtttgaagtcctcagctccaccatgagcagagcaagcctccgcgtggagcaaggggctggacctggcctccaggggcacccacctccccacacagctccagccacgggcat

SEQ ID NO: 104299 - DNA, 1015 bp, Homo sapiens
gcgccgagcggagatggtctcgcggtgcgggcgctccgggccggccccaggctcagcggcacaggagcctggatttgcccgagctcccgggggccgtccccgcaccccctggggcctgcttggcgcggggggaccagggcggagagcacccgcacctggcgagaccccactgcctgggcctcctcgcggttcccagagtggcgtctgggtggacaccccgagacacagaaagtctcagaagcgggggcgcgagccctgcctgtcccctgctgaccctgcccctccgcaccctgctcctgcaggaagcccctgccctgccagcgcccctggtcgggctattcggcagatctggggagcccgcctccccctgtcatctgggggtctcagagcccggacgccctggggcttcctgccaggcccttgatttctcttcccgaagctccctgggaaaggaagaaaggggtccgtctgcccactgtgggctgtggcagagtcaggacagggggtgagggtgagggtgagggtgagggtgagggtgagggtgagggtgagggtgggccccaaacccggcagatcccggcggcctggagggctccctgtgccccaccttccctggacccccccgccctccccacttaatgtctgacttcggcccttgcttggaggttcggcgcagcctgtgaggctttaaagttgagcttcctcaggagccctttgcgggtgggagagcgaggctgccgggaagtgggggctctcagcctgccccatgcccagatgaccctggcacggaacagctgaacagctggtgggaggagccctccctttcctgtccagaggtgagggtctcccggagggcagggccagcaggcataggtttgtggcgagtcagctttttgcatgttgcatagaaatccccagagccgactgagaagcaagcaggtgggcctggcacatctgagtcctcccacggtacctatggggggcccacctctgtcccggggggtctgggaggcct

SEQ ID NO: 104300 - DNA, 1067 bp, Homo sapiens
ggtagggttgccgtgatgtggattgtggttcaaggcccaagggaagattttggacaggaacaaggcctggctgcttgagggtgggagaaggcagagactgaaagaactaagtcaggctgggggagtttgtcaggatgtggcggggcggatcccgggtgggggaagcagaggaggaggggatgcctggctggggacaggaggaagctgaccagctgcaaggacggggcaggtctgggtggaaggcgggccccagggaggggtgacccagggtgggggcaagagcttggggaatgcttctgtctcctgctcagcacatccagttccgggagggcagtggaggcgtgctccaaggtctggccctgcagacggttcaccacctcttctcaagcccaggggacactaggagcactgaggccaggacttgggacctgggatgccagaagtggggccagctctgtcccagaaaccagaacccccagaaagaggtctcggcccgcccacctcctggccctgaaggaccaggtggggtcccgggtgcagcatcccaaggtgctgctggaggccagggatgtgctgggaggccatctccaggtcccagtttaccctgggaggttgagggcctgagacccctgggaaagggccaaagcccagcagcccccacccctgaaggccgcaggggagcgactggtatgcttccagtctgggagtgagagtctggtgcccacacatctcaagactggcagggaccctcacgttcctctggccaggcgagagtgcactcataatgccctcccctggtaccaagccatggcctcccctcagacctgcggggttcctgtgggggtgctcaggccatggggcctctgtgggcgctcgtgcttcctggacggcggcatggtgggcagggtgctgccctggctgaacctgggtctgaactggggtgcctgaacctaccagacaatgctgtggccgctgggcaggggagaagtggggggcgcggggagcgcaggcccagcccctcccctcccgtcccctcccctcctctccggttctcttctgccctctcc

SEQ ID NO: 104301 - DNA, 1306 bp, Homo sapiens
ctgggtgaacggtgggagagcggggccagagccaggagtctcagcccctgcctgacctccccgaccttcctgcccggccccaggtgcttccggcctgtgctgactcatatgcagacactgtgggagctcatgctcctcggggagcccctgctagtcctggcaccctcgcccgacgtgtcctcggagatggtgctggccttgaccaggtatcgccttggcccggtcccggctggggaagctggaccatcgcggctgtgcctgggctgcccctgcctcacctgctccctgctgcctctgcccacagctgcctgcagcccctcaggttctgctgcgacttccgtccctacttcaccatccatgacagcgagttcaaggagttcaccacacgcacgcaggccccgtaagtgccgcctctgccccgcctcttgcccttgctccgccctgcctctcgcccttcctgcacctccctggacctctgtctctgcctcttctctctctctgtctgtctagaccaaacgtggtcctgggagtcacaaaccctttctttatcaaaacactccagcactggccccacatcctccgagtcggggagcccaagatgtcaggtcaggctcccggtgaggtgcagggggtgctgctcagaagcctcgttgagtgtggggccgcctcagagcccgtggggatggccagagctgcgggcactgaggcctggccaccgggcgtgtctcgtaggagacctgcctaagcaagtcaagctgaaaaagccttcaaggttgaagaccctggacaccaagccaggtctgtgctcccctcgacctggagcccctccaccgtggagaggcctgtcttgtacctggcgggtctctcgggtggggcagccaggcccccagacccctgatcctcttccaggactcagcagcagagctcagaacccttggggaggggtcgctctcttctcttcagtgggtctcggtgtctggggggtgggtgggtgagattttcaggtgcagccaagggcatggggctgcaggcagatgagacccccaccctggctcctctgtggggctgcaggagtgtgggagggaggcccttgaagggtggggcgccagctgtgccctcccgccaggcctctacaccgcttacacggcccacctccaccgcgacaaggcgctgctcaaacggctgctcaaggtatatggtttgtggggcaggggctggggacgcagggagcctggtgtggtgtgaagcgcagcaagggcctggccctctctcccctgcagggcgtgcagaagaagcggccgtcaga

SEQ ID NO: 104302 - DNA, 1064 bp, Homo sapiens
taagtttccctcataagtgtctccctcatcctgcctgttgtggcccttccgctctttgctatcggcctctgtgttagtgcctgtcagatcctccccatcagttctcccctgttgtcagttcctgtcccctttcatgctacctccttcatcccttatctgttagggacccattagtaccctgccctgctgttagtgaccccacctgtcagtgtctccccactgcttctctcctgcctgtcagtgggagaactttcagtgcccgctgtcatcacccctcttgtccaatcactgattcccctttccattatttcctaaccctttccaacactactcgtcttttcctgtcgcgctccccatcacggcttgagatatcaccagtcatctaacctcaccttaccccgcactgccctgttgcttccatccccatcatctcttccttcagcctgtcaccttcccccatgcaccgtactgtcccccgacctgccactctgtgtactcgcagcttccctacctgctttgtccactctcttgttactgactcctcccaatttgctgctcattccctgacctgtcagcaccagctcccccaagtctgtcacttccatttagtccctgcctttcactgcagccccctctttgtcactgtacccactgattttgttctagacccttctcctgtgtcttgttctttcatccacccttccctcatggcctctctctgccctgctcttggcttctccttgcccctgcagttgccgacactgttcactgttcactgaaagaggctcttcacctctttttgatgtccctttttctggtttatcttccctttgtttttattttttactttaaaatgttgtgggtacacaataggtgtatatatctctcccctttgacttttctaactcacttcagttaatctttggaatgtgagaggcagctagctttgagacaaattgggggacagagtctcccatgctgagaggacagcacatgcaaaggccctgaagtgggaaattttgggtgtgatatcctccaggaacctagataagactgatgtgctt

SEQ ID NO: 104303 - DNA, 1044 bp, Homo sapiens
tctgtggtcagccttttgtttttctaagtaaaaaattagataagataaattccatctactattactataatttttaaaatgtttcatgtaacattgaaaagatttgtaatctcacagtaaagttttaactttgtgaaagatgtaggctttatgttttcactttctatcagaatagtgaaaactttgttgctaaccagccctggcctgcagaatgacatgtgagacactaggaaggactgtccagacaaagacagcaagagctgggatgtttgggaagcagaggaggggctggatcagtggtgattcctcaggtgcctatggcaagacctagtgcccagttggtgtatgtgtgaggaggtgcctgcttcagagagaaccctgggtgtgattcagcaagatggggacgatgagtggatgggccgggtggctgggggaggcagaggagtgagcgcagggtcaggcagcatcagctgtcttgattttgacttgctgagtttgctcacaaatgtgagactttcagaggggagatgtccagtgttcactcaggacagaagacatccctgacacatgggagagacacctgggcgcattcgcctaacagaactacagagcaagcaagagcattgaggggcatgtcgagcacgctggtgggtgggggacagtgtggggaaggagggcaaaggagggggttagcccagaggagaacctggggaggcaggtcctggagctgggggtgcagcctcagagctgttgagcagctgggaagtctgctaactttgtgagcccaacctggagaggtctgatgggaatggttactggggagggcccccaccatcctgagctctgggaatcttgtgtgttcatgctgcagatggacttccaggacttgggtctagtgttgctgagggtggatctgcagaggtgagagaaatgacccctttggacttgggtctagtgttgctgaaggtggatttgcaagggtgagagacgtgacccctttgccctcgtttgcagctctgcggccgtcacgatgttctggaagtt

SEQ ID NO: 104304 - DNA, 1664 bp, Homo sapiens
cttggatccgccgtctgagcagcccactgcgtctgtgatgggtgctgtgcccccccatggcctcacgcttagctgtctacaccttgttggcactggtcatcagccagctgcaggatgcctctttttcttttctaaaacctcagtcttctttccccttcaaccgctcatgggttttggtcagcagctggcgtcttgtgcactctgtgctccctggatgtgtgttctaggcctggggctgccagtgatggccatcagctcagctcagctctgtctataccattcgtttctgttggaaaaacccgaaccagtaggtattggatggcagctgctcacggcagcctgtgctgccccacctgggacagctgtgtcctgtcggtgcagagccacaggggtccctgtgcagtggcccccccccccccccccccgcccagaccctcacatacaccactgcctggtaggactctgcctgtcccttgagggggctttcttacaatcttgtctgggtctttccgttatttctgcttaatataattactagttcaactttcccatgagagtttttggaggaggtgtctcagggttgtcagggtcggccccgcctgcctctcaggtgtgtgtgatttcaggtgattacgtttttgaagaagaaggacaagttcatcagcctggtgttgaagcacatcggcacctcagcgcttatggacctgctgctgcgcctggtcagctgtgtggagccagccgggctccggcaggacgtcctgcacgtgagtgcgggagtccccccccgttcccgagggcaggggtgctgcaggaagccagctggttaagtgcaggagctcagagcaccagggcgcccggcccccatctctccacctagcgtgcatttctccgtggggctgttaggggttcttgtcaaggattgtggcctgtaccttttccactgtcccgacttaactcgctcagaagcacagagcagagaggtcccttctccccgcagtctccagcctccggctctgtgaagaggccgaaatggactttcctcgcctgcctccttttcccctgccagcgcccacccctgtggcttagagcaggaggtcagtgaggtgctagccctgcgtccaggcctgtgcctgccaggagagccccggtggacagcagttccctgcagagccccgttgtttaccctggagtgtggatgcgtctgttctgatggtgtttagtcagtgagaacaggtgctacagttcccgaaaagaggaggatgccccccagataagcccaggaaatccgtgctgacaaacttctgctcactgttcggccagctttgtttgtggtgaagtttaaaatagagtagagtaaaccctgaggcgctctgcctgtttcccagctcctggaatcaggactcatccgatgaccactctcactcttaggttagtaatgcttcctcagggaggagcttctcaccaggaatgactgaccgccaccaacctttacacagtggacacaggatcagtactagctgtggtcatagccgttagtgggaagcctgcagaactgtacgtcaggcagccttttagctgctttacttgattcacttcacgaagtagccacggggggacagctcatcccatttttggataaggaatttaggcacagggcgcagcag

SEQ ID NO: 104305 - DNA, 1049 bp, Homo sapiens
ggcaatggagagacggggagaaggcccaggggaagacaggggtcagggggcaattccaggagttggaggagaagggagagggtccttttctcgggcttcatctttagggcgctcagcagtatgagccccgaaccgcaccctcctctggtgtttggtgaggaccgcggaggctggggctgtgcgtgcgcagcagtcagggcctgcaaagtccacacagacgtggccgccagccagccctgcccagtccagggatgggtggaggggtgcgtgccgccttcagaccctgactcacgctgtccccctgccccgccccccagctgttccagaagtgctgcctggtgcagaggatcctggaggcctgggaagccaacgaccacacgcagtaagagccgctcggacgtggagggacccagcctggccagtcagggatgcagagacgcacctcacccaagccctggtgacgctgcgtgcaggactgcaggatcgggtggagtgtagggtgtgcgacgtggctccacgttctggggctgctgtgcaaggggcccttctactgggcggacagctgcaaatgctacttggggaggggacacagggagccgacaggaagcggtcccgtccccaccaggcacctgctctggcccccgcccagcctggctttgccctcttgtgggtccgctgtccgttcctgatcttccccaggaactcgggccctccgtcagcactcgcacacagggacgcgttattttggtctttccatcttctgcttaatgggtgctccctctggtcaggacacatgtcccgcttattgtcgtgggcccagagccatccccacccgtttgctgtcctgctgggaactgtctggctctgggcgatatgaggagggactccagggagctgggaggggtctgagtgcagctgtggggaagcagaggccgagctgggctgtacagcatggaggtcccgcccaaccctccccttggggtgctgagcctgagcttggtagctggcagcatgggctcacctcctgcgccactgctgccaccagcggg

SEQ ID NO: 104306 - DNA, 1044 bp, Homo sapiens
atgcggtcactgcagcaggcctcaaacagagctgcgctgggctgcagagtaaaacgccaaggtgagtttccagagggtctgggggagacaggagccgctctccccatagagctcccagaggggcttagttcgggatgtgggagccccgggctggaggggaggacggggaggggcaaggaaagcgactgttccgagctccacagaggggcctctcccagccccaccgcacaggcccatgacagaccgagccatgggcatggcctgagctgcctgggaaaagggtggcggcaccccacacagcccggcttgctcacactgtcctcgtcagcgtcgatgttgaagttgatctctgcgatcctgtcaaacggggcactgcaagagcaagggggatggcttcagcgttcctccaggcccactgctcatctggggcctcagtgctcctcccccggtgctcatcgggggcctcagcaccctcacacaactgggaacacctgctgtctcccggggacatcagacggcactcccggcaagacctcagggagctgcctccacgggagctcagcagcagggagagccgcgcctcgtgcagagtgcgctccaagtagactcacttgatgttgtcgtcctggtcggcaaactcctcatcattgaagccaaactgatccacgaagttggctgtcatctgctggatctggtagtcagagaaggcctgggagggagggagggagggagggacggacagacaccggtcatggaggaggcatcaggcctggaggctgctctttgggaaccacaatctctctagttgttcgggagcttctcctccagcacaagtgggcagtaaactctgttcagggctcacgattctaccaaaactcaggctgcgcgctcgctgcggtcacatctgagatacgccccatattctctgactttcgagtccatctgccgtgtcctcagtgctctcatcaaggtggagtgactttggggttctcccttcagacccaccccgccccatacgtgctcggagacgagcccccgctcccc

SEQ ID NO: 104307 - DNA, 1107 bp, Homo sapiens
tgaggtgcccctctgtcctccagcagggcacgagtgacctgagaggcccactcaggcagaagagacgcaagctgggccgtccaactggtttcaactgccagctttaccaatgcagcatttattttaaaattaaattaaattaaaaaaaaaaaagattgcatcaccaggtagttttctcgattaaggaggcagcctgaccagggtgggccgtggccgggcggcagcagcatcacactgggccatttaaggcagctccttctggcggggcatctgtcttcctgcaggaatggggtggggttggaaccgtgcgggctgcgggccctgtccacaccccctacccccacactcaacctgctcacccgtcctttgtcactgtccccagggtggccaccatggctggggctgctgtgactgccatgatgggccctagggggaccgccacggccagtgcagaagagactgctggggtgggtatggcggggccagccttgctcagtgctgtggtgatggccacagtagcctcggggggcacagccacggctggggcagcagtcacttcctttggcgcggggcaggcagggcttaacagccggctgtcagcacacccgaccctgtgtggcaaacatggactccggttacgggcacccccaccctcagtgccaccccgcctcatgcccaaggaccagctggacaaaaaggtccaggcggcctgggagcaccatctttggcccctctcactcctgccctttgtggggtggcccaggttgtgcccagctaggcagctctgctgccccaagttccaagtactgggacaagctgcctgtccattgatgacctcaaacctcctccaggcagcactcagatcctgctcatcatcaagcgcctcattcttcaaggaccccagagcctcctgtgctatgatctcaacttcagcctcacactggacacagtctggggaaacctcccaggggatgggagggtagagaggaccctgccgggcatctaaggggcttgctctggagggggtcgggcaccccaaggcccagcctggccacgagcagcagacgggccccctggcttcctgcagggcgacgacactgtgtctga

SEQ ID NO: 104308 - DNA, 1048 bp, Homo sapiens
tatgaggagaagggggaacgcaggggccaggtgccgtgcaggtctgtgtgggagtatgtggaccggctgagcaagaggacgcctgtgttccacaattacatgtatgcgcccgaggacgcagaggtaagctggggcctgggtcgggtaggcggctcctgcccgacccaggtcctcaaccacaggcccaccctcaggtcctgcggccctacagcaacgtgtccaacctgaaggtgtgggacttctacactgaggagacgctggccgagggccctccctatgactgggaactggcccaggggccccctgaacccccagaggaagaacggtctgatggaggcgctccccagagcaggcgccgcgtggtgtggccctgttacgacagctgcccgcgggcccagcctgacgccatctcacgcctgctggaggtgcgtgtgatcccagagcagggtctggcctggcacccccctcctctcgctcagacaccagggtcgtgcgtgtgtgtgtacactcgtacatgcacgtaagtccggttacccctgggggttggtgtggccctgccgtctccccaccatgtgaactgcctactggcctggggtggctgtggctccccagggccccgcaccactcagtgggtgcttccagacagtgacaggagggccgtcatcagagaccctcaggtctcagtacacagcctccactctgagcacgtgtgttttccctgacctggctttgagcagctcaggcacctgttgaggagtcagcccttagagacgacagtgttttactccctctgccagaccgcctgccccacctaacgtgagcagctctgggttcttgccctgagagcttggggttgacattgaggcctctcttacccctcactgtgccatccctggtgggcctggactgaacaaggcagagatgcctgggagggagaaaggagactgcgattgggtggtggctgggttggtgtgtaaggcctgaggcagtgtcctgcgcgtggtgctaccttttggggccatcccggagtctctgtgggactgagcag

SEQ ID NO: 104309 - DNA, 1031 bp, Homo sapiens
ccgccaccgcgcccggctgatttttttgtattgtatttttagtagagacagggttttaccgtgttagccaggatgatctcgatctcctgacctggtgatccgcccgcctcggcctcccaaagtgctgggattacaggcgtgagccactgcgcctggccagctctgacctttttacaaggatacactgggccctggttggcgtccaaagcaggctggtgctgcgtcctcactgtgagctgggcgcctgcagtgtggcagccgtcagaggacacagggcgtgttgggctggcattgtgcttggcctgtagtgaccacttggtggacgaggggacattgcctctctcagtcccaccctcgggccttgcagaagcaggtgagcctgggcagggccaggcgcccagagaccctctgtggaccccaggcatctcccagccctttgggctgccagtcctccctgtgccttcaggccacgtcgtctggaccgtaaacctcagcctgggactcagatctgcctgtgtcctggactgagctgctctccgtccttttggactgggctcaggctctgagcccaccctctcccctcttcgggaagcctccaggtcgcctcttctccaggccacacctcttgggcacctcctgttgctgtgccctggacagaggcgtctacatgctcatgtgtggagcgttctgagctgtgcccatcacaagccctggccccctgagtggaggacaaagggccaggatgtggagggagggactcagagacagacttgctctaagctggtttgagtgggaagaaaggaagtgttagaggagagcccgggatccccaccgcatagcccttctgctgccacggagtgctctgcggcctgccctgccctggcagagaggcccacaccaggatggctcttcccactttcctgcgatcagggacttggggctgacccctgctgtctccaggctccctgggggcttggtggaaccctctgacctgtaggcacccccaagctgggcacgcccaggcctggggc

SEQ ID NO: 104310 - DNA, 1785 bp, Homo sapiens
gctgactctcgtgggcctcagaaccctgtcccggaacctggtcaagaacgccaagaagaccatcgggcggcagcatgtcactcgcaagaagtacaacccccccagctgggagcaccggggccagccgccccctgaggaccaggaggacgagatctcaggtggaggggtgggggtggagtcctgggtggtctctggatgctgacattggccagggaggatcagggcaggcggagtggccccgtgatgaccacgtgtgcccggcctgtgcagtgtcggaggagctggagcccagcacgctgaccccgtcctcagccctgaagccctccgaccgcatgaccatgagcagcctggtggaaagggcttgctgtcgcgactaccagcgcctcggtctgggcaccctgagcagcagcctgagccgggccaagtctgagcccttccgcatttctccggtcaaccgcatgtatgccatctgccgcaggtgagggccggccagggctggcccgggtggtggacacgtgactgggtgtcttccctgcccgctgtgggcctgggccacggcttctggtcatgtaaggaatgtggagggggagactccgggcagagggacgggccacagggctggggggtggctggggggccccgtggctgagctggaagcgcctcctgctgggagccatgggctggctcctcttgccctgcttggggcgtgagcctggaggcgggtggggtcgccagccaccttcacgcctctgcctcctctcagctacccagggctgctgatcgtgccccagagtgtccaggacaacgccctgcagcgcgtgtcccgctgctaccgccagaaccgcttccccgtggtctgctggcgcagcgggcggtccaaggcggtgctgctgcgctctggaggcctgcatggcaaaggtgtcgtcggcctcttcaaggcccagaacgcaccttctccaggtacctcctgcgtcctgccctgtgcctgccctgccctatctcaccctcccctccctcagctccgtgtcctcccccaggccagtcccaggcggactcgagtagcctggagcaggagaagtacctgcaggctgtggtcagctccatgccccgctacgccgacgcgtcgggacgcaacacgcttagcggcttctcctcagcccacatgggcagtcacggtgagggtgcttgtgggcagacggtggggcaggggcactttggggggccgtggtggcatttatggtttggcaggcaggccagggaggagcagaaacggcgctggtcatggatgtttgggtgtgggatgaggagcatgccctccgggtgccgtggggcaggggcgggaagcctgtccagaccaagtgtgtgcccagaccaggtgtgtgccctgacctcctgcccgccctgacgtcctgcccgctctccacctctgcgtctgctgcagcttcctgtagggtcctccgggtgctgcctctacgcggctctgtcttaccatttcccacagcctggaaacatcccagatgctcctctgtcctgttccctcccagtgtcactgtttttcctcatcccccacactccaccctccctgcatcccccaatccagactgtctttggagcctctggcctggctctgcctgcagcttggcctctgtcctcgtgtgtcctggttccttgggccttgcccgagctggccttgctgtctctgtccccaccgccacgcacacttcacaggcgccctgcacacactgagctagactggccccaggacggggtggcagataggcccca

SEQ ID NO: 104311 - DNA, 2083 bp, Homo sapiens
gaaaggcatttgggtctcctggacacctgctgccctccctgccagggccccgagtgggtcttctctgtgccctcagcccgtgtctcctttccccacccccagctgctcccagccgtgttgagggccctgaaggggcgagctgcccgccgctgcctcgcccaggagctgcacctgcatgtgcagcagaaccgtgcggtcctggaccaccagcagtttgactttgtcgtccgtatgatgaactgctgcctgcaggtgaggcctcttatcctgctagtgacatggctcatggcgcatgagcgggaacaggcgggcagaccctggtctgtgagtgagagtggagagacggtgcaagagactcctgtgccagtgggcaggggtcctcggtctgcagggaacagggtggagagaaccattgttgggggcaggtgctggggcctggggtctcctgatattgagcctctgaggcagccttggggagctggagccaagggtgtcaggtgctggtctgtggtggttatggggtggtgggggcatggtgggaggtgagtgctgcctgggaggggagaggtcctgacggtctctcgctctacctgcaggactgcacttctctggacgagcatggcattgcggcggctctgctgcctctggtcacagccttctgccgggtgagtgctggcatggctgaggtctccttcccagcccccccttcctggtggctgaggtctccttcccagccccccttcctggtggccgaggtctccttcccagccgcccttcctggctgcatccagctgaccttctcccctggctcctgcagaagctgagcccgggggtgacgcagtttgcatacagctgtgtgcaggagcacgtggtgtggagcacgccacagttctgggaggccatgttctatggggatgtgcagactcacatccgggccctctacctggagcccacggaggacctggcccccgcccaggtgcgcagggactccctgggctgggggctgggggctaggggctggggcagcgtggccccggctcatgcgtgtggtgccgtggcaggaggttggggaggcaccttcccaggaggacgagcgctctgccctagacgtggcttctgagcagcggcgcttgtggccaactctgagtcgtgagaagcagcaggagctggtgcagaaggaggagagcacggtgttcagccaggccatccactatgccaaccgcatgagctacctcctcctgcccctggacagcagcaagagccgcctacttcgggagcgtgccgggctgggcgacctggagagcgccagcaacagcctggtcaccaacaggtgaggcagggactgggggttgggcccagtggaggcggggccgtggtgggcagggcccatgcccacagtttcttctctggcccagcatggctggcagtgtggccgagagctatgacacggagagcggcttcgaggatgcagagacctgcgacgtagctggggctgtggtccgcttcatcaaccgctttgtggacaaggtctgcacggagagtggggtcaccagcgaccacctcaaggggctgcatgtcatggtgccaggtacgggggtttgggctggtgattcccccttggatgggtggggctgggcacaaagtgtgagaactgtcttcccccagacattgtccagatgcacatcgagaccctggaggccgtgcagcgggagagccggaggctgccgcccatccagaaggtttgcgggggccgttggggctgcgggggcccaaggcccgggctgcatcctgagctcctgctcttgttttcgagcagcccaagctgctgcggccgcgcctgctgccgggtgaggagtgtgtgctggacggcctgcgcgtctacctgctgccggatgggcgtgaggagggcgcggggggcagtgctgggggaccagcattgctcccagctgagggcgccgtcttcctcaccacgtaccgggtcatcttcacggggatgcccacggaccccctgggtgagcctgcagactctctggccctgtcgccccctctcccccaggtctttgggatggatgggctttccctg

SEQ ID NO: 104312 - DNA, 1755 bp, Homo sapiens
tgcaggcgaggcggcaggggcccagcaaggggctggaacttggcgtctgatcacaggagcccttgagggtgctgagccaggagtgccttgtccagacagtttcagaggagctggtggccctgagtgcagaatggtgggaggggcagaaggatgggagcggggcagcttggggtgggttggggtgtggagaagctcctgggcagcctggggtggggattggcaggactggctctcacctgcactcagctcttctcccaggacaaggagctgcgcgcggtcttcctgcggctgttcgctcagctgctgcagggctatcgctggtgcctgcacgtcgtgcgcatccacccggagcctgtcatccgcttccataaggtggggtgcctggtggctgggcgtggggtaggagataagcgcatggtggagacccctgagggaccgacctccttctgtcatccaggcagccttcctgggccagcgtgggctggtagaggacgatttcctgatgaaggtgctggagggcatggcctttgctggctttgtgtcagagcgtggggtcccataccgccctacggacctgttcgatgaggtgcacctccaccctgccctcccagccccctgccctggctccgcctgaccatggcttacctaacctcctgcttaccccgctagctggtggcccacgaggtggcaaggatgcgggcggatgagaaccacccccagcgtgtcctgcgtcacgtccaggaactggcagagcagctctacaagaacgtacgagggtagcaggacgggagggcgtcgtaccgccttgatccctgggcccctgccccacacctgccgtctccccacaggagaacccgtacccagccgtggcgatgcacaaggtacagaggcccggtgagagcagccacctgcgacgggtgccccgacccttcccccggctggatgagggcaccgtgcagtggatcgtggaccaggctgcagccaagatgcagggtgcacccccagctgtgaaggccgagaggaggaccaccgtgccctcagggccccccatgagtgcgtaatgagggaggggaaggcaggccccgagcgtggcccaggatgggcgtggggtcaggggtccgagtgtgtgtattctgtccccgcagctgccatactggagcggtgcagtgggctgcatgtcaacagcgcccggcggctggaggttgtgcgcaactgcatctcctacgtgtttgaggggaaaatgcttgaggccaagaaggtgagggctgtgcaggctccagccgggccagggcagcgggtttcagaggagacccaggctgcacttcacccttgtgagtgctgacgctgccccagggcctcctctgcctaacagacagctagaggtggctgggctggccggagggtaggtgggctccaggtctcctctcttgacctcagtgaggggtgggtcgggcctgcgcgggagacccagccagggagatgtacttccatttttagaaatcagaaggtttcactattatgtttcgtctgtgtccttccccttaaattgggtaggcccatacacgacctgttctttgtacttgatggaaaacagagcttgctccctccatacgtgacctgttccttgcatcttatggaaacagagctttttgctcctgctgttttgctctctgtggtgctcacttaacgcctctggggtctttcatcatggccagttggagactcttgtttttcattggctgtatggtgtccctt

SEQ ID NO: 104313 - DNA, 2108 bp, Homo sapiens
agttgaaggtaggcagagagaagaggcagagtgggctccacaacaagctggctgtgacgtgtgtgctcactgctggagccacacgtagtgcaggcacctgtttgtgtgtgtcctttgcgcaggacagggtagaaggctggagcccaaggtgcccccccttcccctaagtgaccggaaggagtgataagtggtccactgcagtagggttggaggaccgtggagccctgtacccactaccttctggggttgagctggtcagctgcttgctggccttgcagccccaggcaccccttagaaggacttgttcattcttgaggggaacaaggctatagactgggaccctggtcatgggctgagggcagagccaggtaccagggccggtgggagctgggggaagaagcagaggagtgtggcgtgggggtcacttgtctctgctttgccccttgatagccttgtgacttcgagccagttgtttggctctctgtgcctcagtttcctcatctggggatggagtgagtcatgctaacctcccaggctgccgtgaggatgcagcgaatgcacaggtgtgaagcagtagcacacaggaggccctggaaatgatgagtttctttcattagtgactgagcagcaggtgtgtgaactctctaggcacagacacaacaggcacttctgagtgggtagaggatcctctctgttctgtcaggctaggacttcagggcgggatgcagggtctcttgggttggggattaggattggcggatagcttgtcttggcctggatctggacatcctgtctggagctgctgggtgcagcaccagggtgctgagggtgcatgagtcctgcctgaggcagcatcccagttgctagtggttaccagctggaaacctctcaggaaaggtggggaggggccctgagaaggtaaatgcctgtgctggccgtgaccctttcacctcagagagtgatggtggccagcgctggcccatctgcaggcccctcacctggtgagtcagggatcaccttctgtgctctggggcaggcatcaggactagacagactgcctctgcccggctcttggcctgatcacagcgtggccagtgctgaggtgtctttgagaacaggagacacatttgatctggccctgacctggccatcggccttccatctccagcagctgagtgtgcatctgcctgggaggaggggctggaccccttggatctgagaaaaagacctttcaccctatggcctcgcctctcctcctgactgtgatgtgctggctgcattcttgagccccatctactgtccccacccacgttcctgccctccctctggagcgggttggggctgtttgggatggcctcaactgcctcccagcctccaccctgggagccggaaggggtccaaggccttgggtcagaactgctcaggtctgatgggcaggggaggttgggggggatggctgtggaagctgcaggggccctgcgcatggcctgctgctgcggccgagggagccatgtgcacgttggggttgggtgggtggcgtagcaggaaggtgctgtccttccttcttttctcttttcctatagctgggttccccacaagcagcagagccggccagggctggtcttcgtgcactgtggggagtgtggtggggaaacaggagaggctgccatccttctttgcctccccacagcacacgctggcctgggccagccctccaggcgtcagagcctggcactgatgatggggtgctgccagcagatgacagaacgcgaggtctgtgttcgcctgcccgcccgcccgcctttcaggcctgccgtctgcgtggggctggccgcagggacattggtgcaggagggagtgctctttgaggggctttcaggacagaagccccagtgttgtccttaggtggccccctcagccccatgttcagaggtggaggtggcaaggaaaccttggtgcccagtgccacccagcacaccgtttggattcgtcctgttgccaaggggaggagtggggagggcaccctccctcctgtgtattctgaggtaaaggcagcactctgatgggcaaggagctcagctgctggaggtcactcctatggcaataga

SEQ ID NO: 104314 - DNA, 1573 bp, Homo sapiens
ctacaacttcttcaacctgatgacgctggtgcttaccactgcgctgctggacgaccagcacctggctgctgagcctggccacggcagccgcaagaagacggccacctgtgcgtgtcacttgtccagccccctgccctcccaggggttctcccctccaacacccccacaggactcccactctagctgcaccccagccccctggctggggaccctctgctgacccatgactgtcctgccccacagcctggcccaaggccctgctggccaccctgtcgctgctgctggaactagccgtctacgggcttctggcctatggcactgtgcactactttggcctggaggttgactggcagcagcgcaccatccactccagaaccagtgagtgccgacctgggggggccagagggcaggggcggaccagtcctcacacccccctcctccaccagctttcaccttccaccagttttctcagtggctgaagacactgacgctgcccactgtgtggctgggtgtggcctccctggtctgggagctgctgagtgccctgtggaggtacatggcccaggaagcagggagggggcacaggtgtgcagggccggcctgacgaccttgggtccttgcccacaggtggacccaggtgcggggctggctacggaagctcagtgctgtagtccaactgtcccttgtgggcactgcgaccgtggccttgttcctgattagcctggtgggtagcgctgcagggctgggggatgggctgggggcagggcagccctgagaacctcccacctgtctccaggtgccgtactcctacgtggagcccgggacccacgggcgcctctggaccggggcccaccgcctgtttggtgccgtggagcacctacagctggccaactcctacggcctcttccgccgcatgactgggcttggtggacggcctgaggtggtgctggagggcagttacgacggccaccactggacggtgagccctcccagggcgggcagggtggtggggcccaggtcagcgggcccagctgacctcggcctgcctggcaggagatcgagttcatgtacaagcctgggaacctgagccggccgcccccggttgtggtgccccaccagccacgcctggactggcagatgtggtttgcagccctgggcccacacacgcacagcccgtggttcacaagcctggtcttgcgcctgctgcagggcaaggagccaggtgcggagcgggcttggggggtgtggagtgggctggggtggagcggggtggggaggggaggggcagggcgggtactgtgggggccacgctgatgcctctcgctgcagtgatccgccttgtccagagccaagtggccaggtatcccttccacaagcagccgcccacctacgtccgagcccagcgctacaagtactggttctcccagcctggggagcaggggtaaggctgggcaccgggtggggtgtggagcccggggtgcaggggtaaggccgggcaccggggggtgtggagcccggggtgcaggggtaaggccgggcaccgggggggggtgtggagcccggggtgcagggg

SEQ ID NO: 104315 - DNA, 1457 bp, Homo sapiens
ccgcgactcttccggtgagctcccgctgcgcggcgccggggttcgcctctctggcttttgcccacgttacgtcatagacatgcgcgcgacgccgcgcctacgcattttcctgggcgggaacagcaaaatggcgccagaactagtggcgggctgaggacgccgtacccctcggaaggcagccctgcggtccctttgccgcccgttccctcccggacatggaggacgtggaggcgcgcttcgcccacctcttgcagcccatccgcgacctcaccaagaactgggaggtggacgtggcggcccagctgggcgagtatctggaggaggtaagggcggcgggggagtgacgcggggtgggccggcgggtggggctgcggggcgggggctccgggcccggggctgtgggcgccccaccgtctccacgcctatggctatctggcgctctggccgcgcaggtcctcgggctccctgcttcttttcaaactccatctctgcctccccaaatcatcccttgttggattagcgtggacctgtcattgcaggtttctacccgtcagcgagccgtgaatgattgagtgggtggtgaccagccgtttctctaacgtagtggaatagactagaaagcattattgcttttattgcagttattgcgagcatgcttgtgtgtttgagaggtctggatcacgatgtcagaggaattttttatcttggattttcaaaccaatttcaagctattgccatgctctatcctgttagcgattagtgtttcttccatgtttgacagccctgtctagacctgtgttaagctgtctgctccatatttgcgcttcatttttactcctcagcccagctcagtctggcgtccacgacacttaaatgtttcttgtcttgatcagcagtgatctccattctaccaaatccaagggacataagtcagcatttgttggactggccactcctttctttttgaaacatggtggtaggattttttttccctatttcattgcctgatttttcttttctatccagtctctaagtgttgagttcctcaggatggggcctaggtcatcttctgatgcatttaccctgaagtgtcatttatttctatgattttaaatattgcctgtattaggacaactaccagatctgcagctccatcctagatctttcctccaaatctactttacatatccagctgctctcttgacatctagtgggtgtcacgcaaacatctcatttaacatatttaaagtggaactcttcatttttctgcttaaaccccagcttttcccatctcggaaaatgacaccgctgttcaaccaaaagcaaaagctaaatgtggctatagtgaagccccatgcttaacactcagttcatccatgaattccatcagttataccaccggaatatcacttgaattcatctgttgtccattttatttggtctaggccaccattgtc

SEQ ID NO: 104316 - DNA, 1143 bp, Homo sapiens
tctcctacttcagcctcctcagtagctgggattacaggcgcccgccaccacgcctggctaatttttttgtatttttcagtagagacagggtttcaccatgttagccaggatggtcttggtctcctgacctcgtgatccacccgcctcggcctcccaaaatgctgggattacaggtgtgagccaccgtgcctggccccagctaatttttgtatttttagtagagatggggtttcaccatgttggccaggctggtcttgaactcttgacctcgtgatccgcccacctcatcctttgaaagtgctgggattgcaggtgtgagccactgcgactggccacaagccattcttcaactcatttacctgtttgtggcctgtctccaccctagaatgtgaattctgccagggcagggaccatacttatgccctcttttgtctgcttagtagagtgcctggcacataggtgtggacgttaaagtgtttgttaaatgcacatgtgatctgatgaccaaacttctctgctctcatgcatagttggctgagaaaatacggggaactgtgctgggcagagctcctgtggattcaggttttcacatcaagcagggtccatgaggacacctgttcacttggtaaatctccttcctggcttggtcagctcccttcctgctttcttatgtctgctcttccaaacctctgcagcttgaagtcctgatttcctggtttctagtattatctttttccttctgtcattttccacacactaccatgatgttctttttcttttttttgtcctttgtttttttttttttgttttttttttttagataggttcttgccctgttgcccaggctagagtgcagtggtgcaatcatggctcactgcagcctcgatctcccaggctcaagtgatcctcccatctcccaagtagctgggactgcaggcatgtgccaccgcacctggctaattttttgtatttttggtagagatggggtgtcactgtgttgcccaggctgttctcaaactcccaagctcaagtgatccacctgccttggcctcccagagtgctgggattataggtgtgagccattgcactggccagaatgttcttctagtactgtcatgatcctactctcttttatccatttat

SEQ ID NO: 104317 - DNA, 1077 bp, Homo sapiens
tttgagacggagtctcgctctgtcgcccaggctggagtgcagtggcgcgatctcggctcactgcaagctccgcctcccaggttcatgccattctcctgcctcagcctcccgagtagctgggactacaggcgcccgccaccacgcccagctaattttttgtatttttagtagagacgaggtttcaccgtgttagccaggatggtctcgatctcctgacctcatgatctgcccgcctcggcctcccaaagtgctgggattacaggtgtgagccaccgcacccggccttttttttttttttttttttaaagtgtcatttgctgagaaggaatacaggagatgagccagcgttggggaagatgttgggtaaagtatggaagtaaagtgtttggggacatttgaatgtactctgtggacagctatgaatgcagccccagagctaaggagagagagctggtcgggttgggtttggggctcattggcttatggttggcagcttgggcatgggatgaaggaatgtgcatggcggggggtggagcgcctggcgcactgacgtttaaggggtgacagaggagctggggctccgggaggctgaggggagcagaggaaggatggcgactcacctgtaactgtttcctgagttctctgctcagaggatggagacctcagcattttatctctgcctttcctacccctgaggttcccttttcttctctgtgtcggggatcttcctgctggagtctgtcagcctctggcgccttgtggagggagccgctgtgctgccctggttgtttgtagacagtgtgccctgggggccttccacttccaaaacaggtttttgttataggaagtagggggaaacacagagacctgtctctgccccgaaataccagggacaaccggtgagcccacagcatagctagagctgcccgtctcgggaggtgctgggcagagaccaaagatgggtggggctgccctggaagaagcgagtgcagactgggccttggattccccctgtctttgtgttgtttcttgcagctggatcagatctgcatttcttttgacgaaggcaagaccaca

SEQ ID NO: 104318 - DNA, 1836 bp, Homo sapiens
atgagattcctggtttgatttgagaattatttttggaaccaaaattggtggtttcttgtactggaggtttggtggtggtggccaggcctcgtgggggcaccgatggatagctgggaaggccttgggggtgggcccctcctttctgggtcctcactgcctgcatctggtcaccaggtggaatacctctactcactcgtctaccaggcccttgatttcatctctggaaagaggtgagttctgcagccactcactgtgctgccctgcatgtggccagggaggcccctgcagctcctgggatgcccacgggatgtgcttctctctcaggcgggccaagcagctctcttcggtgcaggaggacagggccaatggggttgccagctccggggtcccccaggaggcagagaatgaggtgagtttctttggcatgtggtccccgcccactgtgtgtttgcctgggctccgcccccacgagctctgtctccctccagttcctgtcgctggatgacttccctgactcccggactaacgtggatctcaagaatgatcagacgcccagtgtgagtcctggcctggcccctcttaggctggggtgaggtcagcactttccctggggctgtgttgagctgatggggtgtgggaaggtgtcattgccccatgtgggtcctgttctccactggagtggaagggtgcctggctcacccacccttggcctccatgcaggaggtcctcatcatccccctcctgcccatggccctggtggcccctgatgaaatggagaagaacaacaatcccctgtacaggtagggatctgagcccagcgacggggagggaggcctgcctgggaagggtctctacagcaggcgtgtttttgccagcacagccgtcagggtgaggtcctggccagccggaaggatttcaggatgaacacgtgcgttccccaccccagaggggccttcatgttggagccagagggcatgtcccccatggaaccagcgggcgtttcccccatgccagggacccagaagggtgagggcttggatgcggggggcttggtgggaaggaagggagggtcttctggttggactcttgtggggtgccctgtgcttgccacctctggtcttgggagctccctgtctctgggtgcctgctctagtctagacaggttggctggtgctcatcccacccatctgctgtgccttgattacaagttaacatggtctcagtgccagagacctggtgcctggctcagggccctgctgtctccccccagcccaaggcctggagtctgctggtctctgccctcctgctggccccttggagaggcttgttgaacaccgggcagggaccatcttggagaggggctgggctgaccttgtctgatccctgtctctcccagacaccgggaggactgaggagcagccaatggaagtttccgtgtgcaggagccctgtcccagcactcggcttctcccaggagccaggtgagaagagagctccccggtgggactggcagggcagccaaagaggggaccagggaggcagcacccagtggacagggctccaaggggctgctctcagctgccagcctcatgccccttctgtggcccatgggagtgaggcctcgccccggggaagcagccacagcccccggtgagcctcagcccatcttggttcactgactgccctctgactgccctcctgggtctcctctctgggcagatgtggatggctgcatttaaagaggaacatttgctaagaaataaaatgaaccaagcagagcacagagcacaggagcacgacgaggatggtgcaaggcacccgccaaatcctctgggct

SEQ ID NO: 104319 - DNA, 1620 bp, Homo sapiens
gggctcaagtgatctacccgccttggcctctcaaagcactgggattataggcgtgagccactgtgtccggtccctgtaggttttttttttttttttggacggagtcttgttcttttgcccaggctggagtgcagtggtgtgatatcggctcactgcaacctctgcctcctgggttcaagcgattctcctgcctcggcctcccgagtaggtgggattacaggtgtgcgccaccacacccggctaattttttttgcatttttagtagaggcgggggtttcaccatgttggccaggctggtctcaaactcttgacctcgggtgatctgcccgccttggcctcccaaagtgctgggattacaggcatgagccaccacgcccgacccttgtagggttcttgatgttaacccaaggtggagttcctggggtacccagagccttgaggggagaaagaggagaagtggggaccctgtgactgtctttgcagagtgctgccctgcccaggaggtacatgctgcgggagcgggagggggccccagagcctgcatcctgcgtgaaggtaggagtgttggggccctgacccccggcagggagggatgggcggattcgaggactggctgcctgcccatcatgctcttgctcctgctggcctgtggtgttcccagcctgtggccctttgcacttgctctcttaaagaccccctcatgcgactctgggctcccaccctctctctagtgttcccctctgtgatccaggatttgagtgtggtcggctctgccccaggctgtcactgcacttgttgcctgggctttgggaaggcggctgtgcaccccctactcctctgggagggtggctgtgtaccccctactcctttgggagggtggctgtgaaccccctactcctcctttgggagggtggctgtgcaccccctactcctcctttgggagcgcggctgtgtaccccctactcttcctttgggagggtggctgtgcatcccctactcctttgggagggacggctgtgcaccccctacttctccagcgccttcttgtgctctgtgcccaggagactccagacccctggcagagcctggacccctttgactccttggagtctaagcccttcaagaaaggtaattgggtggaaggtacctccactcaggtacccctggctgggtttcctggggcatgaggtgggggggtgggagtgggctttgcaccctgatcccccagcggctctaagacagtccctgtttgcccccaggtaggccttactctgtgcccccctgtgtggaggaggctctgggacagaagcgcaagaggaagggcgctgccaagctgcaggacttccaccagtggtacctggctgcctgtgagtgggtgtggtgtgcactccggaccactgggagctgggggctgggccagggccagtggaggaggatcagcacccttttcccaatgctgtgggcagctcttggcctggctggtgctgagcatgttctttcacagatgcagaccatgccgacagcaggcggcttcggcgaaagggtccgtcctttgcaggtgaggctgaagtcctcggggaagacagttttactctccttcccctacctcttcccccacct

SEQ ID NO: 104320 - DNA, 1028 bp, Homo sapiens
gggcctggctggccctgagggctgagaaggagaggctgcagcagcaaaagcgaacagaagccctgcgccaggcagctgtgggccagggcgacttccacctgctggatcacagaggccgggctcgctgcaaggctgacttccggggccagtgggtgctgatgtactttggcttcactcactgccctgacatctgcccagacgagctggagaagctggtgcaggtggtgcggcagctggaagcagagcctggtttgcctccagtgcagcctgtcttcatcactgtggaccccgagcgggacgacgttgaagccatggcccgctacgtccaggacttccacccaagactgttgggtctgaccggctccaccaaacaggttgcccaggctagtcacagttaccgcgtgtactacaatgcaggccccaaggatgaggaccaggactacatcgtggaccactccattgccatctacctgctcaaccctgacggcctcttcacggattactacggccggagcagatcggctgagcagatctcagacagtgtgcggcggcacatggcggctttccgcagtgtcctgtcttgagccactgcagtctgggccccatcattaaacgggctgcgtttaatctgtgtgtgtgtgtgatctgtaccagcggcccagggaggccaggcagccctcttctctgcgcaggtgtacataaaagggtttttagggggaagatgagatggcaacactgctttattaggccgggccagccaggagcagacacacggctcctcagtacacattcccccacccctgcctcggtgctccccactcagggctgggccatggagggggcagcgtaggtctggaagcgcttgtgcgctcgctggtgcgtgagcagtctcagggacatggtgtccacggccatctccagcccgggctgctgggttatctccactgtgtagtcattggcctgcaggggtggcacatcagcagggtctggggaccgtctccccctcccacgtatcccaggctactcac

SEQ ID NO: 104321 - DNA, 1026 bp, Homo sapiens
gctatggagtttcctacatgattgcaggcgagaacacgatcttcttccacatctccagcaagttctcaagctcagagacggtgagtctcctgccacagctcaggcctgaggaaggggtgccacctggggctgcccaggaacacaggtgtctttggctggggaggcatccttgcttgtgggaacagaggggtgggtacatatctgaaggtgcatctgaactcttggctcccacagaacgcccagcgctttggaaaccacatccgcaaagccctgctggacattgctgatcttttccaagttcccaaggcctacagctgaaggttggagaaatgccagctgccctttcgtccccacactgtggaggaagggacctgtggcagctcacaggcatgaggggtggccgtgcacaggtgcccaggctccaaggacagctccggcagcaggtcctcgctgggcagatgctgctccctgagggcccaggtggtggaggtggggttggagcaggaagggaattttgatttttttttttcttgatagatactaataaaaataaggctgtgtaattttctctcagcccttaggtacctgtgttttgtttgggaactcggaggccctccccctcccccagctcagaccacagaggtggcaagagaagggctgaagctggaagactgttcatgagggacttgtgtgacctgctttgaaatgtgtgactctgctgagtgacgtaggctctgagatagctgtccacgcccacgtgtttgcttggaataaatacttgcctcagaaccttcacctgttccctggggccatttctgtttgtctgtctgctggagagtgagcccacctcctcccatgcaggggcatgtgtgaggcacccctcttggctgaggcacaaccctgcacgggccccgcagcttcttgtcagcatggaaaggggctgcaggcccaggcctgaagtcttgaggcgccaggtggtcatgtctgcaagagggcacgcaggatgacctgtagcaacagacactc

SEQ ID NO: 104322 - DNA, 1050 bp, Homo sapiens
catgatggaggggtcccacacagtaagtgtcctctgcccatgtgggggtcacagtcgtcgggtgaggtgccccctctgcctcctgtctgcctggagggccagggctactcttcacccctttacttctgccccgcagaaagcagacctgcgagatctcttccagaaggctgctaagaagcaccagaatatgtaccgcctggccatgaccggggcagggatcgacaggcacctcttctgcctttacttggtctccaagtacctaggagtcagctctcctttccttgctgaggtcagcaccgttgttgggtgtgtcctttgtcccactgccctcctacacgcagggcttgggccatctcatgatggagcacggcctgttttcctggcttgctcccctgaagctccctggagtgctgggccagctttcccgcccacaccccacctgggcctgtggtcctgggactgagcaggagcaacatcctctttgtggtgttggtgtccttgtgacagggaacagacaaatatatgatctgtcaggtggtgacagcactactgagactagtgaggctatgtgggggagaggcagagcagagggagggctgggcagctcacacaagccttatgtggcatgatgcacaggggaccacggggtggtggccagggagctcctgcaccctcagcagaaccgtgtctggctcagagtaggtcgcagacaccacgtgttggacaggtgctttgggtatgtggcctctgaccagctgtggcctccattgcaggtgctctcggaaccctggcgtctctccaccagccagatcccccaatcccagatccgcatgttcgacccagagcagcaccccaatcacctgggcgctggaggtggctttggccctgtgagtgctcctgaagggggtgggtgggcagcaccagggccctgagggtttcagtggcgagtgcaggccctgaggtcagacgagaggcaggagcaccttgcttagaggagagcataaccccagacctgcatggaagcagaatgttagctatggactcaggcag

SEQ ID NO: 104323 - DNA, 1063 bp, Homo sapiens
ccacagtctccccaattcctgactcttggccattgatcgtagttgcattttattcgtcattacctggcagaggcaaagaaaggtgagaccctctcccaagaggagcagagaaaactggaagaagatttgctggtagaagtcagtcggtgaggaaggaggggcagggtggggtagggcagagcagaggaaagagggattggggaagaggcagatttatcaagctgcagggaaggtggctgtggagagtggagttaggacagtgggggagaagttaaaactgtagggattggccaacctgggtgaggggatccaagcagtgctagacatgctcttgaatgcccctccttttcctgccctccccccaggtatgctctggcatcccatttcttctggggtctgtggtccatcctccaggcatccatgtccaccatagaatttggttacttggtaagtgaccctggggatgggaatgctagctggggggctggggagcagcagcagccacactcttccaggaggcctggggagtcccgggtggctgtgggcagcctgaggtggatgtagaatgctggtcccacgtcttctcaccactgtgtggggtgggtttccttccctaggactatgcccagtctcggttccagttctacttccagcagaaggggcagctgaccagtgtccactcctcatcctgactccaccctcccactccttggatttctcctggagcctccagggcaggaccttggagggaggaacaacgagcagaaggccctggcgactgggctgagcccccaagtgaaactgaggttcaggagaccggcctgttcctgagtttgagtaggtccccatggctggcaggccagagccccgtgctgtgtatgtaacacaataaacaagcttcttcttcccaccctgtcctggccctgctgagcagcagcagaaagtaccaaaccgagcagtacacacaaagggactcttcagtgctctgggattgaaagtggttagcgttcatgctgccagttggggtcccccatccctccccagtcccctggctgcagcttag

SEQ ID NO: 104324 - DNA, 1033 bp, Homo sapiens
caaaacaccaaacaaaaaaagaaaaaagaaatgattgccaaggccaggcacggtggctcatgcctgtaatcctagcacttcgggaggctgaggtgagcagattgcctgagctcaggagttcaaaaccagcctggacaacacagtgaaaccctgtctctattaaaatacaaaaaaattagccaggcatggcagcatgcacctgtagtcccagctactcgggaggctgaggcaggagaattgcttgaacccgggaggcagaggttgcagtgagccaagatcgcgccactgcactccagcctgggtgacagagcaagactccatttcaaaagaaaaaaagaaatgattgccggacaagtcacacagtgataggagcaggggtgcagtagtctggcctgaggggtagataggcgaggggtgggaaagaatagcagagccagtgtatcctattctttgggcttcaggtacctaaaacagatccaggacctgcccccaactggcctccctgagatgaacctgctggagatgtacagcctgaaggatgagatgggcaacctcaggtgagggcaggcaggacaaggctaatggtaatggtgtccgcccttccagtagttgctgagggctggtgtcagggcctggcctgttagggtggctctgatcctcctctagtcactcctgctcaggacccatgctcccatacccctgtaggaagttactagagtctaccccatcgccagtcgtcttctgccacaatgacatccaggaaggtaggagaaggcatctgagtctcctaacccaagatggaagagccagagggctctggagtgagcagaacctcaccccattcccccagggaacatcttgctgctctcagagccagaaaatgctgacagcctcatgctggtggacttcgagtacagcagttataactataggtgaggctggaaagatggcttcccatagatctgttcccatagggctcttgaaaacaggccagctgcccagggcatttggggactgaatgtccaccttattc

SEQ ID NO: 104325 - DNA, 1079 bp, Homo sapiens
tctcgcccttgccctgtgcacagaattggccccctccccaggctctgcccacagtgataccactgcagaccctgcctgccacgcctccagctctctgactgctcatgagcccccgctgctctatgacctgtccaaggaccctggtgagaactacaacctgctggggggtgtggccggggccaccccagaggtgctgcaagccctgaaacagcttcagctgctcaaggcccagttagacgcagctgtgaccttcggccccagccaggtggcccggggcgaggaccccgccctgcagatctgctgtcatcctggctgcaccccccgcccagcttgctgccattgcccagatccccatgcctgagggcccctcggctggcctgggcatgtgatggctcctcactgggagcctgtgggggaggctcaggtgtctggagggggtttgtgcctgataacgtaataacaccagtggagacttgcagatgtgacaattcgtccaatcctggggtaatgctgtgtgctggtgccggtcccctgtggtacgaatgaggaaactgaggtgcagagaggttcaggacttgtacaagatcacccagccagaaagaggttgggctgggatttgaaccctggtgtcgtggctctggaagctgccctggcgccttggtgatctgcgtgggtcagtgcacacaggcacacgtcagcctcaaggacatgggcacatctgttcacaggagcagcgccacgtgcctttgagtgccaggaacggggtgggagggtgggagggtgtgagggccagaagactcagaagatgcaaagtgcctgagagagacgggatattcccccagaagaagcattcttagagacacaggcactggacctccttggttcttataagaaacctgtctgaagctgggtgatgagttgcacactccaggtggggctaaggggcctggagcccctgctggctcctaggaaggcacagcagcaggccctgagacggctcctctggggcccctccaccctcccaggcctctgcatttcacctgtgcccacacttctgtctcctgccttcaccttttgac

SEQ ID NO: 104326 - DNA, 1082 bp, Homo sapiens
gctttgcagagcgttcaggccgcgggccatttggggactccctgatggagctggatgcagctgtggggaccctgatgacagccataggggacctggggctgcttgaagagacgctggtcatcttcactgcagacaatgggtatgccagcagggcagctgggtgctccggccctgtcacgggccagggccctggaggccttgcagttcagctgcttgccaagaacatagtgggtgagggggtgccaggagatgctggccacgttgcaggggcccaaggtgtagtcaggagacacagtgcacagagagctggtcttggtaggcctgggaggtgccgggctcatgctgggcacctccgggcaagctttgtgacttagaggtgtggggccactggtcaccctcggtggctcagaggctgtggctccatggctcatgagcgcctcctgtgtcccagacctgagaccatgcgtatgtcccgaggcggctgctccggtctcttgcggtgtggaaagggaacgacctacgagggcggtgtccgagagcctgccttggccttctggccaggtcatatcgctcccggtcagtccgcaggccctctccttggaaccctggccccaccaccccaaccttgatggcgaactgagtgactgaccagcctcctgcccccaggcgtgacccacgagctggccagctccctggacctgctgcctaccctggcagccctggctggggccccactgcccaatgtcaccttggatggctttgacctcagccccctgctgctgggcacaggcaaggtagggccggtgacccctgatcccagatccttggcccctgtcctggccttcccctggggtgagtgtgggcagtgcctgagagtctgtgcctcagtgcctcctgcactgagtggcatccaagtggcgccacctctcaggttcctgggtgggcaagaagcggtgcacgtccagggcctcccaccagggctggcagccccaggtatgtgcagtgcttggggcctgccccgccccgtgacccctgactctgcccccagagccctcggcagtctctcttcttctacccgtcct

SEQ ID NO: 104327 - DNA, 1046 bp, Homo sapiens
cgcctcctgaagctccagagggccggggcccgacagtaccgggagaccgcgggctgggacggaactcctccaggaccagggcaccttcagattctcgagcggagatctgatcctcctcgcctagcggtccgggctcagggtcgggggcgtaagtcacttggcgctgaccagcggagtcgggccggggggaaggcgctagagggagcccaggaggagccggtaccgggctgcgggcgcttccgcctcggccccgccccgtgacctgtgacccttgcggggcggggccgggggcggggccgggggcggggccgggggcgggccggggcgaggggcgttgctgcgcgtgctcgctccgaggccgccgtgtgcgcctgaggctgttggctgcggtcttgaaacgggctctgggagcttcctctgcgcggtcggccctggctgaggcgtcccgggctgcgcgcggggctcggcgctgcgcagtgtccggtgtcctctcggtccggagcttctccagaggaggagcggctcgtgcgcccccagacctccggtactgggagactcgggccctcctgtaagagacctgagcgcggagcgttatgggcacccggtgaatgagcaaatggcagggaaaaccgtgcagccccatggactgcgggctcttccttcacgactagcaaaagctttgacaccctttctcctgcgtacgcgtgtctgtgtgcgtgtaagctgtggctgggtgcggggggctgtgtacgtgtctgtgtgtggtgtgtgtggagtgtttgaggcaggtgtgtggtgtttcaggtgtgtgtgcatgtgtggtgtttgaggtgtgtgtgtgtgtttttgtagtgtttgagggatatgtgtgtgtggtgtttgaggtgggtgtgtggtgtttgaggggtgtgtgtgtgtggttgaggggtgtgtttggtgtttgaggggtgtgtgtggttgaggtgtatggtggttgaggtgtgtgtagtgtttgaggcacgtatgtgtgtggtgttgggtgtgtgtggtgttagaggtgtggcgta

SEQ ID NO: 104328 - DNA, 1049 bp, Homo sapiens
ttggcagacattgttgagtggaagagttacataaacagtatgttgttgtcaggatggccgccggcctttacagttctgtcagtccaggcccgctgttgggctgaatggcatgtgtatactagctcctttaaccttgacgaacgtacatgttcatgctctattaataccatgttacagatgagcgtcctggtacgcaggtggggcctgtgacgggtccagagtcacagagctacggatcagcttcactgggccccaggtagacccaatccccaactttctaagcctgagtgttcagcagagggctcagggtgcagcagggcctatggaaggcgccccttcctgtgctgccgcccctgctctgcagcctggtctcagcgatgtctccgtgtctgtctttgcctgggcttgttggactcgcaaggctggctgtactgccccaaatctcaattctcccctgaagctttcttatagacccgcggattttctaagggctgggcggcccagtggctgaaagaacacattctgcattccggatgtttccatcccgcagaaaggctgctcctgagttggaggcacgcgttgccacaggctcctccctgcattcattttttgtacgtgttcattcatcctttcagcagacacaaaactaagacctgctgtgtgaggggctccagctcacctgctctgtggggatggcagaattctgttttttccttcctcgcaaacatttattgggtgcctggtgcgtcagaggtggtgggtctcaggaagttgacagccgagggcccgggctaagcagcagttaggtgggcagtgatccccttatggggctgccctggtgagtggacaagggtctgcagctctcgggaggggctgaggaagttcggtgccccgaggagagaagtcaccccctgggggaggcgaggctgggccctgcaccgcgcgggtcgctgcgccctctgtcggttgagccggaccgggacccgacccccatcagccccccagtatcacacggggcacggcgggggagtttgggctgagagcccgtc

SEQ ID NO: 104329 - DNA, 1079 bp, Homo sapiens
tcccttcgttgttttccactgtctttgctctagagtctaaccgagtgggggcttttctggcatgggcaaagggagttttgcagagggtcatgtctaggatccttgggccggctcgtccctgcgctgtggctccccgtggccctcccccagccccgggtcactgccccccgcagtcatctctttcctgtgctgagccactcggaggttgctgtgtggcagccgcccccacccgaacctagctggtgaagcgccttcctaattgccccccgcagcagagacccccatcgaggagttcacgcccacgccagccttcccggcgctgcagtatctcgagtcggtggacgtggagggtgtggcctggagggccgggctgcgcacgggagacttcctcatcgaggtgaggtcgttctggccggtgctgcccagtgggatgctgagccctgagccctgtggtggacgtgcctggggcgtccccacccagctgcctgtctatcccaggtgaacggggtgaacgtggtgaaggtcggacacaagcaggtggtggctctgattcgccagggtggcaaccgcctcgtcatgaaggttgtgtctgtgacaaggaagccagaagaggacggggctcggcgcagaggtgaggggtcacgcttcaggcctctgtgcccaaactttcccctgaccttagacctttgacttcaggcccacattcctcttcccatccctgacccccaactgctgacatcagattcctgaacctcaatgaaccacccacacgtgtgggctgggacccctcccgatccctggtgctagactgccagtcctgtcccctggcctgaggcctttgacccctgacccctgacctcaggctgcccctcctcagatccctgccccctccttcccggcgttcccccagcccctggcgtggcagagccctccttccctacaccgccagcagctgcctggaggccggggttgccatagcaactgtgaggttgacgctgccgcgctgcttattgtcggagggaagggggaggcggcacctgagggaagaggaaaagcgtcttctccccgcgacgacgcgg

SEQ ID NO: 104330 - DNA, 1102 bp, Homo sapiens
agtgccatctaccgggggagactcagagtggtccttggaggtgggtaataggtggtctccatgtttatggatcaaaatcctgatgtttcaagggctgcatcgtgtgcccagagcaacagagccagggcatggggcaggggcctggggagtctgacaacccaaccaatgtgcatgctggcagctgaggcccagcaggccaagaggagccaaaaaggagcacctgtccacccatccatcaaccgagtacaagagggtgcctgagggaccagtgcagaactggcagtcctaggagagtggctcaaggcctgcagggcaggtgcatggacctagacctgcagggtcgggcccaggaacagcaagagtcagaagacccaggtcaagggaggcagagacaaatgtttccagatgaagcaggagagcactggggccgatctccagggccctgaggcaatgaggagtgcacagagggtcaagctggacggatatggggtgatagcagctctgcggaaagcctgatttggccagagggatggaccagagggcagagccagggcaggcagtcatgagaacaaagccatggtccagctgcaaggtgatgagacctgtgcagggcagggctgtgaggccacccaccccgacacatcaggtgaggcagaggataagaaagaaaccatggaagacactcagtgtttaggccagggagagcaggggagagcgcttctcagctccaaagtagctgcagcctcaccagccttcttccccacaatcccacctacagaaataactcttggcagtctctgagggaccaggtcacacacccatatgccttttccacactgctctgtcagttcaccccattatcgcccagaaactcccatttatcttgcacatcttagctcaaaagtacccccaccccgacacacacagccttctgtgacaccaggtgtgcttggagccccccagtgggctccattggtccgtgagccctggcacccacaatgtgcccgctgagctctctgcacacgtcacattccctaaccaagccccagacttggcccaggatcggccttgtgtgaacacaaattggcagggtcctgaggca

SEQ ID NO: 104331 - DNA, 1026 bp, Homo sapiens
tgggctgatcccataggtctttccttgaggacccgactcccaaggctccttccaaagaggagcccttcgggcccgtgggctgcatggatgctggcggcagagctggtcatcccccacccgcccccttgtctgcctttttaaagctgcttttgccttctgtgcccctaggtctcccctctcctctttgggtctgggggggtggtatgtggatgccacctcttgactcctgcttcttgctgcctggaagaccaacctagtgggccccgtactgtcagccttggaggacagagttcacagcgtagcaacgtgttcagaacttaaggactttgcaggtcttacaaaggcctggccattctaccttctttagttcaggattcaaaagacaggtaggagcttgggaagctcatgaggcctctcctaaggtcccgggatgctgcctccagctcctgtcatcctggggaattgctctggggtcctctccccttttagccttttccaactctcagccaaactggaaagccctcttcccagcagtgcagtgttgaaggtgcccgtagaatgggtgttataatcagagtgagcagcctggtcctaggcctctgtacaggaccagacccctgaggctggggtctcctgacccacacctgaccagcccccatcttccctctctgcttctccctccgctcttctctgcctcttggtcttgatgaaaatcaaagccattttaaaaagtgcatagcacagtgcctggcctggttcgggccctcaataaacatttcttaaatggatgaaagaacaaagcaaaatgcaaatgctgtgttttgtgatttgagatctagggaggtggcttaggacaaaaacccacagaaggacttactcagcgttcagactcatcaggtgtcgatcccccatggtcgggctcaggtgggcccaggtctcgtcattggctctgtcctctcctgtgaggcagctgcagcagttgcagggcagggtcaggggattcctcagccggaacctctggcactt

SEQ ID NO: 104332 - DNA, 1039 bp, Homo sapiens
gtgtggttgcagctgtgggtcgcgtgggcctggccggctaactctctctctcattgctctctcctgcccatctgcatgtggctgctctgtcgagctgcgccgtggtcccgagcgccggctgtgtaagtgagcatgcccatcccatgcctcttgccgtccacacgctgtgcctgtctgcctgggtctctgctctgcgtggctgtgagaggctctggtgccactgacagccccttgaggcttcccctgacacagtggggatagggatgggaatgggaggacatgggagtgggttttctctggagctatcaccccaggtaggcctcccaccacggcagagccaaggaggggctagagctctagggtcctgtcaggtgaggctgggaagtgagctgccatcggttcttgtgtgtgtgcgtgcgtgcatgtgtgcgtgttgcgtgtctgcgtgtgtgtgctgctgccaccgcagcatgtctgtaacgcgtgtgggcaccgttgctgctgttgtgtgccgtctgtgcaggaggctgcctttgtgttgagggtgtgcacggcctcacacctgccctgcatgtgctgctgctccatacgggtacgagccctgcctagtgtctgtctcctgtgtcacggacctgttcaacctcgtgctgctgccagcctttatcgcgactcagctgtccctggaacctgcccaggatcccctgggtcttctcatgagagcagagctgtgtggggggtgggcggtgaagggtactgcccaagtctcagcgtcccgggtatctgtggatcccgccatgcccagagccggtgtcggaggctggcaggagggagaagcccgccctttgccatgagaggctgtcttttctttggttgggctgcacttggagcctggatggagtggagggggccaccagtcattcctcatattccagccagtcgctggctctggtcccaggggccaaagaaaagggccagggtaaccgtaggatcccaccctttatttcttcctctggccgggctactcccgccagccgcagcc

SEQ ID NO: 104333 - DNA, 1050 bp, Homo sapiens
tggtctccatgtcataatggttctttccgtcggaataggtcttccccttcaagacctctatgagctgctgtaggcgcttggcaaaagaaagtccttggggaagttttgtggtagatgagggtgtaggtgggggtgggggtgggggtgggggtaaaggtgaggctggaggtgggggtgggggcgggggtgaaggtgggggtcggggctgggctgccggtggtcggggtggaagtggtcgagggggcggttggaaataccaaggaaggtgagcagagatagggtgggagaaggggggtcgaatcgggggcggtcgagtggtgggaggtggaggggtggccgattgaatcatacgcaaagcgttagaaccaatcttggaggcgatccagttcagatagggccaggtggccgtgtagattccggggcgcttggcacgggcacagcctaccccccagcttgtgattcccacgaccacataggcgctttccttgctgtctttgcacatgagaggcccgccgctgtctccctgtccagaaggacacagaggtcactatctgcctgagccactcttcccctgcccagaggggtcggaaggctctgggaggacaatttccacagtgacatggtctcctgctgctgtaaacacaagtggttgtagtaaagtttgagggggtgtcaggggcttcatttgggatgtgaggagggtgtgaattgtcagggctttccttgcagtgagatgagcaaacccacgtgtccacaggggcacatggcaggggcagccggtggctgtcaccgctcatccccactgtgagagtaggtgctagaaaagggaccggggaagcagtcactagagaagggccctgggcagagcagtggagatagtggagcttggggatccaaaaggaggatgttctcaggggccgggagagtcctggagggacccaggggcccagaagccagaaggaaggttacctggcaggtgtcgatcttgcctacaggataccccgcgcacacattggttggctgaacgcgcccattgtaccactgggtcga

SEQ ID NO: 104334 - DNA, 1091 bp, Homo sapiens
cacatacacacaccccacacacatatacacatatatatctatccttggatatccaaaaaaagattctcaataaattcacaacactaattgaattgagatgatataaagttgttgattatttttaataaagtctagagatctaacattagttgtagcttatttcttcactactaaataagaaattccaagttaagtcttttcatcttttcattaataaatagccaatatgtaatatctgcccatccatatatattatgaactatctgaactactccttataattatggggtaaccagtcaaataaaagtgttgaataaacagcttattgtatatgttatgaattacctgacttaaaattaggagtcaattagtcaaaatgccatgggctatatgactcattgtaacattaataaagtaaaatatgtcttcctataatccagttattggtattaaataatattgaagctattttccaagcaaaacttccgcataagtttgtttttgtcttggttgagaactggttcttttgagataaagccaccaactcagcacaggtttttttttttttctcctgaatggttttgttcaacttaaaatgactgttcctaacagcaggtgctctcttctttgtttcagattatattgaacatgcttttggtcttcacaaatactgaaaatcaactataaaaatgctggatgaaaagaactatatccatatggtaggaagataaaattttagctctaactcatatcttctctgaagaagattcttcagtaagttcaataactaacattatacattcagtcttttaggaaatccttggatctattttcaaaatatatccagaaacagaaagcagctataacatttgactggatctctcattatgagtaaaataaaatctttaacagctattaatcttatacatgatatgacagccgtgattttacctttcttttttaaaattaattttaacagctttggagatccttcactgagatatccagtgggttcaactgacaaagcaaggcacaatttatcatgtaggaatgtacttcacgggaaattttcttctacatatgttttctct

SEQ ID NO: 104335 - DNA, 1867 bp, Homo sapiens
acccaggaggcaggggttgcagtgagctgagatcgcgccactgcactcccgcctgagcgacagagcgagactccatctcaaaaaaaaaaaaaaaaaaaaaaagaattcctttgttattttatcatgcttcaaggtccaggaaaggcctaggcaaaactcttggggggcttttgttacattctagccttgtttaagggcactggctggctctttcagcttttaatatgtaactcaaccagtcagtcagtactgaaacagttatggaggcctgcgctagtgagaccccgcctgccacagtaagtgcttctggagaacaaaaccaggtagatacatagacctagtcgtaatccctcaaactgacaccgttttcagttttttcatctgaacaagagatgaatttctgagttgataaacttgaaatgtgtccccctttgttttccttcacttaccttcacttttaatttcattggtatgcctgtgtatttgccttgtagatgtgtagttggtgactgcctctccagatgctgaggtgcctgtatcattggcacaggccagtgctgaaccgtaggtggagtaggctgtgccttccgaagcagtatctattcacaatgaagttgcagtctcccgaattccagtcacttttcacagaaggactgaagagtctgacaggtgagagattaggataccttttcttgattggaaacctatataaatggagaagtagagggttaactttttaagccagcattcggatattttcattgttgttttaattatttttattaaaaaacgtaagtagagggtctctttgtgttgcccaggctggtctcaaaactcctgggctcactccttggcctcccaaaatgctgggattacaggtgtgagccacggtgcccaatgtgcacgttttcattgttggaagaaaggcttggctgggtgtacccagcctgtaatctcttggggaggccaaggtaggaggattgtttgagcccaggagtttgaggctgcagtgagctatgatcatgccactctagcctgggcaacagagtgagaccctgtctcaaaaaaagagaaaggaatattaaaagagaaaggcttacatatggctgatccaaaaatatagctaaatcactggaaaaggcaagaagttgactgcagtaaaaagcatggcttttctgtatgctgtgctaagtacttgccattcattacaggactggtgctactaacttaatgagtacgcacattttgacctgttacgtgaaaaaggaaacagattgttaggcatgtgaagtgctttgcctgtgtttctgtaactactaactagagagctaggtttcgaacttacgcagattgatttcagagcccagcttgcaaccgctaagctctgtttccttcctaggtataaatgctttccatgagaactgaaggaagaaggaaataggagttgcctccattgtgcacgttgcaaaacctgtctggaaggagcataggaaatggctttagctaagtgccagtagcttcttgctgttgccacagtttcattagtgttgattctcaatgttgtctgctgatgttgctaaagcagccacacagtagcattacaaagcctgtgggaattttaatagcaccttcataaatatatttagtagtatatgtagaaatatgacctatacagcactggctatctattagattcacctggggagcttttaaagcacacatgctcgggttctacctgcagcctactgaattagaatctctgggtgggatgaccatctatatttttaataaaagctccacaagttaattctgatgcacagaagatagacgaaccattactttaacatgactcaccttgtattagctt

SEQ ID NO: 104336 - DNA, 1001 bp, Homo sapiens
gcgcctgacctgctttagtctttagtaatacttcaaatttatattgatcactttgaggcattgtggaattctgaattatcttctgaataagcaaagaattctgcaagttctctgtttcctgttggtcctcagaggcactctcctgtagacaagtctttttacttctttgggccttgttctcatttttcatatgaaaagcctcagttaaatgaatctctgctgttccaactagatggaaaagccttgtacttttgtggttaaaataaacacattgaaataaagaacttgggaataaaaatcttattttctctcatctcagaattatttgtcaaagagaatcacgaattaagaatagcaggaggagcagtgagggatttattaaatggagtaaagcctcaggatatagattttgccaccactgctacccctactcaaatgaaggagatgtttcagtcggctgggattcggatgataaacaacagaggagaaaagcacggaacaattactgccagggtgagtcaaaagtttgacaggtaattacattgcttttttggtaatttttaaaaacttaattttctctagttaaaagcaaataacgaaaagtctaataaaaaagtcagtctcttctatgcccgtcataaaccctgcagtcctctgttcttgcagccatgtttactttttatgttacctctccatttctaaaaagacctttgtatgctacgggtatttacttttcagtttttactatcccagttttaagatgtgttacgtattgactttccataagggaagatgatttagctttcttaccacacccttctcaacaacaagcacgtataattctccttcttctgtcttcctagtatatttatatcataatttttggttaagtcaatattcagggttcacgtttatgactctgtattgtttacagccagattgtggagtatattgtgatgacatttcttctattggcatgtttttaaattttcctgcagtta

SEQ ID NO: 104337 - DNA, 1136 bp, Homo sapiens
ggcatgagccaccacccccagcctttattttaatttcactggggattatcagtaagggagttgcaagatctgttaactgtacttattctttatcagtctttcgctcaatggcaaatgttccataaattgacattcacctctttgcaaactggagctattaaaaatatttctgataatagcttgatttgaaattgaagaacagttttgagtttgatgtggagtttctccacatcacttggcagaggtgacatgtttgtgtgttaaactcatcttttttaatcatgatggattttttttaaaaaaatcagtcttttgatctgtttttgaataatgtggatatctttctgtttcaatgtttaggtatggtagttgacgttaaaaagactataactgtcagggcttatagtaccatccctttataaagacaaaaacttatttttttcaattcagtagtatgaaaacctaatttaaatgacaacaaaaaccccatgtatttaattgcagcttcatgaagaaaattttgagattactacactacggattgatgtcaccactgatggaagacatgctgaggtagaatttacaactgactggcagaaagatgcggaacgcagagatctcactataaattctatgtttttaggtaatatttgcagataaaaccatattgtgagtctatcagaatgccttcttttcaagtaaaacctacattctggaaatgttcttcaacttgagaagttgcattaatttcttctaagagatggtttagcagattgcttcaaagaatagtccctcagccgggcacggtgggtcacgcctgtaatcccagcactttgggaggccaaggcaggcggatcatggggtcaggagatcgagaccatcctggctaacacggtgaaaccccatctctactaaaaatataaaaaattagccgggcgtggtggcggctgcctgtagtcccagctgttaggcaggagaatggtgtgaacccgggaggcggagcttgcagtgagctgagattgtgccactgcactccagtctgggcaacagagcgagactccatctcaaaaaaaaagaatagactctggagccaaaatccctgggttcaaattctgactccgtcactcactagccac

SEQ ID NO: 104338 - DNA, 1048 bp, Homo sapiens
ctaacaaattggttatattctaagatctgctttggaaattattgcctctgatacatacctaagtaaacataacattaatacctaagtaaacataacattacttggagggttgcagtttctaagtgaaactgtatttgaaacttttaagtatactttaggaaacaagcatgaacggcagtctagaataccagaaacatctacttgggtagcttggtgccattatcctgtggaatctgatatgtctggtagcatgtcattgatgggacatgaagacatctttggaaatgatgagattatttcctgtgttaaaaaaaaaaaaaatcttaaattcctacaatgtgaaactgaaactaataatttgatcctgatgtatgggacagcgtatctgtaccagtgctctaaataacaaaagctagggtgacaagtacatgttccttttggaaagaagcaaggcaatgtatattaattattctaaaagggctttgttcctttccattttctttaacttctctgagatactgatttgtaaattttgaaaattagttaaaatatgcagttttttgagcccacgaatagttgtcatttcctttatgtgcctgttagtaaaaagtagtattgtgtatttgctcagtatctgaactataagcccatttatactgttccatacaaaagctatttttcaaaaattaatttgaaccaaaactactactatagggaaaagatgccaaaacatgtcccctcacccagactaaacttgatactgtattattttgttcaatgtaaattgaagaaaatctgtaagtaagtaaaccttaagtgtgaaactaaacatgttctttgttcaaataatgtaaaatatctactcataattttaaagttctaaaaaggctgctttgccacctacctctttgcttatattcaagggtttagtgggtccttccttccacatttgtatgataactttcgttttattggtagtcctttgctactttaaaactaatcaggttaaatgtttactcaaatgtagtaatagtatgaggccaaaata

SEQ ID NO: 104339 - DNA, 1056 bp, Homo sapiens
ttaatttttgaaaaatagcttttgtatggaacagtataaatgggcttatagttcagatactgagcaaatacacaatactactttttactaacaggcacataaaggaaatgacaactattcgtgggctcaaaaaactgcatattttaactaattttcaaaatttacaaatcagtatctcagagaagttaaagaaaatggaaaggaacaaagcccttttagaataattaatatacattgccttgcttctttccaaaaggaacatgtacttgtcaccctagcttttgttatttagagcactggtacagatacgctgtcccatacatcaggatcaaattattagtttcagtttcacattgtaggaatttaagattttttttttttttaacacaggaaataatctcatcatttccaaagatgtcttcatgtcccatcaatgacatgctaccagacatatcagattccacaggataatggcaccaagctacccaagtagatgtttctggtattctagactgccgttcatgcttgtttcctaaagtatacttaaaagtttcaaatacagtttcacttagaaactgcaaccctccaagtaatgttatgtttacttaggtattaatgttatgtttacttaggtatgtatcagaggcaataatttccaaagcagatcttagaatataaccaatttgttagataactttatctctatcacatctgtttacaagcaaagtattactttgtctggacttatttcatcttcagtgtctgggatcgtgggcaacagagcagatcgcgttaagccccaaaatttttgaggtgacatgtcttttttggtggccgtaaacttccatccaatatggcttgcacagatcttacactgggcaacagtccaggcatacctaagaaattaaggaaagatatcagctaaggaaacatttctgtactccaagcctatcatataaacctatcatgaagacagactttagaggcaaattctaaggattagagattctaagttgagatttgatccatacagttccctgaaacctaaaaacattt

SEQ ID NO: 104340 - DNA, 1050 bp, Homo sapiens
cataaaaagttcaaattgcaggaagtggctgtcatccaaaaacacttcctgtgtaaggactcctttccctgttcttcaaggtgcctttaaaagaagtgagtctagttccaggacttgccttaattatagatactctctttatctgtttataaggtatagtttagttatttttctagtctcttggcaaataacttctaacatggatttgagttcatgtttaacataaaaggattttaccaaaaaaagtataagaaaagcaattaaatttagagcttctgaaaagtgtatctttgacagctggtatatttttgtattgtttatacttgtataaaatgtgtaaccttaaagagaagggtttatttcaaaaggatattatccgatttgtaagttctctgatgcttatctgactcctaagtttaaaacttgaaaaaccatgtcttgaagatttttcttacagagtagctgcttgtcttcctattgatgatgtattgagaattcagctccttaaaattggcagtgctatccagcgacttcgctgtgaattagacattatgaataaagtgagtaaagtgaatatgtttttgatgcccatgttttattcaggctggagaactaggatgctctgttggggccaatggagctctgtatagagtccagtaatgtagtcatgcaattcagatttcaattgggatcttacaaacaaactcattgttttgtgtttgtcaaatatgaatacatttatcaacttagtgaaaaataacttgatttctgcatggaaatatccaaggttatatatcactattcctttactctagagaaggtcatttagttttatgtaaatatgtggcagatctcagtttcagtgactttcgtgctccatctttaaaagtgtttttgaatgcttggaaggaaaatgtgatattcagagagagcaatatctttataagtaagtttcttgatgatctatgtgattacatgataaagtgaatgccagtttttcctaccaataatttttctctcaaatcttttagtgtacttccctttgctgta

SEQ ID NO: 104341 - DNA, 1071 bp, Homo sapiens
tttagacagatacaaggttcagttcattcctgtcttcatagagcttgcttgtatctgatttgtccatcccaccataatctgaagtactgcatatgtgtcttctgtctctgtgtctgagtagtagttaaaatggtcagagttgggagatgcttacataactaagctaactcaagctaataaggttgccgcgcacttttcctgcagaaaaggaacttaaagtatcgaggattgtagtcttcctgagatatattcaattaactttgaaactgcacacagcatttgccgtggaaacctaaacaactcaaatgacatgaaataaaattatttaagcttctggaagtgttctgtgttatctaccattctgacaaggaagcattagagaagattcagcacgtgtctctcatgattaaggagttaggccagtgtaattaggaaacactttcaaaacccactccatctagagacatttcttgttctggaatttgagctctgaaactgtttacttcttctcccatcacagtgcctttctctattcactggtttactgtagggggatttgagaatccccctacagtaaaaatcctcctcaaaaaaaaagaggaaattttgtttaaacctgtttggagtatgacttaaatgtttctaagtatattccctgcttgcccagaccatctgcttattcatatatcaaggcttactatgttaatcagaaaagagttgagtatgaaatgtaaagataagtcaaatgggaaacagatactaagaaagtaatgagtctcatctttctggcctctgttgaacttagccatggttgttcctgtttattgcgtagagcagggaggaactgagcatgaatttggaagggcaggggtctcatacgtaatctcccagattagtgtttaaatctcctcctaattttatctagatacaaatgttcttatttctttcttatacagaaggatacgtacctttttcttaacggtgtatcttataggagattcttttgtattagtttatagagcattgctcattcttaaagctgcttggaattcttttgtatggatacactgt

SEQ ID NO: 104342 - DNA, 1027 bp, Homo sapiens
tttatctgaaatgtgtagatctccctttccattccacagtgacattgaagatccgtaccttaggttatctttggttttaactttggtatgatttatgaaataaaattattttctgaaagtttctgtatcttaacatcagtatttgatgaatatgtttaaaagataaaacttggaaaatcttggtatttaaaattatcactgtttagaaacttatagttttgagttagtcaatcttagaaatgaataccatgcttggttctctttattttagaatccagcaagctaaagtgcaaattcttcccgaatgtgtgttgccttcaaccatgtctgcagttcaattagaatccctcaataagtgccagatatttccttcaaaacctgtctcaagagaagaccaatgttcatataaatggtggcagaaataccagaaggtgagaaactaattttttatgcatcttcaaaaaatgaagacaggttgttttttttcctgttttaagaaagaaacacaactttcatgattcattacccagccaccttgtatggcaatattccagctacatttgatcctctaaaaattgcacaggcagctactttatgtaaaagcagtttacaaaagcaataaaatgtcacacagctgtaaggtatccttgttattatgcttatcagctatattaatcgcttttgatttttaattccatgggaaatgcttattaaactatgatcaaattagatgttcggctcttgagttataaacatccattatcttaaagaagggaggattcttttggggtagagtagtagtagagaagtagagtctgttttccttcttccaaaccagagagaaaggtttcttttgctatgtgttttaatgaaatacagttgacatcgcagaaattgacttgagactaggtgctctttaaaaatgttgcttgtttgggcactaattcctatgttatatcctttgactaaatcataattgtcataggaaaaaaaaattgagggagcctgtttctactcgtttgtgaga

SEQ ID NO: 104343 - DNA, 1055 bp, Homo sapiens
ccccatctctactaaaaatacaaagttagccgggcatggtggcgcatgactgtaatcccagctactagggaggctgaggcaggagaatcgcttgaacccgggaggcagaggttgtggtgagccaagatggcaccactgcactccagcctgggcaacaagaggaaaactccatctcaaaggaaaaaaaagattaacatcaaactgatacaggtggacaagacttggaaagggcacattctctctagtattctgtagacccattattaaggcctctcataagggtatgtctgtcttcatttaaaaggcctctgtggaatgagatttctcttggctccactacttctctggccctgtaaccaccttcactggaaatggtgaaatgaaagaaattctggagttgatttagttcagtctcgtctttttctgtatcagaatgccaggtactagagaggttaagtaatttgcttaaacagcaaataagcgacagacctgattggttctaggtcccatgacttccaaactggtactccttccattataccagaatttctctataacacatttgaaactcaagccagcttccctttctccagtaaaatatttaatattcatttgtttttcttagagaaataagcatatagaaaaataaaaattaaaaaatataaatatccatcttttacctaaatgacacttcatttattaaaagtacactacagaggccaggtgtggtgactcatacctgtaatttcagccctctggaaggccaaggtatgtgaatcatttaaggccagcagttcaagaccagcttggccaacatggtgaagctgcatcactactaaaaatacaagaaattagctgggcatggtggcctgtgcctgtaattccagctgttcgggaggctgaggcatgagaaccacttgaacctgggaggcagaggttgcactgagcagagattataccgctgcactccagcttcgccaacagtgagactccatctcaaaaaagaaaaaaagtatacaacccccaaagtcatgagtgtgtgtgggttggggagg

SEQ ID NO: 104344 - DNA, 1031 bp, Homo sapiens
ggtaaaaataatactttgtactaaaaaaattcttgaatttctgtgtttgtgatatattcataaaagattagaaattcttctaagagttaaagttagattaaaaattatattttaacatgggatgcttatataccacgtttattaagtgtttgtaaccccatttgtatttttttctttttttttgagacagagtgttgctctgtcgcccaagctcgagtgagtgcagtggcacaatctcagctcactgcagcctccaccttccaggttcaagtgattcccctgcctcagcctcccgattagctgggattacaggtgtccaccaccacacctggctaatttttgtatttttagtagcaacagggttccaccatgttggccaggttggtcttgaactcctgacctcaggtgatccgcctacctcggcctcccaaagtgctggaattacaggtgtgagccactgtgcccggcctgtatttcttttaatgtgatttgctctttagtctgttgagcttacatttttattacatatcgatcatgacactatacctatatatgtttttatatagtacctaggtgctgatatggaagaatttcatggcaggactttgcacgatgacgacagctgtcaggtgattccagttcttccacaagtgatgatgatcctgattcccggacagacattacctcttcagctttttcaccctcaagaagtcagtatggtgcggaatttaattcagaaagatagaacctttgctgttcttgcatacaggtaaaatattagagtccatttgcttaatacattccctctcatgggtaattgcagtggtcagtgttgaagccaaagcaggctgttatttcgcatgtacaggagaggttgggtaagaatgtgaggttaggaatttggttaagtagaagtttgatagtgcaagttggagtatttttgttcatttcattaccatctaactcagctcttcaccttcatacacaatttaactttctggtatttgaaaaatttttaatcatttatattt

SEQ ID NO: 104345 - DNA, 1120 bp, Homo sapiens
acctccacctcctgggttcaagcgattctcctgcctcagcctccccagtagctgggattacaggcacctacaaccacacccggctaacttttgtgtttttagtagagatggggttgcaacatgttggccaggctggtcttgaactcctgacctcaagtgatctgcctgcctcgtcctcccaaagtgctgggattacaggtgtgagccaccacacctggccttcattttaagataatgtagcgactgccagggaaatgttgtcactagaaaaatgctgtgaaattcttcctgctaggttatctttctctcagttttaattaacagatcttgcctgctttgtttcttttcttacttatgtaggaactgattgaagttgagagtttgagagaacgttagaggttgacttgttgaagcctatcattttgcagatgaggaaactaaaatttaattgggcagaatgagttgtctaaggtgttaaaattagttactggtgagggagaagagaaaaatctcccatatagaagaattttaaataacttacatttcctcttcaagggagtggagcataactcatcacccctgaagtggaggctacacctagtgatttgcttccgaagggtacaatgtgaaaaggaggggggaaaggaactttacagcggaaaaacctgacacacactgctgtagccaggtgatcaaggttaacagcaggaatagttcataatatataggctggatatgtaataaaaacagcacattggcaacagaccccatttctaaaaaggaaaagaataacaacacttcacttctgtggtcttcctccctaaaacacgtatcctcagtctaatcatgggaattacatcaaacaaaacccagttgagggatactctacaaaaggcctgaccagtactcctcaaaactcagaaacaagcaaagtctgaaaacccccctagcccagaggagggtagggggacctgataactaaatgtaaagtgggatcctggaacgcaaaaagactagataaaaactaagggaatccatttaaaatatgaagcttagttagagtaatgtaccaagactgattccttcgttgtggcaaatgtaccatactaatataaattaa

SEQ ID NO: 104346 - DNA, 1050 bp, Homo sapiens
aattaaacctcttttctttataaattacctagcctcaggtatttatttatagcagtgcaagaacagactaatacagatgggcacatgacccaagctaggctaatgaaagtccttcctcagttctcttctaaaaggaattgtcaggaaagagtcttttcttctctgggcagaactttattaggatacccctttatgtaaggcgaaggagggtgtttatggactgaggcaataaagctgccacgcggaagaaggaggaaaagagatggagagaagtgtaccaatggtgtctgagtccttgtttccaacctttgtccttctggaagtctgggaatccggaccaacatattactgtattttacactatttgacattgagtttttgtcatttgactgtatattagagtgctaatacaagaagatactgaaataaaaactagtttttattctgattaaagacatcattaataattttaaataattttcaagcagaggaaaagctgtttattagttaaacttaagagatttggtattctaacaagagagatggttaaacaggttttaggactttttgtgaaaaataaatgaaacacatgaaaaatgaaaaaaagccaaatataatcttttccttattaataaaagacaaaacaaaaacactaatgtcaaataactttttataatctcatccatgccattttatatgtttttggtgaaagtcctaacattgcataaaacgtaagaaaaactgttaagagaaattctctttgccagaggtgaaaataaaaatgaaatgaagagccatagaatgtcaaagctctaaaagagaagaaacaagctctctgtgcagttgaagttcacatctgtaagatgctgaagcagttttcagggttgcacttccgaatttcattccttccttccttgcatggctctgcagtcctaccagacccatctattcccactacaagtctcagcttggatggagcctttcctgggcctttatgattgctttccctaactcctaggcatcattgatgctgatttgatacttatgatt

SEQ ID NO: 104347 - DNA, 1070 bp, Homo sapiens
catgcatgtatctttgtaatagaattatttctatttctttgggtatatacccagtaacaggattgctgggtcaaatggtatttctccttctagatctttgaggaatcaccacgctgtgttccatagtggttgaactaattcaccttcccactgatcatcagagaaatgcaaatagaaaccagaatgagataccatctcatgccagtgagaatggtgattattaaaaaggcaagaaacaacagatgctggtgaggttgcagagaaaaaggtgctcttttctgtagagaggttagggaaagcatcttggggaatgggtatctgaggaatcacctgggcgcaaggtcaggttttggaccatgtgaacatctgggaaagaatattctaggacaagagatgtaaaaagcagagatcctgagacaaaggtcctacttgaagcacatcatgggtaacagggagaccagtgtggctgagcagagagggttgggggagtggttagaggtgaaagagggatagccagggactagatcttgtaggacccttatgggtcatggtaagagctttcggtgttcttgatgtggttgtttctttaactaaatgtgacctcatatgatgtatgttttaaaacagtagttgtcaatcctgcctgcacaatgaaattacacggggatttttttttaaatgactagtgttcagctttatttccaggaagttaaatttaaatggtctggggtgaggctaagcatctgtgtgttatggaagcagtcctcgaaattctaatgggtagatagaagaagcactgttacagaaggtatcagtggctaataggataagaaatgtatatgatgagctaatgagttccatcgtatgccgaggtaagtgcagccccaatgctggggtgatgtcagtgccgtcagatagccggtagggatgaatgagccaagagagctttcaagtcttgatcaagaattaggaaaatcttaacaaagaaaagggattttcttattccctggcctggccctgcagactttttttctgaggtgtaataaggaaaatggtaaaaatgaccagaa

SEQ ID NO: 104348 - DNA, 1045 bp, Homo sapiens
gaactatgagattgtaaatttgtattgttttaagccactaagtatatggtggtctgttacagcagcacaggaaaactaatacatccagaggaggaaaagtcaaaatacttgcttaatggttcagaaaggaaatgatagcaatataagtgtggcaagacatcatgtgacatgcgactaaatttcctctctttattagagttatggaaagtaatagagaaggcagattgaagaactgatgcatggatgagatttttgatactaagccccaacctgtgctctgaattccacagacaaaactgtgctgatgtactctttccttctgtccctttggagctgggtaaacattcccttcctttgtgtctacttaaccgtgctgagccaaacccaagtagtatttcttaaatagtgtcagcagcaattttgcctttgggaaataattctttgaagctgtagtttgcttctaacagcatttctggagaacagaagacatcatcatttaaatgtcaccactttcgagtagactcgaagaggttataaaccctagcccaaagaataacaattcaaggcaaaattagagcataagttttatatatatatatatatggtccatttcatgctgattcgaaagaaaagtattcagggtttctgcagtttgttttagatttaacagaaaagcttcatctgttagttcacagtgcaggctgttatctgatcactggtgccattgacatcactctgtaggcattttggttatttctggaaatagcagcagcaggaaagactgttaagccctaaagagaattaagtcttggaatggaaaatttagttcagtccttagtgacaggcttcctctcaaagctgtttgaagatgaagctctcacttataaataaacaacttggaatcttctcccaccttgacttattttccatgagagacttcaactgcacactctctctaaggggataatcaaaccaactgctgggatccaagctgtcagtttgttcttcagagtatctgaatgctgaatggctgccctctcctcat

SEQ ID NO: 104349 - DNA, 1076 bp, Homo sapiens
ctctatccctttttgtaggttctcactcacttccccgtgagggtgatgaatatgttcactttcctgatcatggtgatgacttcatgggtgaatacatattttaaaatacatcaaatgatacacattgcctctgtgcggtctagtgtatgtcaattagacttcaatcaagctgttaaaataaccttggtttttaaaggaagaagtcatgtgggctgaaaaggggaaaaaggcagtctttctatgtgggagagaaggggaccccaggtgggagggggtattaacaaaacctttttaaacatttcagtgattcttcattctcttatagtgaatcatatctgtatggtccattttctatataatatttcttgtgagatgtgaagcatgtgattaatttgaggtttgttttgggggtagagtgtaaaatggaactcttacaggaaatactttgtgtaaacaattcttacgctgctgcaatgcagagcaaaatgacagtaaaagcacaactaagtaaaatgtatgttaacacttttatatgttcattactgtagatgtttttatcagttttaagactgaatcacacagttactgaccaattgcatgctataatcctcaggaatgcaatgcatgagtgaatttattaaggtactcctaggggtttaagcgatttaatgaaaaatgaacttttaaggaaaaagatggcaggtaataaatatgagatacttcccacctgcttctgatatataacgcagtggatgttccattcacttatgctaaagatggatcactataaccacgccagcaggaaactttagctgaattctgtaaacggcaatcaaagtaggccgaggtcacctgaaattactctcaaagatgatcttgtctcaagtgaaattttaaagtggggagggatttggaattttaaagaggagaggcttgtaaatacaatgaggttaggctacaagaaagttctgggggactaatctacttgtttattcaaataaagtgaaaattaagaattttgtctttgtttacaatgctactgctcaaaaggtggatttggtgcattccttttttta

SEQ ID NO: 104350 - DNA, 1592 bp, Homo sapiens
aagacatctttgtttttaaagaaaagacatctgcaggctttttcttagtgttcctattaagtatgtatgagtgtgtgcatttgtgtgtgtgtgtgtgcatgtttagtgactttacatgtgtatacatacaaatgtacacagtcatatatgactagtggtacatggaatctcaatttaattgtaaaagtgaaggagttctaaaactagttttagtatagtaagtgggatatagtaagaatgtcctacaatttaaaagcttatttggttatcttcaatggattttgaatgtattcaatactagatttgcgagtgactatgcctttttagtaaacaaaagaaaggctataatgtagaaagtatatggaataagcataacatctgtcctaatctaattttcaggcacatctccagacttcaatttggctgaaataattcatgccacggacctgtgcacatgcctggaattgagagacacagttaaaagactccaagttgctttctgccttttgaaaactcctgaaaaccatccctttggactctggaattctacacagctcaaccaagactttgcttgaatgtttacattttctgctcgctgtcctacatatcacaatatagtgttcacgttttgttaaaactttggggtgtcaggagttgagcttgctcagcaagccagcatggctaggatgagctttgttatagcagcttgccaattggtgctgggcctactaatgacttcattaaccgagtcttccatacagaatagtgagtgtccacaactttgcgtatgtgaaattcgtccctggtttaccccacagtcaacttacagagaagccaccactgttgattgcaatgacctccgcttaacaaggattcccagtaacctctctagtgacacacaagtgcttctcttacagagcaataacatcgcaaagactgtggatgagctgcagcagcttttcaacttgactgaactagatttctcccaaaacaactttactaacattaaggaggtcgggctggcaaacctaacccagctcacaacgctgcatttggaggaaaatcagattaccgagatgactgattactgtctacaagacctcagcaaccttcaagaactctacatcaaccacaaccaaattagcactatttctgctcatgcttttgcaggcttaaaaaatctattaaggctccacctgaactccaacaaattgaaagttattgatagtcgctggtttgattctacacccaacctggaaattctcatgatcggagaaaaccctgtgattggaattctggatatgaacttcaaacccctcgcaaatttgagaagcttagttttggcaggaatgtatctcactgatattcctggaaatgctttggtgggtctggatagccttgagagcctgtctttttatgataacaaactggttaaagtccctcaacttgccctgcaaaaagttccaaatttgaaattcttagacctcaacaaaaaccccattcacaaaatccaagaaggggacttcaaaaatatgcttcggttaaaagaactgggaatcaacaatatgggcgagctcgtttctgtcgaccgc

SEQ ID NO: 104351 - DNA, 1080 bp, Homo sapiens
ctttttggagtggtgttgatggatttgataagtgtacagcaccattatttcactggcccctattgtaaccaagaatggacatttgcaagaaagcaagcccaggtggggagtgcatgcctggtccacaaaaaaagctgagctaagtgtgtctggctggggattcaacccttaaccttagattccttagcacgagattctaacagctgagctgtaagcattcttctcaagtgttacagttaaacacccacatgccccatcacacaatgctgaatccctacagatcagttaaacagacactgttcctaccagagacaatgagagatcaaactgcccaaaacaaccaggcaaacaagcacactgttttgcatctttctactttcaaagaaccttggacagcaagtaagcactttctaacttacccaaattcagggtcattaaaacatggcatttatacctcttctattaaacttacctaaatgacttgatagagatcttggagaataaggatgtgtcctccagagcattagagccctataaaaatataatgtaattcaaacatgtgaactacatttgtaattttaaattttctagtacatatattatttagggtgaaaagaaacaggtgaaattatttttaaaaatatatattttgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaa

SEQ ID NO: 104352 - DNA, 1026 bp, Homo sapiens
tcgcaccactgcattccagcctgggctacagagtgagattctgtctcaaaaaaacaaaagcaaaaacaaaaaagaatggttgcattgattgaatctgaatatcccaggaggaaggcactctttgggaactgccataaacttcagaccccaagggcacccaacctgaggttactcctgaaaactgaataaatgagtctactaacatagttctggctttgcttgaacacttttggttatggggaactcagtgccctctgagttagcccactcagtccataaagagttcaataaaaatgtttcacaccccaaactgaaattggaatggattgcctctctggttctagttactctgcatctagtaatacacaattagcccatttcggcatcaacattgcacactgttgaactgtattaagctcactgtctactaaaaccagattacaatttgttagttttacgtgacatactgctgctaaatcaaatctcagacattcttcacttctttaggttttatacccaatcttgtatttatatgtctgttaaacttccttctatttagactggcttgattgttacgagtattttggaagttgattttgttcatatagttgctattgtttcaattgcatgttcaataaatatatcccgtatatcttcatctaaatcattgattaaaatgctaaacagggctggaggaagggttattagacgcctgctgggttcctggtcactatagtagggagacatggggaagaataaattatgaagagtgaccatagtatgttgtaaaattaatgagttagtagcaataggcctagaaaagtaggttataaggagcctagggaagaacttttccccattctgaggtacataatttgacctgttgttttatttattttcccaagctttattgaagtataattgacaaattaaaattgtatatatttaaggagtacaaaatgatgttttgatatatttccagattgtgaaatgtgaccaaaattaagctaatcaacatatctatca

SEQ ID NO: 104353 - DNA, 1030 bp, Homo sapiens
attgtaatcattaatgtccataaaatcatgaggttttctatttctcaaagtgtatattaaaataaatacgtctatttttaaaaggggagaaaggagtgacaagaggaagctttgtgattgattgttacatctacagttggtgggcataaatgaaaattgggagattaaaacccagtcccacagtgttctaactatctctgtatatgcacagctcccaataaagttagagttacaaaaataagacaggatgccttcctaagagagcttattgtctttcttaccaagaagatcaaacatgcttgaaacatttaagtgacaagcctaaaagtgcattcaactcgttttcttccatgtattcatggaacacaaaaccagtcttataaaaggtcaaaacagcttgcttgctccaaaccctgccttcacaggcatatgcacacataagaattaaggcatgaaaaactttcaagataaaaataactttgtgtctgttttgcctttggctactgtgtgaaaaggcaaaaagaaattcaaatgttcatattggaaacaagcatatcataatgtcatcagtgttgaaagccaagtagaaaataaactaattgattttattgagctaacagttggatctaaccatttttcaggtctctgaaaccagcttcaaacattatttttagatctcaacaggccttgacaagaattatctggctcacagtcttctaatagctgcttggaggaaaaacaaacttatgaggctagaggccaagtacaaagattcttgtagctggggtttcaacacaaccaaaaaaggaatgaagattttcacaacacttctttataattcagaggcccaggttttaagcctagaatgttacagtatcatacttcagtttctgggtcttcagtacggaatgtgattcagaaaagtcaaacttctcgttaacaagtatcaagagctgcaatctggcaatcgaaaaatgcttcttgagcacctgctgtgtgccttgtcctatggataggaaccccaccccca

SEQ ID NO: 104354 - DNA, 1035 bp, Homo sapiens
tccctggccccttcacagacagatggccctgccatggggttgtcaccctttttttttttttttttttttttacacgcagcaataatggacctacatcctttggaacataattctatgcatggactaccctcaacaatcctgtagttggaatcactttgtataaaatgtctcccaaaaagggctttgcaagtattcggtgcaagtcatggaagattccctgactattgcagcctccactcaaggtgacattgtggtgggaccctgccatgtccccagccatctttccccagatggtggctgtattataaagccattgaggaaggtgaaagtgttactttctgaaacagctcactttctcctggtagactgtgttcattgtgcggtaaattgtggttgttctatgtcttctcttgtcttggctggtttgctttccagggccaggcactgtactggaggctttgtgtacatgacctaatttaatttgcagagtagtttttgggggggaactggttatttttggttaatattcccaatgtgcacttagaaaactaggactcaagatgccccaggtgacacggttgagtgaggcagaaccaggactcacgccatttttgtgacttccgttctctctactgtatcattgagtccattgttttattgtgagtttggggtggggagtggtggactgaagacgggagattactggggcaagggatagcttgcaggagtaaaaaggcaaagagtgaggaggtggaatggattagtggttaagaacatgggctctggagccagactgtctgggcttaaattcttctcctaccacttactagatttgtgactttggacaagttactaaatctatttcttcttcagattttgaaaattatgtgcaagtacttctagaaaaggtacaatcaaggcaggagggttaaagcagtcagtatagagggatctgagtgtaaacctttgacctgctttaaatccactccaaacttgaagggttgatgcttagtcacactgcagaaattattctca

SEQ ID NO: 104355 - DNA, 1904 bp, Homo sapiens
taaacttaggcaatcattggttgttacatttttcttttttgctgttatatctaatgctgaacatctttgtactatatccgtgttacatttataaggtgaaggacgttggaaaatatgtggttagttcttgaatgtgctgccctttttaaagcatacatgttaagtatccatacaggcagggttgtggggaagcactgtctacagccggtgcaatatgcatctgatgggttagagccttcagctgagagtcccagtagcacttaccttgctctttctctctacacagtcttattgttacaggtatcgctgtgctgctcggagccagaacacacctgatagctctgcttcgaatctgggattccgctgtgcagccgaccgcctgcccactatggactgacaaccaaggaaagtcttccccagtccaaggagcagtcgtgtctgacctacattgggcttttctcagaactttgaacgatcccatgcaaagaattcccaccctgaggtgggttacatacctgcccaatggccaaaggaaccgccttgtgagaccaaattgctgacctgggtcagtgcatgtgctttatggtgtggtgcatctttggagatcatcaccatattttacttttgagagtctttaaagaggaaggggagtggagggaaccctgagctaggcttcaggaggcccgcgtcctacgcaggctctgccacaggggttagaccccaggtccgacgcttgaccttcctgggcctcaagtgccctcccctatcaaatgaagggatggacagcatgacctctgggtgtctctccaactcaccagttctaaaaagggtatcagattctattgtgacttcatagtgagaatttattatagattattttttagctattttttccatgtgtgaaccttgagtgatactaatcatgtaaagtaagagttctcttatgtattattttcggaagaggggtgtggtgactcctttatattcgtactgcactttgtttttccaaggaaatcagtgtcttttacgttgttatgatgaatcccacatggggccggtgatggtatgctgaagttcagccgttgaacacataggaatgtctgtggggtgactctactgtgctttatcttttaacattaagtgcctttggttcagaggggcagtcataagctctgtttccccctctccccaaagccttcagcgaacgtgaaatgtgcgctaaacggggaaacctgtttaattctagatatagggaaaaaggaacgaggaccttgaatgagctatattcagggtatccggtattttgtaatagggaataggaaaccttgttggctgtggaatatccgatgctttgaatcatgcactgtgttgaataaacgtatctgctaaatcaggcttcaccgtcatcagcttcttttctctttctcttctttatgttttcttttaaagagaggactttgtgatatgcgtgttttatttgctagaaaacgttcatgtttgttagctaatggataactttgatatgtgggtaatttgtgggaatttttgttccaaaaagcaaggctattccaccagtaaccctatcatgaccttgctgcttgttgccacagtagataatgccaagtcaaaggcactgcctcacttgtggtcttgtaaaacccagcatttgcttcccatgccgggaaagcaccttgttttagaacaatagctttcaacctaaggtccctgttatcaagttcccatcctgattcctcagtcctgagaacccctaagccatttcttgcatgccatttgaaagaaatgtttaaatcaaataatattcaaaagtgtctaaccaacacttgaatgctacttttgtgcttagcctcttaacatgttaaaacaattcccttgaaaagcagtca

SEQ ID NO: 104356 - DNA, 1053 bp, Homo sapiens
taatccctctgggtctttagctcagcctacaacattaaggaaatcctcaccatcctaccaagatgaagagcaaaaggagttggtctagtgttagtggcaagagcaacggacgggaaattgagacctctgttctgttgtggcattctctataatgatttcgtttaacatgagttacaattatctttaaaatgccctttgtaccaaaaagtctccctctcataaaaaccatattgctgctcccctttactttgaagccccaaggctggtaagtcattatcttaaatggattgttcccaagtccaggatctcattcttagcacagacatggagatcaatttcacacagtaattagccatcttaatgaaataggactaaaacaggtccttcccactttccctgttcttaattaatagaatgacccatttttcagccacctaaagacctcacatccttaagaaccacttttgctgctaaaaataaagttggtaaaaaagaaagagcaatgaggacatttataatgaggccatttacctctttaattatgtgctttattagttggaatttaaaataaacgacttattaataaatgtttgctgagtgaatgagtgcatttgaaatggaatgatgtgtgaattgactgttttctcaagtgatggccctgacctcgcaacactaacttttgtagtgagtcttgctttttagggtttaattctttattgtcattttggttaatggacagtctcagggattgctgtgatctaataaagaactaaattttggtggtggggaagggagaggcactgattttaaacttttcattattcaaagaaaacattttcatagcataaaatttagaaaatacatagtaaagatcaaaatgaaaataagatcatcatgctttctaaagaaaacaattgatagtattccagcaaactttttgtgtacttaatttttgtctttcaagaatggaattattctgtatataccggggtcttcagatatggccctgggaataatctcttgtatatgtcttttcactatcctgtgtcgcag

SEQ ID NO: 104357 - DNA, 1170 bp, Homo sapiens
tgtcatttagtgattaattcctgaacctcttagtatgtcagaccgatgcaccttataacttaggaacagaaggcaaccatgtttgtccaagttttacttattctggcatgtgaaaaatgttgaatgcaaatagtatactaccctgcctctaaaaccaagctaccccagcagaatgtatacaaattgagacactacatggacatgtgtgtggaaagtgcttcctttaaaaagaacatctctgaatattttttatggtgtgaacagattgggggggagaatatcatgcaaaatcccatctctagcaaagtagtcattcataagtcagttccaagaatgtatatttataaccaaactagctagactggttacttgatgtgcttaattttaaacctgaactttttgaaaaggctcaaagggtaatgataaagaaaattaattcttcaatatcttctcaatataggattacagagcaattgaagaaatagactctgcctgaggctcatttttcagaatacgggaataaagttgttggatatgcttaatttttcttcacagaataacacatgggctgctcatgaataatctagagaaaacagatctactttttgagggctgcagataaaaaagctgagttctttagaagccgtcatccctcctcagtttcttttactttccagcggggctggtggaagtagtggtcaaaatgagaataaggttgtaaaattctaggtgggtttgtggttgggagatgtcattctctaccggcaagatgtgacttggcatttgctgtcagaatcagaaatagaatttttttcatctcagataaaagcatctgcatgcttggaagggggtgcacaaggccttagaatgctggcaagttgtgaatgtatctatctgaccatctggtgtggagctgagcgcttgttagctttcagttttagagctacttgtgtttcttctaaggatttacagaaaaattcacatttttcttttcaccaatcccaggctttatcctggatgttgcccttgctctaatgaaattgttctcattttaggtttctctttgtcccagtggcctcctttgcttcctcatttgactgggatataatttaacagttttgagaactaaaccccaaatccttagacaattcatactccataattcaggtc

SEQ ID NO: 104358 - DNA, 1050 bp, Homo sapiens
gagatcgagaccatcctggctaacagagtgaaaccctgtctctagtaaaaatacaaaaaattcgctgggcttgctggcacgtgcctgtagtcccagctactcgggaagctgaggcaggagaatcggttgaacctgggaggcggaggttgcagtgagccaagattgcaacccctgcactccagcctgggcgacagagcgagactccatctcaaaaaaaaaaaaaaaattcttatagatatacaccatttaaatacatatgtatttgtttgctgtgaggctttatgatatgaagtaatactttttttgttaaagatttatttacatataagtctttattttggtattctggcaaatgtatttgtttggtaatccaaatggaagttgaagacattgagatttttgctgcatgtactgagttgatatttttctagagttgatgttagtagctaacatcagcctgttctgggttgctttgaggttgcagctgctccctggtggttacctgtgaaaggcgctaactggagacacccagaagggcctgactctactattctgcacaggtgaggctggtccctctttccccagttgacaagttccattgcaaaataggtaccctttgctcttgcaaaagaactcagtgggcatcttcatctataaaatgataagaatgacaaactgtaattgattggtaggaaaataagatggtgggaaataacgtatgtaaagacccaaacactgcaccttgctcataagaaagctcttaattagtggcctctttctctcctcatttggcttgtcaaagagttgcctcttcccagtttccctgctccttttgagaggcctattccaaacctcatgacatgtttaatctttacattctgtttccattattagcgggtctatgaggaagaagacgtctgtcttatggataagtaattgtgtcctcccaggttgccactgtggaagcccaggccttgggtataggattcacatgatcttgagttccagattggaattctttgaagccaccatctaactggaaaaccacag

SEQ ID NO: 104359 - DNA, 1139 bp, Homo sapiens
aacagtgttatacaaccatcaacattatgcatttccagaactttttcatcattataaacagaagctgtatgctcattaaacaataactcttcagcctctggtgacctccattgtactttgagcctctgtgaattctcctattctaagtacctcacgtaagtggaatccttgtccttttgtgcctgacttacttcactcagcatcacgtcctcaaggttcatccatgttgtagtatgtatcagaatgtccttccttcgaacccctgctttcacttgttctggatatgtatggtgacatatctcttgacctgtcatttgtattcatgccttcttgaggtctgttatccatcagtggggtgtgttctttgacttctagtgatggaagtgagtctaattccttctgtgacaatttgctttctggcttaagatgtggtctgtgtgttcagcatacaactctagatgtcccactgtcttccaggtactatgccaaaatgtgaaagaatgccatttgaatatcatctatgggagcatttagtttttgaaagcagcagggctcagacctggtatgacccatttcatgttgtaaagtcagcttttccttggggagagaacactggccccgtcaacagggtgaaggtgggttcacggtaactgagttattcgggaagggcaggccagggctggctgactagatgagataagaaggtaacactgtcttttgtgtctttttttgaaaagagtagttgttcacttgacttaggagccagtgtgtggcataagctcaggaagcaaaacatgataaccctggaaggtgagaacctaatataataggataacagggcacacaatatttttttctaacctgctccaagacacctgatctgaatgagtgtgtgtgaggcatgctggggtcccagaggtgcagatttgaaatacctgtttaatgtgaccttaaatttcttttcatgtcttggttcttttgaggcctaacttagattaagaggtaacaatgattctgatgttccctgcccctcgaatattggactctgtatcgtcggcctctgtgggaaaacaaaggtaaactgttgagtagagagtcatgctgagggatgtctagctttaagagaaacttatgcaaaa

SEQ ID NO: 104360 - DNA, 1032 bp, Homo sapiens
acttgagcccaggagttcgaggtttcagtgagctgtgatggcaccattgtactccaggctgggtgacagagtgagaccctgtctctggggagaaaacaaaacaaaacaaaaacaagccatattttattttacactgaaaccatgatcccttttgaaggtttgggcatatctttttttccaacagctttattgagatgtaatttacataccataggttttaccatactaagtgtataattccatattttttatatagtccagtttcacaactagaaagctgaccattgatacaactcacttattttggggttgtatcaaaaatttatctatatcattacaatctaattttagaacatatctatcagccctaaaagaaaccacatgcccatttgtggtcattaccgattcccatccccagctttaagcaactgtcctgagtcctagcagtgcttcagtcctagtagtccttcatggcttcatggcttcatagctttgctttttgtgaggccaagatctgctccctcccctacccctcatccttaaagccatttctttaagaagctctagtatcttgtagtagaaaacagtatttcgaggaccctgtctaggccctgggtatgctcattgctattaggttggtcattgtttctaggcctctgcagtggacagactgagataaaatgccaaaatgagtatacactgatacttccattttgtgatttttagtttaacctgttctgtattacatctatctcctttcttccacagcaggaatactggttttcaaggacacaggggatgatagactagtctataatcacgcatttattttatcccaggttacatacacagtggtctcaataatactaatgctaccatccccagtgtaattactgagaataggtttttaaaactcccaaacatttatatatgcttttcctgtttctcccctagttttaaaatactgtactatttctgtattattgaaacatatgtccattatagagagtactctttccattttagctctca

SEQ ID NO: 104361 - DNA, 1108 bp, Homo sapiens
gaatctctggtgttggggagcagcaatatgtagttttaaccagctgattacataatctcaactgcacaaagcctgagagccactggtgtagtagaattgcagagagccaagggcagagctctggggagcagcagtgtttcagtggctgaaacaagagcccacatattttaggagatgaataagaacactgacaaatgtaggaggagagtcatggttaccaagggacaaacgacctaattttcagaatagggttacatgcaacaaaaataatcaggtggatgaagaattgagacactaatgttaaataaaatcattaaaatacagatttccatttgatgcttgaattggccagttgagatttataagcacatttgaccccttagtggaactagaatgtgtcagaatgtgagcaaacagtgctatttaattcgtttagctagattcaggacaaaggacaaagattgattatgtaatctcacacgtacagaatactatttcccagagtcatttgtgatacttggggaaatgtatttccttcaagaacagtcacgttctcaaaagctaatcttgttcagtctgcattcttatcagctaagtgagtcttaaacgaaaatggtctctgtaagtgacattaatttaagaggaagccagagacttttaggtcatttctgagtcctctgggaagtcataagaaagactcaagttcaattggacaagaggaatcactttaatagtgtggagagaaaagggcacacatgcaacacattactacaaccttttctggatttttatttcctaccttccttataggctgagaagtttggcgactcctttgtctttgaaggcatgttgagtgagcaagtgaagaccaatattcaacaggcagtaagtaatgtttcaacaggctcctgtatttctctaaggctcattgaaaagggtttgggtgaaaaatccaaaccacatgtgtcaccttcctctccctgtaacacctaaccattctcctgctgaggattgaccccaaataataggcccatggaccaggacaccttatcttaaggaaaatgggacaagatggtatctgaggaagtgatgggtctgccttgagttt

SEQ ID NO: 104362 - DNA, 1044 bp, Homo sapiens
gagccctgatcatgccactgcaccccagcctgggcaaaagagtgagaacctgtctcaaaaaaaaaagaaaagtgggatattctcgctacctctgcattctagccgttagcggcttggtgactgttattccagacctgtttccagtgcaggtacagatttgtatcaagtagtggtttgattaaggagattaccttcttaaagaattttcacttctttttgagactcgtgattcaccttctttggggtatagagagatttttccgaattttacagttattactgtggtgaagatttacaaacttgcgtgcttcctgggtgctaggaactttacccctacacaggtacaccttggctgtgatgcatgacttcctgtgtttcacctttcattgtagatggtccccatccctgctggagtatttacaatgggcacagatgatcctcagataaagcaggatggggaagcacctgcgaggagagttactattgatgccttttacatggatgcctatgaagtcagtaatactgaatttgagaagtttgtgaactcaactggctatttgacagaggtaatgggattggggaaaggagggagaacttgttcttttccagaacttttaagaatgctttaatagcagctaagattgactgaccatttttactgcattctgtggcagaactgtgtgaagcattttattgtatatatttcatcttaatttctcacagcaaccccatgaggcaggttatttttcaggtggcatactgaggataagaaaagttatttgccccacatcacacagctagttggtggtagagctgggattccagcctggccagtttgacctcagaacatgtgctataactattatgctatattgtgttaatgcttaatgtgtcagagaataccactgtccactaaggctttttgagataacagatggcatgtaaagtaagaccacttttcttctcagtaagttgcagtttgtttttttccagaagcatttcatattttttaagtgataaatgcagaagtgcagcttttcattt

SEQ ID NO: 104363 - DNA, 1909 bp, Homo sapiens
gcggtggctcatgcctgtaagcccagcactttgggaggctgaagcaggagtatcacttgaactcagaagttggagactagcctgggcaacataacaagacctcgtgtctactaaaaaaaaaaattagcagggtgtgttggtgttcacctgtagtgccagctgcgtagaggctgaggtgggagagttgcttgagaccagacgatcaagggtgctgtgagctgtgatcacgcctctgcactccagcgtggggtgacagagtgggactccatctcttaaaaaatatatatatatatatatgtatatatatacacacacacactctcacacacacacacacacacacacactgtgtgtgtgagggcacatgagctagagggatatgcaggcaggaaaggcctcctggaggagctgatccttgaaccatgacaatatttaccaagagacaaagtggtttatggaaatgcgggtgaaagacagggcaagagagagtgtgagagatgagctctgatgtttatatatgttattctgaaaggcgataggaattcctgacagttttaagtaggaaagtagtatggtcagattgacactttattttttaaaacaggtagtatatttacgtggtttaaaaatttaaaaacatatagaagagtatatagtgaacaatttctcatttacccagtaactttcccctcagacaaccactgcatgcatttcttatatatttcctcagagctatgttctgcaaatataagtaaatacaaaaatagtgtacctgtatccctcaacctactttcacgctaatgacagcataccatacttagcatttgtgcaccttgctttgttcttgtagctcatcatggtgagatctttccatatcaatatatcaaaagcatccttttttatccccctcttcttttttctttcctatggctgcttaattttccattttattgaaggcccacaatttacttaaaatgagcctgctattgatggacatttagattgtttccagcccttttcagttggaaaattgcattgggtacagtagactaacattttcagaaggattagtaggggcttaaatatttgttgaatgaattattgaatggaagatagatgacttggaagcaggtggggatgtgaaaggagactgaagacaggaacaccaattacaagggttctgcagttatctgggggtagaaaagagggagagattagagagatacatatttaggaaatctagtgagactaggtggcctgtgtaatattgggagtaggggatgtgagtagtcaaggttgatttcttgggatagtagtaatacattagacaaataaaaacacatttattactaatttatcataaatgaaaacagcaccatttttattgggaagtacacgcatagaatcaaagcagccaccagcaaggaaagccagtagaaatggaaagtagaatcaatgactgtggattcctaatttctgtttcttctgatgttatttttctaatgcttctgcccgtattgctaagtgactctctttttttccaactagtccatctctccttgacttcttttttttcccctttctaatttgagcccttgttttttaaaattttatttttaattgacaaataattttataataatttgtggggtacaacgtgatgttttgatatatgtttacattgtggaatgagtaaatcaagctaattaacaaatccatcagctcacatacttatattttttgtgtggtggaaacatttaaaatctattttttaataattgcgaaatatataatgcattacttattatagtcaccactctgtgcaatacatcactaaagctaatttcttctatctaactgaaattttgtaccgtctgatcaacatctttcctttccccatcttcccctc

SEQ ID NO: 104364 - DNA, 1044 bp, Homo sapiens
agagagatcatctcccactttacagatgaggcaactgaggcttaaaggaatcatatagctcagaactgcaagaaactttgaatgtcatttcatctatgattagtgtctgtctgtagaggcaggagggtgacagaatggtatagataaataagccctgtatagatagataaggcaggagtttgtggacagatccagagagcatgcttctcttattcacccagctttctcatgaacctttagcttattttattttattttttattagaggggactcagaacaagagcctttagcttttaatgttaaggttgaggagaggaaagaaggaaaaggagaagttacacaaaaaagttacgtatgagctgattctatttttgtgtacaagacaaaaatcttacggtagcaagtgaaaaaaagacaagactggcttaagcaggaaaaaactggaagggacatttatagctcccctagttgggaagttcaagagtaaatatggccccagacacacctggatacagggcctcaggcagcatctccaaggcctttctctttggctatctcttggctcttctgcatagtcggctccattgtcaggtaatgtcccttctcctactgataagataactagaagagaaaaagttctttcctggtagctccagcaaaagttcaaagatgaactttgattgggtcttgggcctatccctaattacatctccgtggtcaaaagaatgctatggttggccaggcttggtgggggttgggaagtaggatagagtcatccagtacccctgggccacttagaaagcttaagaaatggttttggaaaggaacttcagtattttacaagaagtagagggattgggtgccggatggaccaaaatagcagtgcccactgcacatggcctaagtgtgtagcccacatatggttctgttattccaatgaataatagagtcattctttacttcacttatgcttctggcttgagtggcagtggcagaagctgtggtgtggcagggaaggggttatctcaccttcagattggagg

SEQ ID NO: 104365 - DNA, 1190 bp, Homo sapiens
ctcgctgctgtgtggagcggcagggagccaggaggccgggaccggtgcgggcgcggggtcccttgcgggttcttgcggctgcggcacgccccagcggcctggcgcccatggcagttcggcagccgctcaccgatactcgcgggaggctaacgctccgggccccgtacccggagagcggcaactcgcgcactcaaaggtgctccatcgattcctccgaggcgggtgggggctgctcggttcctggacggggttggagtaggcaaagcaaggcactagtaggaagggaagtaaaggttataaccacaccccaaatcgagcacctgctgttcccgtatgaggagttccttctccgtgcctcaccggaagactccatttaattgaccattagggagtttggtttgagggttattgttacttctttaccccctatttctttctccctccaacctgttctcttaatgaggatctcataattttaaggcaatcaaattatggtttaaatcaccatttcctctcttattaacggaataaattaggatcctgggtctcagtatcttcaccagggttgttgtatacttatctgtagtctcctcgagtacactctgcttgaggacaagggcttgaattgtttatcctgctattcttagcactttagcacttaggaagggctaagcaaactgtagttgttttattgctattatttatctgtcttgcttagcgcctgtatgtgttaggtgccgggatatataaataacttactggccgggcgcggtggctcacatgcctgtaatcccagcactttgggaggccgaagcgcgcggatcacgaggtcaggagttcgagaccagcctggccaacatggcgaaaccccgtctctactaaaaatacaaaaattagccgggcgtggtggcgggcgcctgtaatcccagctactcgggaggctgaggcaggagaattgctggaacccgggaggcggaggttgcagtgagccgagatcttgccactgcactccagcctgggcgacagggcgagactccgtctcgaaaaaaaaaaagaaagaaagaaataactgttacttcaatctgtctgcccggtattttgcatattgatgtgttgtcgaaacaacttatgggtctaaaggtcaggtcttctgactcctaaactagtgctccttcttgtttacttagcag

SEQ ID NO: 104366 - DNA, 1018 bp, Homo sapiens
aaagtgccccacccagcacaggtagtaaggggtagaactagtggcttattttgtgaacgcagtagtttgcaaaatgtatggattagcatcatcttggagcttgtcagaaatgtgaatttttgggtcccacccaagacgtactgaatatggtggcatccccagcaatcattgctttaagaaggcccctaagtgagtctgatgcaagctacaggtttgcctgacccaattgcaactgattggaccagaaatagctacgtgactcaaatgcagctaaagcataggcttcctattggtctatggtgtcttgtggtgagagaaagaggagctgggcaaaccaggcttcccctttgtggcaggtgaatggggaaacagtgatgctgaatgaggctgtgcagtagcattgaggccatgaagggtcaggaacatgctgggaacgggaactgtgactaagcagaagctgtgaagccaaaaacaacaatgacaaaaagacaacgaggaggggggaggaaggcaagccaactggaagagaaaaaataagtgtgcagggaaaagcagaccttggagagctggggagtgaaccaggagagcagcagagtgaagttcaagaaagtccgctgctgaggtcccagagctgctgcagcctctaagccaactcctggttctgtttttcacaatgtgccagtgccttctgaaactaatctttctgttgtctgcagcttctgtcctgtgtattcttaaaatgtatcttttctttgcattttctttaaggaagtctttccccatgccctccacccccaccccagtgctttcaaggagtggggaaagtaagaccagaagcatttgaaaaagaaaagggggcggggcgcggtggctcacgcctgtaatcccagcgctctgggaggccgaggcaggtggaccacgaggtcaggaaatcgagaccatcctggctaacacggtgaaaccccatctctactaaaaatacaaaaattagccgggcgtggtggcgggcgcctgtagt

SEQ ID NO: 104367 - DNA, 1062 bp, Homo sapiens
aaataaagacacctcgcgcctttaatccttgaccgcaaacactggcgtttttgtgccccggatttctgaaattcttggctcggggaaccaaggcagggggagggtgggcttgtaaaaacttcccaaagcagaaatccgagctcctagcccctccccggccccagtgacacctggattccagggaaggggggcagccggaggagaggcgtccccaagggttgcgggcgcttcccaggggtgactttgaacggctggctccaagccctaccgaccccagccaaggaacaggctcagcagcctgaaagcctcgcaggacgcccctcccctgtccccgcacgcgtctatttagggcccagcccgggcgcccaggggattctgggacttgtagtccctccccgcagcctcaggcgccgccacgacccgctacttggactacattgcccagggagcttcccggcctatataagccacccggagccgctttaaagtgcagtaaccatgtggatgtgctgctgaagcgtttcctcaagctcgctggggtgggaggagaggaggaggaggaggtggtggtggaggaggaggcagggggtggagagagagaaagcgcacgccgagaggaggtgtgggtgttccgcttccatcctaacggaacgagctccctcttcgcggacatgggattacccagcggctgctaacccctctcctcgccctgctcccccaaaccggcgtggctccccgggcaccaaggtagcggctggggccgggcagagggcgcggggagttggcactggctccccgggcgcagaagtttttgccccgctctcggggagatcttgatggatgtgcatgcacttggcatgcatttgggggttcctttactgcgggcagttgttttggggggagctcatttgaagcttaaaaaacaaatatcctctactctagtgcgtggctttgggggctccccattctggtctgatgtggcattcccccaagttggaaactgttgctgcagctgcaggaaatagttctttttttttttttttttttgaagagaggttgtgg

SEQ ID NO: 104368 - DNA, 1055 bp, Homo sapiens
agatgattgctaatgagaataagccagatacaccactgaaaccgtcacccattcaactttgagatttctaaattggatgtagtttaaggcacatggtgtggtaaatctatttaacagactctaagacctgttcaagttgtgtgcgattcaaatgttttattctttattcaacaaatttcttgagcacctgctatgtactaagatgtattccaggtgctcaggatatagcaatgaacaaaccatcccgttcccaagaggcttacatctcagttggtgggaggcagccaatataaataaacaagtaagtattatagtattagaggtagtaaaagctatggagaaaaagaaaactggttaaagggggaacagaaaataacaagtggagaaattagatcccttgtgcattgccggtgggaatgtaaaatggtgaagctgctgtggaaaacagcatggcagttactaaaaaaaattaaacataaaattactatatgtcccagcaattccacttcaaggtatatactttaaaaaattgaaagtagggacgtgagcagatatttgtacacctgtgtcagtagaagcattatcacagtagccaaaaggtagaaacaacacaagtctactgatgaatgaacagataaaatgtgaaatatacatacaatggaatattattcagccttaaaaagggaattctgacacatgctacaatgtggatgaaccttgaaaacatgctaagtgaaacaagccagaaataaaaggacacatattttatgatttttcttatagaggcatctagagtagtcagatccctgcagacagaaagtagaatggggattgctgggggagatagaagacaggaagggggagttagtgtttattgaggatagagtttcagtttggaaagatgaaaaagttctggaaatggatggtggtgatgtcacacaacagtgtgaatgtacttagtgccactgagttataacatttcaaagtggtatattttatgttatgtatattttacagtaattttaaaaagcaacaaaacatgatgaggggtatta

SEQ ID NO: 104369 - DNA, 1012 bp, Homo sapiens
ttattccactatggaatacagtttaaatggaataaagtgtaaagatgaatatttgcagagcccaaagaagtgctttttagttttgtaaaggctcttcttttcagatagtgactcctttataatataagcaaagaccaaacctcctgggctgcctatctcttttctttgaagcagacatttcctattttacattgctgtatgcatttgaaaattataaattgcataaagttctataaatcagatttttgctcttttgtgcttttttcccaatctttatacaacttttaagggtataaatatatttcataatgtactcatttgattatcttctcccgtctcctcctacgcctattgtctagaagaggaaatgagaggtgaaatagtcccaaaggcagacagaggcagaatggagaatcaagatggttaactccaaaatagttacgaatggtctatattgtctttgtgtagaaaggagtagtgaggccccggggcggcattgttgaatttggcaagagctggactcaaataaattgggggaaggaagaccagcagcttctccaagaacctcatttttacagcagccagaccttcctttcaattatagctattatttaaagcatgcttgtttcctggtatttgtgcagaatgagtattcctaggctctcatgcaggttactccacactcagggagcaaattattatagatacagaattatagctcaattagacttgtgctcccactgtagagagattttgtttcaaatgtcatccagtgaaaaagaagtcatccatggctgcctgatcaccagatccagtgactttctacatttgacctctctccattatggacctacccttaacaatttatcttctgtggcttttggcaaagaggcctccttctgccctgcctctgactctccctcctttcttcatggttggctccttcctgttttcatcgtctatggttgactcttttaccctcttcttcttttcagtaatgacagcaacagta

SEQ ID NO: 104370 - DNA, 1068 bp, Homo sapiens
gacaggattttgccatgttggccagaatggtctcaatctcttgacctcgtgatccgcctgtctcggcctcccaaagtgctgggattacaggtgtgagccaccatgcctggccatggcttgatgatttattaacctagccctaccttggattctgagcccaccctgtcaagcattatgttagctctgggggcattactatacttacaggagcttaaggtggtggttttatatatgtatattctgctcttgatttttacatgagaactcaggccattggctacactgttcttcttgtttatacagtgaagtcttgtgtcatgaagctgaaggaggcaaactgctggtggggtaccatggacactttgatttacccaccaaatagatactgagctgccagccttgggcatcttctggccttcatggagctggtagcctggtgcccctttggagtctcagtcagtgaggttgggaggacagagaaggagaggcagagagtgtctggcgcaggagaagcttggtcgggggggctttgtggagaaggtggggctcttaccctgagtcctgaaagacaggcaggacttgaggaggcaaaagggaatcttggagaatagaacagtaagggtcaaggctgaatatttaatggtaccttgcatttgggatgagaggaggcagcacagatgaatggaggaaccctggaaaaccatggtgtgttagctgggaacaactgcaagttctgtggtcacttggaagattagccagttctatcagtaccagttttaggagcttggacaagttgtgtaacttctcagagtctcagttccctcatctgttcaaaaatatatttttaagtggttcttctaaaagaattgtgcaagttagacttagcagtcaggactttaaatactgagtctttatgtaatgtgagcttatttatttgtaattttttgtactttccccactagttgcttttgatgctccacagtcctttcatatcttcatgagtttgtgctcatggttctttccacctggaaacgctcccctctagcctccaacatctatttcgaatct

SEQ ID NO: 104371 - DNA, 1423 bp, Homo sapiens
ttaactgggcattgggatttttgaaagcttctcaggtgtttctcttgtgctgccaaggttaagaaccatggctaatgaaatctaggctaataaaacttgaactttgttattcagggaagagctgatctaggtttcgcttttgcagctgggaccaaggggagggatatgcgtccggaaggcattgcttgggtccagcgtgagctcttatcttgttctatatacgggccttgggagctgggagatgaacctgggagagattctaatgtactgtacgaagttaactagtggctatttgttttttacaaatacatgcacataatttaaaattttgttttttaaatcgacatatatttatggtgtacaacatgatgttttagaatatgcatgtatagtggaatggctaaattgagttaattcatatatacattacctcacatgcttattattttttttggtgagaacatttaaaaactactcttagtgagtttcaaatatacggtgtattgttatttgctgtagtcactgtgttgtacagtagatctctggaacttattcctcctaactgaaatctgtatcccttggccaacctctcaatcctccaccccagcccctggtgaccactgttccactctctgtttctaggagttcaatctttttagattccacatataagcaagatcatgtggtattcgtctttctgtgcctggcttatttcacttagcataatgtcctccgggttcattcatgttgtcacaaatgaaccagggactgtttgaatacagggttagaatgttaaaaataaataggactatagcaggggaagtcggaggagacatgtttttctggcacgactgtaaaggtgcctggtgcttggatgtatgtatggtggctgatttgaagtgactgttttgagataacggtaatagtctgacagaagctatttggaaggaagcaaactccttttacagcctggcctggttctacaggtggtcacgtgacagtgacttgatttgttgagtgcttttctccctaaattaaaaataaaggtttctgggttgtgagatgcttcgtccttgtgggaaaatctggttcaaaacaagctctgctgcaggctttgggaatgtaggtcaggacttccttaattccatgtgctaaaccagaggtcccctgcacccaggtgaggggcctaggcagctctgcctttgcaggctgcctcagtgctggaaagatctgcttctccaccgtggaacttgggcagtgagttttaaaaaattttccaaagcattccttcaactgcggtgcagcatactttgacgtttttttttttttttttttttttttttaaatgaagagaaagatctctcttttggaagcaattgctgcgtttccaaatataagtgtattttggagctgaagtcatttt

SEQ ID NO: 104372 - DNA, 2072 bp, Homo sapiens
gaagaaaaggttggctgcacatctgtttcacataagccacatctttttcatctgaatgaattttggacaatatcattgtcctcgtaagggatgaggagagctgagacttagaataatacagcaactttagttcttttattaatatggtaccattttaaagccccaacatccatggaaggtaaggcagaacctcctcttctccctgatttgtgttgtctttgcccataatcttgaaagaatagagaaggcaaacatcagattgaaacagggaatagaaactttgtggttagtgaattcctttatctgtattatcttttcctcttcccacttttaccagtccctcccccagctcccccggtgctaaatataaagatatctacaaagaaaaggtggaaactaacaaccagtcttcattttgctcccagaatctctgctctttttaaatataaatcacctccagggttgttggagtagaaacaagggaactgggcttttgggcaattagataggctttagtgttgatcatgccattattgcataagattcgggcaacagtcaggctcttgctttcaaaacctaatcttctctgttcacatcaagaggccagtcatggctccaaattcttgatgttggacagatgttaccatatcaataatatcaaaatgtgcagcttttaactttgcagggagccccttagtttcagaataaaagctgttcgaagggaaacttacagttcaaaatgaggagaagttggggcaggaaaaaatgaggtgaaaggaatcattattctatcactaagtggttcatatgaattggggaggggatcagacagactgaatatgtggatgttccagataagtatcttacatttctctttcccagtgaagttggtttcaagcatcatagtctaatctaagcaaatgtattgtgaaaaatgagtgttgacctccagcgctgaggccctactgtgtaccagctgctggccttggtgatggcaggacaagatgagttacactccttcttgctttcaggagtcttagagtttcatggagaaacagacccacattataagttacaatagccaatgttaatacagcatttattttgtgcaaagcacttcctttgaattatctcttttaatctgaggaacccacctatgaggtgtaggtcttgatgttcccattatgcagttgaggaaatggaagctctaagaagttgggtaacttgcccatagtcagttaaatgtcacttcttagaatgattatcattcatttcacaaacacttattgggtagttcccatgtgccagccatttgtactccatgaggaaagagacattctcaaagaagtctacatcaatatgtagtgaaaatctttaagaaacttctttagagtaatttgttgtcttcactgcaactatttatatataagtagaagcaaagcaggtgaaatttcttcctacctagtataaaacctggcctactggggaaaagtaaatgaggatgcttttcatgtcctaatctttcgctgtgcagcaccctgagaccagagcgcatctatttggtacctgatgccatttgagatgacaagttatgagctggtccagtgccatgtgacttatgagtgtcgtagccagagccctcttccaaaggctgggcccagtgcttttcttcctttgtagttttatggagacaaggtctcactctgttgcccaggctggattgcaattgtgtggtcatggctcactgcagcctcgaccttctgggttcaaaccatcctccttcctaagcctcccgagtagctgggactacggacataccccatcatgcctggcttctttttaaatttttgtagagatgggggtcttgtatggtgctcaggctggtcttgaactcatggccccaagccatccaccaccttggcctctcaaattgctgggattactggtgtgagccactgcaccctgccacacttaatgcacttttagccattgccccaaccagctgtgggatgcgcagtatgttacttacagtaggatgagtcctgtttgtagtgcaaacgagggtctggcct

SEQ ID NO: 104373 - DNA, 1040 bp, Homo sapiens
ttcaagctatgagatgcatgtctgaaggctctgggtaccctgaaaatgagcataagggaatttgtgtttactttgatgccctggatccattcttttttgcatacctgagtcaccctggaaagtagacctcagacccctcttttatagtcatttacccttatgatttagttgctaatggagaaccattttcactatgtgcataaaatgcttctagtgcaataaataagtttaccttgtcctccaattgaatcactgtattgcttttgtgacttcctccattgagggtgaaattgatttggaaatctcagcaagcgtaatggggtcatattgtcatattgtcatattgttatatggttctcctgaaagcagtatactgtggttgattacggactttttcttttggcaaagggttttataatcccgtcttgagcattgatgaagatgtgtggtgaatcacttgagcttatgataactcttttcctttcttgtttgacatgtgagaaaattagagggatttagaaagtctcctggggtcaaagagcaatcctgtgccaaaactagggttggggcacaaccccagtttctactcacactgtcttttaggcttctgtgtttgagccatgaattaaaaattttttttggttccatcaccctgtgtaattaatgataacctactttttataaatgcaaataatagtgaataccttgtgtagtgctaagagacattagtgaatataatctatttaattaatatactttacatacactcatttatttaatcctcataacaaccccataagtaagaccggtacctttctacagatgaggaaactgacatgtaagatgtttagtgtctggtccaagatcacgtagctagaagtggcagagctgggatttgaacccagtcaatctaacaccataaatcctcctcttaacagctactctaaactgcctttagaagtggactggccttgaaatattctttgacaaaaattacccgatttcttaacttcctcctctgcaaccccaaagtatgtcat

SEQ ID NO: 104374 - DNA, 1050 bp, Homo sapiens
taggagtttgagacctgcctgggcaacaaagtgagatcctgtctctacaaaaaatgaaattagccaagcatggtggtggtcacatgtagtccctgctacacaggaggctgaggcaggagggttgcttgagcccagtaggttgaggccgcagtgagccatgtttgcaccactgcactccagcctgggcaacagagcaagactcaacaacaacaacaacaacaacccctaaaactgtcttgtagttgactcgtcttctccctggaaagtggatcttattggtctcattctctgagagtgtcttctccttgactcctaatgtttgatcttttttctctctttcatgcctatagttttgagattccttggctgcattcagtacatgagcatgaaaaacaaataattgttaagtaccttcctcctttgtgcttggctttctgatagggtcatgcatgcttttgttcttgaccgttggagcacactgtgacatgggtactgttatgtccccattttacagttgggcaccctgaacccacagagggttagcaatcaaggtgtatctgggatttgaacctatgtctggaggaccacacagtgtctgccacttaagtgaattcacagagttgggctgctcagaaaacacttgaggcttctgatgtcctaggttccacatttcaaaggcatgttgcttcgtgggaataaagctaacgcaggggtaacttggaggctaggtctccattcgatattgaatgatgacgttttagattagctccggcaacaacatttctcaccaaagttgctgcacagactcctcacctgtttctgtaattccacctttgcctcctttgtgtctgagtgtggacacctcctccaatccaccgtttactgcggctaggggaatcagcacaggtctgaagatgtcattcagctgcttggaacctcatagtggttccccagttgtgctcaggataaaagacacactctcagggttcccagcagtctgcatgagtcaccactgcttacctctcagccttatctgcagtaactcctcca

SEQ ID NO: 104375 - DNA, 1341 bp, Homo sapiens
gctcaggctggagagcagtgatgcaatcaaggcccaccgcagccttgacttcccaggcttaagtgatcttcccccctcagcctcctaatcctgagtagctgggattacaggcgtgtgtcaccacacccagctaatttttgtattttttgtagagacggggtttcgccacgttgcccaggctggtcttaaactcctgggctcaactgatcctcccactttgtcctccaaaagtatcgggattacaggcatgagccacggcaccctgccgagattctacatttctaacaagttgtcatgctcctgcaaggctctcgggagccactgactgttatcttcccttattttatggctgtcctatagaagacagatgttctgagcccagagcaatagagaatgagggctagtggatcaaagtgcccagaggtagaatatgaggcttaaaagaacttaattctgactattagtgctgagcagttactcaaagaagaggcctgcttcaaattactgagtttcccccgattcaaagagggctgaccatctgtcggggattttgcagagggaatttctgctctgggacagaggttagatggatgattccatttgactgtgtgtgttttcccaccgaaggacccagctgttctttctgtttttgcttcctgtggaagccctatggttgggagcgttgggtcaataaacagctggggagagcacagatgcactgtagacaagaaactctctggaaactgaatgggttcaatccaattggtaagagaacattagtggaaagatggcattattgaatgtttgaaaaaatgaacaaatagaaaaaaacaatagctttctaagtcaaggcttgccgaatccggtcataatgagtgggtaagatgtcctggggagacactacagcgtggtggttaggagcacaggctctggagtcagtcatgggttcaagtccctgccctgctcttactagttatatgaccacaggcaagtcatttaacctgtctatgccttagtttccccacctggctgccatggtgaataacactgtggagctgataggcttgtgtgaggatgatttggtgcatgtgtaacacagtaaatacctgcaatacagcctcagcactcagtgaagagtggctattgtgactgaatttgcaattagcagctttcgggacatctcttaggaagctcaaacatggcctttgccatcttgtaaaacatcgatatgtccgttttaaaaactcagccagtggagtatacaaaggaatccatagccaggcagactttagccttcctgaattttttagattttattgagtgggcctggtaaccagctat

SEQ ID NO: 104376 - DNA, 1688 bp, Homo sapiens
aaatgatgttgggctaggattctgataaggacacttgttggtgatctgctagatgactttatgtgaaggaaaattattttcttttttttttttttaattttttttttttttttttgagacggagtcttgctctgttgcccaggctggagtgcagtggcgcaatctcggctcactccaagctccgcctcctgggttcacaccattctcctgcctcagcctcccgagtagctgggactacaggtgcctgccaccacgcccggctaatttttttttgtatatttagtagagacggggtttcactgtgttagccaggatggtctcaatctcctgaccttgtgatccacccgcctcggcctcccaaagtgctgggattagaggtgtgagtcacctcgcccagccaggaaagttattttctctccaaaatctgggcattttaaagcaactaatttctagactcttgttcctttgaatgcctaatgtgtgattaagtggggccaacgtctcctagttctgagtacagctatatctgcctcccccaactccacaggccataagcaataatctgtatgaagattatgtaaaatttgacatctcttttcatctacttatcaagagccccagcagtagctcatgtttctgatagtggctggaaatgtcatcaatattgtgtgaacttagaaagctgtggtaccatttctggaatgaagtggcttccagattttgtaatttcaggacaaagaggtttctggtccttcattgacactcttctctgattttattatcacctgccctggaggctgcagaggtgcaactggagttcagtcgtttgccaggtttatcactgattggaaacattgctctgggttttcttgaacttctattgttgtatctctttgtcaattacatattgatacattttcttaatttcagttttatgatttcagctttttaattggactttaagataactatctaatagaattggaagggtgaggtatatttaagggaatacaaatgtttttgtttgacgtttttaccattttgcatgtttctgtagtggcatctcaactattgcaatggaaaatatgtccttggcaagactcttagaaacacagcctcaaaggtcattggattgtgcaagcttcttgactatttacaaggtcacctacctgaatgaatagaaatgctccctgcccttaaggaatttgcaattttatgaagagagatgagtgagaactactttgtggattattcttggagaatgttgaatcccagatgagcttttagtcccctgatgttcattgtttttatctatgccatcagatcactgtgcccaaataatttgaattcatgttaataatagcttacgaaaaatgcagtaagagagcttgctggaaaagtgacagcatgcattttaaattacttctagttgacctggctttcattacccaaatatccacaggcccttccatgaatatggataattgagttgatatttagcaaataccattgaagaggttagatgtgtcaggttggttgttggaatggtgaactagactcttgattttggatgatagcttaaactaacctaaacaaaagggggattttttggggtcaatcccagacgaacagctgaattgcatgaaggacaggagtgcagcaggggctcaggaaaacacagattcagg

SEQ ID NO: 104377 - DNA, 1019 bp, Homo sapiens
tttccaggagttcttgcctcagacagagctcgtgcaccgttcactctagctggtgttcctctgaccagtcagtagcaaatgcatgctctgccttcagccacagaagtccgcaagcagtagtgtcctttgtgttgtttcctcttaaaacgtcatctacttaaacaggttgtgaatctgtcttaaggatagacaaataatttaatggcagaggtgtagggtgatgattcaaattcagtgacataaaccaagcgctgggccaactctgaccttttttttttttttttttaatccctttgaatcatcttgtgctgcattctgatgaaatcttgacataccaccctgaaggaagtgctgtgtgaagaagtgtgggctcataagataggaccaggggaagagaggggccactgaaggcttaactttgagtgtttggaaaacaacactggtttaggagctggaggacttgagtcccagtctttggtttgtccctgactagcagtgtgacctccaataacgctcttgacctgtctgggcctttgctgcttcatctgtggcatgaacacgttggactagaaagtgaaacacagcaaaacttttattgagtgtctactccattcaaggcctgtgctaggcatgatttatagtacggttgtagttacagtctcttcactgtctcagattccctcacgtccctgataaactttaatttctcttttaggaaagattcggcctgacattttatttttattcttacatcttagttttaagaagcacatagatttatcacttacatttactcatatgaataaataacatatgtatttattaaagccacttagcaaaggaattaaaactttcttctaaacttaccattcatggaaagctgtaatataagcaatgaaaagaccgttcttcacatgtgtcttgtgttactgctcctgggcctcctacttccatttccctctagatgacatggatttgtcccccttaattgtatccaggcctctatggcttcaaaggac

SEQ ID NO: 104378 - DNA, 1106 bp, Homo sapiens
aaaccggtggaattggatttggttaattgattgtgtactatgtctcagtcagcattcatcttcagtttttcacctttgtactgcattcaaacatcaagtttgggttggttatacatttggatttccttttccacaatattttctagcaacatcattcaagaactcgtaaagtgaaaaggggtgtgcgtgtgtgtgaaactaggacattcttgtctttttagtaaatactcattcctttatttcttattgctctaatggcatgtgactttaatttggtctatttagcaactgtttaatttctgtcatgcagaaaacaaatttcagcaccttttcccgaagcccgtatgcctccttatgaaatgtacaggtagtgatgaatgaactctttgtcctgtttattggagttgtgccagtgacccttttcattggtcacttcagttcgttcaaggtgacatgaaaggcattttatttggggggatgtctcagtcaagtcaggagtttcatttgggggctaaatttgagggctagtaactaaattgaaaagccactagccctccaattttaatctgaaataactaatgaccttttaatctaaagtaacttcttagaaacccacattctctgtaagtcagagaaacaagtttccagtaagtgtttgcattagacacttgttccaattctcacctagtctgggaaccccattaagaagatctgggttattctcccttctcagtaaaaactgacttcttgaaatggaaggccgatgtgtgttcccatgttaccaaggagtcacttttcgggagggggggacttgtttttcttcttggtcacagagtgcaaacaacaccaggccactcttggttgtcaagttagcaggaaagaacttaagccctctccatttgttaatttttatgaattattagttaacatgaaaattgtagtgtgtaaatgtttacaaagaaacttctaaataccaatttgccttataatacatagtttaaataaatatgatgcttttctttttaaaaatagacaaatgcactgacaggggtatttagtaatcattgtttgcattttgtcacagaatgtttaaaattgacattgca

SEQ ID NO: 104379 - DNA, 2693 bp, Homo sapiens
tctcttctttttgaaacctggaacattttggtatctctgaccagatgaattttttcccaagtgccttaggtgctgtcttccatctgaaaagtggggctgccgtcctcttctggggaatggaaccaaagtcttgggttcttcatcttgggttttcatcagtagcctctggcccttttttcctcctagacctataacttggagtgctgagaagtaagaaattgtcagaattaactgtctctttctcttgggccatttctctgcatattctcccatggaggtgattctgactcaggaaatgcccccacatagtcggaacctttcgagggcagaaaagggaggaaagaaaaggacgtggatatgtctactaactgaaaagccaagggtggtttgttcttccctgccgccaaaaaacaaaacaagattttcttcttgagacaacccttcaatgcctctgttttctttagaggactgttttggctaatgaaatcaatgtctgcaggatttcctgtgctttcagtctctttctctatagttttaacattcccctgtcattattagcaagttgtctgctaacagcttggcgcatgccagaaagctattctcggtggggttaatttctggctattaaaagttctctgagaccccagatctctctgagcagggccatgttggggatttccagcacatgtgctgtttagactcaagggccacagcaagcttccccatctcacagcagaaacactgtaggcacaggtgacagcaaatgggcattgaccagtccgctgccagagcgcttggtgaccgtccaacccacagacgcgctgccatctacctaacggggtcgtgacagtgattttattgcgtgcttcatgaaaatcatgtagtgcctggtccataataaatgattgcagactattgttatcctcatgcctgggacataataaatatccctaaactgttacatgaaaaatagaaattccctgagagcataattaggccagttatctccaagttagatttcgttcatgggacaaatggcagacttttccagcatgggctgaaagaagtaaaaaaaagaagaaacactgagaggtaggaggactgcttgaaactaggggtttgaaaccagcctgggcaacatagtgagatcctgtctctacaaaaaattaaaaagttagcgaggcatagtggtacacacatgtagtcccagctactagggaggctaaggcaggaggctcattcaagcccaagcccaggaagtagaggctgcagtgagctatgatcatgctactgtactccagcttgggtgacagaggcagaccctgtctttaaaaaaaaaaaaagaaagaaaagaaacactaacttgttgaagattgagatgactccactaggaacaaaaatggttggtgaagaggaagaggactgagaatagaatagtgctgcctgcctttgtgtttacatctcacatagagctatcttcccctccccacagagcagatgtagctgaagtgctcatgtgtatgtatttgaggggacagcaacttggaagagaagataccagctgcggcatctcatagtggaggtttggaggccaaggcagggcttcagggaagtgccttttctgcaacatgtgttttgttgctcttattcttgtcttggtctgcttgtaacaacaacaaaaaagaccatctggagtctagaaggcaaaaataatgggaatgaagagatggtgttagaatcatagcagtatcaccgtatttatgggatgagttattctactggccctcacttttggtgctgagattgagatgtgaaatcatgaagcgattcagaaatgtgtccttatgaaaatactgtcttctgatagcttcagcatacagggttttttatgagaacagatctttctaatctctcagcgttgccaagaagtgtccatgcttcttatctagagagattattccatgttttaattataaagggttgagtagctgtttcagggctgacgttggttcttgctcatgaatcaaggtcacaacagagctcacccctggccttggccagggacttaatgttcattcagcaaacatctgccaaaccctcactatatttacagcatgtgttaattgtagtgggctagatacagataatactccatgtatatagtacttttaacagtttctaaaggcttattctcttattcacatgaagaatctgaaatcagagaagtcggcttaagttatatagctggtaagtcaacaagcaatagctgcaaccagtcgtatcttattttttgactacatctctgctgtctgaggcaaggtccctactctcaaatgagttaacttttaatagaaaagataatttgattgactctaacgaacatttattacatatgctctggaggttccatgtgaaacaggcttgtctttaatctaggtctcaggatagcagaagtaatcccatttgtatttttatctgttttgtttaggatgcttatcacagttctaatgcagaaattatttggataattctgattgtggaaaaaaacaaactcaaagtgctttttctagtctctcactcaacagcagtcaacacagatttctgtgacaaacggggtgggggaaattctccccatcaccaagcaagcaatcaattctgcagcagacaacagctgggtatcttctattttaatg

SEQ ID NO: 104380 - DNA, 1004 bp, Homo sapiens
gtgaggaaactaccttaggtgtttcctgagttaggtgacttagccaagattgtacaggtagttattacagagacaggactagaaacttggtcttcagaggcaagcgattgcttttggcagtttggtgtgtatctttccaggatgtttcctattcatttgaaggcatataggcgtatattaaaacatacatttttatgaattttcttaaacccgtaattattattctgcaatttggttttttcacctgactcctttcttaacccattttttgttaatgtcaatagcaaaataataaataaaccatggtatatccaggcaatggaatattactcagtgctaaaaataagtgggttatgaagccatgaaaagacatggaggaaacttactaatctacaatctagtttttttcagcatttgaggattattccatagtatggatgtgccagagtgtaatcagccattctctgagtgataaaaattcaaactatttattttttaccatcatgagcaatactacaatttacttaaaaaatttatacagctcttacttttgtgccccttgctattctaaatgctgtacaagtattaaccaatttaatccttgttactgcataaggaggcttgtctgtcttatagatgaagaaactgaggcaggaagaaattaaaccatctgcttaacatcatatggctcgaagtcaggatttgcacacaagcacttcagctccagggtctgtgctcgtagacactgcgtcgtgctgtgttttagcagtgagatccttcacctagctcttcattcacatgtgcaaatattaactatgtgatgggtagcatagaaatagaattatcaaagaaacattttttctaatttagttaaaaaactttattattattattgttaggtttgcaacaacattgataggaaggtacagaggtttctcatatgtcccttcccctactccacagcctctctcactagtaacatcccccatcagggtgcacagcct

SEQ ID NO: 104381 - DNA, 1045 bp, Homo sapiens
gtggggacacagccaaaccatatcactgtgtcattcaccaccccccacttttttttgtttttgctatgttgaccaggttggccatgataattcccttttgactgtgttcagctgggcctgcttttgatgaaatattttggctaaagcttttgacagacctctgagtagtaatctgtggctttcaagcttcaaggattatatatttctttagcacttggcattgtttgtaaactaattgtttgaggtttctttttctttcacattatttttgcagattttatacttttttcctatatcaaagttatagtgtagggatatgactcagaagccagatgggggtaggggtgttcccaattattctaaatgtaaatgtaattagagtttcatgtggatgcatacctcctttctaaaaaaatatggttattttagcgctcactataaattcactggtattcataaatttatggtgaaaccctctagttataaagtgagttttattacatccacataagctgctttttaaaacctcctccttcactttcttttctctttcctacaagaacatcatttgtcccctcagaataagtttagtaaagtgtttggaccattctcaaaccggccaacttctcaattcagtttaaaaaattggaacgtatgcttaagaatagatgttctgagttagaatttcttccatcatttgacaggtttaacatatctaagatgtagggggagaatcttaattggacatacagctacccaatagaatgcctgatatgatgaagagtttgaagaaagttaaggacatactaatggcaaatagtgcaaggaaaaataaaagcaattagaaactccaggaaaaactaaaactgagctaaaattgaaatgtattcatattacattatttgagatgcatagaaaaatatttacatggttataatataaacacaatcaatttatagacaaattacaaagctcgtggttataaaacagtaatgctaatcaacctcaatgatatgaaagtaaaaatatagacaatagatggtaa

SEQ ID NO: 104382 - DNA, 1445 bp, Homo sapiens
ttttaaacaaaattgtaataaaattttattgatggtatacacatacattagttattattttgtagagtttttaatgctcaatgttgatatcaacttcctgactactatttttaaagaaagaaggaaaaaccaaattgaatagtatctgttttttccttctttctttaaatcatgtgtttatggaataatccagaagcataagaggcgacttttgtgttaagcatgaggtgactttcatgttaagctttctctggaagaagagagaactggatttggactttttctttcaaggagaaagaaaaaaatgttagtcacattacagccttgaaagaatcttcttgaacagttctggaggaacagattaactttggtgcatgtagatacagtagttcagcctctgccacttaatctatccccaaggtctcatggagggaagaagtagaggtgacagcgacttattataacgtaactgagtggttagtgaatgttctagaactcctatcttggtttgattggctttttgttcatgttcttttaaccttttgaattttgctaaaagataggtgctttgaatccaggatcctagacaacttgggggccaatgaattgatttcaagatggccttttgctgctttgaggatgcaggctgatgacttaggtcctgtgttcattgattctgctggagatgtccatagaacgaggaggagaatcttgggtttaatgtctcctgatttatttttagcagctgacctggctagctgtgatttgctaattgtctgtatgtagtatatgtttgtaagtgctgagtcgttttgaataaatagtctcatatgaagtgagatgatctacttggcctagtagctgattctttctggaattgataatgacgagagtgaaattctatcttaacaagtgcagcagctgccctaatggagaaggacgacgtggaatttcccattgtctacctgtactgtcctaaaaatatacgaccaattccagtgactgataatgatattgagaccgagtggttaataatggctcaagaaatcccagcttgatttgaccagctttccagcttttttctttggcaggtggggagtgggggattaaatctgttgacttttgcaaatacataattttatagaatatgtgtcctaagaacgaaactcactacatttctaggttcaaacttacttttttgggtccaatgctcaatataggacaaaaaagaagaggaaaggagaaaataagaaagaatgtatattagttaactcagatttttggatctgggtggatttcggatggtgttaaattggcctggggacttctttattattttttttaatcgtagcattggtttgtaatattcatggtttagcctgaatgacttaaaggatttattttttaatttaacgtgggttaaaagaacatgagcaatagacctg

SEQ ID NO: 104383 - DNA, 1240 bp, Homo sapiens
aaatataaacagataactgtttgttttgctcaaaggtcacattgaggattcagagctcatgactcaggatggctatttttcttagaggaatgatttagacaagttgaattgaatagctcctaggccactgacatttattcaattttgtctttaacatttgtttactttttgaacctgtaaaacaggggtgtccaatcttttggcttccctagaagaagaattagaagaagaattgtcttaggccacacagaaaatacactaacaacagcttatgagcttaaataaataaataaataaataaatgcaaaaaaaaaatctcataatgttttaagaaagtttacagatttgcgttgggctgcattcaaagccatcctgggccgtgggttggacaagcctgctgtaaaagactggaatttagatacagctcatcaaaatatcttgctattctaaaagtaattctcaatttctattttttctaagaaaaattattagacagtaatgttaagttgcagcaagtaggtttgcattttggatagtaatagtcccaattttattaaaaggttggcttatgataaccatagatttcttaattttaattttatttattttgtttgcacatactattttactgatagtatgtgcaaaaagatagtgagtgaagcagttggactaattgtttacactaagattacttaggaaggactatctggcatgtttatattacattcagcaaattgtttatagtagggatcatttaaatatgcattaccaatatctcaggttttagatttgccaaccctgtatgttgagattttccaggatcttataattgcaccggctagtggttctcccttgaataaactgcaagactttgcacttagctaaaaatgactcacctttgaaggtggtacgcattcattaaaaaaaaaaaaaatcaagtgcgtgcagtgcactgtgcaccatgctaagcactggagatagtgttgagtgagacaaatgtagtctctgcccccatagaacttacattctagtggagtgagacagacaccaagaagcaaacaatacgtaatgaacaagattacatcagagtgataaacactggaaagaatataaaataaggaggatgtgatgcagcatgactgggggtgggatgggtgggccagcactagatagggcagttagggaaatcttctggaggaggtaacatagaggttgacacttacaagtttaggaagagctg

SEQ ID NO: 104384 - DNA, 1440 bp, Homo sapiens
aaagagcttaaaggtaaggaataggtgggtcagttcagccaagtaaggccagatagaattagagttgagagccaggtcagagttgagagtggggagaaatagccaggactatttggcccaggaagcctgaatggggacacatgcacacacacacacacacacacacacacacacacacacactgaaacactctgcaaaaattgaggtgtttcccaggttcctaacctcctgaatgcaatgcagattctttcctccaccttcccttcattgttcccatacaactctggcctgtaatcagcccaacctgggcctgggccttggccactactagatattctgttggcaccaagagtagtcaggaccagttttccctctcttaatttcctcctcaggagagttgagtgtttatcatattctcttcttttcctctctctttctctgttcagcttaggcaatcttccattctgcagtctttctcctagctgtgtatcttgagaggtaatgcaatgtaggttaagactgcctgagttgaatcctggcagtgccacttatgacttgaatgacctcaagaaagacatttaatctctttacctcagtttccccatctgtaaaatggggataataatacctatttcagtggaatgttgtgagagttaaacaagttgatatgtggaaagctcgtagggtgtggtctgtaatgtgttcaattagcattaattgaagagaagtggagtctccccttcaattcttacctgagtaacactggacaatttcatactttgttgtcactatttttctttagctcttactcttttttatccattcctgtagcactagtgatcaggataaaagacgtgattgctaatagagtaataccttgttgaatttgtgtaatgttccaggttggaggggggatgataaagcctaagaagaccaagtccttttttcttgcaactttaaattgttgtaggaaaggagacatgttgataatggtttgcagtataacatggaacatgctagactccaagtcgaaactgagattagagataggcgaatgaagatgacagtcaaccacgtgcggtgggcttgggggctgaggtgggtcatggagggctttataggggaggtgacgcttgagctagttttttttggtttcttttttgagacggggtcttactctgccacccaggctggagtgcatgctgccatcttggctcactgcaacctcctcctgggctcaagtgatcctcccacctcagcctcacgagtagctgggactacaggcatgcgtcaccacacccagctaatttttttgtacttttagtagagatgggatttcaccatgttgtccaggctagtcgtgaattcctgagctcaagcgatccacctgccctggacttccacagtgtgggggttacaggtgtgagccaccgtgcccca

SEQ ID NO: 104385 - DNA, 1103 bp, Homo sapiens
acatggcaaaagcaggagcaagagaagaatggggaggggtcacacgctcttaaacgaccagatctctagagaactcactccatccatcacctcccaccaggccccacccctcacactgaggatcacatttcagcatgagatttgggtggagacaaatatccaaactctatgaatggggcaggttctttgatgctctcttcaaggcgcatggacttttatcttgtagaatccagggggatcccatgaaagttttttaagctggaaagtgacatcattaaatttgccttatttttattttaaagaaagttaattttggtgacagtgtggaagatgtgtttccttatatttggccatataaaatataaaatttgatttttaaaacattttaaaacagtttctagtattctaacagtataacagtatgtttagatttataaacaaaggacattttatgtttttataagtcaactcatttttatgactacgttttcaatggaaaaatgaatattgagcgtcaacaaacaaaacattgtgtgacaagcttgtgcattgctgattctctgtgttggcctcatccataaactaaagcctcttaaactcaaatctctgatgccttttagaaatgccttttactttctttttgtgtagtaagagggatcatggaacctatgatctaaaaactgggaagcaatgatgccatgtgtctgcaagcataggtaacacagctgttttagagatgtctttaaaagggtacatgagtgttttgatatttgagaacagatcttccagcttgtcatgggagttgcatagttttagaaatcagtccttaaccttaaactttgttcacattgaactctagaatagcagtggtttttgaagagcagttgttgaatgcatttatgcatatttaatttttttgaatggctattaaagacctaagacaattatattcaggtttcaaggaaagaacttcttgtgggagtttaacatttttaaattgttggttggtggagggctggtatttactgatattcttgagttaatgagtcccaactgtaatagccacaattgtgctgcccttcactttggagaattgcgtattt

SEQ ID NO: 104386 - DNA, 1649 bp, Homo sapiens
tgtaacatgatttccttcatttttaaggtgaaataatactccactgtatgtgtacaccatgtttggtttatccattcatttatcacggggcatctgggttgcctctaccttttgacgattgggattagtgctgctatgaccatgggcgtgcaaatctctttgagaccctgcttttaatttctttggctatataccagaaccggaattactagattatatagtagctctacttttgattttttgaggaaactccatactgttttccattacagttgtttcgttttataatctcgccaacagtgtacaagggttctaatttctccacatctatccaaaccttggagtctttttttggcttctctatttcatgccctaatctagtccctcagtaaatcctcttgacttatatttgaaatatatcctacatctgactgcttcccatctatcactgtcacctttttctgagtcaccattggctcttgtctggactatgatactagtcttctcactggtctcctggtctcaatccttgcccccctacagtctgatctccatagaacaaccagagtagtaatttaagaatataagctacatattgtcattcctctgcttaaaactttctaatgactcccatcacacactgaggataaaattcaaagttgtttccttggtttataatgtcttaaaaattctcattcctttgcttgcctggcttcagacacactggtttttgtacttgccttaaacacactaagattgtccctgcctcagggcctttgtcctcgatgtttcctccacctgggtgtctgtattcacagacatttgcccttcacagaggcctttccaaacagccttctcttaaaaaggtactcactgtcaactttttctattctcttaccgtactttcttttcctctgtgcacttgccactttctgacatcgtagtgtatttatttgtgactttcttatggctgttttccccaagagaatgtaaacaccatgaatacagggattctatctcagcatctgaaagaatgtctgatactgaaaagatgctcaataactatttgtggaatgagtgcgtaaaataatattttgtagccatgtgtttaagcagctttggccatggcgacagaggtgccccatgtacacatggcgccttaggtggaggtggttgcccaggaaaatgctgtaatctgtctaccatttctagccaatttctccagctagaaataatttatgggctattattgttcatgaggtctaagtgggaaagtatagatgccttatcttctttttttttttttcagcctcttattgaaaaaaaaattcagggattgatgggaattatttgcctctgcccttttggccccagatcatccttcctgagtcttggctgctccttattacctgcagtcacatttcctgttgtaatgtgagggcaatgcttcgtttgcacaatgaatgccggaaatggattttaaagcattataaagcaaagccagaaattcctcctgcaggggagatggtcggttgacaagtctgtgaattatataatagaatctcctcttactctccttgtaaaatataccaaaatatcaaaaaacaatgggcttttcttcccagtttgtttgggatcatactggcatc

SEQ ID NO: 104387 - DNA, 1859 bp, Homo sapiens
gcagggtagaggaggaccaggcaaggtcagcaccttctgtgctacagagaggcccatgtgagtcttgtcctcttcagaaggcggtctgcatgatgaaacacatctgcagtgatgctgtggtgctatgctagtctctgtcctgacttcactccctggtgtagggttaaaaactcccaggaaaggcttctttgttcttcccagaccagtatggtgtatggtggttgcttttacatcagttttaggtgggttgccatattctccacgagcctcttttaggaatatttgggatggtagtggtaatctatattgggagccatctcaactcagtattaaatgagtctgggacaacaagcaacacccaccccattacaagttttatatgaagcaaacatctatttttgctttgtgcagactccactgtataaagtgctaaaaataaccaaatgctcagaaaccatttgtgatgcaaaaatgactgtagggggaaccgtgttgttttctgccctggttataactaaatagtgtacggcaggaattgtgcccaagaactagttttgcaaggtcattctgaggcttttctggtgttggagggacctacagttgtccctgtggactcaaaatgtcatcttgcccacacaaactgttaaaataatttagacaggcttttttcttttttattgcttaaaagaaatagtctgtttgggtcttgaagattttgtgagttttatttttttttaggattttttttttttaaaaaggaaaatggaaataaacagatcacaggttagggtaaccagaagacagggttgttacgcctttaaaaattttagcacatttcctaatgctgctgtcatttcttaagtcatgctatgtgtgagacttgaatactcggtgctcccgtactggcctcagtgttgttaccaagaagtgcatttgccagtcttatcaaactggcatcagaaatcaagctctgagctcagaggttagataccgcttatttttatcaagtaggcaattttcctctccccttagcatatgcgctttgggttctagacttgttcgaacatgccaaagaaaccgctggttaatttaatgcctagaggccatgttcctactgtgtctgtaggaaaatgtcctcccccacccccgccaccccagcctgagtatgttgaggagccagttgacaaaattgttagcatgctgtgaagggacggatggtcacctcctcttctccccacgcgtccatgtgtatgcactcagcctgttctccggtgtgggtgtgaagatggacatagtcttgtgtgcttctctattctgctgagatttgtgttatcagctccacacttcaaggacaaaaaaagatccaagatgatgagtggttgaccatgttgcatgaaaaggaagtggatagagaggattcattctggaacagactagcaattgactggacaacgtattctttctaagcctcttaaccctttgtatacatctctttatggctgtgaaagtgtcttaccatctgttagattttttctgggagatgattagctttcagaaacctaaatgactcaagggaagtgaaagcaatactagactttctagaaaaatgtatggaatgtgttctccttcttccagctctgtgcgtgcttcagggaagctgctgcctctgctttagtatgtctgtgctctttgggctggtggcacgttgtctgagacctgaagaagacagtggtgaaatctaaatcagaaccctaggcagattttccttctttctttcttttcacccaccagcctttactttagcaatcttcctctccaatatttatttaaaattttctcagcatgtacaaactcttggc

SEQ ID NO: 104388 - DNA, 1017 bp, Homo sapiens
ctgatgctgctggttcacacttctcatggttttttttttttttttttttgagtcagaatcttggtctgttgcccaggctggagtgcagtggggcaatcttggcttactgcaacctccacctcccgggttcaagcaattctgcctcagcctccccagtagctgggactacaggtgcatgccaccatgccccgctaatttttgtgtttttagtagagacagggtttcaccacgttggccaggatggtctcaaactcctgagcacaggtgatctgtctgccttggcctcccaaagtactgggattacaggcatgagccaccctgcccggcccacacttctcattttgagtagctggggtctggactgtgcattttgactgtactctcttaccctttcagtctatttagtggattgtgtctcacactggctggaatttgtggcttccaacaacctactggaggtaattgcccacaggataaagtgagaaaaaggagcaaaatgggaagatactgaaagagaaactgtctcaatttgggaaggacttgttaaaaagacaagcattgctaattagtagcttagtatctaatctttgtcactgaaggctgcaaatcatgcttcctggagtcttcttaaagacagcttctgcagaggttttaacacctctcatctgacttttgttaaatagcctgctggaatccaaaatagaagctgtgtagggagattctccctaagcatatttactgccaagcctgctctgttaagactgtattgattttcccccctcttggtatgaaattagtcatataaaatcacaaagtcctcaaagacatttggttcaatctgacacttgatgcttagctgtccccttaagcacccccactgagggatccctagaccttgctgcatatcagaatcattaagaggtttaagaaatgattttctattatataagaagtagatgcatacagtcttctcatattcttgctgcaaaggcttgttccttgttctcttcctgaccc

SEQ ID NO: 104389 - DNA, 1031 bp, Homo sapiens
ggtttcaccatgttagccaggatggtctcgatctcctgacctcatgatccacctgccttggcctcccaaagtgctgggattacaggcgtgagccaccgcatctggcccaagttcattaattttactcttcagatatttactatttgaaaactcagtatgtcaaaatgtaaacttttcatggggagtgtcaattttaaatattggtttcctagagtagttattggtttgttgatgacatatccctgtcagaaaaatctggtgaagcccaaatattagctacttgagaagctgaggcaggaggatggcttcagtccaggagttccaggctgtagtgtgctatgattgtctgtgaatagccattgcactccagcctgggcaacatagcaagtccctatctctttaaaaaaaaaattggtggctataccctaaactttctgtgtgtgtgtgtgtgtgtgtgtgtatttttaaaagttacaaacgtgtattattgtagtaacacattgtaggcaatataaaacaagtggaaagtagaaggtaataactcagattaagattaaacaataatgtaccctgttatttatgatggtttcatattatcattaataccttaaaacacatagatgctttagggtaatgttcatcattaaaaacaatattttaagtggttttagttatgatttttaatgtctggatggctttttccagatctgattagatcatcattctttttgctttacaagagctctaagggaagggttggttctgccttttttggtttgctgggttgcattactattacctttgatgttttgatttttctgcagaaatcttttgaagccacttgtccattttatgaatgttggttataccacataagacaatgtataaagttgtataaaccgaggcatgctaaatggaagcacatcgcagtgcactgagagtgaggggacaagggcacagactatctaaatgccagtttatatattttctttctgtgtcccagaaggtcatcttgcacacagtactcaaga

SEQ ID NO: 104390 - DNA, 1087 bp, Homo sapiens
agacagcgtcttgctctgtcacccaagctggagtacagtggtgtgatttcggctcactgtagcctgcaactcctgggctcaggtgatcctcccacctcaacctcctgagtagcagggactccaggtgtgtacccccacacttggttaattttaaatattttgtagagacaagatctccctgtgtcgcccaggcttgtctcaaactcctgggctcaagcagtccttctgcctctgcctcccgaagtgctgggattacagacatgagccacttcgcctggccctgcgttgttttttaaactgttgcctgtgctcagagtggccttcctcagctccacctttgtgtcagggcatgccacactgcagttccttagcccgttcacatagggctaggtccaccccactgacggatggcaggttatgatggcacagttgacctgagcaacatccatcttgtccaaggctttgctgaaaaataaaacatgatagtttttcttgtattctgccctctctttctgctcccttttctgttcttccttttctaatcatctgcagccgtaggcactttgtgattctctggcttcaccagcagctcaatggtgggaggaatgtttgctacatagttggtatgattgagagaaggaatggtagaaaattcagatttgctgacactcactttattctcttggtgggtttttagctcctgcatttgaaaagtaataaatacctaacagtgaataagaggcttcctgctctgttggagaagaatgccatgagagtcacattggacgaggctggaaatgaagggtcctggttttatattcagccattctacaagctgcgatccattggagacagcgtaagtgcggattctccacctagaaagtcttccgtgccatgcttccaagcatgactgtatattagagttaaggaggagacgttgaaagttggaaccagaggcttgtcctgtgtaaagagaagggaattgctatggaaactagtgtttgggaaacagggaactgtggagagaagtgtgacctaaatactgtcactgtgtttttcctcctggatgtctgaaaacattgtatga

SEQ ID NO: 104391 - DNA, 1018 bp, Homo sapiens
tgttatagtaaaaatatgaaagtaattgttttagaaacataaagttatggctttgtcaaagataaagacttactctgactctatcttgttttttcttaaatttagttaaaacttacttatataggtaccttaaactgaacagttttttttttttttcctgctctgaactggctttgaaacatctctgtataatcagtgacactcgaggaacaacattcaggcttagccttgtaaacatgaccccctctgcacagggtcaggttttaaagaaggcgtggtgtgtgctacatctttatacttgctggggataggccttgccttcttcagcacagactcatatgtcttctagaactgcccagtggtcaatccgcagtccttatcagttttgtgcaaagctctattgctcctttccattccaggtggtcataggtgacaaggtggttctgaaccccgtcaatgctggtcagcccctacatgctagcagccatcaactggtagataacccaggctgcaatgaggtaaggacattgagttatgtgtgtgggtgtggttatcctgcaggagcgggtctggcaggcgccagtgcatgcgtgtgctgagagtgacttcagcagtgacttggggcagggtgcccattctgcaggtgaagaaacaggcccagggtcaaggctgccgtgtaaggttgtgcaactgtgtgcagtgggtagtagatgtgggctgatactcactctagtgctcagtttgtgaagccttgcgtcactgaggggttgttttttcattggtgaagccagagatgaacccttttactaatttttttctggccataggagcacctttttctaatttgtctccatatacagggtgcctctttttaactgttcaaaaaggaacactgcagcttatcagcagccctgcaagagtgatagcttgcttttggcaatacatctacttctcctctaaattagcaattataggatgcaaggatgttacttccttgtgacataaatatttgtctgat

SEQ ID NO: 104392 - DNA, 1995 bp, Homo sapiens
agggtgttgccaagaattaaaggagattgtgcgtgttagcacctaaacctagtgcctggcacagatttagtgcacaaacaatggctgctgttgttaacaatgatcattaacattttcgagtgtatacactggactcattttttttccctttatggctcatcccattttataagtacttattttcatcaggcctttactttctggctacagaacaagagacttggaggaaaatgaaaatatcattccagaaaggcaggaggcttggttccattagtcatggttggaatgtgcatagtgattggtgcaaatgaaccatttatttccaaactctgccagcaggccagttgattttgcaggtgctgtgattttagtggcgtcaatctttagagtttttagtctcaagtacagccttgcttcctaggctgcggtgagaagtctgggggctggatgacacagttgttgtgaggggtacgtgaaaaaataactcgaatctgtgtttcaggtcaattccgtcaactgcaatacaagctggaaaatagtccttttcatgaaatggagtgataacaaagacgacatattaaagggggtgagtttgatgctttatgggctgagcattacttggctcttcttgggggcagcagtctaattctctttttaaattcttttttccttaattctttcttgtgttgactgtcagggtgacgtggtgaggctgtttcatgctgagcaggagaagtttctcacctgtgacgaacacaggaagaagcagcacgtcttcctgagaaccacgggccggcagtcggccacatctgccaccagttcaaaagccctgtgggaggtggaggtaagggtagggtggagaaagggctcctgggtttagaggatatcagcctgtatataggctctctctctctctatcctacaaatattcatacatacatatacctatatgtgtctatacacccacatacacacacctacacacacacacagaatacatgtgtgtgtatatatataagtcacaaacaagtacttatacccaccttattccaaaaatgggttggggatggcatagtgaagtaagtgcatcatggcatatcatggtgctgcatatttgtgcagaaggaaagaataagtactttggaaacaaattcaaaaacgaaattagaaatagctttctctgagccatctaatcccttctattgttttctttcccttgctcatttatctatcacaacaatatttaaccaggtgtctacctgacacaatacataggtgatgcccacattggtgatggggcagaaatgagaagatatacacccagataactggaacacacaaggggatggtgaaggtggtaagaggcatattccacatgctctggaggtttcagtgagagagggtgaatgtctgggtgggtgaagaattaaggaagacttcctgaaggagatagcatctgatctggtacctgcaggatgatttgtatttcagaaggaagagatgaatggagtaggttacttcatgtaagagaatggtgcagaatgtggaaacgtgaagcagcgtgggataaaactcagtaacttgtttggtgaagggcacgggataggcatgggaaattaaacagaactgtttttggagaccagaggctgaagggccatatatccaggctatagggagttgggatttaatttatgggcaggggagaaatttggaaagttgtttgaggaagggaataacataatcagtgtgcaacttaaagaagctagaagattctgcccacagcatgtaatttgttgtaaggagagtctagaattgcaggacaaagaaggaaatgttctgaatgcttggtgaaagaggcaatgagagcttcaactaacatggagctctttcttcacctcaagccttcctttctgtgtaattgcagcatgaattagaattctaattcaaatttctaatttgaatagataaatttttctgtctctgcttgcgttctct

SEQ ID NO: 104393 - DNA, 1127 bp, Homo sapiens
atttactgaacattgtaatacaagtttgttgagtatgtggagtctgttgttctttaaagagtactgaattttcttttgttgtacactaaagtgacctgtggatccctttgctcctttgaaggcttattttcaagctttattcagccaggtgttgtgtagagttaattttggggctaggttaactccccttccaagatgggacccctttgatgtgtctactaacgcacagggtgttccacatgatccctcagctttggctttccagaatcaggactcctcccagccctgtgtgcgctctgggaaagttcagctttcagacaccttgtttttcttcatttggcttcatagggtcttgccttatgcatatgcagtctgatgttcagcccaaaactcaagggagcctcctgtgcagacttccagagctttttctgtgtgtagttctgtatgcattagtaccccatccccacaaattctagctgcctcagtctccctaaactttgatctgtctccttaactccatgagcttcatgcccttagcttggattcttcctccctatgctgccatccagagaggaccctcaggtagaaaatcaaagcaatagccaagctggccttgtttgtttccctattctcagagatcaccattgtgtaccaccagttgtccaacatgtgaacacagttgtttgggatattttatccagttttctagttgtctatggcaatttcatctattctctgcagtgtctaattgtttatggcaccaactaccactgctagttaactctgtcatggccagaagctgatgtgacatttatttttctgatacattggccccggctctgagtttcacatttcagagcacaggcctgcgtgtgtgttctagcacatgagtacatgcgtagattgctttgacagttctccacgaaagtcctttttattggctgtgcttttggtaggtaaatttcagaatctgctacttcattatggctaaggcaaataacctgaaaaccactgaagtttttattccaaccattgtatgttaactaggagactcgatgccttctttggagagacactgcttacttttcagtttggatgctacacgtgacactggcaatgggtttgtt

SEQ ID NO: 104394 - DNA, 1048 bp, Homo sapiens
ctgccgcccaggttcaagtgattcttctgtttcagcttcccaagtagctgggattacaggcgcctgccaccacgcccagctaatttttgtatttttagtattgacggggtttatattggtcaggctggtcttgaactcccgaactgaggtgatctgcctgccttggccctcccaaagtgctgggattacaggtttgagccactgcagccagcctgggctaattttttgtatctttagtagagacggggtttcattatcttggccaggctggtcttgaactccagacctcgtgatccacctgccttggcctccccaagtgctgggattacaggtgtgagccaccgtgcccggctggaacatttttattgcaacacaaagaggtagagcgtaaatatccctggctgcatggccagttgtcatcttttaggactgctctgtaactgtggtccttttcctgccaactgctgacattcacgatcctttcttctccgttcctgtggattgtggaataattgtagaaagtgaaggctttggcatgcatggttcttgatttggtgactttacctcctcaggtggaccctgatcaggacgcctctcgaagtaggttgcggaatgcccaagaaaagatggtatactccctggtctctgtgcctgaaggcaatgacatctcctccattttcgagctagatcccaccactctgcgtggaggtgacagccttgtcccaaggtatcattttaaaattgcttttccccaaagaatcaggcctggtgtaggtggcctgaccaggtttcttggaatccaaatcgttactgccttttcttttagatttttataaaggatttggtgaaaggtttgcactgactgcccggtatggcaactgatttttttaatggctcaccattgataagttctcagtagttgaatgagaagtgctatatttaggtaaacaagccaaaccataagcccaagtagctcaattttcctagttccctctactcccttcctccttccccaaaccttgggagagctcttggtttggggaaaaag

SEQ ID NO: 104395 - DNA, 2392 bp, Homo sapiens
tagggaaacaagcttactcttaacaacagaatcaacaatattaataataatggctgacacttattgagcgctgactgcatgctagacacaaagctaagtactctacttgtgttatataatttcatctttctcaaaaaacccagtgagagataggtattgctatcaccctttcttgtagatgaagaagctgaggctcagagagtttaagcaacatatcataagtcagtgagtcccgtagcagaacccaaaatcttaaatgtttaagacacatagggttatttgggccattctgactctccaataccatgttggttaatggaaatgtcactgtcatttatggattacacgtatggcccctcgtgaagtattagttgtgtttcatccattcagaggtagctactggtaacatttttgtttatgtagttttagacaagtctctggtcacacagagatgactgtgtcatttattatagatgggatcataagctattttaaacatttttaactgaatagtatgttttatacatatctccaagcgaatgaatatcagttgtcattgtcttaaataattgttgtaatcaggccgggcgcagtgcctcacacctgtaatccgagcactttgggaggctgaagcagacagatcacttgattgagtccaggtgtttgagaccagctggacaacatgacaaaaccccgactctacaaaaaaaatgcaaaaatttaaccgggcatggtggcacacacctgtagtcccagctactttgaaggctgaggtgggagtatcctaagcctgggaggcagaggttgcagtgagcccagattgtgccaactgtactccagcctgggtgacagagtgagaccctgtctccaaaggaaaaaaaaaaaagaaactgttatagtcaattgtaatcatctttaaataacagtagtatcaactagttaatattgtattaactggttcattattggactgttctgttatactgtattaatacaatatattaatataggtattcatatgtaatatgttaatattacattgtaacaatagaatataataaatttgtattctattaactagtccattattgagatatcagattgtttacagtttttattgttacacataatgctttgttgaacatctgtttgcctcatttgcacctgtactatcaccactgaaggaagaatacctaaaaataggattggtagatgaaattatagatatattttatgtgttctacaaggtgctagacttcttttcagagttttgcttgattacgctctcaccaaccatacataggacttacttccctaagctcttgttgagactgggttttagatctttggaatatgatacaataaaatgatattgttttaacttgtgtaacttttatactaaggaggttgaatctatacttccatgtttctttgtatttcattattaaattacccgtttgtgtccttgtcccattttcacttccaatattcatatttttcttattgatttgtaacagccctttgtgtgtagagtaataaccttttaatgcaatgggctactcttttattttcccaggctatggtgattttttttcaactttgtttatgatggttcttttttttttctatatagattatataaaatttaaactatgtaatgagagttatccgtcttttacttttaaaatttaggaatcttatattttgttatatgattcaaaaggctttccctactgcaagattagtaaatactcatttttttccagaaattttatgatctcatttattgtttcactgatccctatgaaaatttcaatcattgctgtattattatttcttgttataagcactaatatatacccgtaaatacttcctgttgctctgtctcatgctctgtttatgctgagacactcattcatggagtatgatcttatatttagaagtataatatataacagtaactgtagagtcgttatgaatgattttctattgtaaatgcatcagaatgtggcttggacctggaccatttgccccttcgtgtatactgcccagtgtatgcagtaggaaaccactttgctatttctattttgatagattatattctagactaggggctatagagtaaacctcaatatttatttccctaaaaccctccttttttccctgttaggaactcttatgttcggctcagacacctatgtactaatacctgggttcacagcacaaatattcctattgacaaggaagaagaaaagcccgtgatgctgaaagtaagtcctgggacttgcctgtctccttttggtctcgtgtttcctaatgaaagggctcctttgaggacagatcagggagtatggagcgtggagatttgttgctttggcgagagtgtggtcat

SEQ ID NO: 104396 - DNA, 1056 bp, Homo sapiens
ggctgaggtgggtggattacttgaggtcagcagttcgagaccagcctgcctaacatggtgaaaccccatctctactaaaaatacaaaaattagccaggcatgatggcggatgcctgtaatcccagctcctcaggaagctgaggcagaagaattgcttgaacccaggaggcggaggttatagtgagccaagatcataccactgcacttcagcctgggtgacaaagtgagactccatctcaaaataataataataatcaagtgatgaagacctcactctctctttctgtctctaagttggtctctagaaccacattactaaatgtcagggaatgaggttactctgagataaaattttgtgtctgatatttcataaaggtgatcatccttttgtggacaatgatatgttttgtgtctttcactctctttgatacttggcttctgttgtcagtttcaaagaaattggaaagtgtgggtctgcccctgtttaactggctcattcgtccagaaggcttccaaggcaaagcttccagcctgctgaacactgaacacatctgtctctaatagcgtctttcctcctaaggtctgtaaccaagctgctagaagatttggtttacttcgtcactggtggaactaattctggtcaagatgttctcgaagttgtcttctccaagcccaacagagaacggcagaaactgatgagagaacagaatattctcaagcaggtcggtgagatgtggcgtactggggatttggctttatgagaaatcataaagcatgagtggtagctcatgcctgtagtcccagcactttgggaagccgaggtgggaggatccccttgagcccaggaaatggaggttgcagtgagctgatcgcatcactgccctccagcctgggtgacagagagagagcctgtctcaaaagagaaagaaaaagagaaatcaatgggatcattgagggatattggtgattcccacctcaaaggcttgatgaattgatttttcaatagactattttctagagcagtttttaggttctcagcaagattgtgcaaaaagt

SEQ ID NO: 104397 - DNA, 1017 bp, Homo sapiens
atacaggctattttgcttaattacatttgtgtggcaggcttagaaaagtaaaggatgtgaaggagtttgcagctgttgccctaggatagaaagttgtaggaagaccctcccttatactgtaatgtctcttaggggcagtagttctcatcaggaaacattgctgctttctttagtctacgcttaaccatattgtcatttatccttcctactgacgtctcttttctctccttataaaggagtatatagccaagcagtttggcttcatgcagaagcagattggctatgatgtgttggctgaagacactatcactgccctgctccacaataatcggaaactcctggaaaaacacattaccgcggcagagattgacacatttgtcagcctggtgcgaaagaacagggagcccaggtgaggcgggagtggggtccatgcaggatggtgtctctgcctgtaagatgcagggacttagctggtgctttttactacgtttccttgtgctgctagtgacaagttttgattagttaggtctggagaggctttttgatgagtagtggcaagaacttggtgttaaaatgagacctgggggtgcattcctagctccagtgtgtcccacctggatgagcttgggttttttcctgaactttaatttccttatctgctaaatgggtagttatgaaaattaaatgagaataaacgcaggtgacgtgcaggcacttagtggatgcagaggaaatgacaaattgttggccactcattcactttttaaaaaatgttcttaattttaatttttaatttttgtgggtacgtagtaggtgtatatatttatggggtacatgagatgttttgatgtaggcatgcaatgtgtaataatcacattgtagagaatggggtatccatcccctcaaacatttattttttgttacaaagaattcagttctattcttttagttattttaaaatgtacaattaaattattgactgtaattaccccatttacctacaaacagtaggtctta

SEQ ID NO: 104398 - DNA, 1035 bp, Homo sapiens
ctgttcagaacatgtttattggtctgcagaatttttgttaccagtagtaattcatttttggcaaaggagcagttttcctgagaagtacagtgccggtaatatggacagccttaaaaaacatactaaattacgtcctgagctagtgatacttcattgattcacatgtataactcagttttgggcttgggctaatgcagggtttttcagtttaggtattttcacatttcgggcttggtaattctttgttgtggggctgtgctaggcactgtaaaatgttcagcagcatccctggcccctacccacttagatgccagtagcacctctccatttcggttgtgacaaccaaaaacctgtccagagacattgcctggtgtccactgggggcagcagcaccatagtcgagaaccactgggttacagtatatgaagatgttaatgtcaggctctctgcggctctgcccttgggggaaatacaaaacaaaaagtgtctttccatgtgtctttatgctgaaagtaaagctagatctcaaagtatttttaaaaatagtaacttttccctcctcctcttgttttctaggttggttctttctcgttttgaatttgaaggtgtctcttccactggagagaatgctctggaggcaggagaagacgaggaagaggtgtggctgttttggagggacagcaacaaagagattcgcagcaagagtgtgagggaattggctcaggatgctaaagaagggcagaaggaggaccgagacgttctcagctactacaggtgcgtgggacacgtgtggggctcagattggggtgccccaaaacagtggcacttaggaatttgttgctcgtttgttgattacttcaaggaatcacaaggagtcatcttgtaagattgtctagaaaaaagccagatgtgtgttttaggagtttggagtgtaagatttcagttagttgacatctggatgtggctggttcccaaaaaggatgagtgcttgcctcagtccctggtgatagtttatccttcagcagcatggcccat

SEQ ID NO: 104399 - DNA, 1837 bp, Homo sapiens
tgggcttggaggatattcatattttaagctttactaagcaattctaaattggatgtgtcagtgtacacacccaccagttgtagacgacaagctttgtttcttcatgtctttgttaaccttgaatatcatgatgctttttaatttttggtaattttataagtgtgaaatagactcatgtctacacttgcatttccccgacatctaatgaggctgagaatgtcttcaaatcatgattattagaaatacatagagtttttaattcagaaggcagtattttgaaagcctgtggctttctcgttatttcacatttcaagtatgtttactctttcagtgtttgatgaatcttctcccaagtgaatgagaaagagtgccttaattggtcaggttccagttaacaacattcacttgcaattggatgaagatgaaaagtgaggagtctcctacttttgtaaatgaaatgtttttttacacgtgtaggaattagagtgacttacatgatataagatctttaaaatgttataaaatttctaattaggctgaatatgtgtgatatcttgaacatttcctacatggtctttactgtataaaacacagctgaagggaaagaaatagacaaccatcttaggccttagcattccccccgtttattttaaaaagtaaacattaaggacctagtggaattaggtcgtcacataattgctccaacacagctggatagacatgtgttcctgttggctgtcaacccacactctactgcacagcttgaatagttcttttatctgcttggtaccaaagccaaaatcctggtatacaagagcaatttaggggtgttgatgtatgagtttagttggccaaatgtcactcccatgacagtcagggctgcccagacgacccttcattcatcctgaatgatttctggagcgtgagctgtgtgcccttgttccttcctctagatatcagctgaacctctttgcgaggatgtgtctggaccgccaatacctggccatcaacgaaatctcaggccagctggatgtcgatctcattctccgctgcatgtctgacgagaacctgccctatgacctcagggcgtccttctgccgcctcatgcttcacatgcatgtggaccgagatccccaggaacaagtcacccccgtgaaatatgcccgcctctggtcggagattccctcggagatcgccattgacgagtgagcctggcacctgaaaacctcactttacattattctgtgcggcagtagatagccccatatggtctcattaaatcttagaagaaagatgaagtgttggttttttcttcaagcttaaaataaaattaagtggatggcaaatatttttttcctcaagaatgtgaaagatggcatgattatgtttttggtttttgtttgtttgtttgtttgtttgagatggagtctcactctgttgcccaggctgaactgcagtggcgcaatctcggctcactacaagctctgcctcccgggttcgtgccattctccttcctcagcctcccaagtagctgggactacagacgcccaccaccacgcccggctaattttttgtatttttagtagggacggggtttcaccgtgttagctaggacggtctcgatctcctgaccttgtgagccgtccacctcggcctcccaaagtgctgggattacaggcgtgagccaccgcgcctggccccgattgtattttttatatctcatttatctcctctttcattctgcaaatatttaagtgtgtactatgtgccaagctcaagaaatatatcagtgaacaaactagaaagcaatctctatgctagttggtggaagacagac

SEQ ID NO: 104400 - DNA, 2140 bp, Homo sapiens
gctatgatagtagtggagcttccaaagatgaaattaaggagagatttgctcagaccatggagtttgtggaggagtatttaagagatgtggtttgtcagaggttccctttctctgataaagagaagaataagcttacgtttgaggtaactcatgatgaaatcttctatgtgtattatctgcctctcagtggtcatttttctatggggcaaatagaaaatatgtgagtaggttgtgattttggtcatgatgctctggttttgtaatggaaaggaattcagcttggttttgttccagaataaaataaaacggataccagtcacatggcttaatagtagttatgggcttaaaagaaatatacaaggtgacttgaaccacataaaatgatagaacatcactttgtgttaaaactgacaagagagaaacactgtgcttgcaatctgccatagcttaatcatttgcagaacataaatccttgttacttctgagttaacaacgtttctgagactgcttttgccttttaagagctgtattgctgaggatcgcagagtgttattatctgtgtccttattgggaataactctgcttgcctggtgttaatattatccttgggaagctgtgtagagcaaatgatgaggtctttttttttttttgattagtcatcagagcagatcagtagctttccatttcttatttttcctccttatgaaacaaaatgaaaatttatcagaaagtgcaaggaaaatacatgccttctcttaccataaggaaggtccaagtctgtcatttctaaactggtcaacatcaaatggaattgaaggggatgcagtttatgtaataccgtcttcttcttttattttaatacaataggttgtaaatttagctaggaatctcatatactttggtttctacaacttctctgaccttctacgattaactaagatccttctggccatattggactgtgtacatgtgacaacaatcttccccattagcaagatggcgaaaggagaagagaataaaggtaacaatgatgtggagaagctgaagagtgagtatctgagggtgcccatacatctgagagatgccctccagcctttcctgttatgctcatgtcataccctatatgtgatgccacatcctttctttgttcattccttcccaacttttcatcgtgaacattttcaaatactgtgtaaagaaaagcggaaagaacagtacgatggagtcccacgtacccatgactttgagtcaacagttattcacgttttgctgaattttattttgtatttatgtgtatttatgtgtattttattttgtatttatgtgtttatgtatgagtcgtgtgtatattttgttgaacaatttgaaagttacttaacactttgaatgtttatataacaaatacatgtcctatcattgttcttgacattcgtgagacccttgataataatatttgtttaggatgtaagaaaatccaggcttctatcttggtggctatttccactttgtgagaaggacaatctgcctttgcatgtttatttcttcctcgttttagggtcagagtaggcagatattggtatcatgtatcaattattgttaactggtcttctgcagctagaacagaaagaaatacattgacttatctctatttgctaggtcttgtgctgagtcatgttgcattataccatttagttcttttgttgagctcctttatttccattttgtagatgaggagactgaggcttagaggtagtatggtgcacctaaggtcaagcagcatcaggatttgtaccttgttaactttatgtacctagttctgtgctcataacaagcacatagttgatgatcaataaaatttgggcagggcatagtgattcatacctgtaatactaacattttgggaggctgtagcaggaggattgcttgaggccaggagttcgagaccaggctgggcaatatagagagaacctatctctaccaaaaaaaaaaaaaaaattagctgggtgtggtgatgcatgcctatagtcctagctacttgagacgttgaggcaggaagattgtttgagcccagaagtttgaggccacagggaaccatcattgtgtcactgcactccagcctaggtgatagaggaagatcctg

SEQ ID NO: 104401 - DNA, 1061 bp, Homo sapiens
gagtgaagttagtaagatcatgtcctgctgctgctgctgggctacaattttatccctgagctccttacaggctatgcaacaaagaaagcaaaatctggtctttcattgttcctaatattaatgtatgaacccctttaaaaaaaaaccgcactggtcaattttgacttaagacattattataattatggaactcttatacctccaagtataaaatttggtataaacaccatatgcacatagttcttataattagcacacttggtttgattattgctttataacatattactccaaaaaacttaaggattcaaaccaccaccattttattaatacttcttacagtcctgtggcttgattaagctggatggttcttctgctggtggtcactgttgggtctgtcatactgtagtgaggtggtaactggggctggcacctccaagttggattattcacatttctggcactatagcagagatgcctgcaaggccagaacttctttctctctctgtccatgtggatagcttgggcttctttacagcacggtggctgactcaaaaagcaaatgttctaagaggacaagccaacagtatgcaagtgctaattgggcctctgcttgcattgcatctcctaatatcttattgttcaagcaaatcccatggccaagctcattgtcagtgtgggaggggactacataagggtttgaacactctgttggggcccaccagtgttaatagtctacctcaatgcttaatataaaacctgtgaaatttgaattagcaacattatgtactatgatggaagatgtttttctgaaacttaaacatggtattgtgagtttagcataatacaggttccatgtgctgtgtgatcactcagctctcccgccattttcctcatagtgaacagcattgaaaccttcacacctttttggaatacatagcatgaatacagtatttataagtcttctctgtgcttttcttattagccagcaaccaggaagtttccaccatttgtcattcatttgactctaaacccaatataggtgcagacccaataattga

SEQ ID NO: 104402 - DNA, 1104 bp, Homo sapiens
atttctgaagctttacaattgaaggaaggactaattgagaatactgtcagggagtcatctaagtgcctggtacacagtgtccccactgagagctgtagttttttagaaacctttgcgtacgctggttcaaagttgggaggctgggagctttgtgtgttttaccccagagcaaactcttcccagggtctcggcaatgatgccaggtcattccattttaagcgatatctctgaaactgtcccacttgttgttgaagccataatcccctgcttattctggaagacgtgaccttagtcttatggatttggcttgatggagtcaacagaaatgccacatactgaaggaattttgttttacgtttttaatgcattataatcccctttgcctccctgcccgccaccaccctctgcaatctttttccagctatagttcctagttttctgagactgatttctttcattctactagattttgattcggcttagcaaactctgtgttcaagagagtgcctcagtgagaaagagcaggaagcagcaacagcgtctgctccggaacatgggcgcgcacgccgtggtgctggagctgctgcagattccctatgagaaggtgagcggtgcctcatgcacagcagctgctctcaggatggggcggatccctgggtttccccaaactcttcacatctggatattgttagtgaagaaatgcatccagtgtgactattgtgactacaaagcaatttcaggtattgatatgaaacagagcatctgaaaaataaagtaaaatcacccgtgaataatcctcatccccagttttaagattctgtaaagaaagagagtccatttattctccatactcccaagacatattggatagagacaacttggtctgtgtcagagcttagagctatatctacccatgagttggtgtgtttcaatttcatttgcaatgtgactcaaccaatttaagtatcaccagctattaagtgcatgtaggaacatgggatgtgcccacttttgaagtcctcagtaagacgctgacatctgcttaagtatttggatttatcaggtgatgctttgatctaggtcttcttttctgttgctggaagt

SEQ ID NO: 104403 - DNA, 1020 bp, Homo sapiens
gtcagtgaggaagtcagccccagttctgttgtcagtccctgtttttgtttacttttaaaatttttattatttttatcttttgttagagatgggtgtctcactatgttggccaggctgttctcaaactcctgccctcaagtgatccacccaaaggggtgggattacaggtatgagccactgtgcccagcccgtccctgtctttagaagtagggggttcagaagtttcagtccttgctggataatggactcatggatgccttctattagccttactctgcagtgctccctcccacccaaataagatcttcactttcatccaatgagcatagacaagttactggcttcttttcagcgtcagcagtgcagcccctcaatatttacccacaacaggtccccagcaaacaccttctgactcccacgttagcaggaggtgttgggtataggagaagctggtctcctggcccagcaatcagtgctttcatctgtctcctcccacacaggccgaagataccaagatgcaagagataatgaggttggctcatgaatttttgcagaatttctgcgcaggcaaccagcagaatcaagctttgctacataaacacataaacctgtttctcaacccaggggtaagacttgaggccaatctgcaaatctatagagggaggagggcagggaagagggaggaggaacagcttgttctttggctgttgtggcttctggggcttgttataatgcaacattcattccaaaggggaacattttcatcacttatcacgaggacataaatactcatcttttggggatgagatggcaggagttggggaggggaaaaggaggaaagtgagatggataaagtaagatacgtgtctatattttcctagtcaagtccttcattgtatcaaacttcagcaatatagaagtgctaaatgtctctcctgccacctgctactgaagtcatgcataaagttttctgtggctatgtatacatatataatatttccatatcaaacatatctgtaa

SEQ ID NO: 104404 - DNA, 1006 bp, Homo sapiens
caacaagagtgaaattccatctcaaaaaaaataaataagatggaaacatttaaaaagaaatatcatagcctaattggtaggtatggaaataccagtgcaagcttgcaatctctgtttccacttgatgcattaatgctggtatgcaggctttctcttcccctaatagctttctagggccagtgtggtatttctgtatctgtggactaaaattatgatgctgaagatttctagttgttcagttatataaatgaatgaagtcaaaataggtaagactgatttgggaagataaatgctaacagaacctctctcttcctctgtgaatagatttttttcatgctgccccacccctgcaagcttgtaatctaaacccaccctgttctttatgtagctggtcaattcgggagaggatgtcctcgtgttctacaacgacagagcctctttccagactctgatccagatgatgcggtcagaacgggatcggatggatgagaacagccctctcatgtaccacatccacttggtcgagctcctggctgtgtgcacggagggtaagaatgtctacacagagatcaagtgcaactccctgctcccgctggatgacatcgttcgcgtggtgacccacgaggactgcatccctgaggtgagcgagcccagcctggctgtgcccttctcgttgctatgtggtgtgtgctgtcgtggctcactgggagacatggtggtggctggcctgggggagccctcatggctctgaaagctgcagctcattttgtagtgggatttcagttccctaaaacattttctcgagcattgattttgcatgaaaggaacacggaagaagttagtcgttctttctgtatctttaagaacagtgaggaaaaaagcttcagctctgtggactaatttagcctgttgagcaaaggggatatgacctgaatgaacttttcagaaatgtgacgaagagtaggttgagatctagtccatatgaatgtaagacttagtaagttaa

SEQ ID NO: 104405 - DNA, 1014 bp, Homo sapiens
agttgagccccttgccgtgtgtttttttttttttttttttgacatttgatattcctttaagaaatatctgatccggttttttgcttaccttttctctgggggtatctatcatataagcacagatctaggggcattcttcattgttacacgccttgcagatatcttgtcccaacttgggcccatttacctcttgaatggtgcctttttatgaacagaaattcttaatttcaaatagtcaaacttgtccctgttctgtggtcagaggttttgcctcattctttaccttgagatcatgaaaatattctcttccaaaagctttatggttttggatttcataattgtgaatttcaaatatcagaaaatcatagaagtaagacttggcagtggggaatgggatgaccattttcatcggtccttgctgtgaagttgaggcagctaatgagttccatacacaccaagatggtttttcagaaaagcttctttctatcttgcaggttaaaattgcatacattaacttcctgaatcactgctatgtggatacagaggtggaaatgaaggagatttataccagcaatcacatgtggaaattgtttgagaatttccttgtagacatctgcagggtaaggcttttggaactgaggaggcagagttggagagtgagaggtgtgtgtgtgtgtgtgtgtgtgtgtgtgtgtgtgtgtagcatctttgtgcacacatgaagaaaacagctgcatcatttctactctaatccgtggcatgaggaggcacttgtgactttcttctcatgtatcctttcttccttttttttttttttgagctggagtcttgctctgttacctaggctggagtgcagtggcacaatctcagttcactgcaacctctacctcctgggctcaagcaattatcctgcctcagcctcctgagtagctgggattacaggcacctgccaccatgcctggctaatttttgtatttttagtagaaacagggtttcatcatgttggccaggctg

SEQ ID NO: 104406 - DNA, 1027 bp, Homo sapiens
gatgggttcgatcataccctaaacctcagcattaagcaatacacttctgcagcaaacctgcacgggtaccccctgattctaagataaaagttggaaaaaagaaaaaaaaaagttgtgcttgttgaggccaaaggaaacgtaggaggaagcccttgccacagaggttagtttttgtttaatattttagcaagtggttgacttgactagtagctcagtgctcattagagaggggaagtctttccatttgtcttggtggtgataagacaaaagacaaggagagttgatgtctgtggaacggtaagacatgaaaacagcactacccagagtcccctctgtgcctcttgggggtcgcttcctcatgactaataccacacccagaacccactgtgttagttgtttagcttatgaatatccaaggcatagagtttctagctgtgacgggtgtaccctgtgcatcctgcttttcaattgttaattatttgtatttttccaaatttcccactttctatattagactgttagaaagttgttggctggcttatagttttttttccgctaaattgtgtgtgtgtgtatgtttttaaatgggatttaaataattgcttctcagattcctctttcaggatgttggagttgtttttacaattagatagttgagtactttctttgcttctagtgttttgaagcattgaagacaggaaatcattgttttttggacattttcccatatggaaaagagtgattattagtcttaattatcttccttttcaaaatcttttattttggaataatttcaggtttatgggactgtagcaagggtaatacagagagttcccacaaatccctcacccattgtcacccgttgtcagcatcttacattagcagggcacctttgtcaaggctaggaaactgacactggtacagtgctattacctcaactccaggctcgattcgaatttcaccacttttcccactgctgtcccttgtcatgccctttttctgttccaggatttggtccaggtaccac

SEQ ID NO: 104407 - DNA, 1443 bp, Homo sapiens
gacagtcttgacaagtactagtcaggagtcctgtagagtgtctcccattatgggtttgactgatgtttgtctcatgcttagactggagttctccttttttaagacgaagaaagaagcacctatccagaaagaggagtttatgccattgtgaatgctacctttaggattatgtttgggataacccagcatttttgtagattgttgaacaaacctgaaaaataactagcaaatgattcattggccaaacgagttccctgtcttgattattcttaaaatacacacacacctcagtgaccctaagaagccattcattgaggaaacccattgaactttaactctgacatgccctggccttatgacctgagagcattttaacattcctaagaactgcttccccccagaattcacactgggaaaccctgacctaaaagatggtaaagttgacttgagcttctcagtctttaagctcaataccaggcaagctggcccattctgggtgtgaaaaacctgctggatggggactagggcattacgtccatctgtagggtgtcccccataaaagttgtaggctcacgactcatctttctcctgtgcagccaagagccgggccattgccattcccgtggacctggacagccaagtcaacaacctctttctcaagtcccacagcattgtgcagaaaacagccatgaactggcggctctcagcccgcaatgccgcacgcagggactctgttctggcagcttccagagactaccggaatatcattgagagattgcaggtaatgcctggtgttgagagaagtgatgcttagcctggcctcacgtgattgccacacacagcagtgcatccttgagccacagagcatctaagctgggccgtgggaagatgtcggtgtgctgaacgaatagtcaaatgttatatatgtagggccaggagtgggaagttacttaggaatagaaaagttcctgaaaagtgatggtctttaaaggttactcctagatttgcagatttcttggtgaaaaattgggactctgctcttattagaaggaagtattgaagtattacagaggatgtttagagtaagagcataaatgttccattttccccatcactctggggttatttagcctcttgaatcagcaggtgaacaagggtggtgatacctgagagaagaattttacatcagaatgagccagatggaaacaaaagtattccttccagctagattatttaccttttttcgtagaatctaccaagacatctgctctccttttgttaaaggggagagtagtgagtattagatgttaagcacttaaacatgcatcttaacattaacgtattttttatacaagcacctcagttgatgctctcacaggtagtacataggtcacagtttgagaatcgcagatcctttgaatgagcccacaagcagtgtttaag

SEQ ID NO: 104408 - DNA, 1050 bp, Homo sapiens
tgataagaacaactttaatcctgtgtaaataccgtagacaaagatttgccagagtcaggatcaataactattgaagagaatattgactgggtgcttccaaaagggatgctatggggggaactgataagagcctcagaattttgcagaaatgacccttttttgactgtgctgtgaaagtcagtatgaactaagggatgttgcaaagtaccgtcttacagtcttgttgggaaaattgccccactcaaaattatttgattgattcatgtatctttatgcatcttaaaccttactgagtgattacattcatcacccaaattgtgttaaatctaagattaaattatcttcatgtcattagtttctggatgaaagattagttaattctttgtcaatcccaactgggtcccaatttaagcagcttttcccatgcaaatgtccttgggtaaccaggccttcctgtattatccaacgtgctgtgtttggcccctgtcttagccaacatgcctgtaggcaggttctgagtcaccaaaccatggagcaggctttagcatcttttgaagataatttctcatctgttttctatcatttgccttcaaatggtgtttgttgtgttggttttgctgctctttcaacttctctctgttttcctttcctacagctatgtgttttgcatttgaagaccatcatgctatcagggtacatgtatttagcatgttgatacagcatgttcattcattggtgtcctcatgtttgtatgactttattatgtgaataattcatgctcattgaaaataaacaacactgacaagtatttctatatagaagaaaatcagaatcacctgtaatcccaccacccagagaaaaccagtagtaatgttttaatatttgatgtttatcctttagctagatattgatgatgtttataaaaataggattattattgtttgacctttgttatgcccatgtcatagacatctttccatgttgttaaattgattttttgcgtcatattttaagctacatgcagtggtaccttgagtagcataagggcca

SEQ ID NO: 104409 - DNA, 1227 bp, Homo sapiens
ctctgtctcggttctcctctccatataatctctccattgtatgtggctgactcctgcccagtgagcctgtttgctgtgatttaccagcaggtgtcactattgagacacagttgctaactggctgttctcagtgcagggaatgccctgaagtatctttaacctgagagctcttaataaatatttgttcattaacggactagttaaaataaattgcttgtgaagtctttttaatttaaaattagcttcaaggaagtaatccgtggttttccccccattcaggttaataaagcatacaaaacagctgctagaagaaaatgaagagaagctctgcattaaggtcctacagaccctgagggaaatgatgaccaaagatagaggctatggagaaaaggtactgcattttattttcatggtcaaaccaggttttactatgaaactgaagggagggacctttcaaaacccaccttagctcaggcattactgactgaggggctagctttttttaaaagaaagaaagaaagaaagaaaaagctgtttatcctgccgttaaagggagctaaatcatatgactgtcttttttaaaagtcaaatatacttagtcgtctcttataggctgattgccacataatctaatgtcagagaagtggtaataacaagattttccatctatttaaattcccagtgaggagcaaatgcctcttttgtatcaaagtatgcgtttctgatttttaggtttcagccaagcatacctgtgggtttacttgcctcgttcagatgagctgttgcgcaatcctttcagtgcatcaagaaacgccctccacttctaactgcaattaaggcaggcatacacgtcaccacttctgagggagattgggaaatggacagtcccgtgacctgattgttcttagtatatgcagtgaacaaggatataccagatccattccttacacctctgatgttgggtagagcaggacagaaacaatgtcattccctttcctttcagcccccagcaacaaatgatgggcgtgaattgaaatctcactcattttcatttgaaggtaataatgttcagtaacggtcagctagctacatttagcaacaatttctgagtaggtgaatatgctgatatcactgacttatcaaaatacccagtaagtcatttttcagctctaggaagaagccttgataattaaatcagcctgccttgtcaaaatcgatggtggcaac

SEQ ID NO: 104410 - DNA, 2075 bp, Homo sapiens
aatccttaaagatgacgagacgtaggtacctttacccatctttactttttcattcaactttagtacttagtcaaggtcacagatgaaaaagaaagttgacatcattctttattatcctgttcaaaaactttggcgtgcctgtttgggtctccctgccttggggaagaaaggccatgaagaactgtcacccatattaccaaatagactaaaacatgatagaatcactgtaagactgacctacactttttaaaagtcatggatattcactagtttcctagattataagttacaatgataacattgatcgacctcttgtcatgtgctagccactatactaaacacatctgccttatctcagttcagcctcagagatagataccactattgtcattaactattttatacgcaaggaagagaaaacataggctctgagagctacagaatttgcccggggttacatagttaattacaaggcaacctggctttcaaacccagacagtccgatcctagagtcctagctcttcaccactgcattatcagtgaacagatggacaccatttgagtgttttgaggtccacctacaggttgaacctgtaagtttcctttatgttacacgattatgtaaacaatagtgggcattagccctgagagcactaaatgtatcaaaacttaaacatctagtcttcagctcattgctgatttttcacacagttgagaacactctccaatagacgccaagtgcatttacaaagtgtgattgtcccaaggtcatccaaaacctgtagttttggtcagttcccacacagaggaatcagactagtgagtagcaagtggttggttcacttgtctgggtccagtgcccccaagaagtgcctgttcaagaactatcatggccggatatggtggctcatgcctgtaatcccagcactttgggaggccgaggcgggtggatcacctgaggtcaggagttcgagaccagcctggccaacatggagaaaccccgtctctactaaaaatacaaaaattagcctgacgtggtgccacactcctataatcccagctatttgggaggctgaggcaggagaattacttgaacccaggaggtggaggttgtagtgagccaagattgcaccactgcactccagcctgggtgacagagcaagactccatctcaaaacaacaacgacaacaaattatcacatatgatgaaaggtaggggctgactgaagaagatggccagagattttaatcatgaccacttaggaataaaaaaaatctttaattcttatgtctctaaaatgcaaaggaccaccaatgcatatacttctcagatcgttaaatataaaataaatattaaaattatcaccaaaataatgatgaaatacatttttgcatgatgcttatagtgtcttttggtcctgtgtattcaaagttaataaactttaaaattatatcaggactttataaacactctgtgtgcaatgcctactaatctctgcttttaatctacagtttaaaccatgtctgtgttgaaaagaaaataacctcccacagctaaatagctctaaaatttaatctgaatcactctctaactcagaaaatcttcaagcccctagaccctgcttgagaaggaaacataattattttatgtattattaataactggttttgtttactgtgggtttttattattaaactgctgttgacttaagttattactcaaagagctttggaaagaaattcagaggccaggaattaatgtaaaaggatatcttagaatgtatttaaaatccatttcccttctgaatagtagtagctgttttagtactagaaagtatatgacctcaggtaatgcctgggttttcatttcatacaaattgtcagtctcctattaattaccaaagcgtctttgctccagctgagtaaagtattaacatttccagctactagtgtttctgacagcaacttaaatttgcaaaacatactaaatgttaacaaagcctaataaaaaatcagttgaggatcatccaactatccttaaacaagcgtaattgtgatacttctcttgtgctttt

SEQ ID NO: 104411 - DNA, 1012 bp, Homo sapiens
aaaaacattggggaatttgcccttgctcccagctcggttcatgttttcatgtccacaagcaagcacacggctgtctgcacatgtggttaagtgacctgcgaggtctgatgcctgatatgtgaataaagcgtggcagcatcgtgtccgttttggtcctgagcagatgtcactgtgagctctggccgtgtcctaagcgcccaagcctcttaggatggttacccatctagcaaggctttaaggagaaacgtcagcaataagagtaaagtctataaacttggctggcttgtatttcctttcctaacatttccttctctctctctccccttttttcttttccagctaatttccattgatgaattggataatgctgaggtcctaattttgttgttttttgtttttcatgtctcatggtggtgtttccgtgacaccttcccagttagccctgtgatccttcctctagtctcacagcgtcgagtatctggctttgtgtggtgtgccctctgggagtgagtggagtctgtcgtgtctgtgttagcatttcccatgagtttgtttgccattagtccttggagatctcatctgagtctagatgaagactttctaaactgcagtaagattttaattgttcactgtctaaaatctcagctgaatttgtggttgacgctggccattaacctatctctgaaagtcagttttgaaattggcctaaagaacttctctatctgtgagtaaagcatctgatacaaaacgatacaacagcattggtataatttgaaagtagtaaaaaaggaaaactcattaccctcttggtctacgtattgaaaagtattgagtgtgagagttcatataaaactttttttaagcgcagtgtgaattcctacgtgctagttgagactttccatccgcaggctcaccggcaaggttagaaatgtcctgtatccatggcttctcttctaggaaaactatgtatagatccagaaattgaatatcatccagtggcttctgtacttat

SEQ ID NO: 104412 - DNA, 1539 bp, Homo sapiens
gttctggcagccactcagattctttgaaaattccctgaagaagcaactgtggatccccttctgcgttgttcccctggcaactgccagcgctgggacaccgatgccctgtccccagcccctcaggctggtggatctggccctctcagcggagatgcctccttggcctttataattgatgccgttctggaagctaccacagctcctgtggtttctcccccaccaagtcgtttgccggtgtgtactcctggaaacctgcagcccacagctggagttctgcagaagcttaatgagaattcgtgctggcccgggattaaggcagggcctcacatctgaactgcgtacccatgttccaaagtctaaatgtggtggggaagagccccaaggctgtgtagggcctgcccagtggcccactgaggaagggacgccatgctttgatcataaaggccacttgatgtgcaattaatgacttgataaaaagtacaatgcctactgaggccctgtcagtgctctgagaaaacagggtgaaatgaggacacaggtgtagatttcctgcaagaaaagcgcatggtatggggtcttccccgctgcattctagaataaaattttgtttgaaaccaggaagaggaggggttgtttgttttttggcaagcaaagaggcagggtctccatccttaccccctgatttttcttaatcccctggggctggggcagggggacagatggggtggaggagagagagaaactcctcatgttgttgtaccttccgctcagagctgggtgaattgttacacatgtgtacacctgtgtagccgccacctaaatcaagacacagaatgtttccatcatcccagaaagttccctcctctagccattcttggcttgaaagagttaacagctggtgctaaagacattcatttatatgactaatatttgagtgcctgttacgtccagggggatttggatacagtggtgccccaaatgggcacagtgtctgccattctggagattacagttttgtggggggcaaagggacaataatacagattcatgcaagatgacagctctcagctgtgagacacattagaaaggagaagctcatggaatccggggacttctacctaagcagggaggccaggtagcggcttaggagatcaggtgatgacaggtgagtggccccaacaggtaatcatgtgaattgctttcctatgctttaaagtgctgcactaatcaaacggatagttccagcgaagtactcccgaggtggtgagcagaacagtagtccacctagttttcatagatgtgtctgtagaagggattggtgtgtttagaaagcaggtactgtggttcagtggacgtgtctgtttctacgtatttgagatgtgattcccactgaatcactgcctccttggaactgtggaatctctggagccattggtgccagctagcaactttgccctcctgcattgcaacaaaaaagctaaattcacattccagctactcagggcggctgcagcctgcatatgttaactcctcgacttc

SEQ ID NO: 104413 - DNA, 1005 bp, Homo sapiens
aaaaacagacagacacacaaaaaaagaatatttgctttgtcctccttgagtaggtcaggaagtggatgcccagagaggttcagtgactggctcagggccacacagagagccagagctaaaccctggatgagccatagtcacaggatgctcatgcagtgctctggggttttccagtctattccacgaagggatcacattgaaaagtgtttttctggttagacacgattcttgaagatgcaaagcatcctctgttttctcaaacggcttcgtaaaattttcaagggaaaagacagttattaatttaaatttaatttttgttttaagaattaattaaactaattttagaacaagcatgacagcagtttaacagaggaaatagtgtgtcagtacaatcataaaacataatccctgccgggtgattaagaaatagatatatactacctatttctattctgaaagaattcaagatgcttctctggacaaagagagcacaggcaagagaattcaaacagacgacatactagttccatctttattttcttttgcttttgttttgattggcaaaggggtaagagggtagctccgtgcattcctatggtgaatccatgcctataattcttttgttctgatcatattggatcagtataaaggatgctgtagtgggagggtttcccatgcaaatagtagaatataatacttctgtctatatctctgtctgctctaaaatgcatgggaaattgctttaattctgctttttctcatatgttctttttgcactaagggaagatagcaaaaatgtttacacagttttaattctttagcatacagaatgtaagggtagagttaaaaatgcattcttggattgtgatctttctatcattttgaaaatacctttacctgtgctctgcttttactttccttccccactcatgtccttcctaccaccagcactgtccctccccaccccgagcaggaggctgcatgcttcagagggaagttttctcc

SEQ ID NO: 104414 - DNA, 1042 bp, Homo sapiens
ggggtgggaaactcatctccaaagtaaccctgagtgcaggaaaccttgtttctcccagagacactggagcagggagactgcatcccctaagcccaagctggagcctaggtcttcttctctgctgtaggacaggatgtggagaatggagagacatgggagaaagcctaaacccacaggagacatgtggcacgtggaactttcccaagccttgggcccctgctttcatcactacccctgctcccctgagagcctccgtggacacgcatactattgctttccttgtctcggtggactgagacaaggatgtgctgtggtttttcctgtcacttgctttgttttaaagcatcattcctccttggttagtggtagactttttttgtttctttcttatcttaaatgtgttcccccatcgcaggtcgattgtctcctccagcacaaccacattcagtttgatttgaaggtatctggtcaccttgattgctgaagcccacttcggcaggtgatccagcagggttgcctcatctctgatccttcctcctgtgttttgtccttgagtgttggtctctggacttctctgtggcccacgagatgcaagtgccatgactaacgtacttcgttttactcccaattagcttcctccagctccggattctgagaacgccactgaggtgtgttgcccgcctatatttgtagcgccagcgccagcaaatatggatgcctctcagttgtcctggttgggtgtctgaattgttgtaacaaaaagtctctcccggtggtagatgtaggagggaggtctctaggctggctgggaacagatcattgctgacgtggatgtggctctcagtgtagaaagttctgaggagctggatccaaactgagcatcctccaggtgccaggacatggttctttgaaagttctcactcagaaccatcttaatcctgagacatttagctgagacatgtgaggatgttaagacctttctgctgttatacaaaattgactttgggtcctgtgcagagatgatgcacttttgaagttatta

SEQ ID NO: 104415 - DNA, 1494 bp, Homo sapiens
gaaagaagacttaaaaatgaaacatgaacaaatgattgaatagctaagttgcagtgtctatgttttctaatgatcagtgtttaatatcctaatcagagctcctcattctgttaacggttttgttacaagacttgtgtacttgtggggtggggaaagccgtggtcccatatctgtgtctgctcagaggcgtgtgtcttgatgtccttatgcatgtgctgtgcaatgatgcatgtatgaatcataaggacctgcccgattgagtcttgcattacaaccccttttgggttaatgtcacagcatataatatagaacttctttttcatgatctttgcaataaattatgttggccaaaaagtcatatgtctgcccattttgaacagtgcactagggttgggggtatgggacagtcgttaagcagcatctaaagtaatcaagcatggatatacgggggaaaaacaaaaatccagacctattctccttttgtgtaactcttgtctatatatgaactctcaatgtattttatatgtgactgatgctgcagatggtagtgtctccttagtgttgtattaaaatggaatttctgcatgcctagcaggagcttgaaccaagtccacccctgcggcagctggaagaccataaaagggtacgtagtcttgagtcttgggtatcgggagctaatgatcaatgaccgtaacacctccatcagccacacactgtgattgagagacagcttttgttgttgatattgttaaagcattaattgactcaagagcaatcacagccatgtatataaatgaaactaaatagtggttctgcccattgtctacctgatcagagcactgtaaccagctggcctccaaataatgaccaagtaaacttttcatgtccttttttcttttctgtggtggctttctatttaggtgaaatataaaagaaaaagaaaaactgtaatggctgatgaccattataatttataattttaaaaaaatggaaaaacgttcataattacattacctagccacaagagccactgtttttgtttgttatttggggtggttttttagagacagatattactctgttgctcaggctggaatgtagtggtgcaatctcagctcactgcagcctcaacctcctgggctcaagagatcctcctgcctcagcttcccgagtagctgggaccataggcaccacacccggctagttttcttttattttttatttttgtagagacagagtcttgctatgtttcccaggcgggtctcagactcctgggctcaagcaatcctcttgccttggcctcccaaagtgctgggattacaggtgtgtgccaccatgcccagccccactaatgttttaatatttccttctacctattttttatacacatgagcacatgtgccaacagacacaggcacatttgcattgtcattgggattattctaggtatacaacttttgtaccctgttttgtcatttagtactggatctgagc

SEQ ID NO: 104416 - DNA, 1033 bp, Homo sapiens
ttaagttactttaaaatgtacaattatgttattgttgactgtagtcaccctattgtgctatgaaatagcaggtcttgttcattttttgtaactatttttttggtacccattaaccatccccacctgtcccctgtcttggagaattgatgcctgagataaatgggtagccagatgcacctgtactctgctcacacacccaggcccctgcccagtcccactacatcccaaatcccttttgttttcttgctctgatagagacatcaactttgtgatttctcagactaggaccagagaatagctccaggaagttggcatttcatccgaattcgggacatgaggctatagcccttcttctccagcttcctgtatctcctgcacttcatggcccgaggcaccttgcattcttatattttccatccttgcctgccctttagaattgtcctaggtcctaggagtagctgataaaggcacatagctgtccctcatgtcctgagctctcagaggacttggtatggaatgctgcctatgcctgtgaactttgtaattagaaacaggttcaagttttggggttttctttttgccagatactagctgtgtgattttgagcaagttaacctccctgtgcctcagtttcttctgctgtaaaatgggggtgacaatggtccctataccttaggacagtgagctgtgcacatgaagcccttaacacagtggctggaatgtgataagggatattaacttgtagataccttgtggagtgaaacattgaggtgattttgtagacaacaagaggagaaggaaggtattttaaaatccaggcgctaccctcatgccgactaaggtgtgagaggctcacagctcacatgagagggtgatcttgcctgaagcacatgatttttaagtggctggaacctgggaaaccgaaaggtcagttctctctctcctttgtgtgtggcaatgttaactccttagtgccttgttcaacactggctctcttcccacgcagttcattcgcttatttagttcagttcat

SEQ ID NO: 104417 - DNA, 1064 bp, Homo sapiens
ccggaaaggagtccagggaaaatttatacagcctttgacttttagaaccttcagattaggaggtggtcttggggccccttaggagtgcgggtgaaagtgtagagctgagaatgcagaacgcatgctgcctctggttactggcttgccagtatcccccagtattactgaacaatggaggtttttttggttagagtaataacaaagagttactatatccctgttcaggactctttgatatttatatttttaaaaaattttattacagaaaggttgaaatgtatataaaaggagtcagaaaggttttgaaacccctcattcataactctgcttcaacagcaactgtcagctcatgcccactcttgtctcacttatatccctcgctgcttccccttctctcctgtattgttttaaagaagattccagacaaaatgccattttacctatgttgggtttttttttatatatttgatatctgccactcatgccactaatttatttcctatagcattatgaggtttttgttgttgttttggtttgtcttttgtttttttaaccatttggcccatcgactatttttgtaagaaaggcttactcttggcttattgtatcatcttattctattaccctgatatcttaatattttttcggaccttgggaataaaccttgtggttgaaataacatttttatattgctatgtggaagctgacctgtaagccttttcaatttgtcttaattttatcaacttaccccaaagagatttttgtttgttattgttagttgtccttcaaaattactgttctgtcttatcattgtgtgagagggaacttcagtcaatattttagattgctaccgttttttaaaaaacatctggttttctgagaaaatattgaagttaacttcagagtttctaaatgcttccatgaataatttattctttcgccaagtgaaactgggccaattataactgagtacccctgtgtgttttgaatattcgtccctcggtgatgcattaaatgcagaagctgattttattatcctgtttgaattaagggtgaggcgctca

SEQ ID NO: 104418 - DNA, 1046 bp, Homo sapiens
ctcatcacaagatgaccaaagagtttgaactgtgtgtgctatttagaagatttaacttttatgtatctatagataccacagctgttgcttctgataaatttacctaccttttaactgaaagtttaataaagccaaatcaatttgaaatactagagataccaggctatgttagtcagaaatgaatagatgactttttgaaaggtaggtatgatatatatttaaaactaataataaaaactcaaattctatttctagttcactttttatagatgtccttaaaaaacaattttcatgattttttcttccacaacagtcatcttagaacatgaattttaataatacataaataacataacttttatatatgatccctttaaatatttttaatacctcctttatgcactcttccttctttgttagctctctgaataagagttttttttttggacgtgtatctatgtacagactcgtgtacacatacacacacacatatgttttgataaaagctttattgagatataatccacatactgtaaaattcaccctgatgtatatatttgacctgacatattcttggccttgaactgaaattcggagtctcggttaatgaagtcttggttctttgtgcaactttgtaaagggcgtttcttcctgtgagtcagtgtgcccccggccagggtgcctggcttggcaggtgcagcacaggtgagatttcagtccctgcctgctcctccagccagcacccttgtgccttggcacaacctgtgcagccaactgcggtggcccttttctttcgccttccaatccccgcttcccccaacgtacacttttgaagttcattgtcacgtgttgcaccaggttgggatttgggacaatgagtgaggcacctgggccagtggcaaggcccactgcttgtctaagttgtcacgtgggcacgagtcgtacacgttgggattgctttttattttgtcatgtgtgtgtgggtgggtcctgcagtccttctcatcaatggaatgttgcccagccactgctgtgttctgggctcc

SEQ ID NO: 104419 - DNA, 1131 bp, Homo sapiens
acggtcacttcctgttcggtgcaccatggagggtctcaggaagggaaatgggtctgtggtcagctggccttcttgagatccatgtttcctgatgacaggtggtagaaaggggagttgcagggaagcaggcaggcctacacagttccagaaatgtatacagtctgccctctgtgtttgtcggttctgcatctgtggattcaaccaactgcagatttaaaatatttagggaacgctgggcacagtggctcaaggaaacagaaactcaaggaggttatgacttactcagagttccagagctggacaaaacccatgataaaatatcctgtacctcttgtccgtcccacctccacctgtagttatctgtcactgaataaccacctaaaaatttaatagcctaaagcaatggccattttggtgcctagcatgattctgtgagcttgggctcagctgggtggttcttttgctctgtgtgatcttggctgggtctgcaaccatcagggggttgactggtcttagaacagcttacgtggtcactcatatgactgtggccattggtgctggtcctttgctgagagctcagctgggggtactgcctggagtgccttggttctctgtgtggtttgggcttcttagaacatggtgactgggttctgagaaacagtgtttcaagaagcaggaagtggaagctactagccttttcaaagcctgggtttagaattcctagaatatcacttctatcacattctattggtcaaagccagacatgaggccagccccatttcaaaggcggggagaaaaactccacctcttattgtgaggagggtacatgtataaaaagagagaattgttggggaccacctttggggactggcttcctcaccaccacccccattataatcgattgagcacctaccatgggtcagccaggcccccaagctggatgctacagctgcaggaaagggagacaccattgtctctgcagttgaggagtttggatctccctggatactaaatcccttctttgcaaaagtgttgactcttgtctttctccttttggatgttgtaagaaaattcagtcctgccttaggataagctcactgggaatcacagcactccagaaattctagattt

SEQ ID NO: 104420 - DNA, 1100 bp, Homo sapiens
tcccagacttctcctacctggctgccatcagagcaggcttcacattgaaccctccgcttatgggaacaaggagacagtaccacagcccgtggattttccagaaacgggtgacacgttgtcaggtgataggatcacgcttgtcttgaagagaacttccggctttctttctccccactctggtgccacccgcttcctgtcagcccccagaagaaatatttccttgtggcttgatgttttgtagcaagtgggaaactataaaataagcatttgcttatgaattaatttttggcacacatggggctcagcagggctcacggcactttcatatccgtccttcgagtccttgccaatttctatgttccttcctcctaagatgttcccaccagcgcctgggggaagttcccttcgcttcctcttccttacagaaggacaggggctgtccttacctggaatgaagaggaggacaggctatctttggacatacctcgttttttatttttgttttttttaagccaatacagatgttttgggatatatatgctgacatgaccatagagaacctcctagcacattatggggatagatagttaaacatttttttggactaattgcttctggtttcagaagcactgggaatttcatgtatcaaatggctgcccacgtctattcctatgccaaagtctagtctacagacacacccgaaaagggttttcttttctgcacgtaagcagctagagatggaaaatgtgagaagtgctccgtcaggaaactggcctgcaaattcagcagagagagtgatccctggttcatgaggcctttcctacaccacactctttttttttttttgaggttggcttaagaaatcagcccaagaacaagtgttagataggaaatctcacatcccttccggaagtcaccaacacagtgtgggagggacacgttggttgggctatctctgaccccagttagcaaagagatgagggcggaaagggcaatttgatttgcctctgctggaaatggaaggccagtttgtgaggaagatcagccttggtttgacagggcagtcaccctgaggaggaggaaaagattggtgtgtgagc

SEQ ID NO: 104421 - DNA, 1565 bp, Homo sapiens
aacagctccctgtaatgcaaggtcacgtggtagacaagggttagtattaggtaaccttgaatactaattcgtgattctttatcttctcaaagtaaaaacaaaagaacaaacttttgttctggtcattttatgagtcatctgagcacttgcagaaccataatggcaaatagctaatacatggcaccttttcagttgctcacattggatacccaattccctgccttcatttatgcattattgtggttttgaccacctactggttctgatgagagaggaaatcccgtagtaggagtgatagccagagcatctcttgctgaggtgaccccctgagctgattatagccctatggggtattttgttttgctgatacataatacattgaaaacactgtatatagaattttttgaatgcttaagtggggcctccatatacactgagatcattttatccccctaccttccactgcacttcactgacacttaaccccgaagacatttgcattggaaacttcgcattatctgtttgaaagtcctctcagttcaagccacacattctaagactcagcaaaagcttattgacaccaagggcattgaattcaccagcacctgtaacgtttcttgaagaatgcttgctagggaaaagttcccatggtaactgtttttaaaagagttttgtagcatcaacaggttagacaggaagtcaaaatcatggagctcagcagcatcccctataagcacgtgctcctttttaaccacccctaacaaagacactgaagcaccctgttcataagccctgatgggcactggagggtctggccaggttgggctggatttcaggggacctgatttgtgtttccctgtgcagtgctcgtttccatcaccatctttaaggaggaggccttttccatccactggactcttaccatcgtgcctgttaaggaacaaaaagacaactgcttaggcctggagggtatgtggaaaccaccagttacctttgaatatacctgtggtgctcgaacctcctttagaaaacccaagatgccattttaatgatgctttgctcttgggtatcaaatttactccttaatttacctcaggagatgttctaagaggaagccacaagattccatacctgctgttgttgttttagagctggtggatttttttttttttaatccgcggaggaggacttgaccctgtgggttcctaacttggatggccatgcagagcacccttaacttggaaatctatatcctgctgtttaaacttcaagatgattcctatctggattaaagtcctcaaccagcaggccgaggcaaactctaaagaaaaacaaggtcatgctgcatttttttttggtaagcacaggaatcaacaaagagatgttatataacttctatttatatcctccttgctcactatctgcaggcagacaagagtcgctgagaagggatttaatgagctctctgggtttgctcaccttcctgagctggtaggaaccagcttgttctcaaatgcgtcagtaaagaatctggctgtgggtgggcggccagggtaggtggactg

SEQ ID NO: 104422 - DNA, 1505 bp, Homo sapiens
tgctctgcttcatatggagctgttttgccttttgtcttttatctagcggcgtctttatcctaagatggtgttttgggaccggagaggagcacgttaccctgctgaaaaaggcatttggaaactgctggattccagtgcttccagctgcagagttctgtgatctgtgttctcttgctcttttgttgtggttgaaggttggctgacagcagccatgcccacttccctttccccctgtccagtggattcaggatggaaacagccactgccggggtcactgcctcaccctgcccctgcccctgccctggccttttccttaaagcgtatctgatcagatctgtcatcagggatgtctgggactggtgctgaggatctgcccgcagaccagctttgtgtcttctgctttcccagcctttgactccggcctcactgctggggctggttgtctgtgtcggttcaacgtgcagatgggaggagagttggttgtggctctgccacaagtcactgacctctcctaaccccagctctctcatctataatgtgacagatttatgaatgatgatatctgccttggcaatctcctaagactctggtgagacagcttatatggaaagggctctggaatcaaatgtgatttggagacgactggagggtgaggagaggtcggcctggcgggggcagatgccgttccctctggtggagaggcagcctcagaaggtggcccctctacagagttccccagctttctgggaacaaagcagactttctgttatctttttttaattattattattgtgatataattgacatataatcataggcacagattttaaatgtagactttgattcgatatgacaaatgtttctatacccattgtaccagttttctgtggctgctgtaacaaattcctacaaactgagtggcttaaaggaaccaaatgtattgttttataagttcaacatgagtcttactagactagactaaagcaagtgttggcaggccagcgctcctttctggaggctctaggggagaaggcttccttgccttttccagtttccagaggccacccacatcccttggcttgtggctccttcctccatcttcaggtttagcaatggtgaatggagtccttctcacattgcctctcgccaccctcctctcctgcctcctgcctccacagcgaaggctccttgtaattatgttgggcccacccgggtaatccaagctcatctgtctactttaaggtcggtgattagcagcttttgttccatctgcacctttaattccccttcgccacataagacagcattttcacaggttccaggaactagaacatggacatgtctgcggggaccattctgtctaccacacctgtgaaactgccaacctaatcaagacatttattttcttctagaaagttgtctcattcccatttatagtccttttctactcacaaccccccaccctccagaggcaaccaccattttggtgtttttttcaactttta

SEQ ID NO: 104423 - DNA, 1036 bp, Homo sapiens
ccttttgataccaagagtagtgtaactgagcacacctctcatttcatcttgacctcagagcccagcctgggactcctctgaatcctcattccccattctccagttcccaacctattctctttttgattttctgtgcttacttgtgtcttctagaccttattatccattttattattttattgagcacattctatcaataaagctgcttcgaacccttgagcgactgaggactggaatcagtaatgcgaaacaaacctagtgaccgtggcggaaacacacacagcaatgtggcgttctcagcgcctggccctgtctcatctcataagagcttcccttaccctgaccctagcggttgacagccattgggtcacccgattggccgtcagacagcgcggtccgtggcaggctatctgtgtgtgtcgcgtggcgctgctgtcagataacagatggcgggctttatttattcatttacttacttacttgaagggcttttgtttccttgaatgaccagattgtcccaaaatgcttttaaagctgcttccatgccatgagaacacagctgggatagcagctgaagcgaatggccctgcacggccaccttctggtgcaccccagctttagcgggcagtcctctgtaagcccgcatgggtgagatgttggatggtctgtcttggtgagaaattcagtcaccataattaggtggcttcaggttgcattctttgcccccatgatttttttgtctcctttattgacctgagggttcaagagctctcaaagaagtgaacaactgaaagttgctttctcatatttgagcaattttctagaattcatttattttggagatttatttctgtcatgtccaccaaatataaaaaggatctgaccatggggaggggggcatccagttatggggagccataaagtgttgggttatattcattcttttatcaaataatcatggagtgccttctatttgctgggcctcttctaggtgctctgggggcagctggaaaccactcaggcgaggcatctgcct

SEQ ID NO: 104424 - DNA, 1059 bp, Homo sapiens
atatttttcatagggctctgcccaggggaagagtgcatagaagcccttaaacaaatgattggccctgcagtaatccccccagaaaagctcagttttcattattaacagtgttgttttgcgtgtgtgcaagggtggaagggaattgttcttagttggcaacagtctgcccaccacactcgagcatgctcccaaagcctatgtgtctgttgcagccacagcaatttgtttcaaaggctctgtgttgaaaaccccaggccttagaacccagagaactacagtgtgtggagtggtccttaatgttgatctaaacttagatcatgcgtgaggttttgcaactggctctgatcttcattaggttttggtgtcatgagtggggtgcagtttctggtcagttacagtgttcacaatctatggattttcctttgcagcactcctttttctgtcgcttgacagaagataagaagtcagagaaattctttaaggtgttttatgaccggatgaaggtggcccagcaagaaatcaaagcaacagtgacagtgaacaccagtgacttgggaaataaaaagaaagacgatgaggtagacagggatgccccatcacggaaaaaaggtaaatgttcctcagtcttcagtcagctggatcatgaacaccagaagagtccttgttatccttcattgttttcattacttctgtgctctaaaatgcattatgatgggagctttcagaagaaatgccagcctggttatgatgtaattcttcctcagtgacctgagctgaagccctgctgctcagaaggatcttcctgtttaataaagaacattcctcttggtcgagcttagggttttattggcaagggatccatgaataatcttttcctgtgattcctattcaatgttagagaaagttgagggaaatacgtattttaaaactgggtgttagtcctttgtcagataatgttcttttgttttccgaggtattggaaagcttataaagctttttatccagtatctcaccagaagagaagtcgtactgggcagtgggtagacccacaagtgttgg

SEQ ID NO: 104425 - DNA, 1191 bp, Homo sapiens
gaggtacctccattttacagatgaggggactggggcacagagatggtaattaagtcattacggacatgcagctaggaggcagtggagccagcattcgaacccagcgtgtctggccgcagagtcagtactgctaactgtaatgccataactacctcacagggttattctgaggatgagataaaataacacacacaaagttcttcatcacagtgctttgatagttacagaagggtcaggcattacgacaacaataattgtgattagcattatgttgagcttcttaagaactttcttgagatgttattcacggatgctctcccattttaaagatcaggaagctgaggcccagaaccttagatgtgtgaggctgacagaacctgtgctgaggcttttcctctgaaacacactgtacacgtaggtgaaatggtagatccacaagtaaggtggcagggcctggctcggttttaatcctgtctgaggactgagagcagattgtgacttctttgagtgttttgccaactttgaacgtctctaggagataaaggaatgtaggtttctgagtgtcacctttggagtggtgaatagggcccatgaggactctgcagcctttcatgccttatgcttgctttctagctaaagagcccacaacacagataacagaagaggtccgggatcagctcctggaggcctccgctgccaccaggaaagccttcaccactttcaggagggaggctgatcccgacgaccactaccagcctggagagggcacccaggccactgccgacaaggccaaggacgacctggagatgagcgcggtcatcaccatcatgcagcccatcctccgcttccttcagctcctgtgtgaaaaccacaaccgagacctgcaggtgagggcctgggggtgggggcgtggagggagctcgggaaaggctgccaaggcctgccttcctctgatggttcagcacctctcacttgggccagattgcttgagccaaggatccagcaaggttcttttttttcctttttcttttttcttttttctttttttttgagatggagtctcgctctgtcacccaggctggagtacagtggcgtgatcttggcttactccaacctccagctcttgggttcaagcgattctccttcctcagcttcccaagtagctagaattagaggagtgcctggctaatt

SEQ ID NO: 104426 - DNA, 1064 bp, Homo sapiens
ttggctgaaaggttgagctgtatttattgcatgaaggatgtcataggaaaggtcattaggaaagatgggaacacagaaacctgtgggaatggcagttattttttctttactatttagaactgagagtccacactaacagtcgatttgggtgtgtggtttaaatggactttttttctgctatttttaattccttttgacaaattgtgttttagagtgaattttaacagattcaaccttgtgtacctggccaccatttatcagaaagtccgaaataaacagaagttcatgtgctcctggtcagcatttgagtgactttttcaactaatccagtgatctatggatgatgatagaaatttgtgccctgcgatagcatgataccctgactcaactgctgtgacctaaactaggggaagaaataagaccactctcactgtccaaaaaaagaaaaaaaacccaacagctttcaagtcctgtacataaagaagcatacaaagtatcatagacccagggcctaaaatgaagtcaagccaggaagtacaggatgtggggtgtgaacatgggtgtttttaatgtaatgggaaattagggcttggcctgcatacattgttcctttgggtcacatttgttaactagtgtcagatgtactcattatattaggggttatgagagctaatagaaatattttaagacagggaagaattacctttattacctgtcttctctggcctgcaaggccaaataacagtttgtaaccacacctgcccggaaggcagcacagatctgtgtagtagcagcttcttcccaaccactgtcaccatgagggtgacagtgtatccgtaagcacccacgtgtaaattcccaatttcttctaggacttgtaccagctaacattagggcataacacacatgccctgacaaatatgtgcctctttgtccgaaatcagattctgcacacgtatctggggtctgaagggggatgctctctgcctggtgcagatggattttgatgtccttaacccagagcttcctcatggggtgaaatgttcgtctgtttagccgggatg

SEQ ID NO: 104427 - DNA, 1004 bp, Homo sapiens
agaaatagtttcaccagctattcctaaatgtgaatagacttcttatcaggttttcctgaaatggtaaagggctgggagtgggaaatgttggtgggaggaaatgttgagataggaaaagtctggcttctagcctacattcatatcatatttattgtttcaaggtgcttgaaagccattgctgccttctaaagaaggacattaaccagccacagcatgtctcttggtctaagtagagtgaatgagtttcatttctcacgacaggagaggtggattggtattgatggcctgtgccagtgtcatgaaggattctgaggctgtgtccaagcccgataggagagagtgcggaacagccttttccctgggaggggagacagccagtgtgcatgctgtccatccagtcctgtgtgggtcttccttgaaacaggatttttgttcccttggctcttcttgcaggtggaagtgatcaagaaagcctacatgcaaggtgaagtggaatttgaggatggagaaaacggtgaggatggggcggcgtcccccaggaacgtggggcacaacatctacatattagcccatcaggtatgatctctcctgtgcctcctctggatgctgcctccctacaggtccaaaattccgagctggagggtgcccccagtcttgcttttcctttatgactttaacctaggactgtctgtactcatgagcctgcggctcacaggtgctcgtggcaacctgacccagtgtgcagagttccaggacgtttccatttttccacagtgatagggtcatgtagttggaaatccccgtgtttcttaaaagcattcacccccaagcagtgatacttggatggtttatgactctgtctggagacagttgaaaggagtcttaggcttttataaatattgatgagcctctcttaacaatccaaagaaataaacttcagcttccttgcatattgcacttggaaatctgtgggaacttgtccttatgacttccttttgtttccc

SEQ ID NO: 104428 - DNA, 1012 bp, Homo sapiens
atctctgtccctgtattctagttggctcggcataacaaagaacttcagagcatgctgaaacctggtggccaagtggacggagatgaagccctggagttttatgccaagcacacggcgcagatagaggtaaaagctgagtaaactcagggcatggggttgtgttgaggccattagtgtgcaatgccctgctctggggctggcgtgcattcattcatctgagcaatggaaatgtgagtgtgtactgtgtgctaggtcctgggctgggtgctggacatcccatggccaagacagtcattattgctgcttgtggtccggtggggaagaggacactgagcaacctctcattcctcacgaattcacgaggacaggtgggaggcatcataagaaagtccagcagagggacctgctgtagatcgtggtggtcacagaggcctagtctgaagaaatttcatctgaacccagaccgtaaagaacagagggatgaaacaggtagagactagcaagaggaacttttcagacatggggaataacagcaagcgaaagcccagacgtgggaagattctaggtgatccggaggggctaagcaaggcttcaaggctcagggcatagagttcagtgcagagggagatccgaagggaaaggcaggcagccctgatctcacagggtcctatcaaccatccttatgagaagtctgggctgcatccccagagcaatggggaaccactggagagttttccccaagagggcattacaatcagatctgtgttttttgttttttttttttttttaaaaaaggtgtcatgtggctgggcacagtggctcatgcctgtaatcccaacactttgggaggccgaggcaggtagatcacttgaggtcaggagttcaagaccagcctggccaacatggtgaaaccccttctccactaaaaatacaaaaaaaaaaaaaaaaaaaaattagccaggcgtggtggcacacgcctgtaattccagctacttgggaggctgaggcacaa

SEQ ID NO: 104429 - DNA, 1070 bp, Homo sapiens
gcattttgggaggctgaggtgggcagaccacctgggctcaggagtttgagaccagcctggccaacatagtaaaaccctgtcaatactggaggaaaaaaaaaaaaaagccaggcgtgaaggtgcgtgcctgtaatcccagctactctggaggctgaggcaggagaatcacttaaacccaggaggcagaggttgcagtgagccaagatcgcaccactgcactctgtcctgggtgacagagcaagactcctgactctgtctcaaaaaaataaaaattaaaaataaataaataaagttaatggatctgaagttaggaaaatactcttccagagttacccaagctattttttatataaatctgagacacacagcccagtttggggttataaaatcagagatcatattatactcaatcttgaccaccgagtctaccaccagtagcaaatagtcttagtaaaaggtttcaaagatgaatatttaatctcatccactttttcatcctagattgtcagattagaccgaacaatggaacagatagtctttcccgtgcccagcatatgtgaattcctaaccaaggagtcaaaactacgaatttactatactacagagagagacgaacaaggcagcaaaatcaatgatttctttctgcggtctgaagacctcttcaatgaaatgaattggcagaagaaactgagaggtgggttccaacgcatcagcaacaacacagagagacacagttctgggatttcacaaacttgggcttgatggtgcgttcatttccaagcaggagcaaagctagtatcatttatgatactttgcacctctgaccaccaggaagtcataaccagttttgcagctgatcagtgggctcaagccaaagtatgataactcccctgaaaaggcttccttcatcagaatttgacttgatttgattggaaagctccatggaagactttttgaatgcctcttttgatatctctatctagaaaataaaaagaaaagggaaaagcccaggcccttgagctcacagggtggttcacttgagcaggaaattcacactgcttgctggctca

SEQ ID NO: 104430 - DNA, 1589 bp, Homo sapiens
gagatgggaactctgctgctgaccacgaggtcagcaacttgtacccctcgcttccctgtcctcaagaatgatcatccaacttcagggaaatggcagatgactcaatgccgggaaaggaatcattgtcttgcttttaggcactggcgtgttagtggagcatgttgagccagagaggaatgtggaaatgataccagccctagtctggggcccagcggggctgactctgaatgctgtatctcccccacccctccccagtgccccacacttctaaaaagctaattgaatttttgggtctctccgggcatctcatctggtcccagagccctagggggaaccgaggactcaatgtgtgaactctggataacccccagattccgcaactgatggctgcggctggggtatgcagggtttatagatgctccaacttttctctttttgctctctccttactccacccccaatacatcttctgttccagtaagtactccacacagaaataaaccaatctgatgtcattatgtaccaagttccaaacaaatgatcatttttactcttgtggtaaaaaccgggaacaaaagtggacttgtggggcagagctggcggaagggccacattgcattcctggcgttccggcttggggtctccagcctcacgcggctttgcctttgtctctgcagcccagcccgtgttgtactggtgtgcccgcaacatgtctttctggagcagcatttcgtttaacctggccgtcctgatgaacctgctggtggcgtttttctacccgtttaagggagtccgaggaggtacccatatctttaacttcaaaaatcctattagaagcagcaggaaggctaggacttgcatctcagttgtggttcctggatgtattggtgcagtactggggatcccagttatccacattcagacaagaggagattgtagctgttaccatagatttagttttaaatctaacttaaaataatttaacttttttatccattttttttaaccaggaaagaaagagaagcagctagatactattaaacctgtgagaaagtctcttaatcagccccttcttttatatatgaggaaactatgtctcagagcagttaagaaatcaggccaaagtcacatagctaactaatggcagagctaaccctaaaacgtagacgtcttgatgctcagtccagtatatgtgtttccacaccgcacttctggaattgatttcagactaaagaatttgtaagaaatctctggaatattttttttgccaggggtcagaggggaggcaggacttgaatgactgcagactgtacaatgtttagtctattaagaggtacctgccattattcacataacaaaacatgatgattatggtctttctgggttccccccagcctacctccttccaggctacacattttgctgagaaaaggcagacaatttggaggtgggcattttgctatttggggcccctcgacaagcattcaaagctcctcttctgtgatacattcatggccccttttctgacatccacagcagccacctgggaggtccacctcccggctaaatttttcatcagagctttttgg

SEQ ID NO: 104431 - DNA, 1066 bp, Homo sapiens
agccaacttcttgcaaagagcaggttccttagcagagggcaagcctggattgtgaaggcactgtgacctgcaggggtcttaccctcgcaatgttaacgtcactaatgtccctgcgatacaccagctatgtgaccctgccccagtctcttgatcaggaaattgatgataattactatttactgtacttactgagcatatggatgccagtgtgctaagcactgtgcgtacgtggtttacttattcttcataacaactctacatcctccagtctgcaaatgaggaaatggagactcagaggggatgaggaaagtgcctagcccgagatcatacggtggacagtagctgagctgagatttgaatttacatctaagtccagagttcttgccactgacgctggcttgtagtacgtctgccttcccaccagacactgggctgcaggagggcagggaccagggtggctggctcttcataaactcaattcagtaccttctaaatgaatggatgccaagaccctcatcactttcctctccctttgtctctgaaactcattggcacaagcatgtattttctctatttccagtccctctaaatggctctggatactacttgaagttgctattgtttcctgcttcctcttctgtgtttatttttcctcatttttaccatctccgtttcactgtgaagccagggaagatgttcagtgttaagatcatatgtagtgcttttgagtgtctaagagggcaaactctctataaaccaagtttgcattatgggatagtgatgtacatctaacatcaaggcttcttaaaattctttttgtttgttttcaaagctttttgatttagtgtacagagaagagactttgcttaatgtcattaaaagtgtcactcgcaatggacggtccatcatcctgacagcagttctggctctgatcctcgtttacctgttctcaatagtgggctatcttttcttcaaggatgactttatcttggaagtagataggctgcccaatgaaacagctgttccaggtgggtttgggatcttctgatctttttaatgctaaaag

SEQ ID NO: 104432 - DNA, 1918 bp, Homo sapiens
ctcccaaatgctgtgttcttggcatgtatctccagcctcccaagttgacactaagtgacatttactgccagccatcttagagttgtggactaaactggcctggaccttggatttctattaatgcctgctaatgcttctcgtgcagacttggtataaatcttgccagagtctgtacgttcagtagtatctgtctaagagtttcagctgtttgtctttaaagttggagaggtgctatttaagtgcgatatttctagtaagcctacaggaattgacatttttggcttttttcccatccagatcaccaaatgaaagtgtaaattgcatttctgctttgaatttatatgcaagattctagggtgttatttatgtaaagaattgtttaatcagccgtgaattggggacttcaaacattttaaccatatgctgccagattgttcatcataaaatttccttctctctcccagaaaccggcgagagtttggcaagcgagttcctgttctccgatgtgtgtagggtggagagtggggagaactgctcctctcctgcacccagagaaggtaggacctcctaactgtaagccccatgttaatatcggactcctccagaggcttagctgatgcaggtgatgttggaagaagattaaatttactgctcaggagtaaggctatagcaaaggggaaaggctgagaaagaggagggagatgaagggaaaagaaggttacacctgaagaaaagatctgatgtgattcagccgatttatactgagtgcccgccatttgccagggactgtggtgtactctaagagacagtaatgtagtggagggtgcgggcaggccaaatggtgattgctagagagttgcccaatgctgggaataaggatggaatacagaagttaggcacccggcctactactgggctaagcgtatcatcaagaaagtgatatccaaactataaaaggagactcttgatattccaaggagagggaatagtacatctaaaggctttaaaggtaaaaagaaaaaaacagcaagtttggggagataatgattataaggaaggagagtggcaagaaatgaagccacagatacaaacaaagggctagatcatgaaggatcttctatgtcaggcgtaggaggttaaacttcgtccagaggatggtcaggggttgttggaagatgagtgatgaaatctgtgttttagcaagaccctctgcagctggagaaaggaatgaggcacacagcaaggcatggctcttactgcataaaccagtgagaatgaacagcctccaatgtaaagcagttgatccagaggccctgccgtgaaatatccctggatatagtcctcacaccattcccagtgaggaacctgtgtcctgtggcataaccctcatctgagagacaagaggcctgtgactcagagttgcgaagcaactcatctgacatgaaaagactgtttgcggctgggtctggggtttaaaacctgaaaaggacagggcatgttttagatcccacagagggagagcaatactaccatagctggagaaattagcgggggttagcgatgaaaacagttgccccagacgactttagcttttgaaagaaaataagaaaattcttggctcttgattccttaattttattctttcgtgtgcctggtgagatggcattcaggaaacaggatttcaaaatcccggtctctcttttctcctcacgttttctctctgttgttacttgccgtgttcacagagctggtccctgcagaagagacggaacaggataaagagcacacatgtgagacgctgctgatgtgcattgtcactgtgctgagtcacgggctgcggagcgggggtggagtaggagatgtactcaggaagccgtccaaagaggtaaattaatcccgaggggaaggaagggcaaag

SEQ ID NO: 104433 - DNA, 1044 bp, Homo sapiens
aaaaccttaacatgtctgcattttggcatttacctgggcgaagggacttcacattccctggttgcatgcaatatgtgagagtgtcacacacattctcattttacccctaaacactcctggaacctagacggcggtctccccattcactaacaaggccactaaggcatgtggagatgaagcagcaactgccaagtggcagaggtgggattcaaacccaagtctgtctgactcacagcctgtgttttcctgccataatgtaaacatgaatgtacttataaggccgacagaatccaactctttataaagacaggagtgaaaccacagccccctttctactgacagttctgttattgattttttttctttaccaaggctgctcagctggggctgggggctttttgtctcatttttaggcttggaaagagacaagtttgacaacaagactgtcacctttgaagagcacatcaaggaagaacacaacatgtggcactatctgtgcttcatcgtcctggtgaaagtaaaggactccaccgaatatactgggcctgagagttacgtggcagaaatgatcaaggtgagtggaaaggcctcctgggagcaaggtggacttggggcctactcagctctgagcaaggccccagcagcccatcggggagctgcacaacagaagaataacatccgatgttgcctgagcccttctcacggatggggcgctgtgctctgtgaacttcgtgtgttctctggagtgatcctcagaaccactagataggtggtattggcctgtgttagtgggggaaatgttgagcctcggtgagattagcacgtgaccacggaactggggctgggattttaatctggatcaaactccatagcccgatttcctgtcgctatgtgaatctgcctcttttcttgatagtgcttttttcccctttctttttaattaacacctactctctaagaggtgtcttagaggcaaagtgactgctcactgcagtccagcatggtttgtgtttgccctcagcctcgcctttctgggagacactc

SEQ ID NO: 104434 - DNA, 1037 bp, Homo sapiens
tggctgcctctgaggagaaggggccaactctccttccagttaccaaggacttgagtgctcggcctgataatgacttaccctaaaggagcctgctttttacctagatgtaattttcaggctttttatgtaaagatactggaagtcaggtctgttcagataagtatcatcattgacaggcctagaggcagccaggctttcagttttattgccagcagggcagcgattacgtggttgtgtttgctgaataccccgattacagaggcacagaggcctctcctaggttctggagggctttctggagattctgtgccgtctgtacccttgaggtccttagagttgaattccatgcttctcaaattttattgtacatatgaatcacctgtggagcatgttaaaattcacattttgactcagcagtcacttccaggacttgagatattctgcatttccaacaaccttccaggagatgccgaagctgctggcccgggaatcaccctttaagtagtaagagcctcacagaggagacaaagcagatgcttacttaagattactctcagaggggttgtgcgaatgatgaggagaaatattcctaatcctttacatacatttggccctcttcggtttgtaaaatcctctcacctctagtattgtatttggttgttaaagttacgctccatggggaacccggaggaagggacttctgggatggggagagatggatggaggttcacggcagaggtaacttttgaaaaaggttttgaaagagaggatgaagtcactagggtcatagattagcagaaagaaaggagaaaaaaaaatcagcacagactggggagaaaaagacacaagttgcagaatgctgatgatggcttatcccttttacagataaaagccaggctgggggttaagtgacttcctaggaacagttcagaaggagctgagccagaattcaaaccaggcttggctgactgtagaaatcgcactccataatcatgtcgttgataggaaaccgggagggtgctggtgattctgggagc

SEQ ID NO: 104435 - DNA, 1027 bp, Homo sapiens
gcccttggcatgctgatgggccccattcgtgtcttcagcacacactctttagacactcacccttggaggtagggcctccgtgcagctccacagaggcgaagaactatgcattgagacctggccggtgaccacagttcttggactaaagcagcttgagaatagagaccttgtctttctcatctttagatcctcagcgctcaaccccatgcaggacacagatattgtaaaagttcagtaaaaagctgttgaatggagaaagtctgtgcattttgcatttatttgttcaaagacccttctgaaatcattgcctagagggccaggaggtacatatggcatgaaagaaggtgaggaaaattctcattttaatctgtagtcatttggtcacttgctattaggaatgagggagagaaactgttccttaaactttcggctatgtgcagactcttgcattggttttctggagtctttcgaaggcctcattaatgtggactctgtttggaaatgtgtgttttctatttttatagaaggtttgctaagcaaatgaacatatgaaggatttgaaagccagattttagatggattcgctaacattttaggcagtttagattcatttgcatgtcagtaataagtgagctacaggtgagttccgactgctagcagtgaggactgtgaatgtccatcctctctcctctcccctggtctggtaaggcacggcggcctttcacagagttcctgcttccttctgtttccctctagtcttcaacagtccaagctgctcctgcctgtctgccctcatccccagctccagccacactggagcctcactgtgccagtggcctctgtgaaatgccctcatgcttgcccaagggctaaccttctttagggccaagccttgcttgaagaggattttagccaatcaatcagtcactggttgttgggtcttacttggacactactctctctaccgctcctagatacaacatagcctgcattattccttagttagttttttatttgttttcagaga

SEQ ID NO: 104436 - DNA, 1033 bp, Homo sapiens
ttctatcacatacttaggtatcaaaactgtttctcctttgagggggtccaggatgcagtgaccatgtctctgttgctcactgtagtatcctcaacattgttgtatccaaagtgggactttgtatcttttttcttcaatttgttttcctcaattgaggtcagtctgcaaaaataggtagcagccaccgtgagtatccagggcctcgtgctaagtgatctctctgcagctgtgctttggtttgtggcttcagcagcccagcccacgtcatccctcctcccctcgccctagtgggagtgagtgatcaccagtgacctgtcgcctatgtgtgccctcttctgaaaaatgaggtttcctcctcagagttgcatagtccttgaacatgggctacttccttggtgggaagatgtggctgtgtctgaaggattgacacaggagagatgagtacagtcaacgataggccactgcagctgcacgggagaaaactggttacaggtggggaagcactttgggtttctcagctagtcatctctgaaatggaatattttttaacgatcttttgcccattgctctgtggtgggaaattgatgaatataagctaatgttaagacacatgaatgaagtgtttattcagggtataggaaggtagagattgccatttttctcctccagcagtcacgataagcagctcaggcttactacttaagcatttgttattagggtgcatgcagaagaagagttgcatatcattctgtccttccacaagcttttattaatattgaatgtctactatgctctagtcagtatactaaggtggttcctgccttcataaagctcacaaactagtgactgtgaccctgcccgcccacccaccagtatcttaagcaaacactctatgacaccttgttgtccatgtggtatgactgcttgtgatatttttcatctagctctcttatagggcttctatattgctagatggccctaggtcaagatacagctcaatgatctcacttgagttgtaatatttagacatgtc

SEQ ID NO: 104437 - DNA, 2015 bp, Homo sapiens
tgcacagcagtgtgaatgtacttaatgccactaaactgtatgcttaaaatggttacaatggtaaattttatgttatgcatattttaccacaattttttaaaaaaaccaaactcatcagccatgtaatttgcaaagatcagagcagcagtggcagtattcagatttggagattaggactcttgtttagaacctatatttcccctatatttaaatttaaagtggcttcctctaagaattcagagttccattgtatgcaattaaaaagatagctactgagcaattaaaaaaatacacagcacataagttctgccatagaaggagataacctaatgagagttaggaaacatggcacggtaagctggcctttcttgtttttacctctagaagtgactcagtcttttttttttttttttttttttttaatgtggattctaggaaagaaaccttgactggttccccaggatgagagccatgtcattggtcagcagtgattctgaaggagaacagaatgagctgagaaacctgcaggagaagctggagtccaccatgaaacttgtcacgaacctttctggccagctgtcggaattaaaggatcaggtaaagaaagaaaatcccagcgcctaccctcccatcactatccccacccacacccactatcaccacaccaaatctgatgaggaaaatcagtagtgcttcatctagatggaaaagggagccaggcaacaggggacaaacccactcactcctccagtctcctcaccccaatccccttcactgcccttttccaggataaagccatggtgctactttcagtgctgctcaggacatggttttaatatgaaaaacaaaaccaaaaaaaaggagggaaatgcagactacttcagtgaagtactgtccaaaaaccactatgcataaagccataccctttttactttatgtactgtggaagattaaaagctgtttcttgttttgcttcctagccctcagacttgtcaaatcctcaccccatatatttaaattcagcatcctaggctaaaccatagtcatggaaaagcccttttggtttcattcttttctcagtggcttactgagtggctatcatagtacaggaattatgccaggtgttggggataaaacagtgaacaatatagacatactccctgatctcacaggcctcaaccatccacagaaatactgcctgcaccctgcttcctatccgtaagataaatgcttcgcccttatcttatggataggaagcaggatgcgggcagtactgtgggcagaatttaaattggaaacaggcagtttccaatttaaagtaagttgtaggggacatgtttatacaaaaccgtgcgtactctgtttctgcccttttgactccattaaaatgaacatgccacagtcaccaggtggttatctagtgataggatgcagctgtgtattaaggacttgtaccctgggtggtgagaagaccctgattggttttattagtgcatttctgtaagtgactgggataatcatgttcagttcagcattttatgtgagtttctgaaagctctttaatcaactccatagacaagattatagtgttgcacagcaataggcatgggccatgtctgcactggaggtaagttgcaaggtacacccacgggtgatttatcactcttacaaagatgataactaatgaagaccgcatctagaatgctcttactggagatggtttacagagcatttttaatcatcatacttagatttatattaatatttcttttcaaactaaattattccaaactgtgccctgagataccatttggcctcaagttcttttctttcgtctgtattaaggtgcaaataaaaaagactagtaggaaaagaaggccttatttatgaaggttgtctatagctctgagcttggtagctacataaaatgagtaataacctaaataagtaaaactaatgaagatctaactagattactttgcttaatattaacattttacccgccccccgccgtg

SEQ ID NO: 104438 - DNA, 1028 bp, Homo sapiens
acaaaatatgtaaaatttgattacatatggactaaggttcattaagtgacattaaaaccagtatggtttaaactgcttgattccagccttttatgcattttttattttgaagttggcagttggaaccactcttcagaaagcccttcccctgtgaatgaatttgaactgttttttttcttggaagatattataagttaaaaagaagcatgagaatccagtagtacattctcaagtgcttttaccaggattgatctacttaagttttaaggtactcagaattacaggaaaaattcagcatagctgctttttttttttttttttttttttttttttgagggggcagggggatttgcatcttttaaaaggaagtagtcagtgttttcttttgattatgtaacgtcctacaaacctttaatgcatttgagaatcaacttgttgaatagatttgaatttcattaagtttggttatagcaatcataaaggtttaaaaaccctttatgtgcaaaagatattaaaaaatgcagatatgttacagagctgctctttcttaaatagtaattgtgagaattcttgccctttgtgggaaaaaattttgaattaaaaaataaaagctccatgaatgattaatgaccaagaaatcttgtgatattttttaaaacagctatgaaagaataccattcactagtaaaagtgctagaaaacacaaaaattgctccattacttagaggttttttttgttttgttgttgttgttgtttgttttagattttctgattcaaaaaccagcagactcgagcaacgatagcttaaatgtggatgactttggtctaaatctttactgttatttacctctttgattgtttcgttatgtatcaatctgagggaaaaaagttcttgttaggatattagtaaaattatggttagtggtgtcactttttctattattgccaagaatggttggttaggattgctattctaagtattatttaacgatgcctctcatcttgaagtttcccctcccaagagatt

SEQ ID NO: 104439 - DNA, 1309 bp, Homo sapiens
tcctgtgcttttattgttttttgtttctttatgaaacaagtggcaagcaatacttctgaatgttacattgcatgactaggtcacagaatttcccattctgcctaagaagatgccttttttgaagtgctgtgtgtttgatatagcgatggtacactatttgtagaaagtgggtttcagtataaaccataaccacagaggtaaatctatggttcagtatgcgatttgacgtacaggaagtatctgggtctaatgatgaaactttttaactttccagatgacagaacaaaggaagcagaaacaaagaattggtcttctaggacatcctcctcacatgaatgtcaacccacaacaaccagcataagcaaatgaaagaaaggaattgtatttaccttttataattattattagtgtgggtatggctaatgagttctgattcacccacgaaggttacatttatgctgaatacatttgtaaatactcagttttatactgtatgtatatgattgctactctaaaggtttggatatatgtattgtaattagaattgttggcatgatgacatttcatttgtgccaaaaatattaaaaatgccttttttggaaggactaacagaaagcacctgatttgcacttgaaccagattatagatttaaaagtatatgacatgtattttgtatttaaaactagaatagccagtatttatgttttttataaaactgtgcaatacgaattatgcaatcacaatacatttgtagctcccgagtgtcctaaagggagtgcacttctttgaagctggtgtgttaatactatgtaataaatggttaactttcaaatgatgctgctgccaaaattatattaatagtgagtttcaggcccctgggcattttgtaccatgtaattatcctctggtgatgctgtttctcgttagtggcagtagtgcctccgtctcctagtgataatgctccaagtctatgaactgttaaatcagcattcattttaagaaaagcaactttagtttcaaagatacttttaagcttctaaattgatcatttaaactatttctttaaataagagagccaaattagaggctcatactttagcttgtgaagaagataatgaattttttaaagggaactttctatgcaatgttcaggataaatgcatactgctggccaatcagtgtcatctcctgggtaaattttgatgtcgcattataaagacatgcataattgatggtttctagattatctagtccaaacaatagagtttattttttcttcatctgaaccaacatgctacagtagctaaga

SEQ ID NO: 104440 - DNA, 1062 bp, Homo sapiens
caggaaccaccttctcttctctccctccatccaactaatcatcaaacccccattaattctactcctatatattttttcgaatatcttaccttttcatttcccatctcatgtgcaatgttactagccttttcggcaaccatcatttcttacctggatttctgcaaaagtcttttaatggttgttcctcctacttgcagttttgaagctcccagcattcttgtaccctactccccaaaacttctactcacaaagtcctttggctccctcttcttatctatcctctctcatcactccctccttcactgaagacactgccccaacacacacacgtaaatctataataattaacactgtacttcccaagtcctggaacaacagatgctgtcttttgcatcatgtcttttcacttactattcctttatgtagaacatccacctcctcctgcattcacttaactaacttttacttatcctccaggttttagttaaggtatcctttctcatgggaagctttacataataccctaatctagatgatgtgctctttatcttttagcacttaacacactgaaattatttttctctctgtatctctttctagattgcaacctccatgagagctggggctgctttacttgttcatttcattcatcactctgttcccactattgttaaattcagtaatccttattacttagaaacaggcacaaaccagaacaaagcagtcaatggcatagtgtaatttgggtgtattgactcagagcaccacattgactatggtctcagtcaaaaatattcatcgcccaacatgttgacattcttattattgtgtaaggcattataggacttggactcagatgccttgggcaattcctttcagcctctctgaaggtttttcttcatttcttaaagggattaagcaatacctgtaccaaagtgatataggagaaacagattataggagatgaagcaaaagcattttgtaaatcaaacaatgatactcaacatatacatatatgtatccttgactaatccacggtggccaaagtataatggcttactt

SEQ ID NO: 104441 - DNA, 1084 bp, Homo sapiens
atccctttaaaatgaactgaaatgttaaaatgtttcctaggaacaccttcagtcctcattctattgtttgttgcaaaaatattcttggatttcttcgctttgagagaaactatgaaaatgaaaaattcccaataaacaaagggggagagttcactttataaaagaatgcttttctttgcgctggcatgtgtaataaaaagaaacaaatacaaattctttattcactgatgggttctgttagcaatacacttaattttcagacacaaaatgttaggagtcagttgactaccaaaatctctgaaatcacatggttgaggagataatttaaaatggaaacatttgatacataccaaagttttcagtgatatagctatttggcaacctcaaagtggaatctacagagatagtctggaaagtcattgttaaaagactcataaaatcatgtcttcggatagtgatgaaaacatagtttagcgaacttaattctagaagacagtaagctggaaaagcaaggtttaaaagccagaccacagacagagaagtacttcacataggcacaataatcttcaagaaatagataaatgtattggatatttatttttatttgtaataattctaagaagctatctcataactacaaaatgccacacaagcatagcagcttttatccaattgctatatgtccttgggcatgtttttacaataatagaaatgttagtttttctattcacatacaaactccaatttagctaattaaatcttagccttaatatgattctactggaattaaagaaagatactgcacacattacttcctgccctgaccatttgagtgttgctgacagcagttaaaaaggcatcacatccctttggtgtggcattgccaggtttaagaaaaacaatgccaggcaaactgggcagagaagctggaaatccttcaggaatgagatacaacatgagtaggtatgtgtgcatacacatgcaggtagaaatatatgttattatttacccaaaacttgttacagagcatatacaactaattttctttaaaataggtggctgtcagattaaattcataatgtct

SEQ ID NO: 104442 - DNA, 1009 bp, Homo sapiens
ttgtgttttgtttttaatttcattgtaaccgagatgcctaggtagagaagcgggggagaagctaacccaaagccccaagcccggggcggaaggacctcctccagcggccccagatctctgcaatctcacttaggctgccggagggccccacccacctcccccggaaaggtccgggctctgtgaccttctcactcagccgggagcagggaaaacagctgaaactccaatcccgcggtgtgagcagcgctgatacagtcagaggagggagccagtggaaactcatgactaaaataaggcctggctggggatttcactgacctctgcgctcccctgccctgcaagttcggggagttgagagatgactgtaagcccttcccactgcgcttcgggtcagtcaccccactgctgagtgacctggctgtgggaaggattgaaaaaaaaatggggtcactgccgagactgggcgaagagtagtagcctcgggtgcagttaggggatcagtcttaactggcagtgcccttgacgacctagagaactggcattcacaagttgaccaaactggcagtgtatttccttcaggtcgccttggagagctcccgcttcctgtttatatttcacaagcgtcaaactctttagcaagtgtgagaaatgcctccttttctaactgctaactggcatgacctcacttcggggctcagagatccctccctgccagaatgtacttttgctggccaaaggcggggaccggggtccgccctggaaacgcgctttcaatcttgggcgacctgcttcattgtgtgattttaataaggatgaagggctgtcacggctgcgtcaaaaccacggttccagcaggaaataagcactgggagaggacaggacacgtacccccttccgccgacaccccccacccgatggcaggagggagcccaaaccttgcagcttccatggctcatggctcatgacaatatcattcttaaaattctttgagtttatcaatacgttttgc

SEQ ID NO: 104443 - DNA, 1360 bp, Homo sapiens
gactcatgcaaatgaggcgagaaccacttggacctctccaagttggctccaacaccaactggccttccttttcaggagtttaacttctggtgattttcaggattccctagtttttctcacttaaaggaacacgccaagaaacacacacattttatttaccccttcccctctaccactccccccaccttttttgttgttgttgtcaaataaggggacttgctttggtgtgtgatttttacggcctgtcctttcttgacagtagccctcggctacttcgcagcctttggttggggaaatggaaaaaaaaaaaatagtatttcgggaggaacaaaaaagcctggatgagctggaagttctgaaagggtgtaaggaaagaagtagggaaagcctcttggctgccagacgtaatagaggtccctctctgagttgacaccactgcaggaaaatgttatctctggattcccctgagttaaggtcggcagaggctgctggagaaatttatctgtcaaaggattttcctgaggtagttgcagcttccaaaatgcctccaaagacaggtggcacccgtttttttaaattatttaattatatatatatattatatatatatacacacacacacacacacacacacacacacacatatatgagtgtatctgtctatctttttaaaagcatgacctacagacttaaaacagccaaccaggaaacactattccacttttttttttcttttctcatttctcattgctaataaatgtcccaaaggtgggacttctctgacctcaccgctgactaaggctcttttccttccagactttgggtcacttggaaaaagcagtggttcttgaacttaccttgaagcatgtgaaagcactaacaaacctaattgatcagcagcagcagaaaatcattgccctgcagagtggtttacaagctggtgagtgctgattctggctatgctctctttaagagtttgagtgcaaatagagagcccgtgggctcaacatctgatgtaataaacattactgcaacaaattgcttatgcacgttcattgggggagatgcagttttatctttcctaaaaggtcagacttttcatttgaaatgcattgtgccacctggcatgaatacgtattagtgaaatgataagatattcctgtggcattttagcttgagagtctctgggttctgggagatttccctactcccttttaaaatgccaaggcacctataatttgcattgtgggtgttttacagttggtcttcttagccctctttcattggagaagaaatcatgggtatgccccagcgttttcctgtttctttgcttccttgtcacttggtgtgtggtgtgatc

SEQ ID NO: 104444 - DNA, 1323 bp, Homo sapiens
aaaggttcggaaggtcctgggaaaaactgcgtgccagtcatccagcggactttcgctcactcgagtggggagcagagcggcagcgacacggacacagacagtggctatggaggagaatcggagaagggcgacttgcgcagtgagcagccgtgcttcaaaagtgaccacggacgcaggttcacgatgggagaaaggatcggcgcaattaagcaagagtccgaagaaccccccacaaaaaagaaccggatgcagctttcggatgatgaaggccatttcactagcagtgacctgatcagctccccgttcctgggcccacacccacaccagcctcctttctgcctgcccttctacctgatcccaccttcagcgactgcctacctgcccatgctggagaagtgctggtatcccacctcagtgccagtgctatacccaggcctcaacgcctctgccgcagccctctctagcttcatgaacccagacaagatctcggctcccttgctcatgccccagagactcccttctcccttgccagctcatccgtccgtcgactcttctgtcttgctccaagctctgaagccaatcccccctttaaacttagaaaccaaagactaaactctctaggggatcctgctgctttgctttccttcctcgctacttcctaaaaagcaacaaaaaagtttttgtgaatgctgcaagattgttgcattgtgtatactgagataatctgaggcatggagagcagattcagggtgtgtgtgtgtgtgtgtgtgtgtgtatgtgcgtgtgcgtgcacatgtgtgcctgcgtgttggtataggactttaaagctccttttggcatagggaagtcacgaaggattgcttgacatcaggagacttgggggggattgtagcagacgtctgggcttttccccacccagagaatagcccccttcgatacacatcagctggattttcaaaagcttcaaagtcttggtctgtgagtcactcttcagtttgggagctgggtctgtggctttgatcagaaggtactttcaaaagagggctttccagggctcagctcccaaccagctgttaggaccccacccttttgcctttattgtcgacgtgactcaccagacgtcggggagagagagcagtcagaccgagctttctgctaacatggggaggtagcaggcactggcatagcacggtagtggtttggggaggtttccgcaggtctgctccccacccctgcctcggaagaataaagagaatgtagttccctactcaggctttcgtagtgattagcttactaaggaactgaaaatgggccccttgtaca

SEQ ID NO: 104445 - DNA, 1031 bp, Homo sapiens
tcatgcctttaaaaaatagctcacgagcgtgtgttttcactaaacacaggaggctggtattcccctcaggtattccaagtgagcaagatatggctggtagaggggagaattgggaggtgagtcaccggtttggcaggtgacgtcaccatgaggtgaccgtctgcgtggtgtgccttccaactcccacgtctcccattttctccactcaggggcggccaggtcaccagctggctcagctggaagtctatctgttctggtgtgatgtttagtgagaaacattcctctttatgactcagtgactcaatatcccaacagatgggttcaggaaggctccagcagctaaagccaactccgaggtcgaaacctggatagccaaggaggagatgaaagacataaacccttgggaagggagaggagagagctcgttttctgtttgttggaatgctaaatatctaagaagtaatgggatgatttaggataataattattatcctaagacaacttaggagactggcacacggaagaggatagtaaatatttattgaatgaaatattcattgattattatttcagaggtattcagctgcaagaacaatcccaaactatgagtgaaaaacacagattctcgggcgggcacagtgcctcacgcctgtaatcccagcactttgggaggccaaagtgggtgggtcacttgaggtcaagagttcgagaccagcctggccaacatggtgaaaccctgtctctgctaaaaatacaaaattagccaggtgtggtggcacaggcctgtaatcccagatactcaggaggctgaagcaggagaatcgcttgaacccaggaggcagaggttgcagtgagccgagattgtgccactatactccagcgtgggtgacaaaagggaaactccatctcaaaaaaaaaaaaaagaaaaagaaaaatgtatattcttacttatgtctcaccaactctagttttctcaaaggggcaccagaaatggagcttgatatattttcatggaattgacacaggtttga

SEQ ID NO: 104446 - DNA, 1073 bp, Homo sapiens
tgaacaggaagacaagagacttgaatttgaatccccaaatatgcttgtgctactgatcagctgcaagccagaagcgtcttttcaaaaggcagatccaactgtgtcactcctctgcttggatcatttcagtatcccccgagaacgttcacatctctcaccaaggccagcaagctcctatgtgtctgcctcgctctgtagctgctctttgtacctctcttcaccttgtggctctgccagtttcttacaggtttcaggcttctttgcaaaagctgtcccctcttctggagcacctgttcccttctccctttttgagccagtacctactctttcctgctggttgcagcttcacctctttggtgaagctttccctgattgccagtaggtcagacctttttggaacacaccctcaatgcactctaacttcttcaaagcacttctccccgtgaaaatgaataatcacatttaggttggccattagactgtaagctctgtgaagggccaggtaccatatttgcctggttcatctgtatccacaaacctagcagaattcttagtacatagtgagagcccattaaggatttatttattttattattattattttcaatactgctccttctgtacattaagtatgtattgatagactcagtgagagtctgagaacccattgtgggcctccattttcccattcgtaaatgtcaggattgtgtaggtgtcaaattctatgattctaagagtcttcaatgtgaagcacctgggtaaagagggagctagtgtcagtgggtggaatttggttaaatcccagagggtgctgcattttatttgaagcttatgaaagaaaaggctagctggggccatctggtctggtaacaggtggactcaaaaacgaagaggagaagttcacttaaaaagcagccctgtctgcaaaaaaaaactcacactccttccctgaagaaggctgtcactggtttctctctctggctctgacatatgcttcaatccctcgctcctaaacgtggttgatattcagagcttgctccatgtgaggagagctgctatgagaactgcaaaca

SEQ ID NO: 104447 - DNA, 1012 bp, Homo sapiens
aagtcttcctgcagattgttaatgaacaattatagcaaaaaatgaatgaatgaattaacgaatgtataagtggatgaatgacgaatgaaccaacaatgaatgaatgtagagaaagcctcaagggggcccgagggtacgctgtgctgcggagcatgcccaccaggtggcgatgccagcggcgggcgggcctggccggattggccgcgccgctcttgccgtgggtgccgacggcggcgccgggacgggcgtggggggtagggcgagtcatatgatccgctcggcttcctgggtctggctgctgccgcccgccggtgtccgcccgtgtcgcgccggggcaccaaggagccgttggagggtccgggcggaggcccgctcgtgtggaagtcgtcgacgccgccgctcgtccgtcctcccgtccgttctcgctcccggccgccatcatgctggcgctcatctcccgcctgctggactggttccgttcgctcttctggaaggaagagatggagctgacgctcgtggggctgcagtactcgggcaagaccaccttcgtcaatgtcatcgcggtgagcgcccgcccactcactcgcccggggctccgcagccaggagtccggcccggcgcttctccaaggcctgagttggggcccccctcggcgcgatgggactgatggcggggggcgtgcgaagctgggcctgtcatctcccgagggccagcatttggaatttcccgcgtgttggcggcgcggggagtagcactgagatcggcagcggaagggttaagtcagtgtagacattttccaagggctgtgtcctcaacgccgcgggggctcggaaagagttaaattgaactcgtcacatttttaaagcgcttggggattggggtttcccttgggtttgcccagtaggggcagccaaagagttaagtccagtctgtcactttcccaaagggtgggatttggcaaatccgtcagccgtacgagaaagcgtaagcattaagagcctctcttaagttg

SEQ ID NO: 104448 - DNA, 1062 bp, Homo sapiens
ataagatggatctgcagttagcataaagttaactaccctgcgaaagaggagttggtctttaaatggtgtttttcacttgaagagaaaagaaggtactgggcaggaacatagcttagcaggcctagggaatgggtggaaggaaaattgcactgaggacttacatagaatgtggtgtttgttcagcaatgattgagtagaaaggtgattgtttcgttttgcttgtttggttggttgggaaataaataggagtgaaagatttcgcctcgatctttatttagagcccaagagttgttgtgactcagttttagctggtagtggcttgtacacgccaggggagttttagaactgttctgaagagagatggcagcagttcttccaccttttcgatgactgttgaaatcctgaagattagctgtccgactggttaggttacacaagatgattcaaacacagctttcatgtttgagaaaataggtaacttgtgattcttagtccttgcactaataaagcaacaggaatgagtaagtcttggagaaaaagagattagcagaaaccccaaagtcctttgaagaatgatgtatataaggaagatttacctgcttgttgttcggctccttttctagtagtattattattaattttttttcttgagacggagtctcgctttgtcccccaggctggagtgcagtggcgagatctcagctcactgcaacctccacctcccaggttcaagcgattttcctgcctccacctcctgcgtagctgggattacagacgtcctccaccacgcccggctaattacttttagtagagatgggttttgctttgttgctcaggctagtctcaaaactcctgacctcatgtgatccgcccgactcggcctcttaaaatgctgggattgcaggtgtgagccaccgcgcctggcctcctattgtaatattatgattttttgcgcttggaatgactatctttccgcaggaatagaagagtggaatgtgtatctaataccactaattttttttttttttttttttttttttttctggtagagacaagatcttc

SEQ ID NO: 104449 - DNA, 1022 bp, Homo sapiens
gtctaacattgacttcaagcttttgtacaaataatgactctcgttcatttgccaacaaataactgccaaatgcctgaggcattacactaaagtggaaaatcacttttagggcttttaagtttaaacttaggttcaaattccagttttgccactatttagctgtgtgtatgtgaccttgtgaccttgacctcaagttttcttttctgtaatacgaggccagagtaaaatgagtaatgctgagctattatcattattatttttaaatagtataagccaattacatatggcttagctaataaggatgtgttgttgatgcagtcatcacatgtgattgaaaagcattcctgtcactccaacttcttactgcgcttactgcacctgccacactccccaccctgatgatagtaagtggaattttaggcagctactgaataaataatgattttactatctagaaggcactgcagtttggaacctgagaaatgtacagtgacttagtattttatgactgtccatcattttaagagttgagtttcactgtgaaacaatgtcgaaagcactgactggactaatggagtggctttacagtgcttactgtttcttcagtaatacccagagagagctgcagtgtggaggagccggtgaaagaatgtattcagcccatggcattctctgcagccacaccactgtactgccaggatcacttgagaaacagatgtctctactgatatataagcagacagctaaaagattccatacactgtagtttaaaatgattttagggaattattaataatattttaaaaaattgttactgaatttttttacagtagaagggaacatgagacaatccatatgatactattagtttgggagatgaagttgcaaaattgtgaggcagaaaaatgttaaaagtaggcactaaaggactaagaagttacaatcttggctttaatgtatccaatgacaggtgccatggtttgcttcctccagagtctaacaggcaaaatagtatttgtaaa

SEQ ID NO: 104450 - DNA, 1106 bp, Homo sapiens
acatacatatcttactaagatcatttgggtagctctagaaatccccctttttaagttcagtaatagaaacctagaaatagatttagaaagaaacttttttacagtttttttttatgaacaagcagcatttgtactcatagaagggcacacaatgacaagtctttttctcattttagttcccaaaatacccagttttcccaagaaagaagaaaataaacttctaaataaagttattttcttaattttaaaaagtttttatgttagaaacgcaaacattcaaaaagtagtacagatgtttagagaccaaccaggacaatagtatcaaggcctgaaaatgtgactggtatactaataacctcaacactcatgctccctacttaagaaccccacacagcctgcatgtgaacggtaatcatctttttatataaaaatgcaggtgtttattaaggattatggccgacctttgattttcatgggaaatatatccagataactttagtgacttcacaagttgacaaaaagtgttatttgcttgagctctctagcactaagatttcttttagtgtccctttttatgttgctgttggctcatcaatgtttctgaatatttgagtgaaactgctggttggttgacaagggatactcactagcaaactaatcacagacaagcaagttgaatttttattcagcagttttttggatatggatttagtagcaccgttattagaatgctgttaatgaaaggtagagtgatcatatgaaataatctttagagaccttttaaaatgactatttttcaggagtagaggtaagcaagaatgagttttcaggctcctaattgaaattgtggtttggagaacattttaatcctctagggttgtctttgtaaaggaagttgctgcagagtagctccctttgtattaacaggcagtagagttagttgtttcaagtgagttagaattttagaattggaacgacagcatgtaattagttggagagttcctatgccattacgctttataaaaagttatctagatgtgatatgaccagttgatcccctgtaataaaaacaattaattttctagagaatttttatctgctgtatt

SEQ ID NO: 104451 - DNA, 1033 bp, Homo sapiens
tttcagctcactgcaacctccgcttccctggttgaagtgattctcctacctccacctctgaagtagctgtgactacaggtgtgtgccaccacacccagctaattttttatttttagtaaagacaaggtttcgctatgttggccaggctggtctcgaactcttgacctcaggtgatccgcccgcctcagcctcgaaaagtgctgtgattacaggtgtgagccaccacgcctgaccagctcccacttataagtaagaatatgcagtttttggttttctgcttctgtattaatatcgctgaatcttttaacatgtactttttaactaaaatcctttgggaaggaattatgtctgtggttggaagtaaatccaaatttgcatataaaacagatcaaattattgatctttgcaaaattatttaaggattgtccatagtgttctgaaattgggagaaaatgaacattgtatatatgattcttgaaatgttactgtagtgaatgattatgaacatattttctagcactttaaaaagactgctgctgggtgccatggctcatgcctgtaaccccagcactttggggaggccgaggtgggtggatcacctgaggtcaggagttcaagaccagcctggccaacatggcgaaaccccgtctctactaaaaatacaaaaattagctctgcatggtggcacgcgcgtgtaatcccagctactcgggaggctgaggcaggagaattgcttgaacccgggaggcagaggttgcagtgagccgagatcgtgccattgcacttcatcctgggcgacaggagcaaaactccgtcttgggagaaaaaaagagagagtgctgtaaagggaatatcatatttgaatatcatgtatgtgtttgcaataaatattgtaaagaagaggaagataaagaatagaatattattatactttgtccctcggtagatgcgggggattggttccaggaccccctctgtatatcaaaatctgtacgtattcaagtcccgcagtcggccctgcacatatgaaaag

SEQ ID NO: 104452 - DNA, 1953 bp, Homo sapiens
tgaaaatttgcagtttttcagtaatgaatgtgcatgtttcaaaagaataggtttttttgttgttgtttttttgttttttttttggaaacagagttttgctctttcacccaggctggagtgcagtgtcgcgatctccactcactgcaacctctacctcccggttcaagtgattctcctgcctcagcctccaaaatagctaagatgacaggcttgtgccaccacacccagctaattttttgtacttttagtagagacagggtttcaccatgttggttaggctcgtctcaactcctaacctcaaatgatctgcctgctacggcctccccaaagtgctgggattccaggcgtgagccaccacgcctggccaagaatagatttttaatctattttgtttttcaaaaatcaaatctatggcctgagccttaatgtccattttgcccaattattgtggtttacagaagctgttcactttctctgtggctcatctaatgaagttccagatttagtcaagtgcaggtttctttatgcttgttaccagtgctttagttaaaccggaagcctcttgaagattaatactgtgacttgagactttaatgtagcccagtgtctagtgtgatgccctacggagtagacacaataataaaatgattatggatgtggctttcatgtgcataaaataattttattttattttatttttttgagatggagtttcactcttgttgcccaggcttggagtgcaatggtgtgatctcggctcactgcaacctccgactcccaggttcaagtggttctcctgcctcagcctcccgagtatattacaggcacctgccaccacacctggctaattttttgtatttttagtagagatgaggtttcactgtgttggccaggctggtctcgaactcctgaccccaagtgatccacccgcctcggcctcccaaagtgctgggattataggtgtgagccaccatgcctgaccaaaataattttatacaagaaaaacacctatgtggaaatgttggctacttatttacaggataatttcaaaaggttaggcattaatgtagaacaaatcagacgattaagacttaatagattctgaattgttgttttctgtcttggcattcaaatctggatggtgcatggtcctgtagcttttaaattgttatcataaagacatatgttttcaataatagaagtatattagttaacaggcaaactattgcacataaaccaaatctttgcttaagcaaaattttagatgtattgtaaatgtattaaatacggacttcaagtttagaagtggccccaagaattcccatattaagagcttgtttgaggtcaagtctttcaggagcactttgcctctaacattgtagaaataaatatatcttcccgatctttctttttttctgttacttcctcttgcaatcatttaattaaaatatctttattaagaattgccttgttttgatttaaagatctgggacataggaggacaaccccgatttcgaagcatgtgggagcggtattgcagaggagtcaatgctattgtgtaagtggtttttttttgtttgtttgcttttaaatcaatgtaggcatcaaagaagaaagtttattttagtatttccagaggctcaatttttatctcaggcagtgaaaatctttcttagctaatatcctagtgtaattcccaacatgggatttaaaaaaaattaatcatagaataagatctttatgttttttgtttatggagctaagagctaaggggtgtacatgttttactatcatgtattagtctctaaaaacagtctagttaaaaagtattaaagggtgctgagccttttcttatgacatagtttattttggttaataatttcaataatgtaaatcttacaaaaattaaaaatcaataatactagttgtcatcatcaaggcatacagagaagg

SEQ ID NO: 104453 - DNA, 4000 bp, Homo sapiens
cataaagatccatttgtctttaggatatgaacttctatcagtatccacagaggctttgtgtaattttttagtgaatttctttttttttttttttgagatggagtttcactcttgtggcccagctggagtgcagtggcgcaattttggctcactgcaacctccgcctcctgggttcaagtgatctcctgcctcagcctcccgagtagctgggattacaggcgcccgctgccgtgctcggctaatttttgtatttttagtagagatggggtttcaccatgttggccaggctggtctcaaactgctgacctcaggtgatcacctgcctcggcctcccaaagtgtgggattacaggtgtgagccaccgtgcccggccatgaatttcttaaatatttaaatttggttatttcacttcagatttacctttctcccattcagttccaatgagtgtggctttgctcgtattgtgcactgttgtccccattttaaggtgcagaggtgcttcttcagtagttgggttaaatcattgcttccacaatggtgaacagttcatgtttgttatagctcagccctgtggtgtttcgttaatgcatgttagctgggaaactggtagtgaatttaccctcatctttcaggcttggagaatagagtggtgcttctgatagactctcatgtacccttctgaagaagtgaggacaagaattacccagccccagatgtcaaaagggcatggtgtgaaccctgcaccagccttggcagtgacagcctcctctcccatccctgtgctttagtcacattgtatcactcacaatccatccagagctccacaatgtttcatgccttttaacattcttttgctgttttttttttttaacctggagttctgtggggtggcccccaagccccgggaattactgcatcttttctgtgtattatacttaaaagcgccttgagggcaaacaggggttattcctttttttttttttttttttttgccttcctggcaatttgcatgcaacacctgattgattgtgtgggcaacacataaaaggtggcaccagccgtcctatacacaacttaatttttaaatcagaaaacgcttcagtctctgataattcctcatattctcttgaagttcgggtaatggagtatggtaatgcagatgcagaaaagcagcagaggtcaggcatagtgtgtgccttgaattagctgccttttaaatattgtctctgtttgatgtttagttttttaactttaatgtcttcacttttcccctctatctttagatatcacacttcagtggcttattcagcattcaaaatctagaagaagctgaagcatctcctgaagtcttccagtccttcttggctataatcctagaattattgtccgttcctctgaagtaattcccagaatacggtccttcctaaaccccagaaattgcctttttcagagtttatttctcatgtgcactgctgaagatgaatatccctaatccttcataaagaatcagctagagttgtcatgataaagtcagcacacacaaaaaggcttcttacacatacctgtcttaaaccatgtgtagagctttaaaaacagaaaaaaaaccccatatacttatgaccatcttaaatcaagaaaattgcatatttccattctggtctttctgggccagatttttatattggttttcagtaaatgtctatctataatatttcattatagagtccagtagcttaatactgacactgacttgatacagcatgaagtttctagtgccacacacagtatttagaaaacctttaggcgtgaatgactcatgtgggatatatgtaaacataatgtttattttatctcacaaatgcatgtgaaatgtataattacatcttaggaatccaaaatggtctgcagagagtgagcggaggcaccagatcaatgttggttctttgcactggtgagattctgcctgatgaatattaaagatatcctgctttctgagaactctatcaccagatggcagttgggatatgggaggaactaaagcatcctgttttgtatctgtccagatcattatttctgtctcttgttttttcttcctggttcaggatacttttttaaggggttgagaattgaagattttccaaaagcgttcatgaatttagagcattccacccaatataataaaacctgttaagaatgtcagtctttgttcaaacatctgtttgttctatctccagtcattaaatcagtgctgctgcatgacactcttaactcctgactttttatatccagtcataaagttgactttcagcacaaaagatacttataaacaaataaaaaatttttatttttctctcttactgatgtaagctttggcactcttttgactggtgccattagacatcttgattattgtgacaactctagacctgcctgctttatctaatgtaatcatgctcaatgtctacaggttgtttaataatcagtcacacagagaactgaggaactgatgctgtttgtttgcttctatgatacagagatgtctaaaaacttcaaatggacatgttttgtagtttagcgacttccgtatacataaagggacatattaatactggttcatttgtaaattattattcatatagaccactgtagtagataaaactctatggtacacctgcttatgtgttgcctcacactgtgtgtgattttgtttcttttgttaagcagcacttatgtagactgcatttccaaatgtgttgagcactcagagtgtagtcaacagtaagttcttttaatgaatatcagttttaatttatagactgccatggccttaaaaatattctgtacaatatactgcactgtgttgcacagacactacttgcttttctccattcatatttttatgagtagaatctgggcttttaaatttctcttcttattctttgaagcatgttgcatactaccctggtgggatggatggttctgtaaatgaagggatatttaaacttgctactgttgttcaacaccattaatggtcagtgtgaaccattacaaagaatgtggcaacttgcttgtgcctaaaaggaggaattggaactagaatgtgtgactctgtggggactgcataggtttgttaattgacctatagctaaaccttaatgtgtttgtgtgtctatacattgctttccgcatttcaagacatccagacgctattaccaacattttcctgtgcattaacctctgcatgtgaaaacttttaacagttactgaactatgtaaatatgtgaatttttttatttaggtggatgcattttttgtctgtttactgctcttctcagctttattcaataaacttgcattttaagggttgtattggcaattttaacttaaaatgtgcatcatgatggaaggtgcagacttttttggaagtttccgagaggagggtctatagaccatttgtcagaaatcagatcagccctcaaagaatggggtctgtgggctagttaaaatagaaataaacttttaaaatatccacagaattgatattgtgattttttgggggcgggggaaatgctactacttgtcaacggtcacaatacaccaaatttaggactttaagtggcaagtgctagtaaaacattttatgtcccagtttttacaaatcaaaccaagaccctgctaagcaaatgaagttgcaagacatgcctattcactgacttcagttcagaatggaaatattttaagtaccgaacatgctggttttcccacaaaggcacatttttagcataaagctttttgctagtttggtatcatctgcccataaaataagtcaatacttgagctattggaaaaataattgtgtatatttttatttgtttagaaaggttcagttagcattttctccatacgcatactacaattctgtacagccaacccttagtggccagttggatgcatgatttcgcgtttatttccctggaacgtcacgttgatgtgtttttgt

SEQ ID NO: 104454 - DNA, 1364 bp, Homo sapiens
tgggttggcatttgggagaatgggttctttccttggccattaactgactgtgtgactggtgagttgcagaaccccctcatggctccttaagttttcccatctataaaatgaacaggagaggatttctaaccataacttctgccactgacaggctgattctagcagcctagaaatttgcttggtggttaaaaagagatacaaaaacaccgatttggcctagtgaatatgttaatattacatgttccttcaatagaaggtaattcaaaaatacagaaatatttacatgttacaactttaaattttagcacaaaagctggagattgcagacattttacagaatgatacagtaaatttattttgtttgaaggaaattctgtaaatataccggcttatattttgaaaggcatttacaaattttagaacattttccccagactgcagaaaatgtttggtatgcactccagaaaagtgtatatacctactaccaatttgagggtaggtggtttagagctaaggtttaatcctttataactgctgtgttgctgggtttttgggggtttttttgtttgtttgttttgagatggagtctcactctgttgcccaggctggagtgcagtggcgccatctcagctcactgcaagctccgcctctcgggttcccgccattctcctgcctcagcctcccgagtagctgggactgtaggcgcccgccgccacgcctggctaattttttaatatttttagtagggacggggtttcaccatggtctcgatctcctgaccttgtgatccgcccacctcagcttcccagagtgctgggattacaggtatgagccaccatgcccggccagctaggttctgctagaatttatccagagctttggagaaacctggaatggttagaaaatactactcttaaaagtaaaggggctggaggaccaacaaaaccattgtatccccttttggacttgggaagtagaacattaaccacttgctaattatagcatctcccttaaccaattcttatctacaattgtgacttaccctcagtgttgtacaatgtgtatcacacaatgtgctagcttgtttctgtggcttaagagaattcaccatttctatctactacccaataggtgaattagataactcttccatttgtatattttattctgtaagaaaaattcaaattgctcttatttgtcatactattagctaatttataagcgctagccctcattcaaagaagggttaaggatttatagaattcctatattctctggaagcatcagtaacctaaaggctagagcatggtatgggcatgtgcatgatgaatatttttgatgtatagttcatatatttgtttcag

SEQ ID NO: 104455 - DNA, 1083 bp, Homo sapiens
cagagacccgatccacccaaggccaggcggtctggggtcacgtctgtgtccagcgtccggcgggcgctgccgtgccgctctcccattggctggaagttccctcgcgggccggcgcggctcctgctcgccacgccagcccatcgggctacggaccgcccaggggggcggggcttgggagttggggcggggcccgggtgaggggcggggcctcggggcgtcgcggacgtcctggcggcctactgcgtgggagggagtcctgggccgcgccccgcgaggccgggcccaggccgggccaatcccgggccactgggcgggcgaccgtggggcctggccggcccgccggagagcctgggggttggggacgatgggctagttcctggtgcgtcacgggggagttccttaaaggggaagcgagccgggctacggggcgagcgcggggtgcggtggtcggcggggaggcccccgcgctttaaaataatgcccgcggcgcccgcgcgaccatgcaatggcgagcgctcgtcctggggctggtgctcctccggcttggcctccatggagtattgtggctcgtcttcgggctggggcccagcatgggcttctaccagcgctttccgctcagcttcggcttccagcgtctgaggagccccgacggccccgcgtcgcccacctcggggcccgtgggccggcctgggggggtatccgggccgtcgtggctgcagccgccggggaccggggcagcgcagagcccgcgcaaggctccgcggcgtcctgggccggggatgtgcggcccagccaactggggctacgtgctgggcggccggggccgcggcccggacgagtacgagaagcgctacagcggcgccttccctccgcagctgcgtgcccagatgcgcgacctggcacggggcatgttcgtctttggctacgacaactacatggctcacgccttcccccaggacgagctcaaccccatccactgccgcggccgtgggcccgaccgcggggacccgtgagtagcccccgccgcccggggccgcgcgcccacgcgcttccttccgccctccgcgccggggtgcagccctc

SEQ ID NO: 104456 - DNA, 1043 bp, Homo sapiens
cttaggctgaggatagttaggtggtggggagggaagctatgtggcccacttttggggtccagatacttgaggtgaaattcactggatgccagattgactgtcaacgtcatcgccctgtacgatctgtctataaatcccccgcctctggtggcgtggttgtccgggaaggtcaggcagtcttccctgttcaccagccttgtttgcaaaggctgagctccaagggtcaccactgttgacatcaaagtccaagagggcagtacacccagctaaggacctcttacctgtagggaaggaatgtgcattgccatagaccctgttagtccaaatagttgactcccctcccctggatgggagtggaggagttggtttgctcagtgtcttggcaccgtctggggcaagcattttccttcacctggaggaaagcagtggagtccagtccttaggttctgataaggaagcctatagactaaacggagttgggtttttaaaatggtgtggttatttacacatttatgttttaaattgcagtttgagagcatgatttctaccgaagcaaggggacatcccaagctaaattcaaaggactgagccttttcaaaattctaggaaaccgatgagtttttcttgcttaaccatagcgtttatacgtataagtgtattttctatctcaatttttttgagaaaaaatattaaattttgaaaaaaaagtatttggcctttccagattttttgtttgttttttgagacggagtctcgctttgtcgcccaggctggagtgcagtggcgcgatctccgctcactgcaacctccgcctctgtggttaaagtgattctcctgcctcagcctcccgagtagctgggactacagactcgtgccaccacgcccggctaattttttgtatttttagtagagacggggtttcaccgtattagccaggatggtctcatctcctgacctcgtgatccacccgcctgggcctcccaaagtgctgggattacaggcgtgagccaccgctcccggccatggtctttccagattttaag

SEQ ID NO: 104457 - DNA, 1047 bp, Homo sapiens
cagctgttacaggttaagtatacatgggaatttaaatttaaaaacacatatgtttgattttgttagctacataatcaaaaattttctatcaaaggccatggttttctccatcttttctgttttgaggtgaactttaaaaatttacagtggggtgaatgccatgaacatttgtacctggtgaagtaagtggagcgtttagttgtgcggttcagccagctggttacagggaaaggtattgagttcttgctggatgaacttaaaggtatcaggttaggctggagattgacaagaatatctacaaagaacaaatccagagtctgagctgcatagtgggctggcataaatggagtcataataatttcatgctgttaggccagtagagttttatggtgtttttttttcttccttcatcctcactcccacttcccccttattttggcaccttttgaaagaggatgtagcaattatttggtaagaaagaattaaaagtgttctaatgagtaaataccccagatcttagagaggatttgtctgactagagtggagagaagaaaccccacagttactgcaagtaatttttttttttttttttactgtggcagctcattaatttttagtgactgggcattgtaaaaaatattttaaaactgggtctattttagttatagattacaaggcaaagcacaataaaacatagaaaggagttcagtgctcacagtgagtaccttccttccatgggcctgtgcaggtggatagaatgacacatgccgcagatctgggtgtgactcaggagaggggagttacatgtggttctcctgattaccatctagcttggatgctacatgatgagggagctgttttctgatgaggtgggctgttgaagcccactctgtttctaagcggcagagcaacagagtgaaatatttacacagagcagaacattcttgagttggcagaattgggcgtaaggatctccctgtctcctttgagcccctcctgcaacccttgcactttttgtaccttttttggctgtcacttgcgcttgag

SEQ ID NO: 104458 - DNA, 1069 bp, Homo sapiens
gattccatatcctcgggtgggtagactggtttgaccctttgtgtttgacaattcactatcttcctgaattaaaattctttgcttactaatttatttgggagaaggaatgggatggaggtagatgagaaaagcagtgtccttagaagaatttggccttaaatatgatgtaaatattttaaaattcattcagcatttactgaacatccactgtatgaaaggcaaacagtgatatatctgacttattccttccccttaaagagtagatgttctgtgaagttcagtattcttaagtccatttacatgtgtgatttatattctctgctacaaagcagtgtggggagtttgtcttcatctctgacttgggtctgttttcccagagatcctcacatgggtattgcgggagctcagtgagtgttcttttcaatgcttcacgtggatctttcaaataaaggctgcacagaccagcaagttagctgctgatttaaatgccaggatctggaattagattatatatttgtgacatctgatttgccaagcccagaactcctctgggaattgagtcagccttttaggtaactgactgagaactgccagagcacagagccttcatgatgaaactggctgtcatattctggtagtgcctcctttcttgcccagtttgaggtttgtttaggtgctgagcaggagtgagttcatagtggttcatttaaaatttagaagaaattctatagtttgcctttgtctctaaccctaaagcctggtgcctgtgttaccatgaagaaaacctgctggaaagagaaggtttagtgaagtgttatagccattccctgaagacttgctcttattaataaagcaaggctctgctgttcttattgtcttgtttgtgtcttttaaatttaattcccgtattcacctcagatgtatcttggaaggcagagggcagactctcaccgtggtaagcttggtttattagctgagtgtagtctctgagacccggcttttcagctctgtggattccttgagttttgtcacagtctttgtctgttcccatccccaggtgaatctaaag

SEQ ID NO: 104459 - DNA, 1110 bp, Homo sapiens
gaatttatttatttttgcttttcaaagccacaaactaaattgagcagtaatccccaagggtcttgctctgatgcatttctccaggcccatgctgtaggacattactagagaagagactctttgtaccaaaagaaccaagcttttctgctcaggtgaaatccagcataggcccatactatatactgaattctcttatgtggcagggctcttaaacccaaagctcaaagtgctttctgcagaatactgtgaaatcctgacatattacaatggctgcgttaggaactttgatcctgtggaaaatattatcttctgctagagtctaatgtagataattaaaggcagtctgtctgcagaggtttaaggaatgagttaggagaaaaaattaatgttaattccgtttaaatgaaactaccagcagctgctggagaggtagagatctgtcagtgagctttcttttcaccactgaatgtgctgcttgggtttgcaggcgggaagcctgcaatgaaggagaaggagaccctccactctatgtcaacgtgaacatgttcagtgggcagctgatgaacacctggattgactctctgcaggcctttttccctggactgcaggtattttgccatcagatttcctaagaataaccaatcaccagaaagggcttctccctccttttctttcttttttaataccctgagcattctctgtctcctttggatttgggaggtcactgacactatacgtcttcatctctctgtttgagaaattagtctccagaatattgaacagagccattccacacaagtgcaaaaccgtgcttgagaagtgactgtgtgtgatttttgtttttgtttgtttttgttttgagatgaagtcttcctctgttgctcaggctggagtgcagtggcgcaatcttggctcactgcaacctccgcctcctgggttcaagagattctcctgcctcagcctccagggtagctgggattacaggcgcctgccaccacatccggctaattttttgtacttttagtagagacggggtttcactgtgttgtccaggctggtctcgaactccaggccttaggtgatctgcccgcctcagcctctcaaagtgct

SEQ ID NO: 104460 - DNA, 1032 bp, Homo sapiens
gcagtagaatattatcactgtaatctccacatacagagaaaactgtagtcagtattgaaatgtatgtacttataatcttttaaatatttttatatatgatgtgtgtatatatgtatatataagaaacatactctatatttcaattttgtgacatgcttttttttacctgctgtaagtttttttttttaagtactatcttaaataataagtcaatactcaaataataagtcaattctcaataataagtcaattctacaagtattaggactagaaatttaaattagtccttttacatttgttgccggtcattttcctggtgccacgttatgcttctggccagcaccccgccaccacgcccacaccctctaactcacctgataatttagcagccaaaagcacttgctaagtaaatttgcaaacaacccaggctataaaaaaggagagcccctcaatgtaaacatagtttcatatggtgttggatgactggttgattattctgataagagaatgtttctgcttcttaagtgaatcagcaggtgggaaggaagagaggcaggactgaccagatgattgttttgtaggtgtgggtacgccacgctgcatcacgtcattgacaagtccacagaagaccggatggagagcttctttctcagtgagacctgtaaatatttgtatctggtatgtgtgttgcaagatgaacccaggaatatttagtattgcttagagcaagcattcgcatagtcttccatctgacaggtacttactggctaaagctatgtgctggacattgtgcattcccaggatgcaaacgctgtcagaaccaaaggatattactatcttctttcatggtttccaaccttgttgaaaagtcatttgtcaagtaaaccaagaactgaacttatgattacaaactgtgggaaatcctggtaacgattgatacagaaccagtgttagttctgtatctaactacaggtggtcggggaagacgcctctgaggaagagagctgtgttcataatggcttctcacttctc

SEQ ID NO: 104461 - DNA, 1060 bp, Homo sapiens
ggtggataaaacttggtccctccctgtcagcatttacagttcagggtctaggtgtgtgtgaggttgggtgtagttctagaattccagcaggagaactcttaggtagcacatggaaatcatccagtgaacttttatagactacctgtgcttgggccttagtttcagaatttctgagtctctgcgtctgggcagggtatgtgtaggggagaggcaggtctgggcatctgagtttagatgaagcaggtgattctgccttgcagcctgggttgggcaccacagttgtcagtcaattccttttcacccagttgtcactgagaagcatgaggcccaagcaaattctactccctgagtagctgggacacgcccccatgattcagttcccagtgtgctacaattattggttgtatctttttctccgttccctctagctgtttgatgaagacaatccagtacacaagtctggaaccagatacatgttcacaacagagggacacattgtatctgtggatgagcatcttcgggaattgccatggaaggaattcttctctgaagagggagggcaggaccaagggggaaagtctgtgcacaggccgaaacctcatgagttaaaagtcatcaactccagctccaacgtgagttgctttttccaggggtgatttgcatatagaggaagagaagatactatgaattgcttagttgttcagacttcctgacagaaaattgatggtgtatgcagattgggagatttgaaaacacctcctaaagacaccatttacatagctgttgtcagggtatagggaaaccgcaggagcagcggtggcatcatcactgctggctgcaggtgctggtggggagagtggctacaggatcctggaaggggggagccttgtgggaggagcgagcactcagcaggagccacggctcagatctgactttcaaggccttgcctggagggagccggcagagtcaacatgtgacccctccccgctcccccagttgcctgctggagcatcttcttggctgcctggggcagaagctggaggccgagggagcctgttga

SEQ ID NO: 104462 - DNA, 5325 bp, Homo sapiens
gatctgccatttctttataaagtgagtgaggatgttaaattatgtcactggtcttcacctgagggtgattttgctcctcagggaacattggaacagcgtctggagacgtttttgattttcacagctgaggcgtaggagttgccactggcacctagtgggagaggcaaggggtgctgctgaccgtcctgcagtgtacaggcagcttccacaacagttacttccaaacgtcagtagttcacaggctgagaaaccctggattaagtcatccagtcacatttcctgagagagcaacatatgagtttttaattttccctcgtttttgtctttctagtgcaatcgtgtacctgatgagaggaggtactccctgcccttaaagagcatctacatgcgacagattgaccagatggttggtttgatttgatctgctctctgtgaggcctcatcttgaaccagaccttaacgaccaaacccagaccatgccaaagtccagtctgaaatgaaaggggacagaagtcttgctgtccatggtggtgtaggaatttctgtgcaacacctcaccacgtctggttaatccttgcacacttcagtgtttctctcctgttcaataaaatgccctgttaaggatataatttgaagtgagaagatacatggaaattgccctcttatgacatgttgatgttataagcacaatagatggggcatctttggattgatgttcacagctttatacttcagaacctaagtctcttcactttgctggcacctgctatactggagtattgctatgtctttaaaaaattttttttattatattttatttttttgagacagggtcttgatatttttttgggacagggttacctgggctcaagtgatccttctgcctcagcctcccgagtagctgggattacaggtgagcaccactgtacctggctagctacttctttgttagaggattgagaatgaaatttctgcaaaagggcccatggttcatttggtatccctatttaattgcattgaaaatgtcatcctttctgttgttagataattggggtcttcccctgatatccaaccgtgattttggatcacatgggagaaaaagtcatccagtttttcatgtttgcctcaagtaatctttacagtgttacaaattatttgcttaagaagaatggtcttaaccagaattcttaacagatagtctcttaggttattatgttatggtctaagaggttaactgacatcttttgggtggtattttgcattttgaatatgaacttacctgaggaactcccatagttccagaatcaggtgccttttagggagagaacaatacctaagattgtctgagcttccatctttctcatatttcctaagcaaggattctcacttctgaccatatttgggttagagttctgttttgtttctgttttctgtgtctagtgccaattagctaaatcagggagaaagaaatgatcacatgacttttagcatccttgagccatttctctgtgtaatacaggctttagattagtgccttatattggttttggtttggggcactggatgtcgcagctactgctatggtttcaggaggcctgtttagccacatggtgagaccgtggtgaaagggggatggaaattgcttggccagtctttgcctttcatcctgtaaaagtaagcatgtagaaggaggaagttgtgctaaaatgcctttgtttttttgttattattttcttagccagaacatctctctttgaactcacactgatacacacctgctactcttacacagtgcagcagggttgactcttagtctggcttccatgaagcgtcatgggtggaaacgcattctagtaaaaaaggtaggaaatccctaaaacttccagcctcacatagcacggttctcacctgtcactgttttcccacctctaaggatttcatgtacatcttttcaaagctagaaataagcactgtctaagtttatgttgcatttttagtcaaaagggagaaatcttattccttcttgaaaattttaagtgttatggttttatatagttcagttctttgagatttttgaaaagagtattttcagtaataaacgtgccatctctatctcttaaacatttattacaacaattgttttaaaatagaaaaaataaaatgcttctattttaccttttttcatttcagaagcattattctgtttattaacagtgtcccatctactgaatagaaaactttgagaataatatatatatatattttaaatgttttcactgactcattgaaaatgttaattacacacacatgcatgcatgcacacacgagcatacttgtacctttgtctctgggcaaacaggtgggactgttagtgacccatttgggaaaatagagcatctcagagaaggaggtgagttcttcctgcctgtgatttctcttggcgctcccctcctctcccgctctggcttctgtggcggcagtggtgggtaagcactccagtgttctcttaatgaggcactttgcctgtcactcgagcaagcctgggtgttccttcctcctcatgctcctggaatagggaatagggatctcatgcttgcaaactacacaatgctgcaggtgcttcccaggggccacaggctgtcaggaaacgtgttttatgttaagtcacaaacccacttgacttctgggtactggaattaataccagtgggtgagactgagggtgagtgagttagtacatattaatcctggttgttgagcttccagactaccccgtccaaagtttgatgctatgtagtcagtggtttgtggggctggatgccagaaggttctttgagccagtttcaaaggttacttgttttttttttttttttttaaagtcagaatgttaacagctgtgatatatcctgcagggcttttgcagtttcttctgttctgtgttctgaaatactgggtagagaatggctgaggaggagattaccagagaagttgctttgctcagtgctttgccccaggattgcctcaaatctgagtggacttcatcctttgcggcggctctgagcctggcccatcttcctattcccacgtgtagctagtgtctagtgtcagctttgctcagtgtggtggaaacattttgcagaactgttgtagaaagctgccttatagttggcttgacaaagcataattctctcataacaaactttcaaatcattacagtagcttagctactttagttgatgtgaccgaggaatcccttctagaatcataggtggcaagggagggtttgctagctctccatttgcactggccattgtgaaaaaccagcttctgtattcaaatctttccttcatttttttaaattttttttttggcagcgcttgtgctggaacttactcattgtaactgaatcctcagggcttttcttgttttagatcatggactgtgcacgtgacacttaaataattttctatgtatttaaagaaaaatgcaccaggatggtgtctgtgcacgtgactattagaggagcgtctgtagaagtacctggtttggtcagtgcagttgtgcaatctgagggccttgtttcctcctcccctttccccttctccccaccaaaggaaaatatccctcttaatgatttcgtagttcagtttactgaatgattaccacctgtaattcctctttggattgtgtagactcaacatgagacattcctttctgctttctggagggcaccaggggcctttctctttgataaattttttttgtctgttgacaaaaacaaaaatcttttttcaaatgtagtgctggtgaaaaggtagggctgagtgattaccttagccacagggtggctgagcaggaactttagaagaaaatcctgagctttcctgtccattcccagcatccagctcctattctagtgcctcttccctgcagggcagggaccccttgggaaatcgaggaggtgggacgggctgggccctgtgtcccaggtttcacagggctcagggttatgctcccgcttgaatctggacgtgaatctggtaaaaatatcaagtacctgtggaactccctgattctataccctcttccttctttctgcaaggcagaggaataatatttttaaaggttattttgttttagttttaaatagcaaaacacaagctgcatttttatttattttgcataagaaaggtaaatctttttacaaaaaaaagtatagagttggaaactctgggaaaacttacggaaatacacaaatgcttctctgtaatgtgcaatatgctttgcaactgtagatgatattttatgtttaatctgtaaataagaaatgtatttaaattaaaagggatctttttgtaaaaggaccaaatgttcttttataaatgtaataaggaatatcttgctctttaaaatttattaggatttttatgagtaatttttattaaaagatttctttttttgagttgtcatcttgtttcttttttacattctcatgtacattacattacatgcaagacaaatgggagaaaagtctctaaaggaagtgcccatctagatgaataaaaccttgctttttatagctaagccctaagtaatacctcccccatggaattccactacatttttgtatgtcacactcttccattaaatgcccctcacatgcaggtcagaactgcttttcatgacttttgtcccagccctggccttcccctctgcatcagcctcctttctcttggccactgagttcattgtctattcttattgccaattagctgagtgtatctgggatctaaaaccagttctctgcgttatctaagcaaggcgcttcatttctcctcacctctgagagcagtggcacttcacggtctgtgtgggtgcagaggcccatgggaagcgtgtgggtagagggttctggagggctggcctccctccctgtgtgttgccactggggaccatggtgggatcctgaggaagggacctgctcctgctttgtgacatctgtgtcccagctttggtcacagacaattttgatacgggtttttttttttttttatttgagacagagtctcactcagtcacccaggctggagtgcagtggcacgatctcggctcactgcaacctctgcctcctgggttcaactgattctcctgtctcagcctccctgagtagctgggactacaggcacgtgtcacgacaccaggctcatttttgtatttttagtagcgacggggtttcaccatgttggccaggctggtgtcaaacacctcacctcaggtgatctgcccatcttggcctcccaaagtgctggggttacaggcatgagcc

SEQ ID NO: 104463 - DNA, 1098 bp, Homo sapiens
ctcacagtatttggggtgtctcctaggtcctgcaggagcagtccgctttcttcagagggtctgtgggttcttgcagttgatctggagctaaaattcacaatgcaatcctctgcccatattaacattttaaatcttgggttgtcagctttgaacacttgagaaggtttagtctaatcacctttatgaacagaaaagaagactgaaggctagaaaagggaagttattttcttggataccaaaaaagaaatatttaaatcatgactcttagtatgattatgtctagtattgaatttatgatgatatctctgggtcacaggttattgctaagacgtgtcagaaagtatttgtagagtatacacagcttattccacttgcaatgagtttacttatttttaccagaatttctggtataaagataaaaaaaatcttaaaaatgaattaagaaaaaattatatgacaacatacaacttgggatagaagacttttgagaagttatttttattgaatgctataaattatttttaagtcatgatgcttgataataagcatgttacatttataaggaaatagtggcaatttcttgaacttacactggtcgagaagctacatgaaagatttccttcacatttctgctttagctagaaatgctgagaattaagcttcttcaatgaaagctcatctcattccttttccttagcgtgggagatctaaatatcccattaaaaaaaaaagagagagagagacaagggaaaggaaatgagagtataagactcagagcaattgcagaataggatattttaatgccctttgtaccataacttccagcaatcctatcaagagagatttcatgagttatagtagatggagggaagtgccctacggacagatgaggtctgcttcagactcagacgtggatttgctgtgtggcctcaggcaaattatttagcctctctaagcctcagcttccttaggtatgtttgaaatggtacttctggtgccttattttataggttggtggtgaggcttctgtcagaggatccttgtgaatatgctataaaatagtaggacatgagaattagaaattacatagctaggcta

SEQ ID NO: 104464 - DNA, 1132 bp, Homo sapiens
agcttttctttccatccaggcaatggggagaagagcacaggggagttcagtgactcttacacagcagctgttatcgccctttattatttcagcccaacaagggaagctttatcagcatcttccacggtcttccctgggcgcaactggtggagttcaaggtagaaaaggctgtgagattatgtgaaccatctcccatacgacatccctaggggttgaaaactctccaaggccttcactcaagacccaccgattcatcaactatttttacttcactcagcgtcgacgagaaagtggggatatagtggtgctcagaagtgactgaatgcgggagttgagactggaattccaaaaaactgcactgtccgcttcccacctggactgaagatcagtagccatttctttcctttaggcatactttttttcccttagaattgaaattcacctttattaataataaaaaacacaaattcagaagtaggttagttcactcacatattatttcagtgagtattattgcacagtcacaccaaatagttcatttctctttgttacaaaaaattatttgtttgtagctaaaatatgttcatgcatcattccttctactcctaccctcaaaattccattgtcttttaaattccattttcttctttattgtatttggagttccaggtggtatatctgctgttactcacaaacaaattacttttctatggcttaacagaggcataattgaatataaaaacaaggtctataaagtaatttcagtactctaatacaactctgatttcataatgatagagtaaaaagcacaagagtgaaaattcaagaggactcaatagccatgtaaagaccaactggcagaatgagtgagtgttagtacataaaggcacatcagaaacagtgccttgttgtttcccacttttcctaaaacatgtaatgagaggtaataaaatggaggcatttaaaatgtttctgcagcttttcaagtgattcttcaaactttctttactcatcaacattaatgtcagggattagagaaatgaaatagctacaataacattcaaaataattttatagaaaattttatttatttaaaaagtcttcattaaaatgtgttttcttattcccaaat

SEQ ID NO: 104465 - DNA, 1027 bp, Homo sapiens
agagcaagtaatagagtcattatttcactgatcctcacccaatttcaggaaaatcatatccctaaaacagcaattctgactgataaatttttccatgtctaaacagaaagaaaagtgaaattatgggaatcctatgatagattactatacattgtgtgcttttaatagttcaacactggtaatgtttgataatcaagagtaaattaataggctaacatttagaaatgtatactttaataagtataaagtatataaacaattaggtaagcttgtggagaagttgaccaagatacataaattagaaaatacaagtgtccatctaaattttctatatttcatttttttcataatatttattaaaggcgtttaatgtatagtttctcatctgccattttgggagtcctttattgtaaagacaattctattgtttgatgacaaacagcaaccaccatggttattcaggacctccacattggataaattcaatttcttcttgagacacaagtttgcttctgtatttctgaggtaatgtttttattatttctgcagtgtctggtggaccctgatacattagcaaatctggtgatgtatcccttagaatgttgtgaaattacagaagagtgagatggtagccctgctgatctcaaagcttctgatacattgggtttaggattgtctcttctgtcaggaaaccttattaatggagtgtgtggtttgactacctgaacgaccctactggcagacgccatcttgctgccaatcgtcacccctgagaaggggcagtttccagtcttgccttttaatttatgaaatttgtgacaagtatggacttgaaggagcatttccaaactgtgggcgttttaggcccacatcttgcatctgtacatctttgagaagtacacagagaaggactgaagatgagtaggtctgaatgggatcccagcccacacactgcttcttcatgcagttagctctttcttaagttcaggaacttaagttggaacacctattctgaccagaccaacat

SEQ ID NO: 104466 - DNA, 1034 bp, Homo sapiens
tctatgttacaaaataacaatagatcaggactctggagccctgcattttgatcctggttctgctaaaaatgtggctgaccatcatcttgcaattcaaatttgtcatgatttactgggggtgagtgataaacttgccctgcatatcagtcacacatcccacctgatggtgcaatggggccgttcccttctttgacagattaataagggagtggaaggcacacatgccttagtcctagaaaatctgcatgtttagctccatcgcaggggcaagctgggtgatttgaacaagatactttggagtctctgggagatggggataatgatcttaatttcccctgtcttacacagtgtatccacttgtttgtctctgtctgtaataggcagaattctaagatgacctctaaagatctgggcccttgtattattccctctccattagtatgggtggtacctttaacttgttctgaaccaatacaatacagccaaggtgttggaatatcactcccagaatactgttgtgtcttatgccaaaggtgaaaggatttttcagatgtgattaagatccccaataaggtaatcaaaagggaccttttcccaagggagcctgacctagatgggtgagccctctaaaagacagtatagaagtgagagacaggagtcatatttccttctgtcctgctgaccttgaagaagtagccaccatgagttctacatctgcaaggaaatgaatctgccaacaaccacgtgagcttggaagaggacctgaggctcagaggagacctcatacccagctgacacctggctcagaccctatgagcccctgagcagaggacctagctaagccaggtctgaactcccaacccatggaaaccatgagagaggaagagtattgttttaagctgtgaaattagtggtattgttacacagtatagaaaaccaatgcactatcttccccatcactcctggttctgttttaaagatttaattctcttggggtaaaaaagctcggtacctatttttaaaaagtgaaagac

SEQ ID NO: 104467 - DNA, 1036 bp, Homo sapiens
gaggcagtatttgataaacagttggaaagtgatatgtatccaggcagcagattaatgtgaggccaaagcatggaaagtgagttcctgctgcagccccctggaggtgtcacgttaggggagaactttgtctccaggagctgccaccaggaccctttcaaatcttgccattgaatttagcctggcatccaggtttctttgtgatgggtcccttttcagccacatcttccactacaacattctgctgccccagaatgtcactcattccctgaacatacttttcttccttgtgggcgtgctgagagggtttcctcctccacggccccaaatcccaccccttcctcagtgccctcctccataaaaccatcagttctgactaagttctctgtcctgtgaagtcctcgtgtggacttactctcctgctgaatgcacgtttacttttctgaatggccctgaagcatctacagtggctgtcttgcctgcttaactcctgtaccatcatatcctgtttatgctgaaattctccatgttatgctccttgagaacagagaccattccgtcttcccctttgggtgtgccctggaaccctggcacatgttatgggctcagtgataataatggatagaaaagggagtgggatggaatcgggaaataggagacggaaaggcatcaaaagaggtaagagcagctttgttctcctttctgacagggacaaggaattctgaggggttagaaagaaggaaagagaccctaagagcgggggatacaaaaacaaaacagctgtggaatagaggaggggagaccattaacctatttaagcacccctcagtgtggccccttcccattctgcaccaagatcagaactggcaaagtaggagtgggtggggggagtggggaggagacttcgtggtagcatttaggaggaatcttaagatgaaaaggaaatgaaagtgagagaaattggggaagccagcgcaccaaaccagaccctgaatttttttatgctttcaagttttattctccttcttcaagcttgtct

SEQ ID NO: 104468 - DNA, 1025 bp, Homo sapiens
ggatggctgcagagggaaggcactcctgcttggtccaattcagaaacgaaaaaagtccttgggggagtgtggcgggggcagtaaagatgtgaagaaggagtttagcacttcctaaaccatttcaaggtagagtccaccaaacccagcccagcaagaattgctctgggaagacccaagcagaggttagctggtcccttgtgcctttggggtatgcctcggggtttggtggatggggtgatctcccctcactgcaccaacttcgctgtggatgggttttggtctagagtggcccctgggacagaaagagaggtcattctgtccacagtacttaaaaaccaggacctggtattcatatctgcacaggaggaccataagatccagctggagttggattcgcagaggttttctttctttttttccactgaggattctgaggttaagaatgaggctgccacaatgcagcgtccctgggcagcattcatgtcagcatctatgtggatggcacctctggagtgtgcagggaacagactgtaagtctgtccctgcggccctgggagaggaaagttaagttctgtggagcacatagcaaagaaagagtttttatcaccactgctgtagcgttgccttgagcgctcagtggggggacaaagtttggaaggtgttttcgcagcaatactgacttccattatgagatgggaattataaaaataactacgtatgaactgaatgaaatcttttttatttaaatgttgaaataaacctaagcagtaggtattagtatctccattttgttgatcaggacattgaaggtaggcaatggggcaacaactaccagatggcaggatttgaactcagatctgcatgaatcccaatcccatgctcctaatcgttctgcagtacacagggctatgagctttcagagcagaacactgttccctgactccattccctgacagttcccaacctcagaggagctcgcaccgtcttctggttgctagggaccttcaaggtcctccaactcaggc

SEQ ID NO: 104469 - DNA, 1034 bp, Homo sapiens
acatatctctgctcccccaccgccaccacctccccacagtgtctgatacagtagatctggggtggggcacaagaatttgcaagttcctaggggatgctggtgtggttggggccacactttgagaaccgctgttatagactgtttaaaaataactttatacataagctcagcaaaactgatatcaccaattcagttcagttacaacaaaggctcatttgaattcctgggatgtttaaactcaacactattttttaagaaagaccaatgaggccattctcaggttacttcccctattaaggagctagtatggtcaaatggaagttctttgggactatggtaaaaggcatggagaagaatgctttataattagcatatcagttgtttcttgttcatgttcccaaatatctaagattggagcttgctcgtgagaacgtttccaacatttgtcatgtgaccttgtttgcagactatttcccacctgggtagaggatgtgtgaaacaaacctttcagaaatagaacaaatgggaagtttcttcctgtgccagtaaagtgttgccttgttccttattctaatggcatgagattcttaattgaaatgaaagattttgaatattggggcctttgcaatttgtaaacacctgcctcaagaaagctgaggaacattttagattcagctgctcaaaagctaagaccctgcagagttgtggggttccctcagccatgggtgtttaagtcatgttggcaaatttcttggatacccttccaaccaacatagaatttaattccttttccatgaatatggtcccaccttagtgactcaattctatagaacagaacatggatgaagtgatgctatgcagctcccagggtagtaataaaggcagtgttttcccctgggctctctctctcagtacacacaccttgggagccctcagctgacaggaaagaagtcttggtatcctgaagcttccatctgagggcaaccacgtggagagacctcggaggtcaaggaggtcaatggagggtccctgct

SEQ ID NO: 104470 - DNA, 1050 bp, Homo sapiens
tgtgatcacagctcactgcaaccttgacttcctggtcccaagcaattctcccacctcagtctcccaagtagctgggaccacaggtgcacaccaccacacccagctaatttttgtattttttgttgagatggggtctccccatgttgcccaggctgatctcaaactcccgagctcaagcaatcctcctagctcagcctcccaaggtgctggcattacaggcatgagccactgcacccagccatatttctctatttttcaaattctttccagtgagaatatatttgcatatattgcttgtgaaaatagttatctttaagactttagggaataaagaagaaagagaaaagagattctactgtggccaccaggccagcagacatggtgccaggtctgaatttccatgtcattctataaatagtataaaatctgctgacttaacttggtgtggaatggcatgagctggccatatcgcaggaattcacagttgggaaatcctagtgaaatggcacaaagttgggattcaggaggaaggggagtaaaggagaccaatccaggagagaaatgatcatcagacaaggatcaggttgacctgtggtgagctggcatctaaggctggcctgagtcctgccagaggagaaggggggacagtggctgggatggagaacacggaactcaggtcttggcattgaaaatggggaatgggaggtgaaggtcagaggcgcagaaggaatattccccaccctgagcctcctccagcctgaaccccggccagtagcccagaggtgagtggcaaagccacgtgtccatcctgtgtgttgctgcatggcactgttccctcctctggtgctagccactcaaaagcacttccagctcggtaccccgggagctccctgcttcatgccacaactcactgcacagagcaaggcaggcctcggcccacctgtcgctgcttgtcaggaaacactgctgggcctctggtctatgggccccagctgtcccaaaggcaaggcctggaggcttttacttttgaaatgcagctgcattttcctc

SEQ ID NO: 104471 - DNA, 1020 bp, Homo sapiens
atggtccacagctcatggggagtcatcaaaggtgtgtgagcacatgagtgacagcagcagacttgcattctgcctgtgctgtggagaatggattccagggggaccattcagtaggatattgcagtggtgctaggtggaatatagttagacctgaacaaagcaggtgaatcgagacaagtggaaggatctgattggtggggagaatcaacacaagactcccaggtgtctgacatccatggataaaaaggggcccctgagggagcatctgggagaggaggggacggatgaagccttgcccaatggacatgttgatttgaggtgttcattatgggtcgccaggtgtctgggaagcagaggaatgtatgggcctggaaacaaggagaggaatctgggctggagacttggattcggatgcccacacatgtaggtggtaggtaaagctgtggctgtgaatgttgtcatctcagaagacaaggagtaaggggatggattgacaaaaaaggccttcacaagggagactggaaagatacagctgtggaggcaggagaagtctcagaacttagggcttaatacagcgtgcatggctgggatctttgcattttaaagagagattggggaaaggatagtgctaacaccaatagcgctaggtttgtaatggtgaaatctgggggctctgtgggaggaatatagggtaactgcctatacacatgacttaaattgtgtatacaggcagttaccctgtctgtttgctggcccagccagttgtcagcttgttggcagcctctgtgatacctgagtgcctgtttgggactcagggaggccccagtagcatcaggaagccagctgcacttgttgttgactcttagcacgcattatacaccaacagcatggctgaagtagaatccagggttgcaggatgggcaaagagagagccatctatgcttctcaaatgtcttgtggctattggacctgtgaagtaagcctcttcccagagtccttttctgtttctgctcctcctta

SEQ ID NO: 104472 - DNA, 1027 bp, Homo sapiens
agacatgctggcctctttcctgaatgcttggaatttatttttcaccttggaaacagaaatttcacatttgacaagttaaacaatacgacaaggccgtctgtttactcattcatccatttattcttccgttcatttattcatatagtgttaaacaatacgacaaggccatctgtttactcgttcatccatttattcttccattcatttattcatgtagtatttcaaagcctctgccatgtggtaggtattgtgctaagcactggggaattcagggttgaagagatgcctcccctggccttaggctgaataagggagttggttaattaaacagctccagtaccgtgtgatatatgtggtggtcaaggtatgttttcaagcactgaattggggaacaacaggatacagggactctcagagggagtaatgaatggattatcagaggacatgaatttggtgtagaagtttattatcaggataagagagaaggatatatgaaaagttggggcgacatggagagcacaggaagtttggaagatgatgactggcatgactagagttcagggacaggatggaggatgagaaggaagaaggccaggaaggcaggcagggaccaggcccttaactcacagtgagaagttgtgggagccttcacctcagggcatcagaagtcatttaaacatttcagcagggagtaatgtgatctgattcgtgttttaggttccaaaaggtcagagcagagagaatggatagggagagcggaaactggaatgaggaaggcaaatgaagaagagtgtttgagctgggacttgaaggatgcacaggattgactgagtaaggatgagagggtgtggcatcccaggcaaaagggatggcaaaacttccagtatagaaattgggaagcagtgggaggtcaaggtaccagtgaagagatcaggctgattagaatccaaggaaggtcataaagtttggaagtgggtggcacgcattagggggacatctgggggctcagaagcctgtagaaccaagt

SEQ ID NO: 104473 - DNA, 1074 bp, Homo sapiens
tcatgacagcatggcaatttcattccctttggcagtaactggtttaggcatgaccattcagtagaactatggtcatggagatgtgagaagtgttctagtgggcttctgggaaaggcttccttattgtcaaaaggagacaaactcaaggatggaaagtctgttctttttctggacatcattgtgtctggatgtgatgctgccaagggggcaaccatcttaccaccttgaagggagtgagtccaagggcagagcctcagactaaagatggcagagcacaaagatggagagaattcacgtccttgaagatggcattgagcagctgaatttgcccatctggctctggaattcatatgttaaataatatatgtctttaatgttattttgagatggggttgtctattacatgcagctgagagcatcataccctaaacaaaggaaaccgagagaggacattcagaggagtatcacacacccgggacttttactgagtgtgaacgtccctcctcaaaatggatccctgctagtgggacagtcggccatcttcttctgccctcaaatgttttctagcctatgtccagatcggggcaatcaactgggaacctctctattttagacaaattcctttttttctaagaccagctggaattgcacaggagaattattaactaccacttaatgtattaaaatctgccgctactcagcccgaggtcttgctacacagagctggccaagtgaggagctgctctgttagcaaccaacacctacaggcaaagtgtctgcctttgagactttaggtttcatgttgacttttgaaagccctctgtctcttccagtgaacagcacacaagcctgtcattgtagcttagttttagttggaagataaccatctatcttttctggaagataaccacctatattttccagttccctctgggacctccaagagtgaattctgggtaaatcaaggagcctatatttaatgttgggccagctaacatacccttcacatttactttaaattcatcaagcacttaaaaaaaatacactgtggttaaaagacaaacttacttttat

SEQ ID NO: 104474 - DNA, 1731 bp, Homo sapiens
agcattttagataagggatactcaacttgtatttaagatctctgaggagaatggctaagaaatacttttatagtgtttcacacccagtctttggatagcagctggatacattttctggcaagattctagagctgctcttactctagtgctttccaaagaagccagctggcttggtgtcaaatgaatagacagcaaggctgacatgctattgtaaatgtcttttcttgaatggggttcaggtaggcagcaagcagggagttttttttggtccccataatataactttggaattacaagcacacaattgaaaccccaggattccacatgatgtttatttccatttgggtcacataagaactgcatcacagtcttaaaagaattgtatcatatcttttatgtaatagctgattttgagcagccctgactctcatgcctaataagtcttcactgcaaaatgcactttctagggaacattattgaatgagctattttaatataactatttgaattttaaagagtatctactgaaaacattttggcaacataaatattgaatttctgaaagcatgacatctacatagaatcatttgttttctatttgcaatacgtggtattgtgttacttaggttaaaaacctaaagaagggggtggggctaagagaacctatggtggcacaatgtaaggcccaaatctgattgtcaagagactgaccttacccactttgtcacagttttgtagaaatacaggcttcatggaagcatatttgtctaaatgtatttggggaccattgctgatttctatccagaaagggaaaatagttgaacaaatgctaaaagtcataacctggtcaggggctggtttttgttttttttctagcaaagtaaaagaatatcgtagtgatgaactgtgggatagttctgttttaaaccagctaagctcgtccttcatgcaagatatagtcagagatccagacttctgtttgttaagttgtgatgggcaaaagtacttactaaagggtgctctttagtaagaatggaatggaacccagaagaaaggggtggtatacaaaaagcagtggtgagcaaatatgttggtaaacacactggcaagttttaagtaaatatagatttaggggtggagagtggagagtggttaaaacaaggtggaaataaaatagtagataatcatgtgggacatgggagatcagaatatcaaggcattctgaagctcttggtattagtattgtttgggaggcatcgacctactttgaactcttaagaatccattttaaggttttaaaggcaactcttagtgaacacctgtttccagaaaatgggtttcaggaaaacttggtaaagccacggaggcagaaaagattagaaaaacaaggaaaagcacagtgaatagaaaatatgaaataagatggtccaataaccccaactatatcaataatcactatccctataaatgattacactgaactcttaagagtagctagtattaattaagtgtgtagtacatgccagggctaagggcttagccagtgttaactcagtcattgcaacaaccctgttttacagataaggaaaccaggacaaaggttaagacatgttcccacaataatatgtgacagtttcttaggttggatttttaggaaacaatctagctttatgcagtttacaagaaacaatcatacagaaagcaaaaaggtaggaaaagataccagacaaa

SEQ ID NO: 104475 - DNA, 1056 bp, Homo sapiens
agagcagtcctcaccagacacggaatctgccagtgccttgatcttggacttaccagcctccatacctgtgagaaataaatttctattgtctataagttacccagactgtggtattttcttctggcagcacaaatggacacccagaaactgatgcatgcatcttctgactcctttgattccaaaatacaaaatattagaataaagttatggaagtcagcttatgctagtaagtgcctgtgtgtctgccaacttcccaatagtatcaagagaagctggacaagtcagaatttcatatcacctatccaggatcacctccataaacacacaaacacacacacacacactcacacacacacacatacacatacacacacacagtgctttcatttgtcacagaaagattccacagtgcattaacaatactatttaatgattgtataacaatccatctggatcgtgtgccattttgcacagacattctacgcttggacacttacgttacttccagctttttccaattacaaataatttagaaggcatcatggtgcatatagttttttccatatatatgattacttccttagattacattctcggaaatggaattattgggaccttagcttttaataaaatatatggccaggttttcaaaacgggacaccaaagtattctaaaggaatttttttctctgggtcttaatgggttttaagaatcacattggagttcatcagtgtcaatgtcacagcaaatgcaaggctttcatttctgttaactatcaaagctgagagtccaaaattgaaagggactaaaacaaaacaattctatggagttacaagcaaacaaagaccaacaatacttttcatgttctaatgtaatagaaagttagataggttctaattatccctagtttcaaattagagatatacaataggttgcgtatccttaatttgaaaatctgaaattggaaatactctgaaattggaaactttttgagtgctgatatgacactcaaaccctcactggagcattttggatttcagattttttggattaggg

SEQ ID NO: 104476 - DNA, 2284 bp, Homo sapiens
cctgcaatactagcctgtatttaagaaattaggaaaatcttagctgattcttcttacctgtttgtatggcagccacctcgttctccaacactctgccaaaagtgagagaagtgtggcccatctttggaggggcatatttttctttggaattttactttcttagttcctttaaaacctcaggtctctgaaggatcaaacagagttaagattttgttagactgtctggctttttcttgttaggatgggagcagctttttgtttgccgttttttcccagccctctacatgctaaacagaagcataaaactcctaaattttaattcagaaaaaggggttcagagctcatttactatctgtgatctttgctaactcactaattcataaagtggaaatactaataataacaattatgaattcatcaacagaatagaggattatttcgaggttttaatgaaataatatgtgtgaaaacacttgtaaactagaaactgctgtacaataatcattactttccaagatgtcatttcctttttctgtcttcagaaacgatcttcaagacacagaaataagtccaagacagaatcgccgcacaagagccgctgaaagtgctgagattgaaccaagaaacaagcgtaataggaattaatgtgggcttttgctgacttttcaaatgcattgattagaataccgtacttttggttgccacagatagattttctatttataaatgcccaaggaaagatgctaaattctaaatattacggttagctgatattcattcttttctgcttttccagaggggaaaaatgttacaaaatatccttacttggtcagttgcctcctgcctctaaaacatctctctctaaaaatactgacatttcacacaggtaccagctttgcagaggaggtagactctttggcactttggcacagggatttggtttggtttggtttggtttgataattaaatttcagaatgtccttaggccattctccttctcttccatggagaatccagcctcacaaaaggattctttcaacttctttattgcaagaaacagttgagttaaatgtttgtttttggaaaggcgggatgtcagttcacatccttggtgtgtgtaagtaccgatgcacgccaccaccatgcctgtgttacagcagctccatgatggttgttgcccgaggttaatgtagttgtttgttagacctgtgtcttacacatttctcagagtaggatattagtattataatttaaagctacgacagtcacaaagtcacaataacttagaaacattgcgcatattcttctgaaatagcacttaaaaatgattagtgtcagtattttttcacttgggtcaatcaaatctgtaacactgaatccaagctattaaacaaaaagtatgcaatgaatgaattttgtaaatgaatagagagtatcagtttacaataatgttcttaaaacagtatcctctggatagttgagtatgggttagaaatcattgaaatggattggtcagaaattgctatctgtgtaaaatgtctaccagtagccagatgcttccagagttcttaatgcctctctggcatttcagagccagcatcccccaactcccacccctctgccatcacccaacccaaacacatcagctttcaaatgagatgatagtaaatgcggcaatgttaagacaagaaatttatgatttgccagattcaacatttatgacctccccttccaaagactgtctccgttgaccttgtctttttggtatgccttggggtttctgataatgtgtggagtctcattatggctgagagtttagtgttttcacagtgaagtgcagacatttgatttctttatgagttccctgtgttagaaatggctatagaaaaatttgtcataataatttcatttgcatgaaatcctgaggggtgcattaaggaaactaaaagcaccacttaccaaatctatcggcagaactgatgtgaggtaagtgagcatgtcaaacaaaataggagctcacatggatatatttatgtcactgagttgtcagaaattatgtcaaaatgaaaactgtttgtttcatgacaaattatatagtctataaattaaactggaagtaattattactttaattgcagcaaaaggagtttgtgagggagcggtgagacccaagattgggaaagtaggcacatgagttcattcagcaaatatttggttatctatgtctgtcactgtgctgacactgggaatacaaaggtggccaaagatcatctagaacaatggt

SEQ ID NO: 104477 - DNA, 1044 bp, Homo sapiens
agagaagggaatgaaaaggttgggttaaaacagcttcagctttgtttaaattggagtagttctctccaaggtaaggagtagcaggagctggggtcttgtgaatagaagggtttagaacaacttctgttgaagtaggggtggcagggaatctcagcctccctggctagtggaaaatactaaagatggtaaaatctgcctcagtgtttttcagcgcctttggcctttgctcctcctctcctaatggaaactacatttggctctctctttccttgcccacccccactctccctccttcctcttactggtaaccactggtttgctttctgtcactatagactcatttgtttttttctagaattttatataaatgggacgatacagtcttcttgttgtctgtcaatactgatgtacatatccttttagttccagttcagacatcataagagatcttttagaagaagaggaagcctgggaagcatcacataagtgagttctcataatcatgaaataagcatgcactttgacctgagaaattatacttctatgcagctgattttcaaacaaaattatatttttgctttctggtttaaagaagtagtaatcctcatgcaaggtaaagattttcagtttactacttgtttctatatatttctgctaagaaatggaatcctatgtaataactgtagttatgtatcagatgttatttctgtatggataaattgttcttatgggcaattaatacagtcatgcatcacttaacaatggggatacgtcctgagaaatgtgatttcattgttgtgggaacatcagagtatacttacctagatggtatagcccaccacacagctgggctctagggtatagcatattgctgctaggctacaaacctgtacagcattttacagttaggcatttgtaacacaatggtacctgttagtgtatctaaacctggaaaaggtacagtaaaaacatggtattataatcttacgtaattgccataatgcagctagagcgatcttttcaaaatgcaaatctgatcactgt

SEQ ID NO: 104478 - DNA, 1649 bp, Homo sapiens
acagaaatgggacctcaacttaactttgtctgacaccgaaatctgagggttttttctctaactaacattaccagtcatacatttgccgtaggtatttgacatcttacttttcagcttcagtagtaaattctttactagtagaatgaaataagatgctacaaaaggaatatgcgaagatagtgttttactttgctgaagaagctgtgctactttccgtcagagaatgacaagagtgagatattacagaaaaaccagcttggccaaggtgtgcatgtgtgtgtgcatgcacacacacagaattagcttacatttctgcaactttgacctgaaaataaggctaaaagctgactaaaaggtgtgaaaaataaattgcaggtgttctaaataagcctattaatatcttcctggaccaaggttgggaattccatcgaattcaagattcgattttgaatctttgccagtgagtctttctcacgtgtaatctatatattaatatccactgtagcctggaccagtagggacatcagagagggccatttgaatgcccttccataggggagctgtaacgttcatgtaccaaaccttacattcatccagcttcttgaagcgtggtcttccagaatgtttcaagaccaaatagtagacaagctgaaaaagttcctcgttctagactttaaagctgcagttgtgtaggcttgtatatgctctgaccccagaaatatcagaatgagtaattaattttctcctttggaagattttttaaatgtcttgaaagaatgttaaaggaatttttgatcctcaaggcatattaaaatgactaagacttcaaaaatattaattgcttttatccccagggaagcgatctgagtgataattttagtaacactgactgctatacctaagtgtctttttgtaaaatcctatttgtgaaactatgtttaattttaggaatgtggtttttgagcagatatggtaataagcacattacttgaaaaaggaatgagcagttctgtctggtattttaattgtattagcatcaactgtgtttttcagtggtgactagaattggaacagcagatatagcagataatcctgaaacttcattttagataaaattctgaacctcccaaattttgtatcagtccatttagtgatttggttatcattcaggtgagtgcctgaggtggggcagaaggaaagataatgggaattgaagacaccagggagctgtgcagcctggctgggcagtgacattgaagtcacagaggaagaggagattgcaggcaacttctgagatgtgttttttgttaaccacctctaacatctgttttcactgaggtagcatagcaaaaacctcttagatttatgtcattagtgtactgcaaatgttttcctttaacaaatcagtgatttgtgctggtgatttgaaagcccctaggtaaattgatcacagactctactaggttagttgacaggcttggccatcctcctttcttagctagaatagtagagatgctttgtaaccttcctgtttaaaaaaaaaattgtgtgtgttgtggagcacaggggggtgttggcaagaagcttactttactctttctccaactctgtgacccctgccaggccccagaactacgtgatcctccgca

SEQ ID NO: 104479 - DNA, 1034 bp, Homo sapiens
tttaaattaatctcccagagtttcagtttcctcattgaaaaaaatggaataatagctttttttgtttgtttgtccctctaacttccctggatgagtctacaaagcaaattagatgatcatatattgtgaatgctttgtaaatagaacgtaaacttattgttgcttggtttcatctcttgttaaggattttgcatatattagtaagttatttttattattttctcttaagctctcttcattttatctttctttagttctagtggagagcagtgaaactcttagccttgttttttccagaactgtgttgatgtttgtgcgacaaaaaccttattgataagtaggcaggagagcgtattcttaactctggtaaaatcaatagcatttgatttttctgctaccactattgaagcagcacaatgtggcaaaacaagatgagttttgcattcccattcctgtttttctacttactttaatttctctcagcctttgtcaagtggggagaaaacttagggtgcttctgtgaattaaagctaatgtgaaggctggatgtggtggctcacacctgtaatcccagcactttgagaagccaagcaaggcgggaggatcacttgagcctgggagtttgaaaccagcctgggcaacatagggagatgccatctctacaaaatatttaaaaattagccagacatggtggtatgcacctataactactcaggagatgtggtgggaggattccttgagcacaggaggttgaggctgcagtagctgtgattgtaccactgcactccagcctgagtgacagagcaacaccctgtctcaaaaaaaaaaaaaaaaaaaaaattaaaaaagctaatgtgtacaaagtaattatcactgtggcctgtagaggtagttgctcagaacatgataattttcgtcattgtcataattgaatgagttttttggaacctggaactttactattctaatacgttagccaactgctaaaatatttggcatataagctattgtttgtcttacagattactaaaaat

SEQ ID NO: 104480 - DNA, 1002 bp, Homo sapiens
aaaggacagcaagagcatttgaagcgcccctgttttggggcaggtaaggcaatgattgagtcagtcgaaaaagaaattaagtgacttaatctcatgatcctaatgaatggtaaagccagttttctgaattcagatataatgctttcttctgcttttttttgctgttctccaaatctcagaaggcactgaagccagattaaaagttaaatgaacaggtgacatattaaagttacaggtttatgagtttccccactccactgttttcatgtagctccagaaccttagaggataatggaagacagattcagtccaatgctgtttttcagagtagaatctatcatgtttttaaagttaaaaattatcagtgtacatattaaatacaagtttttcagatttagaatttgttcttctgaaaataagagtcctgaatgtctcctggacagaaaaccctggttctgggggttttaggatccagaagacagcatgcccagatgggcttgggttagttcacttgatttgcacgtgaaagatgtgagggtacaggaactgtgtgggttggggtggtcagaaaagagggaacagatatggctatagcaagagagaatttttgcaggttgttttttaggactagatctaaacattttaaaatcagcatttcaactaggattcctggataatgggaaagtccagtgttcggaacagcatgtatagcatgtgacctcttttctaaaagggggaggaatacttatatttgtttggttttgcataaagaaacactagaagactacacaacaaactaatgaaagtgattgcatgttggagatgagaaaacaggttggatgggaacaaaggaggaagtgggccaactcagtatacatcttttatgtcatttgattttgaaccatgtaaatatatcaatctactttaaacaaacaaacaaaaaaaaaagagagcaagtactgtttaaaccttactctttataaagttttggaaatcatctca

SEQ ID NO: 104481 - DNA, 1684 bp, Homo sapiens
tgaaaaaaatttaactgtatgaacttggcaaggttttttgaagaatttgttatgttctttccccataaattctctctgtataatcaaaccttgacaattgtatttttagtgtgctttgttgaagaccacttgcctctacaagtgcttgatgagtgatgtgtgaaagctctgtttctctgtgaggaaacacatgaaaggagctctgtagtattattagcacatgtagcttgcatgtgaggtacctcctcagttcctgaaagttaaggacagcacagatgaaaatcccagcagcgttcatgatgagtgggagaatcctgggcactaaagaatctttcacagatattcttccactcatatttgtagaaaattggccatacccatatgccacatttttgtaaacactgcatccttccagctttttggggtctttatttttatctgcaataagagaccttgaaatctgagaatatgacaaagaatgcacggaaatgtgatgtgtattggatcaaatggaaatattccttatgtctgtttagttgtccttttccatagagaataattagattctagttaacctagaaaaatgtttagaaaaatgtccagatagattcactatcatataatagtagcaaatattgtggttgtcttattagttgaatctgtagtctttttttggttatacttcttatgttggtttgtcagtgttctctgatctatgaaatatgcaagaattccttagtgatatgttaatagaggcctcattagaattacaagattcttcctgcttctggttttaaaataaattttatttttaaactaattaatcttggaaaaacatgggctggacagtataattagatagcaccattgtagtgttaattcttgctctctggctgtcactagagttctggaatctatgtgacatatacttcaactttactaagtgcacatggcagtattaagtgttgcagaagtaataggcatacagaagttgtagattttaaggtactcttaaatttattttttcctaggacaggaagataatatgacctcagtaacaaaccacttttctcaatcaaagctggactccccagaggaattggaacctgacagagaagaggattcttctagctgtattgatattcaagaagttctttcttcatcagaatcagattcatgcaataggtaagaaacatgcagtagttgattattttaaatatctacttcatatgcacatgtagatagataggcagaaataattagaatgtagctttgaggcatggcatggtgtgtcactcttacatttcagtccccttttactgctgggtcttcttcacagtgataacaaggcaggatttgggaaggtagtgcagggatcacagggtgagtttggtctctactctatagcctttatgtagatacttttcctaccgttggaaaagaaagcatgatagacagtgaaatttttgtcaagacgatgagtaaaggagataaaaacaactatattggaaaacagaaatgatcagaaagacatggcgcataggagggttaagaaatgaaaaatttaactgagtaaatagaatagatggggaaactttaaaaatgagaagtttggtaatgagtcattttgaaaagatattttaaaaaatatatagggtttattttacacacacacacacacaca

SEQ ID NO: 104482 - DNA, 3306 bp, Homo sapiens
tcttccttgtgcgtcacaatttagtgttttctctttttgcgttaaaagataattttcaaaaacaactaacatcattctcatatggatgtaaaatgaacatgtgtttttattaaagatttaaactcattagtagagagaagactgatattatgaggtgatcaaagaaggagccaaagaatcatcacatttacagatgaggaacattgaaatgaatgtataatgagcaaaaaactggcttcttccacattggaggaggaaagtcaattgaacctccacccaacaggattttgcatatctatagacaagaattattttccattgctctcagttatctacaacatacagagttataccatagctcaaaggcagtgaatggctggaatcttgggagagtagatttagacaatgccatagttcaactgaagcacaattttttccctacacccagtaaattccctatgccttagtattatgctaaggaaaatggaagaaaccaagtgataacaagtacattgttgatttttgtatgaaaacagtgtcaaaattttgttttaaccatttgtagtatggttctccctaaaaattttataggatttatgacattactttggactgtggcctaagtatttaacgttgctagataagtaaactgtgacctcagctgcatggttcagaatcacaaatacatgccctaaagtccatacagtaatgatgactggctgctctttattgaacagattggtacattaataatgatgatcttgaggtcagggttaattatattcaaaggtgttaaaatggtagtaaataaagattagagttagtatagtatcgtaagataaggtagaattggttgggagagatcttagaatcttaaaggggctctactgggaaaccggccggaaatgtgaagaaaaaaaggagagctggagtagacggacattcctttgttatgatgattcaactttcctagaagcttctattttagattcagcaaatactcttagttctcttgtatcttggaagttagaatggtatcatttgtatatatttaagaaagcgggcatctttcatgctcttatgattatgtaaaagcctttctagagaatggagtttgggaagaaacctagagtagctaactaggaatatcatgtttccatatttgtatttgaggaagggagaagataaaaagaaggttccatgacactccagccctttgtattcttatgcttggcagcttttaaatttattgcaagtgattcctaaggatgctgttcttgagcaagcttgtacacctctgttttttgttttttgttttttttttttgagacagagtcttgccctgttgcccaggctggagtgcagtggtgcaatctcgggtcactgaaacctctgcctcccaggttcaagtgactcttgtgcctcagcctcctaagtagctgggattataggcacacaataccacacctggctaatttttttgtacttttagtagagatagggtttcaccatgttggccaggctggtctcgaactcctgacaaatggtccacctacttcggcctcccaaagtgctgggattacaggcatgtgataccacacctggctaattttttttgtatttttagtagagatggggtttcaccatgctggccacgctggtttcgaactcctgacaagtgatccattcacttcaggctcctgaagtgctgggattacaggcgtaagccaccatgcccatcccttgtacacctcttgatattcagtttgtcagttgtagatggttaactttcatagtcctagctttactgagaagatcttttgaatttcaggtaaaaaacataagagtgaatttcagcttctggtggatcaggctagaaaaggatacaagaaaattgctggaatgtcacaaaaaacagtaacaataacaaaagaagatgaatctacagaaaagctatcttctgtatgcatgggtaagagactataattaaaaacagacatatgtcgaatttcattatttacttttaatatgaaaaaattaaaccaaagaaatttactttggagttcttagttctttgaaatgagaaaaagtatttttagacaaacttcatgtagcagtttgtaaactagatttattactatggggaaagtggttggaagaatgtcctgaagaaacaatctctttttgtctatcgtcctttcagttaatgataaatcataaatttctttgttatttaagcttcaggatgttttctagatatagaatttattggtggagatcctgtaaagagagtgaattatttttgtgatagaacactggtgtttactttggatgaaatgttctgccaaacagtctaaagttaacatacctggtaggctaatacagagcacgttccttaactttgatccattttaaaatttgaaattgatattttaattctattgcctgggctttggaccagtgaacaaaaaagaatcataatgggggaaagtgcgcaagaaaattgcttattatgtttttctatattgtggtaaaatatacataacacaatgtttatctttttaacccttcataaatgtacaagtcattggcattaagtacattcacaatattgtgtaactatcaccactgtctatatccaaaacattttcatcattcccagcacaaactttgcactcatgaaatagcaactcttccgtcccctctgcctcatagccctggtaataacaattccactttctgtgtctatgagtttgcccattccaggtacctcatataaatggaattgtataatatttgtctttgtgtgttggcttctttctctaagcataatgttttcagagtccttcaatgttgtagcacattttaaaattttaaaatattttaaaatttttgattaaacagtattccatagtatgtatatgtcatattttgtttatccatttatctgctatggttatttccaccttttggttcttataaataatgctgctatgagcattggtggtcagatatttaagtttcagcttagagtgcgatttctgattcatatgctggttctatgtttagaaccttttgaggaatcgttaaacttttccatagtggctgcattatcttacattcccaccagcgaagcatgagggttccaatttcttcacatcctcatcaatgcttgttattttctgatttttaaattttttaaaaattgtagatgtgaagtggtatgtcattgtggttttgatttgcatttccctagtgactaataaacaatttgtgcataaagtgctgcctcagtatgtaactcat

SEQ ID NO: 104483 - DNA, 1092 bp, Homo sapiens
tatatgggattttactttggaaaacactgactccaaactcatttcttgatttaaagtagaagaagtatctcagtggcatcactgtagaagggtgtgagtcttttctactcttgagagagcctgtttttagtcttttgtaccactgggttctgggttcttgggcagacccagagacactctgactgtaagggctggtctaaagaagagtagttaaagtgatcagggagtaaagggcttgatttcgttctaaaaaagattacatttaaacttagagaggcacaaaggatggtatgattcaggtattcaaaatctggaagaaaatgagttgattgaacgtgtacttagtcatggacactcccacgactagctgagccacttaaaacttttaagaggaaaatccaggacacatgcccaccagaactgagattttaaactctgcagtattccttgccaaatggcagatcttctaaaatgaagtaaagaagtaagtgggaacaatgttactagtcttgatctgttgacatttttcattttctgagtaggggttattggaattctctggctaaagccagagtagtggctgccatttacttttggtttccagcctagctgtggggtaattagatttaaatctgggattttattacttcagaagataataagtcattaagtctccttaactgttaatgtgattactttagcaaatttcttgactaattcttaaatctccagtctttatgtgtacagtggaatggccttagtaggaaaatagcttagacctggtctaactaaattatgtagatcccatagtactgtgtcaccctcgcctaatagaaactacataatgatgatggtagtgttagcccattgattctaagcagccagagaaatacaagataattatcctcaagtgcgtagagtgaaataggacctcaaagaaatcacctagcttgtgtcctagataggatctcacttgtttgtaaagagttagttttttccagtgatctttacggccagcatatatttcttttgctgacactttaattggtcttttatttaaaatatgccatacattttatagcccaacattag

SEQ ID NO: 104484 - DNA, 1275 bp, Homo sapiens
tgatcttttaagtctgaggtttaaaaagtggacctagaggcttaacttactgtgttttgtattattgcattttctatacatactgcttttctataatgacctggagaagttagattggaaaggagagaaggcagacaagaagatcagccttactaatagtcagctaagtgtcgttagtcttctggtttcaaatattgcctgttgtattaatgaatgtgggatattaaatattgaaaatagaaaatttattattttgttaatatataattgaatcatgttgcattttctactgatgagaaaaaataatgagtaaaatgtataccatttctggtatttaagggaagtacataggaatgattcttcctaggtctatataaaacagatgagagatcattttcctctattttaaacactcacatttgagatttgaaggtttgtaatatttccctttttgtcattttggggagatttttattaaggtctttttttgattattttaggtaatggtttttacaaaggaccaaacagaaaaggaaatagatgaaatccacagtaaatatcgtaagttgcacgactttatttaatttgtaaagagcttcagttgctgtttttcatcttaagtaatttttcagaataatgttttatattaaggttcaattcaaacttttgttaacattacttaagagattgaattttaattgggtgtttacttagtgactttttttgtattttatatgcctgctttttgatttttatgactagcattctactttgagcttatcactaagcactttgcaaatattaattagctgctctcaaagcatttctgtgaaaagaagctgggattaaaatggaaacattcgggactctatcctgtcctcaggccactcagtaacaatacttctgtataggatttcaatgcttctatagcttgcaaatttgtgccaaaaatagttttcattttattgcttgttagcaacctcccaactttatcacttccttttccttaaatggtcttcgtgtatatctttcccagggctaacacattactgttttgtcagatagctgttactctttgtgtggtggttggattttagtttaaatttaagtgcctgacgaacagtagatagttaatagatgttcattgaatcagtattcccaggcatggtatgttttaattgaggtaagataatttttttctctcttcatttcttaaactctgaagggccaggttctgtagtgatgtattgtgggagggaggatgaagcacacctg

SEQ ID NO: 104485 - DNA, 1315 bp, Homo sapiens
tgaattaaaactcactaagaagttcctgtttatggaattgcttaagtcattggtacttttatgtagcttgaattttagcccactagaatttctagcatgctttaaagaggtggaaaattgaataggtctatgtaagtgtgattctaagtgaagtcctcacagcatattccacaagcgttacatatatgtcttctaagtgtgcctctttaggtctgacctctttttgagacccaagtctctcacttctggtgccacctaggcccctgtgtctgaatgtcttaccagcacctcagatacatcatgtcagacactcaactttatccacaaacttgatttttctctcccctttttaatctaatggttctactattttcccggtcacccaggtgttgaatcagaatttatttgccattttacatgaaaagcatttgataattcacaataatcatcaggtatcttccccccttttcagttctgttcacaaaaggaagccgctgcccaaaactgtatataatttgctctctgatcgtgatttaaagaaaaagctaaaagagcatggattatctattcaaggaaataaacaacagctcattaaaaggcaccaagaatttgtacacatgtacaatgcccaatgcgatgctttgcatcctaaatcaggtaaagtaataaaacagtgagttatgcttactttctggataaagcaattttgtgtagctcagaaattataaaccatagaaaaatattgtaaataaatacatttttgatagataagacgtgcaaatgtgttccttcaaaaggtacctagagtatgctatgataagccagccttcctctcagcctgccttccaatccccagatcccttctcagaggcaccccattgccagtttctcatgtgcctatctagggagaatgtggtggggaagagtggatctggagagcctgggttacagtgcccgtttttcagctttgtggcttggtgactgtgggcacgttacttgatatctctgtacctcagttttctccttcataaaataagggttataataactacccacttcataatgttgagtgaaataaatgataaaaggcatgaaaagtgcctaacacagtaccttagcaagtagttagctttcagtaaatgttgccattatgattattgtacacaaacatatatccttttcattactgtttttacaaaatgatagtattctgtgtagtgcactatttagtggttggttcttttcattaaaccacacacatacattggagttctttctattaacatatagaattgcctaatttttaaaaacttgg

SEQ ID NO: 104486 - DNA, 1064 bp, Homo sapiens
gataataggtgataattcagagagatttggaaaagaagaggagggaagctgaagaaattaatggtatctgagaagtggggatgaaagaatgatttgcttctatgttcagtctgttttgaaggactttgaagagtattttccaaaaaccatgttaataagacagagccatagtattattttttgtgattaaagaaaatacatcacttaatttttatgagtaaatttggagtgaatgcagattctgagggtcagattcatactgttacaacttacaaaagctaacatataagacacaatggtgctttattaaggtagacatacttgagtccaaacctggggcagttttacatgcacagtactcccacctagtgggtaagtttgttaatgagaataaaatttagatttttaggttgcttagtggtgatttggagtaaatgaatagtcctaaggattatttcccataagccacgagagtttgatgaactgcttttctctttagaaatgcatgagttgggaatatagaagctgagtatattcttttggaagagtaaggaatctgcactgattatcttgcatggactcccctttttctagatccatccatcagttcgaatacatttctgatacatcatttctgatgctgtcagtttgtttgaagacatactcgtccatgtgtaattaagttctaatagtggtttaaattcctgcttcaaagaacactatagtcctgccagtgctctgtagtgaacttataagcactacctcctggatccccctcttagtgtgttaaaggctttgagaagtcctacattaagggttactgttaggttttgtttaatttagtaatcctaaatttatttgaccgccaagcctttctgttctcatcacttccatcttacaaaactggtgtttgtggagattctgaagacaacactgggccatgttcttctttagttgtatcttggccacggagtcaggtcatagagaaaaggccctgtgagttttcctgtctcctccacaatattctgacaggccatctgctgaatgtgagtggcagcccttaa

SEQ ID NO: 104487 - DNA, 1043 bp, Homo sapiens
gttctctgtggcctaaagctgatttcctttcattttgttttattgacacattaactgccttttacgttagatttattgctttgagttatactagaagaaactttggtttggttgtcattatagtataggtcctgtatttcagaaaacaaggttaattgggaaaacagcttatgtcagttaatttatgatgtaaaattggatctcttaattgtctgttgtgttctttgtgcttcaaggaatcatctgctgcagtttgctttagagtcaccagccaaatctcctgcttcttcctcttcaaagaatcttgctgtcaaagtatatactcctgtagcctccagacagtctttaaagcaggggagcaggttaatggataatttcttgatcagagaaatgagtggttctacatcagagttgttgataaaagaaaataaaagcaaattcagccctcaaaaagaggcgagccctgctgcaaagaccaaagagacacgttctgtagaagagatcgctccagatccctcagaggctaagcgtcctgagccaccctcgacatccactttgaaacaagttactaaaggtaggaagttattttcatatgtggaaatatggacatcttttcatccacatgacataagaataaataggcagcatctttgagggggaaggaatggtaaaggacaaaccagattttaccatatcacaaacctcagacattgttgtagatatgtttgttctctttctctctcagaaacaggaattcaggctgactgctacaaaaaggaaacaattttaattagttcagccttcaagtatggcagtagctttctgttttcagcttttaatctttcttcccctcattcaacatatcagttcccatttaatcttgaaaagctctttttatcttattttaccaccacttgaatgcctcctcactgttctgcctgccatataaagcctgtgacaatttgaggcctaacctagtcatcccgccttattgctcacctctctgtctcagaagtcctgctctagcctccccactgttcctc

SEQ ID NO: 104488 - DNA, 1044 bp, Homo sapiens
aggaggatgggtcagacattttcaaaaacaagattatgacaagttgattattgtttttgacctttttccatctgttgtttgttttttctagactgtcacagagccggatctgaaaaataaccgcatattagatgaactggtaaaaagcttgaattttgcacggtatgatttaattttgtgactaacctctaactacttttgccttttatatgtgttctctctttactttgtgcacctttggattagggaatgcagggttgcatattttatagtcaaagaagggaagtaacagtcattattcacacatggaaaatttactagagtaagattttcttcctttacttaacagaaattctcctgtagtatagaataattaagagttaaaacgcagatttgaggacttccttacttttgggtgctctgaagatactccttttcctgcccaagccctagaatcagccatttctccaaggagctcctcttcttggagaatagtatttagagaccaggatctggtgctgggtatgcttgttgctactggggtgtcattgcttctaggccctctcaatggacagagctaagtaatatatgtatgttatatatatgtatgtactaactcatgtatatacacatatctataattgattctgtctgctatatattaatctgttaattcttaatcggatttattcagcatgtattaaatggtatggcatttgaaatatgtaattgcttgtactttataaagctcagatatgcaactttacttcctgtcaaatgcatgaatgtgtgaaagtgagtttggtcacccaaagggatatgaaaaggcatgtttcaatatcttggattacttttagttttaatcatgcaagtcaaacaagaatttttatgaaggacgtactggtttagatagtggtcaggtgcccctgtagttaagtgtaatcatgtgttgcttaacagggatgtgttctgagaaatgtgtcattaggcaatttggttgctgtgtgaacatcatacggtgtacttacacaaaccaacatggta

SEQ ID NO: 104489 - DNA, 1042 bp, Homo sapiens
attgtgtgcctgcttttgataccagtttcctcttttgactagacagtttctggagtttggctttaacattctttgatttgattcttaacttgtgtggtggcaatggccacctttcacccaatagtgactataggctaggtgttggagtctgaagaggaggaggcttggagtaagagctggaagcgcattagaagtggaacagaagtacagtagcccttatgtgaagggatgacaatatggcacaagaatcggtgtgccatcatctttagctgtctaaagcaatttgggcaacctgagactgaatgtataagagtcatatgagagaagtttttatttatttgtcaagatcccttgcagtttatctggagttagcttttgaatttgtgtatttgacaaagagtttgattttttttttaggggatagagaaaaagttttgtgacaggacttccaattttgatgtctttctgatatgtatatatgcatatttgcatttcagacaatagatgatttgctgcggtgtggaatttgcttcgagtatttcaacattgcaatgataatacctcagtgttcacataactgtaagtatgttttgttcctgtgagttagtaaattgcgatttttacatgaggtagtgttaatttaacaccaaagatatgtgcacatatttatgtttcacctttagctcttctatcttgtagtttttcagaaggtctttttcactgccttcctcttgaatattgaaggtttttacaaggcttctatattttctacctcgttcctctttgatatttttatgattcttatagcatttatggcagtaaaatttttggtcacaataagtggttctttatttgccaagtgttttttgacgttaagtttcagaatttttgtttttaacaggataacagataggtggttccaccaagtagtacttgatatagaatttcaaagtttaaaaatctgtaacaataagaatattgccccagtgggagaattctaccactgactttattacagacagttttataccttaactgctat

SEQ ID NO: 104490 - DNA, 1064 bp, Homo sapiens
agaggaaccagtgtgggaaggggcctttatgtggggctttcttctctgttggagtcccttggagtgccttgttgggtatatttctctgtcattcaggaggcacgaatgtggaggacttctcgtgacctggtcgtgatgtggcattcagtgcatgtccacagctaatggaaaaacacgaggactcgggtaatggttcttcctctcagtctttctattcctaacttttcacacatccagatggttccacactagtgcaaatgcctcactctcctgagaaacccagaaagaagagtggctggctcacaaccatggggttagcccctgctgggctgggagtcggggtggcggccaggaggaaaggcagaaaggggtgagccgaggtgttgcctagctgattttctgctgtgcagagctaatgctgacatttcatgtcaacttccccggttctctggggtctcctctcctctgagcagccacatagaacattccccacatatccaaagctgcccaggggagccgagagaagggactttgctgtcaggtccaagccctcctgacctccctgagattgatctgccagtgtcctgctgtccctctgggactggccacatggccatcgctgccccttgttgacacctcctttctgtgtgagttgtccccggccaataacaaagctgttccttgaaccagaacaaccagagtgcacttttccttccttagacggaagtagatcctggctagggtttctgcccaggcccttgttcccggcagtgtgactgtttacatggtttggcaataggtttgattctgattgcttcagagtggctggtctattttgtttcctttggtttccttcctccccaaattgtgacaggaaaaacagaccaaaaccaccctaggaaattgctggttgcctgtccccacgtgatgataaatgttgccctcttctggatatcgtttctctaccttacgaccaaacgcccgtcctatagagtgtctgattggatcctctgtcgcgtattctgatggtgcctgctggtttgacgtggagctatcctgtgaaa

SEQ ID NO: 104491 - DNA, 1436 bp, Homo sapiens
cttctggggaacctgcctacgaagggaagctgcttagcagacaggaaggacctgactccaggtctccagactgtgctgaccccagctccctctgtccccaggacatcgagaagaccatgagcacggctctgcacgagttgcgggaactcgagaggcagaacacggtcaagcaggcgccagatgtggtgctggacaccctggagcccctgaagaacccgccaggccccgtcagctcggagcccgccagtccccttcacaccatcgtcatccgcgaccccgatgccgccatgcgccgcagcagcagctcctccaccgagatgatgaccaccttcaagccagccctgtccgcccgcctggctggcgcccagctccgcccgccccccatgcggcccgtgcggccggtggtccagcaccggtccagcagcagcagcagctcgggcgtgggcagcccggccgtgacgcccaccgagaagatgttccccaacagctcagcggacaagtcgggcaccatgtgacctgcaggatgggccgcgccgccgtggcccgctgtggctcaccacggcccagggtggccttggtggcttccacgtgcttcccagtgaccctggccttggagggcagaggtccgtctgggagggtgtgtctgtgcagagctgaggcccgggcgctggctgcagctcacgtccagccatgggaatcccacggacctctcgcgtgtcaacagacgaccagaggagtgctggagctccagcagccccaaccacagcattccctaacatggaggcaaaataccacatggcttctcccgcatatcgtcactggaaacttcctctctcgacattctctctacatacgtatatgtgtgtgtatatcgatgtgtgcatatatacacatgtatacgtatgtacgtgtctgtaggtgtgtgtatatatatatatatttatgcatctatatacatatactagatctggacacacgcatactaagtgtatatagtatctcctttttctttttatgaaacttagatttacctcagatccatgccaccaaacatctcccaccgagttatttggtgggatttgcagggacttttctgggagaacttaaaggcccatagtaactgcgaatgaagcaatataccactaacctgcagaaaaacacaaacaaaaacagactcccactgtctccagaagtcgtggccttccagaacagtctgcccctcaaggaagggtggggcaggcagtacccccaagcaggctgctcccagaggtggggaacccttcataggaaatccccacccccgtccaccccagagaccctgcccttccacccggaggccaaaggccaactgtactcccaaaggcatgggagaaggttggcgagaagacccctgactaccacatccttgtgtttgtgtgtagagacgggggatagtg

SEQ ID NO: 104492 - DNA, 1051 bp, Homo sapiens
tattagaattttagtcatttagaataaacttttaaatttgattcacagaaaagttgccccatacccagtttcatttggggtgtttctcacagtactctgagagatatttgcagccaggaaagtgtcccaggagatggcaagagaagagggaggtttgagctcttttttattgtgtgtgtaaaagacccttctgttcctctcttccctccacactattccctgctcatctttccagacctccatactacaagctgtattctagactgcagaggtctgaccctgtctgagccctgtatcacttgctcagccagtgtttccagaaccccaaaaatcctgttcctgtacagggccctgagccaatttcaggtctaggatgacctggaaacaggggtcagagatgagatcccaagcatctgccagactttggctgataggtagcttgagaagtggtgatttattcgatgttcatttcctgagcaaccactatgtgtcaggcctgtgctgcagctggtgtttgtaaagagtttaataaaacatcgtccctgcctgtgtctgtcaggactcataagtaacagaaacccagcttaaacctgcttacttcataaaagggaatgcactgttcgggaacctggaaaacttaggtccagctggactcagaccttcacacggcatcagcagatatatgccccgtccggctctatgccagcttcactcttaggtgggatcctcctctcaggggcccccactgtgctccaggcttccctctacccaggtccaagagggcatctccctgtgggtttctcacaaccaagtccggagagtcgactctgattggttcttgattaggccacacctccagcccctccctgtagctagggagatggatgctctgattggccaggccaggatcacctgtgatccctggaatcaagagtagagctggctcccccatccacgtgggttgatataggagatgtggcgagcgaatgtttgttgctttgctctctgaggatgaaaggcacgctgaaaggcccctttatgttacagaact

SEQ ID NO: 104493 - DNA, 1015 bp, Homo sapiens
gccagccttgcttcccccctggtgtgcccttaattctgacatcaggtactgcagtaataggatgaggacttgatccttgagcactgagaaaatagtgttgagttgggacaaaatggagggggaggcagagaactcttcaaggccagactccagcacccccccgaggtggttccctctccactgcccaagtgggcctgccaggcctcctgagcccaggttcctttccagttgggtaagaagaagagcatttctttaaaataatcatagctatgcctttttgtgcatacagttgaagactctctattgtaactgtccgtggagactttaggattagcagttccttgcttgttttcctactaatctgatggtactaatattctggcttgagtctgtaatcggtgtttgcaatgtctttttcctgtggtggttgtcaagccccataaaactcacaatttttcttttctcaaggattcaggacaagctataccgcttgtagtcgagagctgcatccgttacatcaatttatatggtaagctggatcttgggccagtgttttcagcaatctgcagaacaggtgctaggctgttctgataggaaatgagattctaatttgtcctggaagacttcccgtcacagctctgctttggagggggaaagtactgcacacagcagctgctcttctgagtgctgcttttgagcctgtgtgttgagggatggagatcatggtgagaggatccaagacctaggaaaactggagagtagaaagggcatggacaagagaactcaaccctatagctctgtgctttgagcactgaatggagtttgccagtaaatcagctaatacggctagattataagctccatgaaggtattaggttgatgccaaagtaattgtggcttttgctattacttttgaatggcaaaaaccgcaattacttttgcaccaacctaataatgatgtctgggatttgttaaccatggtgtcaccagaacataactggtgcttatccactcg

SEQ ID NO: 104494 - DNA, 1007 bp, Homo sapiens
gtattcaatccttcaactattgagaatggaatttaattttctattataattcacatgccttctgaaagaacattgaactaagagtccccagctttgaaaaaccacacctgtgaaaagtttttttaataaaataacatcactgggacttcacaattatggtggtctagagggacaaggaagcatcccctgggttcataatcataagtaaatgttgctggagtttgttttatacatttcttggaccctacctgaataaacaaacccctttcaaaatccttgatgttttttcctcctcctctcaggcaaaaggagaactcatttttataagagccaattttgaagcccaggaggttcacctctgggacaaggggagaatcctcttcttgtttctgtaaaataagcatgacaattacctacttcatgagtttgtgaggaagattaaatgagccactatatgttatgtttctagagcactggatggcacatagtaagcactatgtattacctatgattattagcattaatgttagcatattgctcatacagcctgttcgaccaggctgtttgctcagttctgggattctggtagatttagtcagcatgtcaggtagcagacaattccagctgtcgagatgctgagaactggacagatgactctagctagaaggcacacatcctccaggagcctggatgggacaagtgctcaccccagagatggacctgctgcacaggtggaaagagccgatggcgctcccctgaaaatgggcatcatcagtggcttttagtgaaagtaaaggccccagttctgcccccaagctcatgaaggcattctgactcaacttccctttctcctccaggccttcctcagcttttgtattccttaatgccagtgtaagggtcaagaggggaggaaggagagcaaagccaagtggatacccaagaaaagcaacttagggtgtacggcagggaaacatgggaagctgtttggaatttggcatcaggtggaa

SEQ ID NO: 104495 - DNA, 1113 bp, Homo sapiens
tacagaggagaatgaaaggacagaaggaattattgaaaggaagaacagaaggaatgaaggctcagagacagggacatcctcagtttgcttaggtctttggaaatgggtgatcagtcaggatacttggaaggaatcaactcttatctgacagtacttgacaagtagatattctgttgagttaagtattttcgtaatagaggggtcctatatataagatgtgactataaagttatctgactttattccttctgaccaacacatcataacctagtcaaccacatgagtgtttgcccctttgagacagtcaccttgggaagccaccttcttacctgaatgtgttggcattgctgcagctgctttggtcaatcttctttagagcctggagcatggcctttaccagtggggccaagactatgtattcaaatggacaccttgtctttggaatagaaagctccgtttgaagctgagctttgcgatgccattggaggtgcaaaatggcaagaggaatatgctacagtggggctgttccactggctctgaaaagagcaccccagcagcgacagcccagagcacttgagcagtggcagcgctgttggaataagtgcatcacctcctaaggggaaaagttggaggaataatactcatttgactgggaaaaaaggtgtgtttgttaaatactatttcattcattcattcattcattcattcattcattcattcatttattgaggcagtcttgctgtgtcgcccaggctggagtacagtggcacaatcacggctcactgcagccttgacctcttgggctcaagtgatcctcccacctcagcctcccgagtagctggggctatacgcatgcaccaccatgcttggctgattaaaaaataattttttttttttttgtagagacaggatcttaccatgttgttcaggctggtcttgaactcctgggcccaagggatccttcccaagggcctcccaaagtcctgggattacaggcatgcgccactgcacttggccttactattgcgttgctttatagtcacactgtactcatcacataccatcagcacagttcaataaactcatactgtgcacctactatgagctaagtgg

SEQ ID NO: 104496 - DNA, 1143 bp, Homo sapiens
cccatgtaccaaggctttgggccaggctcagattgcgcgcagctgggcacacgcatgtgcataggcgtgcacagactctcctgccgtccacaccctagcttggacctcacgggcacttggatgagctgacggaaagtaacacacgggcaacttctgctttctcttcagcttgttcaacattcccttttgcgctttttcctgagcagaccagagccagtgaacactttccactcagcagctgatagcccaggggctgactttacttccctttcagagagcttagatccataagtggctctgtcactggccaggttgtttgcttagagcctatttcatttctatgttcctattaagagatattgcactgcctagctggaattcagccagtggcccagaggcctgcacttttccatcacacggcagtagagcgctactttttgcctcactttctgggcccagggacctgagggcattctttcttttcccacaaatgctttccagtggccccaaatcctgggaagccctcatgtttggcaagagcaaagatgaactcccaactctctcctgctccttgggaagggagttgggcaaagtcttggcaacctctggggttttcagtttcctgggctcaggatggggagacggagggcttggcagaagttcagcccgtacagctgttcctctgggctctggcaatttggaaacatcaggatgattcacaccaggcaaggcccttccagcacacggggcggcagatgtgcagggtcactttcgaagaaccttttagaaacgaacccattataatttttttttcttttctggcgagagaatgttgtcatagtctcaaaacaacagaagctgtattttacaccaaattctgcaaatagtgaaacagatgggggatgaattgagctgtccctcacttcctcctaattcctagaactcacgcagagaagtttgttccagcagagtgtgggagaggagatctgtaatcaaacacttggccaggtctcagggtcttccctcaggggaaagttgagggtttgtgtgttttgttttgttttgttttgttttgttttgtgttttaaataaagccctctgaagtgttgtcttccacaccctccttgacctagggcctgggaa

SEQ ID NO: 104497 - DNA, 1048 bp, Homo sapiens
gaaaatagaggccaaccacaagtcttagtttaggttggcagggacagtccaaggcaaagtgatagaggggcatccatcaggtagggagtgggaatccagggcctcagaggctggcactgacatttttcagcagacactatttgcaaggaatactactggagtgtctggctagggttctaggtccagagaaggaaaatccatacatgtaagtcagggtttggccctcgagggacctgacaactaggcttaaagccactcaatgcattccagtggcagttggaataaaatcccagctgctgtcacggcacatgaggccttataccacttagcttctgcctgcttccctgacctcatcagtcattctccctttccttactgtgccgcagccatgctgagcaaatttctgcccttcaggactcaccaagcttattcctgccccagggcctttgcatctgcatgggcaaccaccacccaaatcagggggtagagcatttcagtcaccctcaaaaattccctcgtgctcctttgcagtcagcaccccacactctactctgatctgatttctgtcactgcagattagttttgtgtgttctaggtagtaagggctggggaactttgggggctgacggaaataaaagctccatatcctgctttgagtggtggttatacttgggggtagacatttgttaaaactcattgactagggggtaggaggggggaagactcagttgcagtgagctttttcttcattctttccctctaaattttacccatcccgacatttcagtattgggccagcgggtaaagggggtgtggaggagtttgggtagcaaagagggaagaaaaacagtgagaatggaggagaaagggagagagtccaagagtggagctcagggtgtgggtgccatgggggcagcttctaagactagcattaaagaggagggttggtatttataggcacagggcagggggctattcctcatgagccagttaaccaaaaggtaggaccatatgagttggtggctacttgcatttttgaaattagatg

SEQ ID NO: 104498 - DNA, 1055 bp, Homo sapiens
cacagtcactgaggaacaaataatgcagagaaaggattttccagtaaactccactttttttcttcttaaagttctgtaagggaggtggtggtggtctgttccgggggtcctacagggtataatgatggtggagataaatgctaaaggccacccatcacttgctttagagaaaaggcttgtctctatctggggctaggaaggatgcagaggagactgcaaggccaggcattttgttcattcatttattcattcactcactcaataagcctagtccttatcacccagtccttatctgctcagcccttagcaccttgaggcaccctcctctttaaaacatgctagcatgggtgtttatgcacatatgtgcgcgcgcacacacacacacacacttgcatacatgcatgtgcagtttgacatgcaccacacactagcacatatgcacattcacgtgcttgtatgtacatacacatatatgcaagcgtgcgcacacatatatcccactccacttcttttccctcgaactcccatcagcccaacacaatatagttcttgttcatgtattggcctgggagaaaaaaagggcagaggtaaagaacgtggaccagtatggcaatccttctagaagaggcaaatcaaaacaaaacaactcacaaactgtaagccccactgtgttttcactgttcggctaaaaatgtgttcagattttcaatatatttctatattatgaaatgcatgtgtgtcagtaactagtgaacgtccagtgtccccccacctgtctcttcctctgtgttcagcagctctgctccaaactgtgggctggccttccaagcccagggctgcaggagaggcccagtgactttgttctttgccatgtggggagggcctgaggagtgtccattcatacccagtagcagctggtcacaggtagaccctaactggagccatgaatcactctacctttgacttgttcaagccttgattgattgtgtatgggctcagggatgtgacatcaactctgggccaacaggcaaatcttggcaaaggtgtctccctcc

SEQ ID NO: 104499 - DNA, 1051 bp, Homo sapiens
gggaaatgatgtgtagggttctccaactcatatgatcagggaatcccatctgcaaggaacctctctctgtgggtttgtttcatggacatagttgaggaatttatgttgttgtagatcaatgaaatttatgctgatttctgtaccccttctgaccccacccgaaacattcctgacctttcgcttttgaaaagagattggtaaatgtagccagcaaacttctcccccgctgacatttgttcttccacattccagagcaaggagattggcctgcagatgcacgaggagctcctgaaggtgaccaatgagctctacacagtaagttctgcccaggctcactgctgttttgggattgggtctctgtcttcatcaccagagctggagggaagcaaaacagaggtctggaatgaccccaggccttttttgctgcgttttatgctgagtgacagtgggtcatcgtgtcaggatgtaatgactcacagccccagcttctgattctgtacatctggggcagggcctgggcttgtctagtttgtcaaaattcacgagagattcaaacgacctgccgctgtggggcgtgttacctgcaagaacagagggcacaaagtcaaggccgggggagtgtgagtgtgaaggctcctgaaggcagggatgtgagttttggagtgaggcagcacaggctccagcagaggcccctccttaccaactgtaggaccataggcaggtgggcagtttgtctgggtctcagtctgtgcatctgcaaaatggagcacggttccgaggatcacgggaggtcatggggtgagcctgcattgccatctccaaggcatagtttcataacatcacagtgtggtccacggctgactttgttacctgcttggagtcaacatctaactgtgcttgagatgagttttagaatccaagaaggtgagcaaatggggacacaaacacatgaggtgatgatgcaggaactttcagactgtgctttgaggagcctacggcttcctcaagaggaatgtggggaccccatggagagatatggggagtggggtgg

SEQ ID NO: 104500 - DNA, 1068 bp, Homo sapiens
gtgatggaactggaagcttgggaatggaggccacactgctcgtctctcaggggctatgccaggtttgtctctgcttctgtctgctccactctccagcctctgtctctgcagactggcttcctccccctgctcactttgcacttggcccaaggtggccgtcagctgggcctgcgtggctttagggcttgtacctatcataactgccctcaactcttgtgtcttggttcaaatgttagagagacagagagagagagacacagagagagagagaaatattggctggctgaggccagcctatgagtggacaccctctcccatctccaccttggatcactatccattcctggtccagtcgctggagggagagggctggatcatgttatgccaacatggctggctacccatacttcccctttctagaggttgtggccaagtcaggcacatgtggatgggacatttaataaggatttaacaaggacatttaacaaggattgagcacctatgatgagccaggcaatgttctaggtacaggggatacagcagtgaatcaaacagacaatgatccctgccctcatggagagtacattctactcagggaggcccagctgtgcagaaataaataagacaccattaaggcagaggttggggatctagaacagcatttccataggacacatggatgatgtggggaggagcaggaggggctctgcccaggaacccggttctatccttgtcttctctctcccttgcagcttcgacagttcctttccaactggattcccgttgcctgcttctgcttatctctgaccctgtcctgggctctctgggctttcaaaggcagcaatacctttccttacttcggctctcccttgagctccttgctggccacccctagacaattcaaccctaccatgtctgacagccacttccctccaacctgctgaccctgttgctgggaacttcacagtcatccttgcagacttgaaatgttgggatgccccttggctctgctgtttccatccagccagttatccagttgtttagagtgtgttcctcacatctgtctct

SEQ ID NO: 104501 - DNA, 1074 bp, Homo sapiens
ggaggccccaggccctgccgccttagcttggagccgcaggttggaagtgatctctcccacgagagtgggcgctgatgcctgtgttgggtttggcccggacagactggctcctctcatgtggctccatccctcttgatctcagccagggcagcctggacagactgaggcctgggccagatgatgttaacagcgattgttcatgtttattgaacactgactgtgtcccaggaattgttctacctgtatcagcccacatagtcttcataatcacctaagaagcaggtacggtgacctccctctttttatggatgcagaaagtgaagcacagacagggtaaataactttctcaaaatcacagagctgataagtggcagagctgagactgaaattcagcctgcctccaaatcccgaccttcatccactgccagacactgcctctgctgtactggcttgccccttttggagtcatttacactatttcaactaaacctcaaaacaccctacaaggtaagtactcccattgttgtttccatttcacagatgtggaagctgagactcagtgaggttaatcacttgcccagggtccagccatgctgctgggctctaagagctcatgctccttagccttgcccacccttggtgcttcacccatggccagctccccacgctgtgtgtgcccccacctgccaggtcatccttttccctgtgttggaggtgttgccctcactgtggtttatctggcggggcttaatcccaggggcctgcaagtggaccagaaggagcagggatcactcaggattcaaaattgttggcagcaagttccacaggcagatgttgctcccagagccccaaatattaggattgaaatcgcccatgtactcctcagggaggaggattctttgcagttatcttggggggaggtgtgtaaagggggcatcttaatatcccattccctatttttgcttcatctttgcatatactgaggttatttttatttgctgaattgtggcaaaatagacataacataaaatttggcattttaaccatttttaagtgtgtagttcagtggcatta

SEQ ID NO: 104502 - DNA, 1064 bp, Homo sapiens
ccactgtccagtgagcggcttgagtgcaggaactgttttattttatgtttgcgccttcttttcatatcttagtaggtgtcagtgactctcaaacagatactctcctgaaggagggtagtgctttcactggcaatgacccaagaccatcatctggggcctgccagagtcaggcacagccccggcattagaactttgggctgtaagcctgtcctctgtgcttatgtgggtggtgcacaaagcacttgcaaacatctgtgtgcagtgctgctccattcggcctgctgaagctttcctgccctgttgccgctgaagcagggagtgtgggaagcgcccagctcagagctgggccagatgtggccatacctcccagcagtgcaagcagcatcactgcgccaggccagctgactcggctggccctggtgcacagtgcttaggggcttgtggccacgagccatgccccaccacctctcctgtttgccttggtagcttcccagcttcctctcacatgactgtttctgtttacttctccctctggccttcctgcctgcggcgtccctgtgccacctagagtctcatctaccgcactagacatagcctctgcaatggccccgcaccagggcctccttccagggcatatcccgtctctgtctcacccttctagtctgcgcttgcccttctcactccccagctctctctgttactgtcagtggagggtctgtgcactttgtcgttttgatcctatgacgttgtatctgtggctcttccttcaagtgcccaggagaggcccagctcctggggccagaaaggggttagtcttgaagtcttgggttggacatttcaccatggccagcccagagctcggctggaaacagatgagagacaacatgtgaggaggcagacaggagctggggatccaggctctgagcacctgagaggtttgggggaaggtattggtaatggattggattgtgtcccccaacaaaagattttcaagtcctaacccctgtacaggtgaatgtgaccttatttggaaatagcgtctttacagaggtaatcaagttaaa

SEQ ID NO: 104503 - DNA, 1011 bp, Homo sapiens
taatccacccaccttggcctcccaaagtgttgggattacaggcgtgagccaccgtccccagcccatgtaagaccctttttaaaattaaggtcacatttcgagttattgggatgaggactccagtccacctctttggagagttagagttcaacctgtaacaattttaaaagatggagattatcctggattatctagcggtccctatctaatcacgtgggcctttaaaaaatgataactttctctggctggagccagaagagcgggggcaccagaagggaaaatcagaaggttatgatgcgttgtaccctccctggctctgagatgtttgggcccaggcacagagaccggagaggcctgaggagcagagggcatcccttgcgggcagctagccaggaaacctcagtcctacaactgcaaggaatttgattctgccacagccaccattcatgaagaagcagatttttccgagaatcttccaataagagctcagcctgataagactctaagcaaaaaaccccctgagtcaacctggacttctgagctacagaacggtgagataataaacttgtgttgtgttaagtagctaagtttgtggaaatttgtttcaccagcaagagaaaacgattaccattaccttcccatttggctggcccttcaatgccttaaaccaaagaaatggcctatgctggaaatttctttgggtctcaagtttaccttcttgagtctttgaataatgccacccacctgtgcagcacgtgacacttcccggtacatttcacacataatttcattcaattctctcagcagccctgagaagtataggtatattatgcttcttattttacaaaggaggaaactgaaatttaaagaagtgattttgcttgaggcttcacagaactggggttgcaagccaggtttcctgcttccaaatcacatgcacttttttgccactgcccccggctgcctccgtgtctccagacatctgttgtctgaacacagtttctcctatcc

SEQ ID NO: 104504 - DNA, 1043 bp, Homo sapiens
ctccttccttgccatggcctctggcttcaccttgcccaatattaattaattgattgaaatgggaggaagtcgagggtgtgggcaatgcagagacacctggcttggtgccctttgcttccttaagcccctttacagaggggactcctgagagcagatggaaatgtctgcagggagtatttttttcaaagggcccccgaaagcattctgcctagcaacaaagagcctttcagaatgcagctccaagaggaggcgaggagcttgcaagctgagaaccgggaagggctggagtcgctgctacaactggctccacaaaagaggcaagccgcagaggattgagtttcatctcggggtacagctgtgggggctgaggggccggggctgggggttaaggctagggagactgagaaggtctttaggtgaacattacagtgtgtgtgtgtgtgtgtgtgtgtgtgtgtgttagcaaatttgtgttttagtactatatataacacaaccatgtggaaggacatgttcaactagtttcctagggagccgtgtgttcttaattaagaatagttttaattataaaagcaatgcatgcttgttataaaattaaaatattctagaggtatgtaaagtaaaaattgaaagcctttgccatctgccccaagtaagcactgttaacattgtgctgtgtattctcccagacttgtgtgtgtgtgtacaatgttttatacgtacataattaaacatctgtataatagatatgcaattataatgactaggttttcttgaatgcttactatatgccaggctctctagtaagtaagtgccaggtattccatgttttcatgacctcatttaattcttgcatctctgtgaagttagatattgtatacatttataatctgctttcaagggagagggatgtgagactcagtaaggtgcaaagaggtagaagcagagtttgacccaggcgccgtggctgcactgtgcacactcttccctgccagcactgtgcctgctatttaaaacaatgtggcatcagttcagctgttttt

SEQ ID NO: 104505 - DNA, 1043 bp, Homo sapiens
ccttccacagtcagcccagttcacagatggctccttcttcctctgaaacccctctttgaccactccagtcatgatcctccctgccccgtcttggtgctcagggtagctagtgtgaggggctggaatctggcctcgccaggtaggtaagggatagagaggctcagtgtggaagaggccttgcatggtgtccaagggcatgcagcctgtccatgggaggttggaatccaggcaggcaaagaggtcagtagtgattgtgaaaccacaaatgccccagtcagtggatggaatactgccaaggggactctagggcctatgacccttgggaatcatgtgggaagaccgaagactctaataatgtgggaagaccctaattttttatagttttagagatggggtttcaccatgttggccaggctggtcttgaactagtctggggagggaggatgggaagaacaaggtatactagggagatgaccaatacaacagccagcccagggcttgggaacaaggtgggatccttgctgttgcactgaggtttacattgtggaagccacagggtggggtccaagctgatttataccttctgagctgatttatacctgaaagggatggttctggagctgggggagggaggctcttgggaggaggggtgcaaggataaggagccaggctggactggataacctccctcttctcatctctcctgtaaagcacctagttcgttctttaccatttgtttgacccttagcctccgaatgccttttacactgtggccatgtcctcatggaacttccgagtggctctgcctaattcccattctaggctataaataccttgaaggcaggatctgtgtctgcatttctaataataataatgacattaacaacacccatttactgagcatttcctttggatgctaagagattacgtggatggttgattccatcctcctgttaaaaccttgaggtctacttatccctgttttaaaaccttgaggtctacttatccctgtttgacagatgaagaaactgacgctcaaaaga

SEQ ID NO: 104506 - DNA, 1318 bp, Homo sapiens
taatttagattgcttttgaaaagcaatcaaggagggaatgaagtgatcacacatcaaagggaaaaagatatggcaccaaagagaggcaatatgctttgcacaactggccatgtcaggttgctctgagctttctccagcacaagaaatatcagaaagtccatctgagctctcctagccctggtgtggccccattcatctttcttcgtgtccattctgtcagtggataagaaggtggagaaggcatatgtggcagatgattgctgggtggagacaggactcttcctcactcagcctcagtttcctcatctagaaaatgaaaaggtggattagattatctttcatgcccttctctctaggtctacaactctctgccaaagttgttttgaagacctataattgtgtaacataacaaatggacacactaattacctgcttctaatccataaggttctccttgctcagtcttcccttgggtattattaggaacagaaaggtgaactaatatttctgtatctctctcctgcttcaattatccgtgctattaattttggtcatggatttttcagttgtcagccttttgttttatttgggttcttacaaaaatctgtgttattgaagtataatgtacacatagaaaaatgcacgtttggtaagggtacagctagatccttgctttttgtgatcactgtcttgtattctttctcccctcaccccctcatcctacttccttctaatttgggatgggcacagaaagggtctaggaccagagtcccattccaaatctattgttcccataggcttctggcagagggttgtttgctaaatgagtttgggggatttgttgtgaacctggtttctgtttctgtagtcactgtcaagggtgaatatgaaggattgcaggtgttctgagggcgtctctgacgggtataagtcacgtcgtacacggccttgcatgggacatccagtgagcgagcgttcggtgaaatgagatcgagcctgagggtaagaccctggtggattgaagaggttgtgagggaaaaaggaggcagggcaggagagagaggcagagcatgccctgtcagcaagaagcaacacagatgaagctgtggcagggtctagatttatataagccaagggggctggtggtgtgcacaaaggggcagccagtaagagacagtggctgacttcttaagctattcttcccgggggaagaggcccagggctgggtaagactgctcgatttgtgattaggaggttggtgaagactgtgcttccttgaagaggtgaaaggtgctgtgtggagagagaaaggatgtgg

SEQ ID NO: 104507 - DNA, 1090 bp, Homo sapiens
cctcctcgcatagctgtggtttatttaggcccctgccacccacctgggcacctcctctgcatggctccccatttcacagaaggtgctgatgcctttcttgtgattctgccagcagagaaattgaggtcagggagatcagccaagcacacttttcggtggcttttaaggaggagcaatcagttagtgatcactgtgggcagagggctaaggggatggcttcaaggagagaaaaaagagcaatcggatggttcctgaattgtagaaatgaacacagtgaaagtaccaggctgggcttgggggtcagaacctccctcaagcccctgaacatcagcttccccactcaggatttctcacttcagtgactgacttcatcatccctccaattgcccaggccagaaatctgggagtcgtccttgacttgtctccctcaccccacagtctaattggctggcaagtcttgttgtatctattttctgtctcttgagtttagtcctttgccgtggccactgcccactaccaagggcccaccagctcttacctggactggttcagccatctctttccaggccatggtcttcctgcttcagctctcctccctcagctcccccatccattcccctctgcagtcggaagtcttctagaggtgtacatttgaccttatcatgtcagctccaggttagagcctggagttactataacgattacctccagggcgaagttcagactcattagccttccaggaaaagcagctcttcttgccctgcccctgtttgactctctgtgatgggggtcccaaaactaccttaggtttgataattcacttgagggactcacaaaaattagaaaagctgatatactcatggttatggttcattgcagcaaaaggagacaggttaaaatcatccaaggaaaaaggtgcataggtcggagtccaggaagacaccaggcataaatttccagttgtcctctcccgggggagtcacttggatagcactgaactctcccagcaatgatgtgtgacaaaacatagcagggaaacccaactgccccttggtgtccagggtttttgttaggagaagggagtcagtca

SEQ ID NO: 104508 - DNA, 1071 bp, Homo sapiens
acagttctcagcaggatgacttttaaaccaactttgcttgtagattttagtttggaaaacgggccacctctttgacaggcatgtcctgtggaacagctagaggcagaggctggcatgaaaatgccaacttttctttcctttctagcattgacatctgatgttagcagaatgatgaattcaggggtgacagatttctagaggatttgtgtcctctttaggccagtacaccctgtcatctatacgaatcccttttctaccctgaaaaccatcgttgaggctgatttaaaagggaaggtggcttttcttgtcgtgagtgaaaaagaacctggtatgttctctgttgtgcatctttgaatggggaggacgaaaactttggagaggtgtgttttagaaaagaatatgttgtttttcttccttctttaaaatggaaatcatgccagagtggaaaatgtagaaacgggaattagaagacctgggttttaatcctgtttctgcacctaactggctgcctgacctttggctgttcccttactttatctgggtgcaactttgctatcttaaaataagagtattggactagtttgcaaaatttagggtttttgtctcttatctttgcatttttccatgtttatgtcacctttattattttctgcatatttttcttgaaactgatccatctattctgtacaaattgttttggagggaaatgttacaaacttctgcaaataaaaagtcagcattgatgctgtatattggaggtaactctaagacaaaagataggctggttcagagggcacattttttgttatgtatattttgtctcaattaaaaaattaaaaacaaagaaaaagcaaaaataagagcaaagaaaacataaaacacaactattaaaacaaatatactgtatttactcttttacaactgaaagctttcatccatcagtggcagtaaatgatccaaagacgaccttctggctccaaaggttttggtacagatgatgtttctagtgcaaactagcacaccatactgcccttgccagagagccacacatctttcttaatcacaccgtag

SEQ ID NO: 104509 - DNA, 1071 bp, Homo sapiens
atacctaatttggagggccctgtacaaatgaaaaggtaaagccccttttcaaaaattaagagtttcaagacagtactggcacagcaccaaaccaagcactggctactgaatgctaggtagattgtaagtccaggaagctggccccgtggtttcttcccagaaccttgtataaggagagggagttattccttccttattaccccagtcttcctcatcactgcatgtgggaattgaacagcctctgaagaagaagatgtcttccttgactcagtgggcctatgtagagaaataataaaacacagataaaaggcacgacaaacattaaataaatactggttgcccgagacatgtagctaaggccatgtagacatataaagaatgttcaacttttttggaaacatctgaacataaatcagatgtaatgacagaaagccttgtcatccagtgttccttggagcaaataggctgtgaccagtctaattgttacagacttgaaagacagtctctatagaaaggcctgtgccctgtatgataacacagtttactagtttctataaagcaacagacaacctacctgcaagtcataatataatgaagaataactacaataggatagtttttgtatttcccaaatattctctggaatattatttttaagaaagagattctacctaaattgggtaatttgacaaataagttttggaaaggctcatattctattccctcttggagatacacaattcatattaaagtcccatggctgtgaaggaagccctttaaacttttaacacaatgttatttgattatgacacctcttttagaaagtaataactaataacaatgtagttagagaacagggattctgaagcatatgctttggaaaatgccggtgatgtacttctaaacttctgagatgcatgatctgggatcacaggatctgggtttcagagccactcacaactatagacaagttacatggtcttctggagtctgtcacccaatctgttaaataataatacccatatgacacagttgtgtggtttaaatgagacactacaaaatgagaagaaa

SEQ ID NO: 104510 - DNA, 1062 bp, Homo sapiens
ttctcatccttatctctaggcaaccacagtctattttctgcctctatagatttgccttttatgggcattgcatataaatggaatcacacaacgtctgttttttttttttgtgtgtctagcttcttttaataagcataatgttttttgaagttcatctatgtggtaacatagatccatactttgttccttttcattgctgactaatattccattttaggatatagcacatttggtttatcgcacatttgtcagttggtagacatttggattgtttccagtttttggctattgtgaataatgctgctgtggacatttatgtgcaaatctctatgtgtacataggcttcattctttttgagtgcctagctacagttccagtgtatggctctaccattatgcatttagccaaactccattggtggcaatttacttggttttcaactttttgggatgatataaataatgctttatcagccatctttgtacatacatctttgtatatatgagggactgtttttgaaggatatgtatttagaagggaaggttctgcatcagtggctataaacctttgaaatttcaatagctagcatcaaagtggtcttctaagagaagttgcccctaatttatgccaccactgtcctcacacacttgtcaatatgggccggaattaatagtctaatctcataagtgaaaaatctctcatagtcatttgaatgggaatgtctctcattattagaaaggttattgaccatttgtaagtccttttcttaattttgtattgggttgttgatcttttcctatggctttgaaataactatattttaggaaattggctctttgcttataagatgtactgtgaatttttttatttgtcagtttatcttttattcctccaaaaccgtgttcatggctgttgtgctgtacagatgttttacatttttaagtaatcatatgtgttaggagagaaacccctgtgaacattttacagtatcacttagctatttataatatccccagaaggaggtgaggaaggtaaaatattggtggggagaaacctgaggaa

SEQ ID NO: 104511 - DNA, 1173 bp, Homo sapiens
tcctttcttaaacaattgaggtagttcttctccctgccccgaataccctttgaaaagttggccaccctctgtagatccccttccttttgcggggaggagggagtcttaccaggctgtgaaagctggtctaaaaaccccagccttgtccaaggtgaggcccatcagaatttgacgtgcccccttggagggtcttgaagaagcaatctggcatctcaatgaggcccctgtggcacaggattgggccattaatagttaaagtagttaaatttctcacagcccaatgtattggaaaggcagcaatgttttcatttagaccttagggctggggtataatttaaggagagtggattttgatttaggaactcagttaacgagtgccagccttgtcaatttttttttattgtgtcgaaaagcacatcacataaaatttactatcttaaccgttttaaatgcacagttcaatgacgttaaatacattgataatgttgtgcaaccgtcaccaccatccatctccagaacacttttcatcttgtaggactggaactgcacccagtgaacaggaactccctgttcctcccccattccctggcaatcaccagtctactttctgtttccgtggttttggctcctctaggcatctcgtgtgagcggactcatacaatatttgtcctctgtgtctgctgtagtttagttagcgtaatgcttcagggttcatccgtgttgaggcgtgtgtcagaattcccttcctttttaaggcggagtaatatcccattgtatgcgtagaggccgcatcacgttcatccgctcctctggggagggacacttgggtggcttccgtggtgtggctcatgtgctgcggtcttgtcagtttttagccatggctcgggaaagtgacttggcccctcagtacctccgtttcctcatccattacatcggagcctgtcctctacgtgggactgaagtaagaatcgttgtttgtgacagtgcgtaactgcaacagtccatcgagttgaagttatttctgagagcactgggctagcatttcttagggtatctgctctgtggccattcagctttgccagcctgaagtgtaggaggaaggtgggagacggttcagagaaacgatacggagaggaccgggctgtggctgctccacagggtgttttgggtggg

SEQ ID NO: 104512 - DNA, 1022 bp, Homo sapiens
ccgggaggttgaggttgcagtgagccaagcagagattacaacactacactccagcctgggcaacagagtgagactccatctcaaaaagtaaataaataaataaaaataataaataataaaaagtaaaattaaaagataaaaaattcaataaaatgaaataaaataaagacagcttttatgtactcctaaatcagcggtgggaaatagtttctacctgatgtgccaactgtgctggattgcagtgacagctggcggtctgtgttgagaagtattctgaggctgtgtcagggtcagcaggagagtatcagatctgccctgggcttggggctgggcatggtgtatatggacggtgtgtttattttctctgctaagcgtttatgcttagattctgccatcatgctttaggtgacttattccctcattctctggtctctttttctggccacacttcagcttatcaacatttaaaaagccatctggctgccatctcttctccctaattcatttctagggtggatttgaccaatctggctggcccagctgtggtctctcctagagcattgtttcctgcaatatcttcccaaatagaggaggaccatttttggatctgcagtctgctaataaaccttccaaattattaacgggtctcttaaaatctggagcccaagctaagtaagcactgtctttcagaagtactctcaatggttcggaggctagcaggactaataatacatcccttgatcctgttaatgcggcttaaaggttgtgttagctttttccctgtgtttgtaaagccgaagctgtagtgtaccccctgctgcggatggtgagggcaggagagccagatgcagtgggggcaagatctcctcctgtcccctccctgcctctgtgactcttggtggcttggggggcctggggcctgcaggggtgacatatggccccaccgaggtccaaaggccacaggtctcattctgtcacaatgaagttgtctgccctaaaggtccctggatcactgtcagtct

SEQ ID NO: 104513 - DNA, 1045 bp, Homo sapiens
gacaggcatgacactttctttgcctgttatgtgtgtgtttctcccagtgtggttcctggaccacctgcagcagaatcaccttggaggaacttgtaacaaattcaaggaacttgaattctaggaaccaccccagacctactgaatcagaatctctgttggggggcagtgggtggaccctgggaatctgcattttacaagtgcctcagatttcatgaacttaacataattggccctggtctatagtaaactcaccagtttggctgtgtatcttttttttgaaagcaaaagaacatttaataattaggtagactattgctgagtgaggtgggaaaaataacacccaaagtgtgtgtgtgtatgtgtgtctgtgtgtgtatgtattacagttttaaaaataaaaaccctatgtccttatatatttagatatgtataaaaagagtctttggtttttgacgattggtaatgaggtttacccttggggacgaggggtggaatagggtggtagtgtcaggggacaggggaaagaagaccttttcatctttatactgttcaattttgattggcttctgaaaaaaatgagcatgtattccttttctgatttaaaattccacgaagttgacagtaagtaaggactttgttggcaaaattcctgctagagaggatgctcagacatcagctgaactgtaaaagaaagaaagtgacacctgcaagagctatttaaattatgctgaacttactgtggtgctcattatgtagtgtaaggatgattgctgaaatgaaacgtaatattttaccgaattattcccccacgcagtgaggaagtttttccatactctttcaaaactttgaaatatgggtagaagagtggaaaagttcagcttaaccttttaatttaccgagtttcagtcaggagccatcgtgatgcagtggccagagtctggggtttagactcataagacccgattttccatctctggtctgtcttttgagcgagtcacgtctgcattcttcattctgcatcttggcttcctcatctgtgaaatga

SEQ ID NO: 104514 - DNA, 1749 bp, Homo sapiens
ttctgtctttggcagcaagtgctaaagggagaggcttgtctagggcaaaggattcatcttcagcagctggagaccctccctgctggtacctgttccctggtctacctttcctttcctccttgttgctctctgctggatttcctggccattgtgatactttttggattccggattgcttgtctgctcctggcagatgtagcctgccatccccttgcttccgattgctggtgagagcattttcaaaatacagttaatgtagatcagtaagttttccaaccatttgtcaaatagaaagacctggatttctgtaggcgggtagagttctcgctgagagattcaagcttggcaggatgagacagttccttaggggaccttctatagcttatagtgccttaagagggtcagagaaatgacatgagaagactcttaccaatgaaacatctcagccaccttcagggacacaaaagaatggatgtcatgtctgtgatttaatttgtactaaagaatgtgaactggccaagcgacatggctgttctccaactcagtgtctcggtaggacacttccaagcagagttggcagtcacaatgtctttactttgatcagtggcctctccagacaggatgttttgggtctcccaaagatctattaccttggggaaactgaggcagaacaacagtcactctctggcttctgacgtcttatagttgattactccttgacctcttgctccgatcttctggacccttgatcatttgcctggttgtggttgtttgaatttatttgtcccgtgaccctcagctaatctagggctccatccttggcctgatcctccaggttcaggccccaccctgagcatctctgtcttgctggatctcgtacttggcataatatcaccattgaaactctgctccaaaaatggcagaggctctactgctgtctgccagaaacatagaattatgttactgggaattgtgtgaaagaaatgctgagaatgtggtgggccagttcacatagatttagcttaacaaatatttattgagctcctactatgttccctgcccgcacagactttataattctgtggggaagacaaaggataatttgtaattacaaaagtgttgagtgttatggaaggagtggtgcagtgtgcatgggggaatctatagcaaatggatctaaagggctgaaaatgctgtgggtgatttactgatactgatttgtaaagctgagttgtattgactaagcttacctcaccatcattgtttcctgagctctttaggatctagacagaaccatctttccatttagagaagggtcagaagtcatcaaaatatttaaggggtcagaaagatcagtgcttctaagagaaacacacaactccaggtgtaaaagataaaagtggttccagaaaggggattttataatagctctattcaggatggtaaataccatcgtgggatgagtgcttttaaggtgaaattaaagccaggaatcagctgaagaagattgaaacccaccttctcttgatagaattaagctaaagtcacagagatagatgagacaagaaagtggaatgtaacgtggaaggaggcagctgtgatgccctgggtggagtcacccagaccggggttcaatcacggctcatggtgaatcagctgaatgaccttggatgaaagtcattaacttttctgagttccagtttcctcatgtgaaagagggacataataacacctcactgtgtgtgtggg

SEQ ID NO: 104515 - DNA, 1224 bp, Homo sapiens
ttctttcactgctataaagaaacacctgagactgggtactttataaagaaaagaggtttaattggctcacagttccacaggctgtacgggaagcatgatgctgacatctacttgggttctggggagacctcaggatacttacaatcatggcagaaggtgaaggggaagcaggcacatcttacatggcaggagtaggaagaagagggggggggaagtgccacacacttttaaacaaccagatctcctgagaactcactcaccatcatgagaacagcaccaaagtgatggtgctaaaccattcatgaaggatccatccccctgatccaatcacctcccaccagcccccacctccaacactggggattacaatttgacatgagatttgggcggggacacaaccaaactatcagaccgttataaaaataggttaataaattatgacacagtgtagtaagtactgggacagtggtagaaccaggcactgtggaaacttacaatgaagtttcaactttaccagggagagctggagaaactcttatagaagaaggatcttttaagcaggattttgaaggatgaatagaagctctccaggtggtgaaaggcattacctgaagagaagacagcatgtgcaaaggtatgggggtcacaaaagggtcagggtacttgagaaatggtgaggagtttgaggtggctaaaatcctgagtaggtggaacaaaatggtggtgggagatgaggctggaaaggagaagagcttgaagttcctgtctgatcatcagatcctgtaagtctttgaccttgaagatggtatggatgagagtcgtatttatttgttgtggtaaaatacacaaacacaaagtttaccgtcttacccatttttaattgtgcagcttagtggtattaaatgcattcacattaaatgccacccatcttcataacttttttcatcttgtgaaatgcaactctgtacccattaaacaatagctccttggccgggcgcggtggctcgtgcttgtaatcccagcactttgggaggctgaggcgggcagatcacggggtcaggagatcgagaccatcctggctaacacggtgaaacactgtctctactgaaaatacaaaaaaattagccagctgcagtggcgggcgcctgtagtcccagctaatcgggaggctgaggcaggagaatggcgtgaatccggcaggtggagcttgcagtgagccgagat

SEQ ID NO: 104516 - DNA, 1060 bp, Homo sapiens
agtattaactacagtgaatttccttccttctccatctcctccatcctggcctagcctgccattacctcttgctgggaccagtgcaacccaaagtttctcagggtctcctgactcagagcttctcacccacagttggcattttgggctggatcatttgtggttgaaggtgctgttctgtataacataggatgtttagcagcattcctgacctgtacccactagatgccagtagcatccctgctcccagttgtgacaatcaaaaatgtctccagacatagccaaatgtcccctggggacaaaatcactcctagttgagaaccacagttctaagcggtctccctgcttcttttcttgtcccatagtctactctccccacagcagccagcagtaatctgtacaccatttaaatctggccatgtcacttccctgtttaaaacccttcagtagcatctcattgcatgagactagaatccaagcccctcaactgcacttagaaagccacgctgtgctcacctctttccctcccctggtcactctccccttgtcattctatccagtcatgctggcctgtactggtttctggacttctccaagcttgtacttgctttgggcctttgcacttagattttccatctttctggaatgctcttgccctggattgccacttgattggctccttcttggtattctgctttgaggttgcatgccacctgcagactaacccatcttaagtagccgaacagcaactctctattggatcagctgacctgaattcttagcagagcactaaaagctatatgatatttttcacgctttctttgtttcttctcttcaccaggactgaaactcaataagagctttgatttctcttgttcattagtgttttttggcacctagaacacagtgtaggatgtttagcagcattcctgacctgtactcactagatgccagtagcatccccgctcccagttgtgacaatcaaaaatgtctccagacatagccaaatgtcccctgggggcaatgggtgttctaggtgccaatggtcacaatttttgttgaa

SEQ ID NO: 104517 - DNA, 1025 bp, Homo sapiens
agtgtgaatcgctcagtagggcccatggagtttcctcaaacttacttgattgtgtagatatttttcatggactgggtcacaagactctgttttctgagttacattttagaatatgtcaggctgcacaattcatggatcatctgggtgctttttctttttgcctctggctcagttccctaatgttttatacttgtctcagagagcagtttgaagagggaaagaagtaaaacaaatgcacatctagttgagctgagtgatatcaatgtagtgctttgagttcacctaggaaatgtggattttgacatttccaattacagagtgctcaaccattgatttaaatggtaatttggaaacagtgcagccctaatcaatatgcattgcgtgtgcccatctgtgcgtgatggtaatggggtgcacactgctgcagcagagtgttccaggttccttgaatggacctggctcttccccctgggattgcatagccagtgctaggtgataatggcacagatgaacacagagaagcccatgttcccttgtgcctcagagtgaacaaatctcagctacaaacccaggtgcacaagaaatatatttttctttctttcttggtgactcagtctccatttcacatctctatcttttgtttttttgagacagagtcttgctctgttgcccagactggaatgcagtggtgcaaccttggctcactgcaacctatgcctgttggatttaagtgattcttctgcctcagcctcccaagtagctgggattacaggtgccagccactacgtccagctaatttttgtatttttagtagagacagggtatcaccatgttggccaggctggtttagaactcctgacctcaagtgatcctcccaccttggcctcccaaaatgctgggattataggtgtgagccactgcggccggcctcacatctttattctgctgggggtgacagaaataagtataagtcaatttggggtttccctccagggttgtgctccaagatccagggggacttaggc

SEQ ID NO: 104518 - DNA, 1030 bp, Homo sapiens
tgacagaatgaggctgtctcaaaaaaagaaaaagttttaatcttataactcatagctcagtgtttttgttttgttttgttttgttttgtttagatggagtcttgctctgtcttccagcctggagtgcagtggcacgatcttggctcactgcaacctccaccttctgggttcaagcaattctcccgcctcagcctaccgagtagctgggactacaggcactcgccaccatgcccagctaatttttgtattttcggtagagatggagtttcaccatgttgcccaggctggtctcaaactcctaacctcaggtgatccacccgcctcggcctcccaaaatgctgggatttcaggcgtgagccgctgtgcggcttcagcttttttctttgatatccttcttagttggcttgggctgctataacaaaacaccatagcccggatggcttttatttacttctcagaattctggaggctgggaagtccaagatcaaggtgttggcaagttcagttcctggtgacggcctgcttcctggcttgtagacagctgcctttagccatgtgctcatctggcctttccttagtgtatgcttatggagagagagaaatctctccctttcgctccttcctcttttttttttttttttttttttgaattagggtgtcattctgtcagccaggctggagtgcagtggtgtgatctcagctcactgtaacctccaccccctgggctcaagtgatcctcccacctcagcctcccgagtagctgggactataggcgcacaccaccatgcctggctctttttttgtatttttggtagggatggggtctcaccatgttacccaggcttgtcttgaactcctgagctcaagcaatccacccgtcttggcctcccaaagagcattattacaggagtgagccactttgcctggttggctttcttcctcttcttataagggcactaataccatcaggagggacccatcttcatgatcttatctaaccttaatcacctccccaaggctccacctgcaa

SEQ ID NO: 104519 - DNA, 1069 bp, Homo sapiens
ggatctgttttttttccagtctcaccaacagtctttttgccttttagtcctggtcaaaagcccagcgtgctcatcacctctgggcatatcctagggcaagaggagcagaaaaccctgctcttccctggtctcctgtctttggtttttcagttcaatgtggaaaacagtgacttacgatgtctcagccttgctgaaaatttagaaataagcgctttattggtcagagattttaattcacccaactgctcaatacaaaagcctagtttcaatctttgaatagactctttttagggagtttatgttttataaaatgaatttggccaattattattattttataaaaattaaggttgccatgaaaatgccttgagagagaaggggatgttgagttttggacagttcaggttttatgatattttcttggtaggaaatgtgcttatctcattttggaaggattgctactactgggccagtgaacttttcttcagggccagttaggcattaattgccctggctgatccttttgctttttacctttcatcttttattttaacaactaagcagcgagtaccctgagttttatcagaaatacaccaattaccaggcattcatcaggaaatgtgtccaaatgatcttgtctcttccaaatactaaatttccttgcattctggctaaaggagttacatcttattcctttagaattgacacccacaaggtcaggtcaggatatggctgtccctgaaaccctctggaatcttttcttttaaaattctgtgtgttaatcaccatcataattattgatgtgtgtctagggccctgcattttctatggctaactcccagacatcacttactcttggcccacacaatgtacagtagggttagtgtgaactcagtttcagagacaaggaaactgaggcccagttaatgttaaatgacttgcccaaggtcacaaggccgattttctcccaggcttgtgttccctgacacattgtttgcccgaagctgccccttgaaggattgatgtcagcagcagatggcagttttgtggggggactggcagcctcttg

SEQ ID NO: 104520 - DNA, 1073 bp, Homo sapiens
ccagtagagtgacaaaccatcatatagctgttgattccagaaactgaattaaattgcacagtgcaaaaaaagggaggatcttaagtttttggaagaaaaatccctaacccaagtgctaatgtttggagtttgcagaagcctctcaagacttaccaacccgattacttttcctgctgccttcccttttgtgagcgtttcttcccctttttgcttgcagtgagttctgctctcctgtaggctacaatgtgtcagttgttataaaatccgggaggcggagtctagtgacgtgagcagtgggggagagctcagccagccctgcagggcgagcagtccagccttgtgttcaccggagcttaagcgttgcagcaggaaaacttccatctcgctctcctggctttgatcctcactggacatcagaccagaggcaccgaagggagggaggatgcgagatgaccggccctttggcaacctgaccatcgacttagcagagccttcaaaagcaagccaggggctggctgcacgaccaaagaggcgccgcgcctctcgtggatgtgtgtgtgtgagtgatccagcgagtgtgtgtgcgtgtgagggtgtgtgtgtgtatgcctgtgtgcacagcacaactgtgtgcgtgtcccggtgagtgtgcctgtgcatgcgtgagtgtgtgtacgtgtgcatgtgtgtgtgagtgcgcttggttattactattattattatttttggaagaaaaatctttgaaaatctggggcaggttactgtgctcctagggtgattcttcttttgcaagaggagctgaccagggcaagctactagagccatttctcggcaagtaaagagatttttccttccagaaggagaaggatttttctccctgctctgcagccaagtgaaagagattagtccctaaacctgtgaaatcgaccagagctgtgtgattaccagggcttgagagaggactcgaaaagaaaaggagaaataaatcaaacagcctgtcagttcctttggccacgtcagaagatgtcatctcaaactaagttcaagaaagacaaagagatcattgctgaata

SEQ ID NO: 104521 - DNA, 1526 bp, Homo sapiens
gctggagtgcattggcgtgatcatagctcattggagccttgacctcccaggctcaagcagtcctcccatctcagcttcctgagtagctgggactacaggcacgtgccaccatgcccagttaatttttgtatttttttgtggagacagagttttgccatgttgcccagtctggtctcaaactcctaagttcaagtgatccacttgcttcagcttcctaaagtgctgggattacaggcatgagccaccatatccagcccagactttttttcttgtcattatttcccaaacaatacagtataacaactatttccatagcatttacattgtatcaggtatcataggtaagatagagatgatttaagttactcttgagaggatgtgtgtaggtcatatgtagacactataccattttatatgagggacttttgagcatctttgggttttggtgtctttggcggtcctggaaccagtgtcccccacggataccaactgtccataagcaaagtagaggtttatttgtttgattatagtggtgagaaatgaatgaatttctttctctgtcctttacaggaagaagttctaaaggattttgaagacttggctggaaaactcccatggtcaaaccccttaaaagtgtggaaaattaatgccagttttaaaaagaaaaaagcaaagcgcaaaaagataaatcagaattcaagtaaagagaagattaataatggacaagaagtcaaaatcgatcagagaaatgttaaaaaagagttcactagccatgctttagattctcatatcttagattattatgaaaatccagccatcaaagaggatgtatcaacattaataggtgatgatttggcatcttgcaaagatgagactgatgaaagctcaaaagaagaaactgagcctcaagtgctgaagtttagagtcacatgcaacagggcaggagagaaacattgctttacctcaaatgaggctgcaagagattttgggggtgctgttcaagattattttaagtggaaggccgacatgaccaactttgatgtggaggtaggtataggctctgactgtggtgattgaagaatgctgtcacagatttgtagaatttccagactaacccaatgttatgcacaattaaactgaggaaatagtagggtgtggttaagaagagcataggctatggagacagatttagatccaaattttaactccacaactgtataactttggactagatagtctctgagcctctgtttcaaatggagccaataatattatgtacctttaaggttatcctgaaggataaatgaggtacatttaaaatatttggtgcaataccttgcatacactaagtgctccatagatggaagccatcaaggttgagttgtctgttttctttttctttttcgagacagagtcttgctctgtcacccaggctagagtgcagtggtacgatctcagctcactgcagcctccaccttcctggttcaagtgattcttgtgctcagcctcccaagtagctggggcta

SEQ ID NO: 104522 - DNA, 2024 bp, Homo sapiens
tattatactaagaggacaagtcatataactaacacagttgtctaaaaaaaatttttttgattcagaattctaagcagtttactaactcaacttatttcatagacatgtaatggcaaaggtctggtttctaaaactacagctatttttcatgcctcaggatgcatgaaactgtttttgtttcatatagtccttctattttgtatcttttgcaagtgtttgactcatgagaccttctattataggatgggatccaagaagagaaactggaacctttatccagcttgcctacgggagatgagccgtgtctgcacacctaccacaggccgagctgtactacttactcaagacacaaaatgctttaccaaggtgctatacacattagctcaaaatcgcagcctgtggcaactttgggatctttttgagatttggggatgtttgtttggataagatttgttttctcttcccctgaggtttcctatcttggcagttaagaatcctagttgatgtaaaagtagattgtcaacctaattgttattttttttgtgtgtacacaggcgttatctggaatgcgacacgtatggcgaaaggtggatacagtctgggtgaacgttggtggtcttcgtgctgcagtttacgttctgatacgtacacctcaagcttttgttcatccttcagaacaagacggagaaagaggaactctttggcaatgcaaagaatgaagatgactaatagtacttgtacttcccaccactggaaatgttagcataaaagaacttggagaggaaaaaagtattaacaaaactgcagtctgcactctttaaacctgtttaaggctcttcatcctggttagcaaaaggtgtgaatgtaatgtgatggaatttaaaagttttatgagaccaggcacagtggctcacgactgtaattccagcagtttaggaagccgaagtgtgcagatcacctgaggtccggagaccagcctggccaacatggtgaaaccctgtctctactagaaatacaaaaattagccaggtgtggtggcgggcgcctgtaatcccaactactcaggaggctgaggctagagaatcacttgaacccagcaggcggaggttgcggtgagtcgagatcacgccattgcactccagcctgtgcgacaagagcgaaactctgtctcaaaaagattttataagaaagcagagcttttccttgaagctcttttgaagtggtagcttaattagtattttgttgaaaatactttaaagatgcctagtgaaaagcctactaaagtgctgtgagattggggtttagaacattttattttcaggctttatggcctattttccattgtgtcaagtgcaaaactaccctggcccaaaggaagggcagagaacataattacatcttaggccacatttcattctttgcagctttgctaatccagttgctcaagttctttacctcaacctgaaggaatgaagcattattacattttgtgaatggtgttcagcctataagacgaagtctcacaagacctataggaaagtttaccatctgccttaaatattaaaatatccatctgttattcacattaatacacagaatgaaaatagaggtctaggaattatcaaaggtactgcaaaaatactgtatagaacttatttgtaaatagcacatacattgatagatggggtgtgggaccaacaaaccaaattaaaagaaattgtttttctttcagtacactaaggtgtgtgttttcaaaaccaaacacaaacctgtcaagagtatttgttggctagtttcttaaaaggccaagagaaaaaaaatgatatatctttggaaaacttttaatttgggagttatgtgagttgttactttctcctggatcacgattcacatttaattgcttttccagttgcaacaagtccttcttgagagttttgtggaaaatggtgcttccctggaacaaagagtagttgaggtttttttgtggaactcatcatagtattgtttattttggagcctctggc

SEQ ID NO: 104523 - DNA, 2116 bp, Homo sapiens
agtttgagcaattttcccatagataacaccaataaattgagggctgcagagaccacttaagtggttctcttaacagtagtctagacatgacgtaatgagatttggcttaggagtgacaatggtaaggaagttaaaggattcaggaaccaaataccagttattgagaagaaagaatggcctcaaaacatcacttctcaaggaagccttgataccctcacccttactacactgtatcctccatttgaatgttgtcaagagctcttctcacaattgtaaataataattgtgtaattttgttttttttttcctactttaggttgctccttgagggcaggacagttcttatggctttatccgttgcgtaagcacagagaggtctgcgaggtcaaaactattgtcatgatagcaagatgcctgtctttttcatttattctcacggtgtgcagaggctacatgatgtgtgatgacatcctcattgatgttaatgaatggtgctatacttgaattttctaaggtgtcattaggtaggtttaggtatgcatacttgtttttagaaattatttttttcctttttcccatttttagaaatcaactcattttttaggttatgccttcagtaatctttgcaacctcaatattgtgtaatggttactttaaaatactgtagttttctttgtgcctaagtataaacataagtacattttgttgttttgtttgcaatagtggtttaaatattttcccaaaatatccaaatttaaaaattctacaactttagaatttaataaatttattctaaaatatttatatattttttcatttaagaatggatcggcttaaaaagactgcttctcatttacttactggctataccatctgtatactaataaaaaacaagatttgatttggaaggactgactcaaactaacgaaaatatgaaacctgtctttctgctttggagatatttacctaatcatgttctgcagtagaataatttagttcttttgtctttttttggagatgaggtcttgctgtgttgcccaggctattcacagctgccatcatagtgaactacagcctgaaactcctgggttcaagagatccttctgcctcagcctcctgagtagctggaactataggcatgcgccaccaagcctgggcttttaaaaaaattttaaaaagaattttgagacaggatcttgccatgttgctcaggctagtcttcaactcctagccctgagtgatcttgctttgggcctctcaaaatgttgagttaataggcgtgagccaccatacccagccaaaaatttttttagagatgggaatggaatgatcttgaatagtgttggtgccacctatgttgtggcatcattttgaaaccaatcattcagagtgctttttttggtaaggcattattttttaatgcaggtatgccactactgggaaaaaaaaaaaaacaggttttaaagctagaaatgaaaagctacttaagtatcttaaaggataagttactttattatacactagaaacatacacaatagctgaaaaacttaaaaaatctcacactgctgaatgtctctgctggctgaagtgtaagtaaaagatcatagtagtgccgctgttgagtgataaagcaacttgtcattaaagatgtgtgtgcagacatggattctgagttaatatctcatctgtagaagtatatatttgtcccttgctttgggattggtttctggacagcactcccccacccttgctggccatttgccaaggacaccaaaacccaaggatgttgaattcccttttataaaatggcgctgtatctgcatacaacttacacacatcctcccatatactttaaatcatttccagatttcttatacttcatacaatgtgaatgctatataaatagttgttacattgtgtacttatatttgtactattgtattaaatattctcaaatattttcaagcacatttggttgaatctgcagatgcagaacctgaggatatggagggctgactgtgctaatacgttatcaatggatgcgtgcataaacatggctggacttgttacttggcttgtatttgccaggcatcagcaccaactagttaaagatac

SEQ ID NO: 104524 - DNA, 1036 bp, Homo sapiens
tcagagacagaaaagtctttgtcaccaagaagatatactccatgagagagcagaaacaattcatcaggtttaaccctgctctagataaaataaaactatctgattcaatactcacacttctctaataatccaatacattatcccatctcaagaagagagagtcacagataagaaaaaaaaggcttcttgagaagtatgtgctctaatataaactaatatgccactaagaaagcaacctgcaaagtccagtaccagacttctggatttgtgacctaacaaggtgctctacaattaacctaacagtcaaaccagagtgttgtaaaagagaattatgtaattatgccaaacctccactcacaaaaaatatatggaagtaacctaagtttacattttgcaaatctcacacacacactagccctgacaaaagtttcaccagctttctcatccaagtacaagcgtgtaatatacttaataaatttgtcttataagggtaagaaatagtatgtaactacttgaaaaggagataggtagctggttaatttaaacaaaaagcccaaggaagtaaggtgcaggaaaaggataactgcaatgattagtacaggaaacccaaagaagaactgaatggtgggatagatgtactcagagaccatgaggcatcagtttcctctatgaatagaatattaggagatgtaggttaaatgggaccctgaagtctctcccaaaaagccttgtttatatgttttctgagcttaactattacttgagaatcaatttcacgtataaaccaacaaaactaacatttattgagcttccagctctgtgcttaggcactgaaaaatcactttccttaaggattgcaattaagcaggagaaacacaaataaggtgaacttctcttgttcgaaagaatatatttcaacattccttttaaaaggaaaacctgacctgcaagtttccaaaaatattaattactattcctctttgcctctcaaaattcccattctgttattttttaggaggaggaaaaaacagttcat

SEQ ID NO: 104525 - DNA, 1132 bp, Homo sapiens
gctttttcatttttcactattttccacatactacacacacaaatatgacctctctcctgaagtcacatggaatgaattgcagttacccaaatcatagagacgtcatatatctttgtggggtggttctttttggaatgctacccttgctgcttttaatcctgcagattcaaatgtcatctcccctttggtcatgccttccatggtctgttgttctatgacccaaactgcccttttaaaaaagcagttttcttctgactcctgagcagtttgtactgcgtgggtcatagtaattctggggttgttgtcattgctgatttaaattaccttaactattctgagctttttgaaggaatagtgtcttgtactcctgagctcctagtatactctgatgtctagccaactttaagtaaatggagtgagcgacatgtaaatgtctttatggtttgacattttattaatcttgagcattggaaaagtggctggtatgactaaagaactgaatttttattttttatctaatttgaattgcaactgtggacagtatagctgtagccccggacttgttctgtggattacagaatacgtggacattgatggttttctctttttactgagcagtaaggaaataaaagctgaagctctctggcccattacatttcatttaactgcttgttttgttttatttattatatatttagctgaaagctaagtccaacaaaccatttttaaagatgtgcctgccttggacaacagtgaaagcaagcgttaatgagtttggatttcaaaaaaaaatgcataatgaattttagggaggtgagattccattaaactgttacaggagctacatagttaaatatatcagaacttgaatgaagaataggtctgtgtgatacaaatgaacccagcctaaatttctgtcctacaagttttcacttcctggaaacacttgattggaggagctctaagcatcatatcttgagttatagaaaacaatcacaaagtaagttttatcctgaggaattataataccaacattttaacaccaaatgctttttatattgctaatacagtatcttacacattttaattatcttttttttttttttgagacggagtcttagtgtcacatact

SEQ ID NO: 104526 - DNA, 2534 bp, Homo sapiens
gtgcgccgcagcccgggcccaggccccggcagcgcctgggacaaggtaagggtccgacagaaaagagaccgaacctcacgatcgggccccaggggagggaagggtcacctcctccgtctccccgcgctcgctctccttgggtcgtgggcctggccctccccaagctcttaggaggatgctgccacttctcacccccctcgccgccttgcacacaccgttgcaacaccccattttcccagggagagagatccccctctaatctaggcgacccaactccccctttcatgtttttcctgggtcaggacgcttcccctcccccaacgcctcttcaccccctttcctgggaactgcctactccacgtttacctttcccttgaggagaggcctcttgctgccctccgctcgaaatacacaggcatactttttttctctccccgatcccccactccctacccccgttctcgcggccttgtgacagacaactctgatcgctctgggggccgcgatctcccctccgtaatcttcctggacgccttccctctcgttttctggcttcccacctcagatggctgcttcccaaaggcattaccttcgccacccccaccacacgttctctggctccccgtggcgtgtgccacagcgtgtctgagatagcctcgttgaatgtgtagggttcgagcctggagttgagccagattgtgtcgttttacttgccttgggcgtggagaacgatcttgtgagaatatcttcaaaggcagaaaaatattccctttatgaattctctttccctctgcgtgtaagtcgggaatgtgaagaggagtgtaggaaagagccctggttcaagtaggtaaatcgcatgagagggaaagttaaactgttgggaaagccccttctatgctaattgattctatagagtccttgcttgtctcacttcttgggcgtcagtggtctttctcttggatatggatgctgcagtcagctctgctggtctgggtcaggggtgcgtgtatgacctgcattttctgctttctcatgttacttgtgcaatgtattcaccggtaactcatttctttcccagacctctgggttccactgggctttgtctatatttaagttcatttctccagtttccttcctgcacataggtactgaacgaatccccaagttctgtgctaattaccttcatcagttgactaaacaagtttttagatgacatatttgtgaccaaggtcatatttacatttctttgttggacagatgttacatagctatacttgtgattggggaggatccagctgagtggagtgtgctgagctttttaggagagtgtgtactccctatttgaaattattttttggttgttaattttatattattaatgtttttaggtcacagaaagttctaagtggtaattttagatgtgtgggatctgagctaggactaaagcagagaatacccacgtaatcagaggtttctgggctccatagaggacgtagggcttttttttttctattggatttcttccagttttctcaggatcattagttctcttctgtagccaaaaattctggcctgttatgggattagagtctttaaggtttactcagactgtcattatgtgtagaaaaatgaattatgccctttggtaggacatgacacaaggctctgtttctagctgcaaatttaaattagattgtagagtgcttgggaaattggctttcaaaagaccaaagcttaatcttcactcctaaactgctggcttaattaaaatggatatttagaatttggtaaatgttgatttttctaataaaaggccttggtttaaaagggtgaccttaggattgtttctttcttaaaagcataattccagcccttctggcatggagcactggtccaaaaaaaaaaaaaaaaagtgtgtgtaaggagtgggggtggggtaaagagaaggttgttcctttgggttggatcacaggggtgagtatacaaggcagcagcagctgctggctctggagctctggttgctacgtgagaagcttgagtagtgctggctgctgtctccagggaaggacagcagtgcagcgtccattaatgctgctggctgcagggagcagcacttaggcgatggctgcttcaggactaagaagaaaccttgcttttctgggaattttcactgctgagctggtttgctttttattggtggggagatgggaattagtaattcataatctcctacccatttatggatattggcatctggaaactggatcatggttaaagcctttctttttttgtttgtttgatttgatttttgttttttggcagatttttgttttttatctagacatttgtgcttggataggactaaaagttccattagagttttaatttttcaatcagtttaaaaacccaagtaataattttaagaatctttctgataaccacaataggaagaaaataacaggaattttttcctgcagctcacatatcatgccttcctccatctctttaatcatagaatcaattcttattatttt

SEQ ID NO: 104527 - DNA, 2081 bp, Homo sapiens
ccttctgacatcacaaatatatgtctttggccataatccatctgaaatgtaggacagaccagaagaaatatgcagaaatcgaataagtctagttcaggatactgagaagatggcctctgagccccttaggtgatctcccctcccccacaactcctgaacattaggatgatctctgattaagcaaaacagtctgagcgtggaaaaacttgaaggagaaccaccaccaccaattatatgcaatactggacatattcctgtgtgctgtttttcttccccaagactcgtgtatcctatacttttttctctcagaattttgatttgttcattttcgtgtaaatgtacttaaatctcacaaacatctataatttgtagtatcactctggcatttgtggcagagaaccaaaaagaatggaaatgagttttgtcattcacaaatgtggctcacattgttttcccagtaataaaagcagaccaatgaaacagaacctttaatggatactattttaggaggttccaattcttattactatcacatagataagatgcaatagcagataaatatgatttcatgtatactggctgtttgacatacttagggtttaagataaaaatgtttgtagttttttactctgtggcttaagttgctatataaaataattgcttttacactcgaatttcctgttgtttggaaccttttgtgctcttgatattatcattttttagaggatcatacaggcccttttcatagaaggatttacttaagttatacccttgaaaacttttttatatcttttgatactgttttgtgtccaggaactgactttctgaaattattctggcttttctggggagaatgactatttcatttttacctttgaatggggaaataataaagtgcaaagtacagatttgcagataattacttttgctttatcctctccatgttgaaataacttatgaaaaattaggccatagttaacagcagtcaatgactattggatacattttatcagaggggaactggatcatgaataaaataaaattttaaaaataatttttggctgaactctggtgattcatcagtttaatttgaagtcagaaggtctagcagtgaattttatttataaaaattgtatttcaagtgttgaaaactgaaacttcttgaccagtatattttgtttgaggcatcaaactttgcaaaatgtgcatcgtatatttagtgatataactggtagtcatttgtaatttaaagtattctttcaaaggcactctttagaaagtaatgtagtgtacccgtgatgggcagggattggtaccattccttactgccaaaaattccaaaatatgtggcaaaatgattgatttatcttgtgggtgggattctgggaagttcatgaaaggtggagagaatatagtttccttcacttgtctatatacattttgttaaataagtcttaggaaaactgttttattgtatctttaattatgaattgcgtaaaagatacccagtaactttggggggaggtgctgttagaaagcattacattggagagaattcccctaccctgggacaaaatgcattctgtctttaatacttagcgaagggaactatgggataaaataaacaatgaaggtaagctcagtctgctttatatgtgccctcactgagcaaggaatttgtaatcgcatcgtgcctcattcgtttataccatcatattgattttgtttgctgagtacctgagggaataccttacttaatgtaaggtcacattaagtatgtttgatatgaagacagggaaaggaattttctgcttcttggagtaatgtcttagtatttttaaaacacttaagtttttacatcaggccagttttgcctgatgctcatgtctgttgctttggttgggctgctgctttctcttctgtgttcttatgggttcgttgtggtataaggattcccacagctttcatggcagtatgaagtaatgagaagcattgccttagccatgttagttacatgtatacttttggcctatgttatgaatcacaaaaagcggtagctataggaatgtatacaaaataga

SEQ ID NO: 104528 - DNA, 3376 bp, Homo sapiens
acctcccgaggagacccgttctagagctgaattctcattaagaaatggaaaagaatactctatctgaataaaaacacattgtaatacaatgtgtttatttgggttgggattggacctgaacatgtagaataatttgtttccctttatgaaatagttgctcgtagttgtctacaattttatttcattaagataggtagcacattacagctttcatgtgttgggttgccatatgtaaaatgctaactgaagaaaggctactttttaatttcagcctcatccttagttcctggagaacctgatatttcctggagattactccctcccccaccttttagtttaggcaacctcttttgatacatttgtgttcagctcgcatacaagtgggatagttgcatccagtttattaagacttagtatgaatcatagagttggaaaagatctgttggttatctggtcctttaaaccaaaatcataatgaaatattttgaaatttgggtccctattgaagttttcattaaaatgttaaaggatcggtgttctgaacaacatttttagttacttttaaaataaatgttttgcgtcagttctttttttaaaaataaagaatttcatttataggcaaattagctggcaattatttgaattgtgataggatttctcttttatgaaggaatatatgacaaggtttttcaaaatgcttaatatattttaaaagactttaatttttagaaataattggtttgaacagttttccaagagcacatttgttgcttgggttgaggtaccacctatattgcaatgttactaaactagccttaaagttttcccttctgtctatactgcatgcaacaataaagggaactggaatgttaatttccatttatggattagcagaggagatgttttaaccgattaataaccaaaaaactgcctttcgtacacgtaatattaagcaagcctgaccaagttttgtgttatttctctctgttaaagaaaactggatgtgttactacttaacattatattgttatttaatggtcttggcagtaatgatataatatttcgaccaaaagaaattttgagtaattaattattattgtaattagttggaagtttctcatcagtaaaatagcaacagcattaacacaaaatctagtgagctatattttatattactacagaaatttagggtagtcatttctttctttataatttattcacatggattatttccataaatttgtgggactaaaatagaagccatctagtcaagcaccagtctccataccagacagttttctctgcatgtgctatgacccacattgccagtattaaacatcctttacaccctcccccttcccagataattagaaatctcttcagggtagcttccattgctcctattacctggatcttgctagaggctctaagaagttcctggtaaaagtgagacagtaagggaccacattttgattccaaaggttttgataactgttagggctccccaaacagctaatctcattttcaccaagacttagccagcagagggctggaatggaggtgaaacacaagcactgtacctcatcttgcctgtgcagctgctccaccttatttcctgctattattatctcacaacgcctcctcccatcaaaaagaaactaggacaaagggggaaaattggatgggctaatgtgatttttattatgctaggttgtgggcttgtttatatgtacttaaatacaaagctaatttgccccattcttaaaagtctttagtgatagagattttgtaacttctgtatcttctactttctttcttgataaaccatttcagattctcagccttacagaaagaaaggttttaagcatacttaattttcgttggccgttcacagtcattattaccaccagatgccactgtattattagcttgaagaaaggtgggctctcttctgtacataatatctgcaatttgttttggaaaatactaatttgtataaatctgatttatgactaaaataaggttaaaaattagacctctatgtatgtttaccctattaccttagtgggggtgaaattaattagctctttgaacataaatttttcatgtcttagagttcttttttcaagctgcataatttatgttcttcaagccatttttatcccataccacccccacaaagggggaaattttattttttatcatttttattgtctttcaatggtgagattttcgccaccccactcctgaaatgtgaagactcaaataaaactgagtaatctaataaggtatatgcgttgctgaatgtagtaagatgattgtttcatcattcttagatattatgatctagtttgaatctggtttccagtatcatgttagcatatttaatactgttgatatgttaattttaatacatgcccaggtggatctccttgctttctatttgtgccccttgtttgtcgttttgtatgaagggggtttttgttgttggattttcttccccatctctgtgtcctgttatgttctttggcttatgtttcaaaaattctgtttcctaccaccaacctctgtacatgccacaacacatacaatttgtactttcacagtttctgtgaagtaggatgatctgcagttaataatcaactgtttgggcattcttggtatccaaggaaggttttacttagaaggaagaacctggaaggacctgttggcaattagactacttctgcgtttattttacattttcccttattaacgtaggctgttgagagttgacttgttttataagagaaaccagattgacagagaagacccccaatcagatagagttattttaaaaataaatgtgtttattatggtaacatttggggtagaatctaaagggcatatttttaaaaaaacttttagttctaaagacaaaagagtttaacctaaaacagaacaaagagaagggcctttgaagcagtatgattgattatatgctgaatgtagcattagaatgttgtatgaaagcataaatttttattttctcaatttctatggtacaaactactatgcccatggaagtatgtgtttatgcccacagcctgaaatatattcggtggaatgccttaaaaaagaataaatctggccgggcgcggtggctcacgcctgtaatcccagctacttgggaggctgaggcaggagaatggcgtgaacccgggaggcggagcctgcagtgagccgagatcccgccactgcactccagcctgggcgacagagcgagactctgtctcaaaaaaaaaaaaaagaatagatctgaggaaaatgtaagagcaagtctaaaattttgaagtcctttttgaaatgctattttttcctagacaaatttagtgtt

SEQ ID NO: 104529 - DNA, 1799 bp, Homo sapiens
atccaaaaatatgaaaattatgctaacatcatatacagatctcagaagttgctgtagccagccaggcgtggcggctcacacttgtaatcccagcactttgtgaggccaaggcgggtggatcaccttaggtcaggtgtttgagaccagcctgaccaacatggtgaaatgccatttctactaaaaatacaaaaattacccgggcatggtggtgcgagcttgtaatcccagctacttgggaggctgaggcataagaattgcttgaccctgggaggcagaggttgcagtgagccaagatcgtgccactgcattccagcctgggagacagagcaagactgtgtctcaaataaataaaaaataaagaagttactgtagatgccactcttacttaaaccctaggccatgtgtggagtcccaggggaagacatgtatttttagagaaggaaggctctaggtaggtgtaaccttcctcttacagtttatcatgaacagttagtatgaaaaggaatggctggaagtttgcagtagtacaccgagcaacaagagaaataaacatatcccacttcatgaaatgactatgccagccaagggagatgaaaaacaattttttttatagtacacctcatttttttaaaaacactttaatactaggaatatgtttctgtggcaaatagttacccccaaaggattatgtcaaatatctcttgtgaaaattaattttaaaattaatcttttggctgggtgcggtggctcatgcctgtaaacccaacactttgggatgccaaggtgggcagatcacctgaggtctggagttcgagagcagcctgaccaacatggagaaaccccatctctactgaaaatagaaaattagctgggcgtggtggcgcatgcctataatcccagctactcgggaggctgaggcaggagaatcgctcgaacccaggtggcagaaattgcagtgagctgagattgcgccattgtattccagcctgggcaacaagagcaaaactatgtctcaaaaaaaaaaaattaatcttgtgtagatagtgaccacgttttactttccttgggacagtcctggtttatacctgctatcctagcgtaattagtaatagcacccgtttcactctcaaaaatgtctcaatttggatcataaattatacgcttaccataattgtagaggattgtgagacttttagtcgctacctagcaacctagtttttcttgatagagctcttcttattctggagtctcctgtgctgcgatttatctgttgacctctctgaacccccatttccaaatgagcagtttttcgaatgtcttttttcttttcccattaggtggtagtaagggaaggagtaggtatagatttgattaattttttaattttttattattaaaaactccaattactacaaaatagaaaaatactttggagtttattaaactgttagtttaaaaggttccatttgatcaggataaggtccataccttgattggtaagtttgagtctttatagattctgttttttccatgtaggattcttgttaaagaaattcattattttgtggagttcgtactctggattttgaaggttggataatcatttaacacattcctctattaaacaacctccccccacctgtatttcatgtaaattactgcttagatagattgtaagcatattttataatagtactgtgtatttccattaagagttacataatttctgcttgtctgtgtaatgttaagcagctgttgttattcattgcctagatcaaactttgtggtcttaaaaattg

SEQ ID NO: 104530 - DNA, 1581 bp, Homo sapiens
tgtttgatatgttacagtctctggcagttactatttttgacattcaggttgtcctacctttgtctgttggctactaaattcttttgattcattcttaatactttcctcacttgtttccttgcttcctactattactagatgttctaggataattttgtacattttttgccccaaacctggaatcagccatttctgcagaaacctcttcattcttttaatgaaaaatggtacttagaaaccacagtatggatggtaggagtgttcattgctcttggtttgggccttgtttctagatttttcaatgaacaaagtttaaaagtattttatttctttttaaaaatatcacttggtattttaaaagctgcatttcaaactcagtgctacatgatgtttacgtaaacctaatctttctccctttccccatgcccaaaatctcagttttcactaacaccaatgtaatttctctttgttttgtgccacaatacacacactacagttttagtgtgacagaacaatatgattactggaaagtggctttttgttttgttttctcatgtctttttgcccttagggtatatccctttagagatagagatagtcatgcctcacttgatgaggatattttctgagaaatgtgttgtcaggtgatttcgtcattgtgtgaacatctagaatgtactaacataaacctagatggtacacctaagctatatggtatagcccattgctcttaggctacaaatctgtgcagcatgtgaccactggatactatacgcagttgtaacacagtggtaagcatttgtgtatctgaaaatggaaaagataaagtaaacatacggtataaaagataaaaaatggtacacctttgtagggcagctccattacagtcttatgggatcattatcatatgtggtccatccttgactgaaatgtcgttatgtggcacatgaccatatatagtcagattacagtattttgaaatcccccttagaatagttctctatggttgtgccaccagtttgatacacagtgaggttaatttgttacattttactttcagatttttcagggattaggttttgttttatgattatgtaaaatacttaaatggttaataagtgaaatttacgaagctgggtataatcagaaaaattgagcttctatcctagtgtcttccagctggttctctccctgtccctgtatgttagactcaacagagtcatcatgaattttcagagtgatgttttgtcgatacttccccttttagcagaagaagcatttaggttagttcatttactaaaactatttccttctagatttttcactaactaatatttttacactgtagaagaggaatgtggaaatttctgttctttcttttttggaaccagaatttcttggcttaatacaagcagtttgagataagaaactttctccagtaaaaattctctttttttttttcttttttttcttttttttgagatggagtctcgctctgtttcgcaggctggagtgcagtggcatgatctcagctcactgcaacctaggcgtcccaggttgaagcaattctcctgtctcagc

SEQ ID NO: 104531 - DNA, 1069 bp, Homo sapiens
ttggtcattgtcgatactagataatgaataaatggacttctttataccattttactttcatactttatttgaaacaaggtcttgctatgttgcccagctggccttgaactcctggcctcaagagattctcatgcctcagcctcccagagctttgggattacaggcatgaaccaccatgcccagcccataatagaaagttttaaattttaaaataaaagtattcatagacttggctatcatggatcctggtaaagtagactagtgaacataatcagatgtttcagtctttccctgttgatactgcttgccctctgagcccatttcctctcctgatcatcgcctgctatttccaatcaacagaaaaaatagagtagcctacatatataatgagtttatactaagagggaaattttaatattataaagaagtctatacagattctggagagcattcctgaagagaagattgaggaagcaaatggattaattaatgtaatagtgtgttcagtgtgcaataggtaacattttatgatatggttgaatttctgaaaaggtatcttataaatatcagaccatatttaaggagacttccacctctactgataaaatctgcccttctctctccccctgactttattgctgcccatctgtagttttgatcttttttctctaggattctttgcctagaattgccatgggccttctggatctggaacacggatgaaggaagaggatgaatgtttttcagatgttatcccttatgggagtaatttgtaaattctagcttcttcgggtggggggaggcggggtgtgtgtgtgtgtgtgtgtgtgtgtgtgtgtgtgtattatttatttatttttttaagttaattggcctcttccagcaaagagtatacagcagagacctagaagtttcattttttgtttgtttttgttttgttttgttttgtttttgagacggagtctggctctgtcacccaggctggagtgcaatggtgtgatctcttctcactgcaacctctgcctcccgggttcaagcaattttcctacctcagcctcccaagtagctg

SEQ ID NO: 104532 - DNA, 1007 bp, Homo sapiens
cacataggcaaacctgaacagtttgcaagttgcctacccttttctactttggataaaataaacctcttaaaatagcacttaacatagtaatatatgtatattaatagtagttacttcatgtttgttgaatgaatgaatgaaaaaagtagcaaatctacataatataaatcccaagacagccaggaattttatctggacctaattgtcttacatagcaccaattggtacttaataaaaacaaggctgggcatggcagtatgcgtctgtggtcccagctacttgggaggctaaggtgagaggatcgcttgagcccaggaggttgaggttgcggtgagctgtgattgcaccaaagcactccaacctgagtgacagaccctgtctcaaaaataaaaataaaaacaattagttataactcagatgttgctatctaaggtaagtagtaattactataataaacaagctatatattaacatcttaattttctttcctctgaactttactactgtaggtgtgtagtgaacttcatacaagttaatctttttgtagctctatttcttcatttctgtttgttcatcggttggagaaattttgcttaaattaatgaaagtaaaaatacagatattaatggctcataaatgtgcacaacccacttcatctatagtaagtaaaagtggctcccattttggggtttgaaaatgaagaagatctgaattcacagagaggaggcacgtgtagagatatgagaagttcttttcctactctactttggtacattggtctctaacacatgttctgagcctcagaacacagtagaacagaaccttcagaaagtgttgagagtataactctttaaagaggtttagtcagtctaaattatttgagggcatcatctttatttggtacttagaagtctaaaatcttcctgattgttgttaaggttacaaagagtctgtgtattgttggttagttgagcagtaaatacctttttatcattgttaaatgggtt

SEQ ID NO: 104533 - DNA, 3867 bp, Homo sapiens
agataataataataataattctgttatttatgatatgtagtcttatcctactgccactcccctcttctgctccacatactactaagtatgacttggtctctataatacgcactaattatgaagttttttacggagaaggaaattcttaatatagactaggattttttttcagttgtcttttaatggccttttattctagtaaacttagatttcttatagacatcggtttattgtgccgagctcagtagctcctagagggagtataaatttaggcaaaggaatcaaggaataaactggtattgtagaagagatgggagaaaaggaaatttttatttttgctttaaattactaaatcatgatgtttcctgtctctcagtgcttaccccaatcagtgtttctctcttttcttttttcctttcagtcccgaacccctaaaattctttgcttgcattaacttgcttcagattataagcctaattttactgttccaaatacatgaacttttcactgtatctccaagtgctcttttagagttcatctctttgttttccagtaactcatatttgtttcttcttatgcttaacacttctctctcatttttttttttcatgtttctcacattttttctttccacattatctgctgtagcaaacttgaaatatatgcttttggagaagagtaaaaacagtgtttagccatattcaggttattagcagcagctcctctttcttcacatatacttaaagggaccagaaagttatttaagctcttacttgctacaaatgctgttccatgtgctcctatgagtcagcacaacaggtattttttttttttttattgtacagatgagaaaactgagactttgagacattctatgaattgcctgagctagttggcagcagtgccaggattcatagaaatttggagcaggaagacaacacaatgaagattttactttgaggaatttagggttcatctatgtaaagtgatttttctgaggtcactaattatgttgtaggctagaactcaagtctcctaactcctaatatagtgccttttttttcttttctttttttatttttttaggagatgggtctcactatgttgcccaggctggtcttaaactcctgggctcaagcaatcctcctgcctcagcctcccaaagtgctaggattacaggtgcaagccaccgcacctggcctctaagagtgctttttcctagcatacttttcttctcctaaggtaaaaggctgtttgtcatggtacagctacggtgattttacttgagatatttgactttgagatggagatgaagataagtatataatgcagctgccacattcattctcatacaaggtaaagtcattcaaaagataaatcgaagaactatagatgtatttaagaagaaattcagcctatatgtaacaacaaaattttgaataatcaagttcagaaattggatttttaaaaacttattagctactttaacccttttgaaatattcccaaaaagtgttttctcttcctgagttaaatttattcatttattgacctattaaagatttttttagtgcttcagagctattctgtatatctgttcattttcgttatttagtagtatatagaagtaatagattgggctgaatagatttatttcaggatatatcttagatatttgtgttttttcatgaatcccagtttaagggttattgctttcaaaaggaagaaatttggttagtcatgacttttggctagttgaagtttagagaagtgctttatacaggatcttttatttagtgagaaaaaaataactttttataattttataatactgtgtgaaaaacctgataccaaaacttctgaaaaagaaaccaggcctaggagatgaggattctagggaagattattaaattgaggatatttttaagttagattctaaattagtaaatcgtggctaataagatgaaaataatctgatcctttagtaagatctgaagtaatattgttgccctgcaaaaaagtggttgttatcagcataccttatatgtcagcctaagcaagattagattttctcttttctctgatagatgccaatatttaacattgacttttatctactttcaaaaatatctatgaaatatactttctgtctctgaattagagtgtatgtatatttgtgtttacttgaaatgttatagctggatgatagatttcagagcagtttttatgcttagggaagccactgcctcccaaaaaggttttcttatgagaatgaggaaaataagtataaattttcatatttatgttattactattgatgtgcttggataattgtatttataaaagtaaaaaatgttcagtattttatctgaaatttaataatggatattgtacagcctaaggaattaaaagaaaaaggaccctttgagaaaatggcttgttcttatgtatcttaatatatactgtgttcactttatgttttgtcagacactgaaattgaggaagagagattttggcgttctgttggtttatggagagagttgatcagagattgctccttggctgagttgctgtctgcataggctgttaacaattgtttctctggcagcagatcttgttcatcaggattgcatcatttctgggagaatggccaaggtccacagcctcaatacaaagactgtctgaagcatatgaggcctgttctctttctgaagcggcactcctcttcctgccagtcctcttcacaggattactgaagcagacttgttctgaatttctttcgttggattggttgtttattggacttttgtctgccagctgcttccgcctcacctgtctgatgcaatttcttcttctgaaatctgttggaattgttcataaaacactttttgtttgtcttctctgtgagtgaccagggagatcatacaggtcttgtgctttcagcaagtcatatagagaagagactgtcagaatgatgatacagagactgttggccatttctgaaaccaattaaaaagatggggtaattaagaaacatttctggcatgttctatttaacatccttttccctagaaactgtatgtaaatggcacctcctaaagagagtactcggtactactggaagatacaggctgtgtctgtttctgaatccaagaacttactagtgttcctgtggattctgatggattgttctggaaatagttaaattaataataaattgaaactgtgatgcattcatttaccccctactgtacactcacatctatttcgctgttttcctcctttcctttttttctttcttatttgctattgcttcttccttgatttactttatttcttccttccttttactgttactttgatacttttatttctctaattctgggtgtactattttaaatcgtttctaaaaaatagtttattttccagttttttaaaattagaaatcataaaacatcaacataaatgaaatgcatgcgttctaatgcttggtaactggaatcctatgaatagctcttttcatgtttatgatatgttaatctttaaggtgttaataactctggctagcgttaaatttgacttttaggaaaaaacaccagagacttaaaggatactgatcattttcccttcctttttggaaggtagaaaattaatttaagcgccattttttaagcatgtttccatttgaccgcaaatagaactgactcctttttatcactcttttttatagtaggacaagaaactagatggtgtggaatgaagggaaagaaaggagtaataaatatggacttgtaatttaatgggtgatgatggccccttgtctggctggacagttgtcggacatcgggttaaagaaagaactctgaat

SEQ ID NO: 104534 - DNA, 1019 bp, Homo sapiens
cctgggttgactcagtcggtatcatgtacttttcattcctttagtttttttagtattaataattgttctaatgtcttattatgaatcagtgtatcagtcatgactctctttgtagtcttttttgcaaaagtccttgttaacatgggtctttgacattcacattgactttattcccccccaaataaaatgctttttgtttcatcctttcaatgttttttacactactgtaaaactactaatgtaaagtcacacaaagaacacttgtttccctctgcaccatacctccaaatctcttaatctatttttgcatttttttatacttcagtaatttctgagtctttctgttcccagctttcactggtttatggtcaccatgtcaagctatcctcaccgctttttcatacacagttgtttagtctttatcatgaaactgtactcttcgtgatttcgggggtttttttgttgtttttaaaaagtagtcaacttttttagagcagttttaggttcacaggaaaattcatcaggagatacagagatttcccatgcaccctctgcacccacgcatgcatagcctcctcctggtttatatttttgttcatatctagcagcgtattattaccccacaaataaagttgctaagatgattgcatcttctcccaaaattatagttaagatgatttaaaagaaggaagagagtgttcaatgacaaaagaaggcactaagaaacagctgtttccaatcaagtataaacaacaaattgatctcttttaatttggaagaaataacattattgactgcttgtgaaactgcatttatttgtggcctaggaaaaaaacttaaatgaagatcttgaatttttaaagagtttaggtaaactgggatatttttaataaccatcctttatcttaaaacttgtttgctatatcctaggctgccagaaaattttgtttgggcagttttagaatggggagaatgtgttggttagtgagataggcagactcttcctttcccttcaactg

SEQ ID NO: 104535 - DNA, 3528 bp, Homo sapiens
tcatctgtttttttataatattcgttgcctagaaagaggaccttcaaaatcagtggtaccaaacttttttttcagctaagagcagctttaggaattcagagtttgtccaaaggcccaatccctaaaattatactctcaattcttgaagaatgtaaatgccaaatgacaatgaaggtaggccttcattatacaactttatatatattattcacagttttaaaatttttagtcttttgtatcccttctcttttaagttgtccgagattccccctgctcacagattccccctcttgtccttttacctcccttgtacccaatcttccttgcttacagaaaggaagtggaagccccctacctttcaagacgaagtggcactacaccaggatgtgaaagtccagcgaaagagacccaaggggcctagggggcagcacacccccagaagccaagtctattccaggcagtaccagggattagggtctgggctggaaaaatcctggtgttttgaatatgttcaggtccagttcagactcttgatcccacagccacttcttgagtgaggtgggtgttgctctaattcccctgtttctcttgccattttcacagtccctggggattcttcccccttcagcaaagcaaagcaactgtaccagatttctgggttgaatgacatccctgattaataagtggttttcttccttaaaacagaatattattaaagagcatgtatatttcttcataaagccacctaatataacttacctgtttactgagttccttaaagaggaagacttaaagctaccctgagaaatagtatataatattctggggtagtctaaaatgaaaagcagtgtttgggcttattcccatataaaaaggagaaaggagggttgggggtggggaagggttgattttgtttcttctagagcttttttcttcttttgtttttgtttgttttgttttgtttgcatgcaaaaggtatttagttatgtcagtaactgagacttacttaaccattttacaactctttccccaaataaagtacttaaaactctccctgcattagtaggtagccagtttgtattgtgtttataggtttttataaagtcagctactaacctggtactatgtagattgtctaactgtatagatagatagcattaacatttgtgagaaatttcaacaaagaggttaaaccaatacgtttggaattgctggataaaagacccagagcagttaatcttacaattggtgttttccccaaagtatagacatgactgcccgtaaatactgctggggagtctaggactaattccagaaataaaaatacttctggtctacaaatgtgactgcgctgtctctgttaacaccaacatatcctaggatttcctgaaacattttcattcatgatctccagacagatttgtgatactgtggtcataactagctacatagttatgcatttctgcaaagggaaagaatgtcagtaactagctacataccattctgttaaattattaatgatatttattaatgtttcatcatgcctatttcgctgttctgggcactttaagattaaacctggtattaagtgcagcatactcaactagatgtagacttcacttcatagaattttaaatctgatggcaactatatgcaatacgcatttatttttgtgtgtgtttgtaggaaaatttgtagatgtaacaagcaaaacaaagatttttctgaatttccaactctaccataacagaatttcaggcattttccaagaaatggcatgatagcagctgggttgcatgttgtacttagaacactgttgatggagtatatctgttgtgagcctggtttctgtgtatgtgtccaattcagtgataggagaagaaagcctgtaattacatttgcataaagtggttggctgctaaagagatgtaattccattattccaaacttttaattcatattttaaaatataaaaactagtatatatatcaaggaatattttaggaaatcttgtagttacctgtaagtgtctaactgtgtattcaatcagtaaccaatatggaaattgcagagtttcttcatcagaagatatgagtttaaattttatatttggcatgcacagcaatatattaaatgctgtgcttaactagaaagtattgtgcagtgtgatggccttttaacctccacaatatacattttatttttattccctagacttgcacatgaagtgcatatgttcatatttacccgtttggagatgggtaagatacaaccagcatagctccatctccatggccatctttgatttcatgcaactttcctttttcctgtccccctcccaccaaaaaaaaatccattcctaataaacagctatcatgtttcactccatgtgttcagtggtacaaaacctatataaaatatgtacagctctttggaatacttgtttatctagtaatgtacctagtaaattaacaatgttgtataaatttattactttcttttaactgtccatcatagaaactaaattataccttcattttattaatgcttgtctgcctttggtttcatttaggaaaccccacctgtttcctaatactcagagatgattgcctctcagtgagccatgttcagatcatctttttctcaagaatactgacctgcattcttgatgtacccctcccccgttcccatcttgcagacacttttaagtaataaaatgcatgcacctcactaacagagaatactttcctctgtctaaagttcttcacttagaaatttcctttgctgttattaataagatcctttctcacagttttggagcatataactgggtgagttggatacatatctcagaattttctttgatccctcacttctcaattgacattgcaccacattgaactgcacacttattcctgctgtactatatattgtatatctttaagcaggaaaaaatgacttgttatttcaagcgaacaatatgcattatttgactccctgaaagacccattaatctctaagttagagttataccaatcatcggagtttctaatttgtgaatctgtgttctaattaatataaattacaaattactattctattctgcaaagccatacaaactttatatttttgaattacccttcagtattccctaaaacctaaccaggtaacaatcagagttgaagttctttcttcccataaacctgatttttatcctttgccatcaaagcctttttattgtaaaggcttatattaattttctaagtttgaatacatgtataattctacaataatacattgcgcttgaatagtttattttctactcacaaagggtacaaaaagatactaaaccaagcttctcactaagcctggttaataaaggtctcaaataattttctttaaaggactgaatgtcattctcatttctgtagtggaaagagcatagactttggagtcagacagactttgtttcaaatcttagctgtgtcagtgtgtaaccttggggaagtcatgtaatctcaccaccac

SEQ ID NO: 104536 - DNA, 1820 bp, Homo sapiens
tcatcaagatgagaggtatgataaatataagatgccattgtttttacctgtactttcttcagggtatcctgtcttggtagtgaatggaagagggcctggtccctggggcagtgcagaaggcactttgatcatctcactcactgcaaatgtcatgtgaggtttcatggaagtattaagagatccaattaagaagaatagttctgagtctaaaccagcccagagtggcttctctaggggaaactccccgctcagctggtacgtttgtgtttgtcattagggacaccttgtatctcaggtgcctgccttcagacatctgcctgtactggcttcatgttacacacaaatccacatttaataacactcctactgttatttataggcttagttatgttaataagattgtttcaccgagttctttctcttatcctagtggctagtggttgtggaaagaggaggggttagaatgggaaatgaagtgttagtttaagggaagattaggtgttatgctatcatgcattgcttttcgcctttgtgcagccctgaatctgtggaggctagtccagcagttaatgagaagagcgtgtattccactcataattatgggaccactcagaggcatgggtgtcgaggactgccttatgctgtgagtatgcatttgtttctctccagaacagtgatcttcctggagtgtaatccattcttatacattgtgactttcttgaaatgtttatatgcagcatgacgaagttgccccttttgcacttccctgactccagcggacgtctagccctgcatcattgttcttgtttttatgtcccagttgaccttggcattttgttttatcactttcctggttgaagccaaaaaacaaagggtactactttcttctttctttccatatgtaccatactttaggggagagaggggccagtgtttggacactgttgatttaaaaaatcttattttcaggatcataattacggagcccctcctcctccgacacctcctgcttctccccctgtccagacgatcatccctcgttctgacctgaatggcctgccgtcgcctgtagaggaacgctgtggagacagcccgaactctgaaggagaaactgtacctacctggtgtccttgtggtctttctcaggatggcttccttctcaactgtgacaagtgcaggtaagatcctgttccatctaaatttaagtctgggttgctgggattagggtttcttacaagtagggaaaagctcaaagtattctttcttgtgtttgttaatgtagatgattccttagtgctccttggctcgaattctctgcactaggtgagaattgctgacaacaaggaatgagagattgatgttaaagctattgaatttgatatgaaatttaatgtcctggaaacatttggtaggtgggagggagggggtagcatatgcagagacacttcgcccatgtgtgctatgatgtgatgcatgctgttggaaggactactttaagtttattttccctctttaggggaatgagcagggggaaggttattagacttcatcggcggaagcaggacaacatatcaggtgagcggaagatgggttaggtccacaatttgacataaaaatattctgtgatctgaatgttcattttaagaacccctcttggccaggcgcagtggcttacgcctgtaatctcaccacttagggaggccaaagcgggcggatcacctgaggtcgggagtttgagaccagcctgaccaacatggagaaaccccatctctactgaaaatccaaaatagccaggtgtggtggcgcatgcctgtaatccc

SEQ ID NO: 104537 - DNA, 1049 bp, Homo sapiens
tccccatcccaggtatgaaattccagccctacctggcacaatcccgtatgtgttgcagcctcaagtctaggcttccactatccttacagtatctccccacctctcaaccccaaagtacagtctgaaattcttgtcctggttacatgcctcatgtctttgggttgattgtttttccttgtttcaaaaaaaataaaaatcaggaaacatctcttgtatggtctaggtttcctcagtgtcatggtcactttcctgtattctcagctaaaatgtctacgggagaaacttcttctggtttgtgttctttcttccccatcacagcaactttgttgcttctaggtgacttgttcatcccttgttaaggggattggtctttgtttccttcttagtttcaaaactggtaaatctgcaactttaaagtttttttttatttactttttctcttagtatcagaggtgcatataggatttaagagatgcatgctcttccctgttaattacctagcttcacagtagaaagtattaaaattagtctcagagttcattggccttgagctacccctattcttggtaatagtttggggaattccattgtattttttacctagagaaagggggacagaatagaacactagtttgtgccttagttttagtctcagataggtataactgtcattcttggtaccaagttttgtttgttctacttgttttcctccttgggataggcatttcgagagggatcccggaagtccttgcggatgaaggtaaggggtaatcttcgctgatgctgtgttttacttcactgtgatcttgcattttggtcagcttctttcctgacattgatggtctgggaatcttggactctgcttttcattagtttgtagttgttgccattcagttttcatagagcttttctccaaagtagattttcttggccattttctgaaatattttccctttctgtaatcagccttcattgattggtttttcattcattgctttcctagggggtaagtgacatttttccaaacaaaatgaggctagtgtgttctg

SEQ ID NO: 104538 - DNA, 1515 bp, Homo sapiens
ttcaagtttatgagtattcatattcctaaatgatacaaaagcaggatctttcctattgagagttatagggcataaatattaaaatctttagtaaggccaggcgcagtagctcacgcctgtaatcctagcactttggaagaccaaggcaagtggatcacctgaggtcaggaattcaagaccagcctggccaacatggtgaaaccccatctctactaaaaataccaaaattagccaggcgtggtggcaggcacctgtagtcccagctgcttgggaggctgaggcaggagaatcgcttgaacccaggaggcagtggttgtagtgagccgagatcacgccactgcactccagcctgggcaacagagcaagactccatctcaaaaaaaaaaaaaaattcagtaaggataagctttttaggattgctttatgtgcagcaccagtgtgactggtgttagcaaagattacaggtagcactttacctaaagtttgaaggccccacttagtatctatctttaaacagacttgcacatacctgtgaaagagttgggagaggactcagagctacagagcatcagaggcctgggatgtgtcttggaagacaaatcaatcatgcctttgctggatccgtctcttgcaagtggccaagtttgctttagcttcccctttatttttgtctcatttgcttagagaggggccttttaaatagactttggaggcagataatagccctaatcctggctactaaatgcttttctcttatcaagcaactatcataacttatctccagaagctcgaaacctttcaaaagctataaactggctctaccagaaaactgcacataaaccccatattttgcttacagttttgggaggttgacagcctcacaggtgtgttaaaatttagaaaaaaaaattactagtcattttgattcttttaattctaaattgagttataaattttatgctcagaattactagtttaaaactcctccagtgatccaggtgggagccataagaattagaaaaaattatcatttggatttttaatcccagtgtcaagagcagcttccctactgaagacttaattgtaaatcagggtttctcagtcttgacactgttgacagtttggaccagataattctttgttgtggaagggactgttctgtgctttcaagatgtgaacaggatccctggtgtctacccactagatgccggtaacactcatacactcagttgagattatcaaaaatgtcttcagatattaccaaatgtcacctgggtgcaaaatttccctcaattgagaaccactactctaaacccaactgaggtagagtctctaatgccttgaaggatgggacagcagagtaaacacacagtgagattagcgaacaatggctaatactgtgacagaggcttccagaatacagtacacttatcaagtgtaagtttaacaattgccacttaaagctgggaatattgtttggacactgccagtccccctagtctgtaagctccatta

SEQ ID NO: 104539 - DNA, 2994 bp, Homo sapiens
atgaaaataataagtgatacaaaaacatgcattctcctggagaatagtcaaaaaaccagtttgggctaacacttaacacagatattcagtgagtatgaaaaatttaagcagtgataaatttgaggtctctactgttcatttgtatgaagattttcttatgaacttgatgtcagtcctttgattagaaaattgatttttatgactttaaaatggtcataaaatcacagtgatgggatgaaactatgatccagattaatttcttactttataaatggagaaactgagcttccccatttaaagaagttattcaaggtctcacctctcattggtaacaaaagcatgatagaaaccagatcctctgactcccagtccattactcttttatgccacatcaattgccaagtgataaattttctctggaaccccagcttgtcccacccccattcccaaccctctatttatgcatggactttactaacctccctgaatttgttttctacagaattctccctctgaagcacagaatttagatgagaatacaactgagggctgggaaaatcggataagactatggactgaccagtatgaagaagctttcactaatcagtacagtgcagatgtacagaacgcgcttgaacaacacctacattctagcaaggaatttgtgggcaaacctactattttagacactattaataagactgaattggcctgtaataacacagttattggttcccaaatgcaggtaagcaccaaagggttgaggactctctaagtagctgaaattttaagaacccaggaagagggtaatggattggaattactgttccttccaaatgtacaaggccatggaataacagattagccaggtgttgatcatatgtaaccaaaagtaggttatattaactggaaactacctggatacatatttttaaactacctttattaataaaaaaatagatgaattgaggctgtgtgcagtgcagtggctcactcctataatacaacactttggcaagaagccaaggtggaaggattgcttgaggccagcagttcaagaccagcctgtacaacatagtgagaccctctctttacaaaaaaaaaaaattaaaagccgttgtgatgatacacacctgtaagtcccagctactggggaggctgaggtggaaggatcacttgaatgaatttgaggttatagtaagctatgattgcaccactgcactccagcctgaatgaaagagtgagaccctggctctatttaaaaaacagagagagagatgacttagtatgggaaattctatataccctaggtaggaattatgtaatatttatagaaagttaagcatgttctttctcatctttattttagagatagagtcactgaagtcttaatcatgtattttttttttttttttaatattttcttgccgtttctggggaggcaatttcactagatgtagcatgtctcttagaaaaattgagctttcatcacattttaaaatttctcatcattgatctaaataacatgtacagataaaacctgaaaatattagcatgttttccttaattatgaagtaatttgagtgtctactaaggtgttcttgctgttgtttaatgttattgctctggttttattcagttacagctgggaagagtcactcgtgttcaaaagcaccggaagatcctgagggctgcaagagatttggctttggacactcttataatagagtatcgtgggaaagtcatgttacgacagcaatttgaggtcaatgggcatttcttcaaaaagtaagaacgtcattcattgagcagtgagggctaaggtggacctggttgaccagtgttgttgtaaaaatcattctgtttgataagacgctcttgggagaaaaaaatcacaactcagataagctcacacctgtctgctatttgtagagaagtgcaagtaaatcttcaaattgttcaatgtataaaatggtgacacctcctttccaagccaagcattccttgctttgtgcttgttctttaatcaaaagcagacaaacgtgatgctttcccaagtttaggcgttgcaaaagactgctgctgcttctctcagcatatgcttcatatttggagtcatggggtggccttcttatttgtgttgagaattacaggaattttaattgtatccctagaccatacccctttgtgctcttctactcaaaattcaatggtgtagagatgtgtgtggatgcccgtactttcggtaatgatgctcggttcatcagaagatcatgtacaccaaatgcagaggtaagatatctgtagcaacttccctttgactggaaccatcaaatgacaagcttactgaagaagcagtgtgaaaacttcactcagataaaggtctgtagataatagtcgtgatatttcatcgtgggaggtgaaaaacaaaagtaatggtgcttttatacgacaaaatgggcgcaaggaaagagttttctttagagaaggcagaaatagaaaagagcaagttagcatttgctaaggagaaaaagctagactggataagaaaatcaagtgtagttatattaaagagattgccatacggtggaagtagatgttgttaggcctaactaagctatttggttgcagtttttttagattttagtgagtaatgttttatgagaggatctagacatttctagaattcattactcagagcaaccacatcaaataaagcaagaaaatccacagagctttacttactggctaaggaattttaattctctggtggagctggaaacagctataagatgtgaaagcggctgggcgcagtggctcatgcctgtaatcccagcacttcggaaggctgaggtgggcagataacaaggtcaggagttcgagaccagcctggccaacatggtgaaaccccgtctctactaaaaaaaaatagaaaacttagccaggcattgtggcgtgtgcctgtattcccaggtactcaggaggctgagacag

SEQ ID NO: 104540 - DNA, 1641 bp, Homo sapiens
cttgagcccaggagttcaagaccagcctagacaacatggcaaaaccccgtctctgccgaaaataaaaaaattagctgggcgtgtagtcccagctactcaggaggctgaggtaggaggatcacttgagcccaggaaacagagattaccgagagctgtgatgcaccactgcactccagcctagatgacagagcgagattccgtctccaataaaaagaaaaacaaaagtatttataggactctctaatgtctctgtttaacttattcagagacaatatcagaggaagttactgtactgatattttaagagggtgaatggataatgtaactgaatttcaagggtactgagacaggcattttggttgtttctttggagcagtaattataaagtggactgtgcctgtcacaagggaaaccggaattgtcctatacaaaaaaggaatcctaatgctacagaactgccactcctaccacctcctccaagcctacccaccattggagcagagactagacgtagaaaagcacgacggaaagagctagagatggagcagcagaatgaggcttcagaggagaataatgaccagcaatcacaagaagttccagaaaaagtaactgtatccagtgatcatgaggtaatcgcccctggtcaaatgatgatgctatggcatcaatcctccaaaggaagaggaacccgggttgccgcatggtttaagtaggggagctatagtaacacttagtgccctttatatcaatgtgggtttattgtgttcatacatttctttctgttttacaaagtcaaaaacatcctttgctggttttgcaccagagaataggggttagttatcatctgtgtttaccatgtggcctcacatgagttaacagtttaaagcactagagattgttatagagagttttaagctaccagaataaaacagattgattttttctcagagcttgagtacagctgaatattgcctctatcttaaaggaagtagacaatccagaagaaaaaccagaagaagagaaagaagaggttatagatgaccaggagaacctagctcatagcaggagggtgagtactgtctgacattactttgctccttctcattcctgctacctccatcatgtgaacctcttctgttctcttgactttgtatcatctcattgatttgacctgaaggttataatttgggctttttccgtaataaagattttattataatttttttatttatttttctctatacacacagtagttttgtagtgattattatctagtgatggtttgaagaggttgtttttttttttttttttttttttactaacaatctggtttccgctgggcgcggtggctcacgcctgtaatcccagcactttgggagggcgaggtgggcggatcacgaggtcaggagatcgagaccatcctcgctaacacggtgaaaccttgtctctactaaaaatacaaaaaattagccgggcgcggtggcgggtgcctgtagtcccagctactcgggaggctaaggcaggagaatggcatgaacctgggaggcagagcttgcagtgagtggagatagcgccactgcactccggcctgggcaaaagagcgagactccatctcaaaaaaaaaaaaaaaaaaaaaatctg

SEQ ID NO: 104541 - DNA, 2748 bp, Homo sapiens
ggttcaagcaattccccttccttagcctcccaagtagctggcattacaagcatgcgccaccatgcctgggtaattttttgtattttagtagagacggagtttcaccatgttggccacgacggtctcaatctcccgacctcatgatcttcccacctcagcctcccaaagtactgggattacaggcgtgagccactgcacccatcctgtttttctttcatattaaagtttcaaaataactgaccctttttgaaaagtttatgtttgaccttgcctttatttacaactattccccacatttaaaatgaaatattttatttttaatcttctgttttccaagttatatgtgtcatcttactggtagttaaatgaatttctgtaaatttccattaaaaatacttttataaaagctatccactcgtcctcatttgaagcttccttctacaccagtactatctctttctagaccagggaagatagaaaggtagaagccatcatgcatgcttttgaaaacttagagaaaagaaagaagcggcgggatcagcccttggaacagagcaactctgatgtagagattactacaaccacctcagagactcctgttggtgaagagacaaaaactgaagcccctgaatctgaagttagcaactctgtttcaaatgttaccatcccaagcaccccacagagtgttggtgtgaatacccggaggtcttcccaagcaggggtaagagttgaaaagacttcagcacttagacatcctcacctttgctaatgtcaatacctaacttttggaatttttaaaatcagtgttttcagctttgctccatatcacaataaataaggccattaactgtttaactggaaccatttcattggcctattttataaatgcttattagaaataacgcaaacatttgtcgctagcctctttagctcatttaagtgtatacatttttgtatttaaaaattagattttaaattagtgtttctaatccttatatttttcatcagtagacattctgaatgcttaaagtgaataggaaattagactgtttgctgataaaacatttctggtaagcatctgaccctactattgctacaggatattgctgcagaaaaactagtccccaagccacctccagcaaagccttctaggccccggccgaagagtcgaatttctcggtacaggaccagttcagcccaaagactaaagcgtcagaagcaggccaatgcacagcaggcagaattgtcacaagctgccttggaagagggaggaagtaacagtttagtaactcctactgaagctggaagtctagacagttcaggagaaaacaggccattaacagggtctgacccaactgtggtgtcaattactggatcccatgtcaaccgtgctgcatctaaataccccaaaaccaaaaaggtaagtcacaaatgcatcctttataagtccagtctggcaagggctgtcttagtgaaatgagaggacctataatccctagaagaaactaatctcaatattactagattgaaagttctaaaatgctttgacacaaaaggctggagtcatcctgctacctgtttccttatttttagtcagcttaaatcactgatagctgaaattattcctctcttagtgggcgtggagagggtgaaggaagatatccttgtgttctagttgctcaattcattcttactgcagctgctgcatctcctcctgtcctagtttctagatgacgtttgtctttatgaactacactgctacctcttgatttataaactaatgatctcttttttaccttagtatctagttacagaatggttgaatgacaaagcagagaagcaagagtgccctgttgagtgccctttacgtatcacaacggatccaactgtactggcaacgaccctaaacatgttaccaggtcttatccattccccgttaatttgcaccacccccaaacactacattcgctttggctcaccctttatccctgagagacgtcgaaggccccttctgcctgatggcacattcagctcctgtaagaaggtatgtctgtgtttttgtgtgtgtgttgtgtttatgtgtgtgtgctttatttttttaagcctaagattcctatcatcatgacataaataaaatgttctctagatagccactctgcccatgtgagtttataatgagttagttgttcagccataaatactgattcatcaagagtctgtgagactgtggtggaatgaatgtactgcatttttagtgctcagatttgtgactggtcactgatgtctcttctgagaacccttgaggttcctgagtgagagcacacagcagtggatgactgggtagagacggatatgttttgtgtgtgctcttgtgatatgggttaacatgtccatttatgattattgtgtgagattaggccctgggtcctctagaacactgttgcataaatgaaaaaaattaaattgttttgaatcaattcaaccgttattatccactatcatcacttgaaggaaattagaggaaaaatcctattgtaattggcataattcctgttccttgatcaaatgacaagtcggactgtttattccaagagaatacagaatctaccctaaaagactctctttccctctctgtttctgcctctttctcctctttccagttacttactgtttttggatctagtggcagtagcgtttggtggtgtttttggaatgctctttcttaattcccagaagccctgcatattt

SEQ ID NO: 104542 - DNA, 1055 bp, Homo sapiens
acctaagaacattttcattattcaacaaaattgtaataaaattctgaaaatccctcagagtataagttaatcagatagataagaaaaccctccatgggattatttagaacaatgtatatttctaataggctcactgtttcatatctcactaaagaggtaagggcctggccttgtaagttaaaaacttaccagtataggacaaattaaagttgtatctgtatagttgtactcagattcttatgctatttatttttatttttatcattattattctgcaacttctgaaaagaagaggagttcaggtatttgacagaacattttatgatatccctagagtttctaaattgaatcatagtttttaagaagcattttgcattttttagttcctcagttggtattttaaaaacatttataagtggccaacaaggctctcagtagtgtttcaccttgttctctctaaactcctcttctaaacacaatgtgtatagggcatttggtctccagacttcttagaaaaaccagtctgactgataatgaaacagtgtgctttgcattgataattaatatttcattttatacactggagcattatctgtaaatctccaaacatagcattgaaatttagttgaaccgggactcggtgaaaatctgctcagtgttcagtactgtactataagctttcttcacatacattatctcacttaccatgcatgaaattgggatcattgtcctaaatttatatatccagaagctttgtctcagaaatgtttggtaacttgtccaaagtgaagcagctaataagtgacacagccagatttcttctggtgggggatagtaggggttcacagggtctcactgttgtccaggctggagtgcagtggcatcatcacaggctcactgcagccttgacctcctgggctcaaatggtcctcctacctcaacctctcgtgtagctgggaccacaggcacaccaccacgcctggctaatattcatattttttgtagcgacagggttttgctgtgtttcctaggctgatctcaaactcctgagtgca

SEQ ID NO: 104543 - DNA, 1095 bp, Homo sapiens
ctcctttgcaatatattttaatagaggttcagagaagggagaaatgttcttttgattttaacaacttgctgagtaggtgcatctaaaattaacttattatccatgaggttaattgtatcttgttagatacaaacaaatgtccatgttccttttttatatgagtcctgaaatattgtaaaattatacaacagaacctggaggagtaggtttgattgtatttgctgtgtttcacctcatagctaaccatggtagcatctttcttctagaatactcctgttctgattttatgttccctttttgtagtcatcagatccagaatgtaaattattttacaagtacatctactagaccctggaaatattaaaaaattactcagataggaaagcttagtgaccccaaatgagtgttttctgctttgaaaagaaaaacttaaaggtggccataacaaaagatttttcactcctgagcctaatttttccatttataaaatgagtgctttggacaagatgacttctaagttctcttctaagctttaaggctatatgtatggttctgacaattcatctttacatcattattctgtatctaagatagttcattcttcggattttttattttgtttttgtgtttgcttttcagagacctggttgtatcctaaaatgtttacgtgattcaaattaccattgagagctcttttttatatccttgttcactcttccttccaagtgtttacaggtttacagtttcagttttgctttcatttggccagccacaatgacatttgtatgatgtaagatttttttttttttttttttttttttggtaaaatttttgtggattgtttcctaggtttctaagagggaaaatctatgagaattgctctctggtgaagagagtatttacttacctgtaatacatgttctctaaaggtataaattataataattcacctttgctcttcctattgggggagggtcttactcagaaattgatgtttatcaaaattcgatctgtcttatgtcagggcaggagagccacagagtggtgagcaacctacaactgtatatcttaagagaacacaattacaggtaagaa

SEQ ID NO: 104544 - DNA, 1388 bp, Homo sapiens
atgttaagatttcttcctcagtcttgccattttacaccatcccaaatggtatgaaaagttgaatagcagtcattttttattggtttttgtcttttgatgggatctcattatatgtaatccagatttcctcaagtttttcagttaaaaggaattgataggacaatgttccaatatgctgagacacaagacaataaaatgcttgactgtgtaactgaattagtgtgttgaattgtatcactcaccagttgatgtacatttaaaacaggtgcactaaatagttttagataattattgataattctctggttcttttcaattatagcgctggataaaacaagccttagaagaagggatgactcaaacatcatctgtaccccaagagactagaactcagcacctataccaaagcaatgagaatagtagctcttctagtatctgcaaagacaatgcaggtacgtatctaaaacctttctgattatatgaccaatgattgtttcaggtctgcataaaaaatttaagtatgagtatttctgatacaaaaagaaatggcgtgttttctaaatagttactttacatctgtctttacagaggaagagagagatctcaagtcagggatcagttttcccaggacgacaaagaaggactagacagtgtacagataacagcagaaatggttataaaaaaggttagatacatttaaagtagtaagtttaggaaatttatattcatatttataagatggggcaagggcaagaaagtggtggaacactaatattcaggaaagaattaaaattctgagtgattaagttgggtgggacatggttgagggagcaggggatgaatgaaataagtgaaaaattattatcaattgattgttttcaaaggggcttgtataattagcatacaatttttaaaagaacagccgggcgctgtggctcgcacctgtaatcccagcactttgggaagccaaggtgggtggatcacctgaggtcaggagttcgagaccaacgtggccaacatggtgaaaccctgtctctaccaaaaatgcaaaaattagctgggtgtggtggcaggtgcctgtaatccctccctaaacaggaggctgaggcagtggagaatcacttgaacccgggaggtggaggttacagtgagccaagatcacgccactgcactccagcctgggcgacaagaatgaaactccgtctcaaaaaaaaaaaaaaaaaaaaaaaaaaaacaaattttttaagacagctttaaatctaaagtctttgtgcatttttaaactagatgtcaatgaaaaatcatctgttccattggttttgacagtgacttgcaaaggatgtaattgaaagcacttgtgatatcttaatgtattttgtgacaatctt

SEQ ID NO: 104545 - DNA, 1416 bp, Homo sapiens
tgaaaaacttagaattaataataagagtttaggccaggcgtggtggctcacgcctgtaatcccagcactttgggaggccgagatgggtggatcacaaggtcaggagatcgagaccatccttgctaacacagtgaaaccccatctctactaaaaatacaaaaaattagctgtgcgtggtggtgggcacttgtagtcccgctactcggggggctgaggcaggaaaatagcatgaacccaggaggcggaggttgcagtgagctgagatcgcgccactgcactcctgcctgggcaatagagtgagactctgtctcaaaaaatatatatatatactaataataataataagagtttattaatatcactggatagaaggataaatatataaaaagtgtaaatatattttaaaaaatcatttatataccaagaaagtaaatgaataccaattttttttgttcccaaacttaacaaaactaagaaactgcctaggaataaccttagttgggtatatggagtaaactgttactgagaaatatttttaaagtctgaggaaatggaaatttctttttctttttttttttttcatgaatcatacgtgagcctttgataaatttcatgttcattatggaaagaatatatatatgtgtatatatatatttctttctctttctctctgtctttatatagttcccatgaaactgccttgtttttggaatttgattaaatgattctgaagtctacctttaaaaaaataagaaaaaaattgaaaaaataataatgaagtactttctcttgaggtgtaagacgagcttctagtatgaagctaatagttaaatttagtataatattgatgcaagaatggatgtatatatggaacaaaatagtcagaataggcctaaatataaatgtaaaagttggtaaattgtcatggaatttttagttaggagattgaaaaagaattagaatctagctggacacggtggcacgtgcctgtaactctcaactacttgggaggctgaggtaggaggatcactcaagcccaggagtcaagttcaacctgcgcaacacagcaagaccttgtcttcaaaagaactactaggtcctttgccaaagaaaattctaggcacattcaaatatatatatttttttaattcaaacttgggcctggcatggtgactctcacctgcaatttccagctctttgggatgccaaggcagaaggatcacttgaggccaggaatttgagaccagcctgggcagcagagagagacccacatctctacaaaaaataaaaattagccaggcatgatggtgggttgcctgtagccttaaggaggctgaagtaggaggatgacttgagcccaagaatttgaggctgcagtgagctgtgataatgccactgcgttccagcctgaatgac

SEQ ID NO: 104546 - DNA, 1029 bp, Homo sapiens
acaacaaaaaaaaaaaccgggcatagtggcaggcgcctgtaatcccagctactcgccactgcactccagcctgggcgacagcgagactccatcaaaaaaaaaaaaaaaaaagaatattaaaagaagaatatacgatgactaaggttccttctaggaatgtaaggatgagttaatatttgaaaatttaataatcgtcatttgttagcaggtcaaatgggggaggagaagtcataacacagtgacttttatcaatttaatgataaaataacatactatgatcttttaatatctagctgaaaaattgccagttgtcatgcatcatgaaaactagttaaacatcaaaataggctatcaaattatcccactattaccattattatttaatatagtctaagtaattgttagccaaagtaattacaccaaccccctcccccccacaaaaaaaatcaacataagagatataagtactggtaaagagggttaatgtgttatcatgtacaaatactattatctacctagagagttaattgaaaaactggtagagattaatagggtaactggataaaaaataagtatgtaaactttttaaatgttaataacatttagataacaaagggagagatacgttttattcatagtagtaaaaaaaaaaaactaaagaactctggagagtaaacttaattagacatgtggtatatatagatgaagagggacataatatgtgaataacaaagattatgccatgttcctgggtaagaatgcttctcaaattactcctgaatttcatctaacaccaatcaaaatcctaacttttttttttttttttaatagtatgagcatggtcattgaatgacttctatagttcattgctagaatagctaaaatattttggagaactagaacagaataactggaatttccctaacaattttaataaaaagtatgctggtgttgattcagtattggacaataagtggaaagaataacattcggaaataaacattcagaagataagcccagtatatgtaa

SEQ ID NO: 104547 - DNA, 1737 bp, Homo sapiens
aattttattgacaaggggtcaacattcttactatttaaagagcccttacagatgaagaaaaagaccccaacacctcagtagaatgcaggctgaagaacatgagccagcagttctcacaggactaaatataaactacacatatatagatattcttttgatttaataatcctacatgtagccatttgttctaatagcaaaaaatgaaaaaaaagttggttaaattttgataatactaatgttgtgcagtcattaaacctgaactgtagatttctattcattgtcataaaatgttgaccatgtatttctgagtgaaaatagttactgagtagtttaggtaaggcaagagtcagtgaagcaatgtctcgataaaaatttaccaggatattagcatgcgtttatttgtggatatgattttcaggttgtgtatgtgctgtataaccttggtaattttttgagtaaaggtgaaaaataataataataaaagatggatagatttgaccacataaaatttggaaactatatatgcaggaaaaagagaaaaagtaggcaaatgacttggctttctttggcctgtaaacttcttaagggcagacatcaggtctcttgttgaatacagtatcataataagtactcagtaaatatatgttgaatgaatgccttgtacattgatttgcacgtggcagatttcacctgtatcttataactcctttctacaactaacttcatcacttaacataattgactttgatagttatagtgttggacctagcagtacagagatctgtaagattccattgtttaagacccttgaaatattaaatatataaaagttattccgaatataagccatgaattacatgtttgtttctgttttatacctaggcactttttaaaaggaggaaagaaaatttagtatctggaacaaaaggaagatgtgaatatacttccaatctaggaatattaaaaatcctgagatatcagaaaggaaaaatatgcatcttcaataattttttgcatttattcttccctcttcatctaaacatctcctaccctagtttagtgcctcataattctttgctaactactgtgttaactccagatggtttcccagttactagtctcatactgaccattgcttccagataatcttcctggcccaaaaattttccttgaaggcctggaataaatgtcactccttccatccaccaagccttggggatatactttaacctattgattaagaatatagatagatggagccaggcgcggtggctcacgcctgtaatcccagcactttgggaggccgaggcgggtggatcacgaggtcaagagatcaagaccatcctggccaacatggtgaaaccccgtctctactaaaaatacaaaaaattagccgggtgtggtagcgagcacctgtagtcccagctactcgggaggctgaggcaggagaatggtgtgaacctgggaggcggaccttgcagtgagccgagatcgtgccgctgcactccagcctaggtgacagagcaagagtccgtctcaaaaaaaaaaaaaaagaaaaaaagaatatagatagatggggccaggcgtggtggctcatggctgtaatcccaacactttgggaggctcaggtgggtggatcacttgaggtcaggaattcaaggccaacatggtgaaaccctgtctctactaaaaatacaaaaattaagaatgtagatatatgggagcaagaatacctgt
